United States Patent 7,745,391 (HUMAN THROMBOSPONDIN POLYPEPTIDE) - sequence listing, part 37

SEQ ID NO: 85121 - DNA, 962 bp, Homo sapiens
ctcggcgggagtgattattttctcaggtgtttgcaacagtgttctaactattaacgctacgatgcctgaacctaccaagtctgctcctgccccaaagaagggctccaagaaggcggtgactaaggctcagaagaaggacgggaagaagcgcaagcgcagccgcaaggagagctattcagtgtatgtgtacaaggtgctgaagcaggtccatcccgacaccggcatctcttccaaggcaatggggatcatgaattccttcgtcaacgacatcttcgagcgcatcgcaggcgaggcttcccgcctggcgcattacaacaagcgctcgaccatcacctccagggagatccagacggccgtgcgcctgctgcttccgggggagctggccaagcacgccgtgtcggagggcaccaaggccgtcaccaagtacaccagttccaagtaactttgccaaatttccaagttgatcgtgatgttgatccgggactcggtgtggtgacggcccgccctgagcacgaaagtgcacgctcttgacaacttccttatgtttggagctttctccaccaccacccccgcccattttcttgtaaaatttttaccatgcagatatgtaataactgcaagtaaaggctgaagacaatgtgagctgaacacggaactattacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacttaggggggggccccgaccccaaatcccccttatgggggggcattttaaaattaatggccctttttttaaaaacgctgggatgggaaaaccctgggggttccccattttaaacccttggaaaaaaattccctttttccccattggggttatttccaaagggcccctaacgttttgccttt

SEQ ID NO: 85122 - DNA, 408 bp, Homo sapiens
aatggcacctaataactaaacccttcttatttcttcaatcaggggagagacatgaagacagaggagaaatgaatgcataaaataactgataatatgaatctatacatagaacttaggaagtctcatctgcctgaaaatgactgtgtggatcccacccaaatccaactcatcctggtttgctgcacactggttcatcaaaagaaggttaccgaggggaaggaactaaaggtgtttgcacttcatgttactttttgagtttataaacataaaaacagaatttacttctgttacagacctagttactgggaattcattacttgccatggactacctttgctaagaaaagtctgaatgagaagatggcaggacgtctgaaaaaaaaagttataattaataaaatctgcggag

SEQ ID NO: 85123 - DNA, 1025 bp, Homo sapiens
ctcggcgggagtgattattttctcaggtgtttgcaacagtgttctaactattaacgctacgatgcctgaacctaccaagtctgctcctgccccaaagaagggctccaagaaggcggtgactaaggctcagaagaaggacgggaagaagcgcaagcgcagccgcaaggagagctattcagtgtatgtgtacaaggtgctgaagcaggtccatcccgacaccggcatctcttccaaggcaatggggatcatgaattccttcgtcaacgacatcttcgagcgcatcgcaggcgaggcttcccgcctggcgcattacaacaagcgctcgaccatcacctccagggagatccagacggccgtgcgcctgctgcttccgggggagctggccaagcacgccgtgtcggagggcaccaaggccgtcaccaagtacaccagttccaagtaactttgccaagtaagcatctttacacctaatcccaaaggctcttttaagagccacgcatgttttcaataaatgagttgtaatcattcattcaaaaggggggttattggacttagcaccacagtaccaatctttaatgttacgttagtactgcagaggaaataacttggaagttacagggaataacaataggtactagaaattgagtgctatgggtacgtattagatcgttagctcatttagtatcacataacactagcataaactgaaagtattgtaaatgtacagctctttggtttccgtgtgcagatttccaagttgatcgtgatgttgatccgggactcggtgtggtgacggcccgccctgagcacgaaagtgcacgctcttgacaacttccttatgtttggagctttctccaccaccacccccgcccattttcttgtaaaatttttaccatgcagatatgtaataactgcaagtaaaggctgaagacaatgtgagctgaacacggaactattacaaaggtttctgatttgttttgtaattgggccagtttctgtctgaagctcttaagcgagtggggcag

SEQ ID NO: 85124 - DNA, 526 bp, Homo sapiens
ctcggcgggagtgattattttctcaggtgtttgcaacagtgttctaactattaacgctacgatgcctgaacctaccaagtctgctcctgccccaaagaagggctccaagaaggcggtgactaaggctcagaagaaggacgggaagaagcgcaagcgcagccgcaaggagagctattcagtgtatgtgtacaaggtgctgaagcaggtccatcccgacaccggcatctcttccaaggcaatggggatcatgaattccttcgtcaacgacatcttcgagcgcatcgcaggcgaggcttcccgcctggcgcattacaacaagcgctcgaccatcacctccagggagatccagacggccgtgcgcctgctgcttccgggggagctggccaagcacgccgtgtcggagggcaccaaggccgtcaccaagtacaccagttccaagtaactttgccaagtaagcatctttacacctaatcccaaaggctcttttaagagccacgcatgttttcaataaatgagttgtaatcat

SEQ ID NO: 85125 - DNA, 541 bp, Homo sapiens
tagcattctgagggcacccaaactcaatgacacccctggccagggcaggacaatccattccttggaggtggcccttaacaacctgggattggagctggggcgtgagtgctccagtctcctgtcctataggtaagcatttctaggtgactttctatatgcttctcaaaaaagtcttagcaccgatccctctgacctcaaagacataccctccttttcttccttctttcttactttctggggcgctactcaaataaaccacctgcacctatgcatctatggtttcaggcgttgcaactgacaggtaccatttacccttgagtcattacatctcaggaaaaacaatggactgaaaagagcactttgggaagaagcagaatcaaaaagtccagatagtccaactgagacggaaagggagaattccagagggagaagatagagagagggcatattgatagcttgaagagacagcaaggaagagtcaaggacacggggtcctcctgggagctgactcatgtgtgcagggggaaggagatggaaccag

SEQ ID NO: 85126 - DNA, 389 bp, Homo sapiens
cagctgctgaggaggctgaggtagctggatctcttgagtccaggaagtcaaggctgcagtgagacttgcattctgcattctagcctgggtgacagagcaagaccctatctcaaaaaagaaaaaaaatggtccagtgtacctggtctcagaaatacctgcatatgtgccaaatgtaggttgtgaaaagcatgaaatgcatgaaggatgtgaaagaatttcttgtggggttattttagacactcctcctaatggttcttatctcagacatgtaagcaagaacccttctttgtgccttcccagctccaagtttctttgggtctgacaagagtgctttcatcctgttaggaccagctgcctgaccctccacagggtacccagagcctggacag

SEQ ID NO: 85127 - DNA, 283 bp, Homo sapiens
attgttcggaaggcatgattgtgttttgaaatgtgaggacatgagatttgggagggcccagggacagaatgatatggtttgactgtatccccacccaaatttcatcttgaattatagttcctataatccccacatgttatggagggacctagtgggagataagtgaatcatgggtacagtttccctgtgctgttctcatgattgtttctcacaagagctgatggttttataattgtctggcatttcccctgctggcactcattctctctcctgccacttcatg

SEQ ID NO: 85128 - DNA, 221 bp, Homo sapiens
ttgtcaaataaaaagagaaaatacatcaaatttctagtttcaacagaattcatctgaagaggcaaacaaggctgggtgtggtagctcaagtctataatctcaggcttttgggaggccaaggtgggaggagtgattgagcagaggagtttgagaccagcctgggcaacatagtgagagcgtgtgcctccaaaacaaattttaaaattagccaggcatggtgt

SEQ ID NO: 85129 - DNA, 399 bp, Homo sapiens
cagcctcagatagtatgtttatagcagtgtgagaatggactaatgcagatgcctattaatgccttgcttctcaaagtgtgatctatgactggcagcattgtcatgacatgggaatttattagaaatgcagaatctttgccctcatccagaactactgaatctgaatctatattttagctaacttccctaaggtattcctaggctcattaaagtttgagaactgaacaaacttataaaatgcttcagtagatcagcagttgcttttaatataggaggcaatctttataagggtttctaggatatgatccttagtgtgcagctgggtctgtaggaagatttatatctacaaattcctgagttgtacatcacattgctagggaaaaagtagagcttttattg

SEQ ID NO: 85130 - DNA, 255 bp, Homo sapiens
gagtgaaataagccaggcacttaagacaaatatatgatttcacgatatgaacaacctacaataggtagattcagagggacagaaagtagaaaagtagttactggggggccgggggaggggaaggagacgttgttacttaacaggtcagagtttcagttttgcaagatgaagagagttctggagacggatggtggtgatggctgcacaacagcgtgaatggacatgcagctgaactgtacacttaaaaatagttaa

SEQ ID NO: 85131 - DNA, 369 bp, Homo sapiens
taggtacatcataacatagaatctaatcccctattgataaaccgattcaactgttttttgttttgttctgtttttgagatggaagctcgctctgttgcccaggcggctgggtgcggtggctcacacctgtaatcccagcactttgggaggccaaggcaggcggatcatgaggtcaggagattgagcccatcctggccaacaccccatctctactaaaaataaaaaaaattagctggatgtggtggtgcgcacctgcaatcccagctactcgggagactgaggcaggagaatggcttgaacctgggaggcagagattgcagtgagccaagatcacaccattgcaccctagcctggtgacggggcgagact

SEQ ID NO: 85132 - DNA, 176 bp, Homo sapiens
taggtacatcataacatagaatctaatcccctattgataaaccgattcaactgttttttgttttgttctgtttttgagatggaagctcgctctgttgcccaggctggagtgcagtggcacaatctcagctcactgcaacctctgcctcctgggttcaagcaattctcctgcctcag

SEQ ID NO: 85133 - DNA, 218 bp, Homo sapiens
gatccccggccaagcccagtcacgagaatttcaggctcttctctccggctccagcctgtgcctgtgattgtccaggtgtggcctaggccgccaccttctgctgccccggagtcccctccctgggtgggatgctcactacagctctgatgtatatagcacacagccccctccgcccctccggtctgtcgccaataaagtgcactgtgtttcactccggg

SEQ ID NO: 85134 - DNA, 671 bp, Homo sapiens
cttaaagaaatggggcgttgctctgttgcccagactggagtgcagtggtggtgtagtcatactcactgcagcctcaaactcctgggctcaagcaatctttccatgtcagtttcccaagtagctgggactataggtacatgtcactgagcccagctaattggtttttttttttttttatagagatgggggtctcactgtgttgcccaggctggtctcaaactcctcgtctcaagtaacccgcctgcattggcctcccaaagtgctgggattacagacatgcgccaccatgcctgacccagtatcgtggttagttctgagtcttgggataaagtgctagcattctgggcacaggttgccattgctctgggcctatctagggactatttcattaattaaccaaagagagctcttctaccctcaaattgtttaacaaggcaactgagactaaataatctgtatttgcaagtaatataggttgtagtttagttatgatccagccaagaagtgtattctttcaacagtacttgtatcccctttaagttaagttctatgagttttctgtacactaatcggacctaagaaattcccctttctcatgtcagtctgcctttgactttgggtgcatctctgaaggttttatgtagaaatgattctttttagggagtctgctc

SEQ ID NO: 85135 - DNA, 371 bp, Homo sapiens
taaccactcaatgacagcagagctatctatcagttcctctgaacttgttctgaatgagcttttcttactgttcagtcttcactctcctattactgttttgcttcctcatagaattccagattagtgggcccctggaagttcagctggtagatgagaaaactgagcccattgaagttaaagtcacccagctagtcagggttgatcttcccaactcagagtcccctgcttacttaaacttttatatccaacaggtttacttcccctggaaacttatttggtattttttattttccatctccatgccctcgataggtttctttatgtctgtctggaagtgtaatgaaaaataacactagttattgaatagctac

SEQ ID NO: 85136 - DNA, 718 bp, Homo sapiens
tgagatggagtttcgatttgtcacccaggctggagtgcagtggcgcaatctctgctcacttgcaacctctgcctcccaggctagagtgatcctcccacttcagcctcccaagtagctatgaccacaaggcatgcaccactatgcctggctaatttttgtatcttttgtagagacagggtttcaccctgttgcccagactggtcttgaactcttgagtgcaaaggatctgcccacctcggcctcccagagtgctgggattacaggtgtgagccaccatgcttggccatctcagccatcttctttgcataagacattggtgccctttgcagacctgggtggtgagagggagtccatccttgttgagcttgaatctcacttgctgtcaagtgatgccctttgctggtgagatgtggtggtaccgggttcagatggaatacgtggactgggctctgccatacgcttccttatgccctccagattgatgccctgggccagtgaggaatcctctgagaacctgtttccagtaaaattgggacagtcatagttgccacctaatgggtttgttgtgaggaagtgaagttacctccataaagcatttgatgggggtgcgatgactcatgcctgtaatcccagcactttggggaagccaaggcaggaggatcactggagcccaggagttcaagaccaacctggccaacataggagactgtgtctacaa

SEQ ID NO: 85137 - DNA, 436 bp, Homo sapiens
ttttttttgagacggggtctcgctcttgttgcccaggctggagtgcagtggcatgatctcagctcactgcaaccttcgcctcccaggctcaagcgattctcctgccccagcctcctgagtagctgggaccacaggtgcacaccaccacacccagccaatttttgtatttttagtagagatggggtttcaccatgttggccaggctggtcttgaactcctgacctcaggtgatccacccaccttggcctcccaaagtgctggaattacaggcgtgagccaccgcgcccggccaacatctatctttttaaaccaacagaatgcctgctaatttaagaaacagaagttctggaattgagaataatctgacttaatttatactctgtgaaatcaatgaaaaatccaagaataaaaagtacatcttcttttttctaaaaac

SEQ ID NO: 85138 - DNA, 176 bp, Homo sapiens
tctaatacatactagacactggagcatggcgcaggattgggaaatttaccaaaagagctatctgagccacccccgtagccatcacaaagagcacgtcctaaagaacgtgctgtacacttaatctcgccccctgcctttcatttaaacttaagataaaaacgctggtgtctaaaacg

SEQ ID NO: 85139 - DNA, 585 bp, Homo sapiens
ccagtgtgtttagagcagagtgaactgatggagcatggtccattgtagaccagggagataggcaggggcaggggctagattgcataagaccttgtgaaccattgtaaggagtttgcaaaagcactaaacatgtttgcttcatactgtggctttgatttaatatttaatcattagctgtatcttagaatttctccacagcctaaaactgaaaacagtaggtgacaaagaaccccacactttaaaaaacaggctggacctgataggataccatcaggaaacagatatgtattcctcccatcccttctttcaaacctgttctgtcagatctgcatctctgaattgtatctcagggatctatcacagcttttgagtcttattttcagttattaaaaagttcagtctgatcttaatcaaaactcccatctcccattattcagttcagtgctcctacgcttccttcagctcagcactgcccttgtcttggaaattgcaacagggaagagctagctgtgtggtctttgtctcagctccctggcttttcctcctcctgtacagactgttggttcctcagggtctgggcagggg

SEQ ID NO: 85140 - DNA, 507 bp, Homo sapiens
tctacatgtgatattgtttggctctgtgtccccacccaaatctcatctcgaattgtaatccccacgtgtcaagagatggacaattcccacctgtcgagagagagaggtgactggatcatgaaggcaatttcccccttgctgtttcatgatagtgagttctcacgagttctgatggtttgataagcagttttccccactgttgcttgctctctcttgcctgccaccatgtaagatgtgcctgtttctccttctgccatgattgtaagtttcctgagacctccccaaccatgcagaactgtgagtcaattaaacctcttttctttaaaaattaccagtcttgggtatgtctttatagcagtgtgaaaacagactaatgtaacatgtaagcataatcatgtgacatttgtctttctgtgcctatcttatttaacttaacattatgtcttccaggtttatgttgttgtataataaatgacacgactttattctttttaaaggctgaatagt

SEQ ID NO: 85141 - DNA, 653 bp, Homo sapiens
tcggtcattaaacacatatttatcagtcacctacgtgtgccaggcagggatgtcatcaggcccattttacagatgaggagactcaggcctagagttcagaagtcccctgcacaaggacacacagtggctgcgtgtggcagggccaggatctgagctcaggaagccaagttctggggtctcagcctgtccctgccaggctcctgctgggtactgtcacaccacgtggcagacaagaggcaacagacaggagcacggccttggtggcctggcagccagactatttgggcttgaatcccagctcctctgcttacctgctgtgagaccttgggcaagtgacctaatcttttggtgccccagtttcctccaccatagattggggatagtaacagcacatcctttacaggctgtagtgaaaattaaatgcattaatacacataaagcctttaaataaagcccaatgtggtacctggcacaaaggaacggcttcctgagcacctgccaaagtcgccactccccagctgaggaaggtgaggctcaaagagaggtcacttgccctaagtctcattgccagcaagggatttaacccagggagccctgagttcctagatgctgcaacaatccgctgctccatccagctggacaggggcccccca

SEQ ID NO: 85142 - DNA, 236 bp, Homo sapiens
cctgtatcaaggaaacaactgaaaatatcctaacaaattttggaagggagggtttttaaatgatttgatttaaaatatgggctatgtaaaacatgaaatctacttggaggaagggggattcaagacatcttaaaggaatgggcattcttttccgaagttgataataggctctatgagatattactcgtattaaaagtgcgccgtcatgtgtaatgaagatgctttcagttgcaatt

SEQ ID NO: 85143 - DNA, 238 bp, Homo sapiens
gcctctggccgctccctctgccagtgctccagcctggccaggctttccgttgctggaatcttccacacgccccctgcctccaggcctgcatcctttctgccgacagcatgcctcttctccccctctgggtccccaactctgctaactaatttttctacagagattttattttagatgccctttcctccacgagatactcagatctgttttcacacagaaggcgtgcatttgtcctgct

SEQ ID NO: 85144 - DNA, 205 bp, Homo sapiens
tcgagtataaaatgacttagcgattcttctcctcaaaatgtgtcatttatgatccttttgtagttcatgagtgtgatgattgtgtgttcatacgcttgtgtgagatgtgccacccttgaaccttgttacgacattggcacattacccgtctgatctgaaaaaaaaagtatcatttatttacttacctaaaatctatggagtgctt

SEQ ID NO: 85145 - DNA, 661 bp, Homo sapiens
gagccgagagatttggggatctgcactgcacagtgccgagcacttcctttgctgcaggactccacagaggctttaatgcgctggcgtcactacaggcatgcggtgcagcctccccagttagccagggacagcaccctgtctccgtgaaccctggtcccacctcatgacacgttctggttcacacagctgggccactctgctctgcacggaagagccttcgcttccctgaagggctagcctgccccagcgcacgcctcttagcggccgggccagccccgaggccagagttgatgagagctggccggtgggtttcattctgctgcttgcctcggccgcctggcattctggcccagtctttctgacgtggggacactcttggcctaaatcctgtctttgcaaccaaaaagcagtgtgcccagcggtcacctcacttgcttccttctctcacccagggtcccagagctgggagggcaggggtgggatgaatgaagcgtggcctgccctgcggagagggatgagggtggggcggggaagttcctcagccccagtgcggcagctcgttccggggcgctgcctgtgtggtctacgccagcaggtaagtgagagggtgacagattcctgctccagaaggatctggggctgtgtaagaaccgtctcagca

SEQ ID NO: 85146 - DNA, 310 bp, Homo sapiens
ctagaattaggttgtttaggactctaattaaaaatcaagaataatctacattttcccactacttacctcgtcctacgccaagaactccagaccctaaaaagttatgttttgattgctgttttatattatccatacagttttattgaacaattaataatagttcatgaaaggtttggctctgttaatattttgcaatgcatattttaaaatacgtaaaaatgggaaccccctctattttcttgcttaatcctgtgtacaataatcttcagccagtcaatttgaggaatcttgtaaaacttaattgtaaggg

SEQ ID NO: 85147 - DNA, 634 bp, Homo sapiens
tcttaacgaagttacctaatcttggtgtcttggtttcttcacattgtggaagggacatgactcacttcctagggtgttaagattaaatgcaataaaacatgtaaagttttgcaatgttgtttggcacatagctattcaatagttgtagctatttaaaaaattatttagggtacttaattcatgtaataaccatttaagtattcagttcgctttctattatctttatattatttctcccaagcaaattttgctttttttttttccaagaggcaaggtctcactgtgttgcccaggctggcctctaactcctgcgctcaagtgatcttcctgcttcagccttccaagcaaactttgcttttaataacattaatatttactaatggcttattccatttatggcacctgctcaaacttaattgcttgctttatctgagccctttcctcagataaaggctcagaaagtaaaattgacttttactttttcagctacgtgtatatgtggcacttaattatataattagcacctgtggcccagagatgggtgctgggtattgggacactcatttatcaggttgtgtgtaattagcatctacactggaaagcaccttttgaacagctggcgctgagatacaga

SEQ ID NO: 85148 - DNA, 295 bp, Homo sapiens
cgtggacacccctgaaggatgggctgaggctttctgcagagccctggctcactttttccaaatcagagctgctcttgttcatttttagaaggtgccgcgactttggaggcggaggaggaggtgagaatgtctcaatcccacttctgtccttggggaactcaaaggcaaaagaggcggatttgctcatcccggtcccaactttgctgttctgcccagaggagccatctgtggggtggagacggtgccaggtcgtggagtttgaatggtccgtggggccatttttggtctctcttcc

SEQ ID NO: 85149 - DNA, 882 bp, Homo sapiens
ccctagtccatgagcactgaggaagggactttaaggaatccctctcattttgacaaggaaagcaaaagcccagagagatcacacaactatttagaaaggtaggaacagaaagagctgtcttcagacttcttctctgggaggttgatgggttttccccttggctttcgaagagggaggtctggcctcaataactggcagtgctgtcttcctgggactcgggctccaccccttcaccatgggcgtgcatgctcacagctggcactcattccctcacggaagccttccctgggctaaaggcatcatcaagaggtaagaagtacagcttcacaggtacccagagcctctcaaatataggcatgatggaatgaaacctccccaccccagtccccaaagttggtcatcagaagagggagtggccgcctgcctctaaacactaaaaatctaagttccctctagtcaccaacgcccacctggcacggaaaggccttgttttggtgcctttgaccccatttacactccagcaacctttacccccacctttctggccttcccctgcacaccagcccttcatttctgggggctgtggagagtcaggagacagcttggtggcctcctccactccctcccagacttcaggtcccaggagatcctccagtgacctattgtcctggcacctgaccttctccctaccccctaccttgcttccacaagctgggaaggggacaggaaatgcacaaataattatagcccaagagggaaggagggagggagggttccagcccactggctccaggcaatagctacagccagtgacccggagagcggagagccggagagccagaggggtagcggaggaggacccaggctcatgataaggaagac

SEQ ID NO: 85150 - DNA, 672 bp, Homo sapiens
cagagatgtgcttcttctggtgaatacattcctgactgatggatttacagaaatgaggggttaatattgactggttgggcttgcaaaagcatgttcactgagacacattacagttgatctatttaatgtgtttaaaattggtatggtggctacctgtcactatggctatacaaaaaccagaaattttatttttctaagaagcagacttaaaaatgactctcagtgatacctgctcctgttaggatgcccttggataattccttcccttgaataagggctgcattagtaacttgcttctagcaaataaatttggcagatgtgatgaaatatcacttccaagattgggttataaaaagactgtggcttctgccttcagggcttctttcacttgctcttgcttggatctttctctctgggggaagcaagttgccatgatataagcagctcaatggcaggaggccaaggcaaggaggggatgtggcaaggaactgatatctccagcccagtcagagaggacctgaagttcaccaaagtcatgtgagtgagtttggaactggatcctttcctagtcaagttctgagatgacggcagcttcagccaacaccttgacttcagctttatgagagaccttgagccagagacatccagataagctatgcctggattcctacc

SEQ ID NO: 85151 - DNA, 318 bp, Homo sapiens
gcccggcagccggcaaagcccccctcctcgtacatcgcgctcatcaccatggccatcctgcaaagcccgcacaagcgcctcacgctcagcggcatctgcgccttcattagtgaccgcttcccctactaccgccgcaagttccccgcctggcagaacagcatccgccacaacctctcgctgaacgactgcttcgtcaagatcccccgcgagccgggccgcccaggcaagggcaactactggagcctggaccccgcctcccaggacatgttcgacaatggcagctttctccggcgtaggaagcgtttccagcgccaccaa

SEQ ID NO: 85152 - DNA, 317 bp, Homo sapiens
tggggccatggtgatggcagggggaagtggaggaggtagactcacattacacaagcactaagactcaggaatagaaccagaaagctataagcttgaaccagtgaggacgctggagtgtgagcactgttctcaaagcagcagccctgtgagggcaggggctgcttcccagagaattcccagcacctggcacagagcctggcacaaagaaggtactctgcaaatatctgaatgaagaatggaagaaaaagccaattaacaaataaatggactgcaggaacccaggacacaccagagggtgctggaggcagaccagaccc

SEQ ID NO: 85153 - DNA, 436 bp, Homo sapiens
  misc_feature (5)..(5): n is a, c, g, or t
  misc_feature (16)..(16): n is a, c, g, or t
  misc_feature (37)..(37): n is a, c, g, or t
  misc_feature (44)..(44): n is a, c, g, or t
  misc_feature (95)..(95): n is a, c, g, or t
  misc_feature (112)..(112): n is a, c, g, or t
  misc_feature (114)..(114): n is a, c, g, or t
  misc_feature (126)..(126): n is a, c, g, or t
  misc_feature (151)..(151): n is a, c, g, or t
  misc_feature (271)..(271): n is a, c, g, or t
agctncaatgaaaccnaaacttgctccctggccttcntgtgctnaggcctctccccttttttgccagggcttccctggtgcctctccccatgaanagggaacttcccctccnantccccatggaanaccccaggtttgggctgttgcccanctttgaggccccctgtgggcttgcctgtcccaacccaagaggcagggctcaaagtgcccacccgggggttgcaaggacagcagaggaccacctgccctctgcaggaagctgtccaggaanccgtgtcctgggctgtggtccttgactcccatggggagagctgggtcacttggcctcttctaactggccccaagcacgccaattctggagcatggttactaagtggctctgaagcttcagggtcaccacaggcttgtcctgactgcaaactcatggagtggttgc

SEQ ID NO: 85154 - DNA, 475 bp, Homo sapiens
caacttaggtttatccagtatcctcattagtaactttaatccttaatgtcactcacctttgaaatgtgctcattggacgggtgccacacagagcaagctcgcaataaatgttgctgaatagaacttactgactgccactgacttaacttcgtttggatgttgtttatagtctctttatgcctctgccaccccagcagagtcataaagaaccagacagaagcaggacccaagaacatgaggcccaaaggagagctgtgggaagtgaaatactatattcagggagaccctcagctccttcccatctcagttccccaaatgagagcaagcaggctgatacttctcaggtggggtatggagatatcccacctgatccctcttgtcagttgataagctggactccacatagcttatagtcagctttttggtgcttcactcttaaatatgaatgactagacaaagatcaattgtcatttgt

SEQ ID NO: 85155 - DNA, 352 bp, Homo sapiens
ggtggtgttctaatgttttatgcatacatattttagtccttttaagaaaccctataggtattgttattttatgtacagtttggaggtttaataacttgcctaaaatcatacaaatgatgacagagccaggacacaaatcactggtgtctggctccagagctcatgctattaaccctgtgtgatcttggtcttcataacctctaaaaaaaagaagaagaaaataaggaagagagggagggagcaaaggaaggagacaaagagtttaacctatagttcaaggggcagaagggaattaattgctcatgatttatgctgtaggaaaacttaaaataaattcaattaaaaagtgctg

SEQ ID NO: 85156 - DNA, 419 bp, Homo sapiens
agagggcagtggtgccatctcagttcactgcaacctccacctcccaggttcaagcgattctcctgcctcagcctccaaagtagctggaattacaaacatgcaccactacacctggctaatttttgtatttttagtagagatggagtttcaccatgttgcccaggctggtctcaaactcctggcctcatgtgatccacctgccttggcttcccaaagtgctgggattataggtatgagccactgcacccagcctgagtaaagatgttttaagcaaatacacaataagaatgatgttcgcaattcagagctttttgtctgcctaaggggattctgttgttctagtcctgcaccctgacagatgtggtctctcgtctcagccagatgtggtagtaactacaggattaatttgcatgtgtaaa

SEQ ID NO: 85157 - DNA, 701 bp, Homo sapiens
gtctgggctcaggcccacggactctatcctggctgctcctgggggagaaggagagcagcacctcactccgctgcctgcaggagcctctggtagtgagggctgactgtccctcctctcctctgaagcctctgcccacaagctgaactacctcacagataggaaacaggaagctcagagagggcagtggacttgcccaaggttacccagcaaattagtggtagagctgaggcttgaatccaagactcttagagctagacaagttgaaaggtcaacatgattttaccaatgtcttaggaagcagtgggggatgcacagggggacagagtatgagtaacgattctgccggcttcaggcaggcctggggctgtgggctgaaattgacccagatgcgtcaggggcttggatcagatgagagaaggtttcccagaagaggtaaggccaaggtgatcttggagggtgaggatgagttagctcagggaaggcagggagaggcattccaggagggacaaaggcacagaagggtagaggggacttccagggaggatgtggtgtggtgggagcaaggggagagtgcaggaacctcctccaggactaacagctggatccttgagagtcctacggaaagaagctcctggggacgggtgacttagtcctctcaccggaaaagatgctggggccttgggagctggggtcctggggag

SEQ ID NO: 85158 - DNA, 347 bp, Homo sapiens
agggaaatgcacagaattctactaaaataacagcaaaataagagagcatgaattacatatcaaattatttaaagcaaataatttaacaaatttctggaacagacagaaagcagatgagtctaccaagaaggataataaacaatgacaccagagaaaaaccacaacctgaaaacttaagaaaactgcctaagaggtgtgagccagagctcccaggagccctacagtgctccaagctcagaactggcaagtatcaaagtcaagaatgctatggggtagctaggcctcttgactttctcttctctctccattcatagacaagaaagcatatctacctttagtgcctagaa

SEQ ID NO: 85159 - DNA, 259 bp, Homo sapiens
caaatgtcccgctgatccgacaggaggtgaagctcaggcggtaatggctggcctgttgctcacctcctgctgtgcggccaggctcgccacagacctataggatctgccgcccggggctggggacgcctgctctagagcactaggtatgatcgggctgaggctggacctcacctgaaactgcatttttatttgttttccccttttcttctgccactccactcactgtcttacaggtttctccagagaatactcccttaat

SEQ ID NO: 85160 - DNA, 689 bp, Homo sapiens
  misc_feature (2)..(2): n is a, c, g, or t
  misc_feature (13)..(13): n is a, c, g, or t
anttcggcacagntcgtcatgtcagccaggctgggcttgaactcctgacctcagatgacccacccaccttggccaatgcactgaaacgccatctctactaaaaacacaaaaattagccaggtgtggtggcatgtgcctgtaatcttagctactcaagaggctgaggcaggagaatggcttgaacccaggaggcaggggttgcagtcagctgagactgcgccagtgtactccagcctgagagacagagcgagactctgtctcaaagaaaaacaaaaacaaaaacaaacaaaaatctacttgaaccaataaaaattcccatccccacctagaattctaaatattttataaataaagtcttcagagcctagatattcactagaacccagtggtcacgtgttcctaatgggtggaatattattttgaatctttccatgatgagagttacattgatgggtgaaagctttttatgcaacatcatcattgttgaataaacagacgcttagcatatttaggttggaatgcaagggaactaaaggtaggggagattcttaaggaagtctactttctcttcaagaatgctatcaaattgaaaggtaattcctaaacaagagtcatttgtaaattagggaggaagagctaaaaaagattcctagcaagaaacatcataaaggggcttgataaagccaaaa

SEQ ID NO: 85161 - DNA, 286 bp, Homo sapiens
tgtggaggaggaagaaggtaaagacataagcctggaaggaagaactgacatgagttttagttgctgacttgatatccaagtcaagactgcagtggatcccaggacacctggaaaaagatagctgtctgggcattaggggattaggaatattagccaaagaatggtaggctctgtctaggtatttatggactgttctctctttctctctgcatgaaactaattcattctcattctcttattctctccttctctccctctctctctctctctctctctctctctctct

SEQ ID NO: 85162 - DNA, 170 bp, Homo sapiens
aactgcatttcaacccctttaattcctttccactctcatcgctggattccttaatatcagggcttcccttaggggatagtaggtggtaagttcacaggattatttttgtattcaagaggtagattgtcatataaatatatctgcagcattgaacatgaaaataaaaaagg

SEQ ID NO: 85163 - DNA, 773 bp, Homo sapiens
tgggctcattaattgtgtttccagcagttactccatttaaagcataaatagtgttaaccattaccagttatttcaaatactaacatgggtccatttaaaaaaaatatttattttggtacttgggtgtccatattataataatgttgtttttccagaaatatatttgatctttggactgagaatgtttggtaacatagtcaagcatttgttaagccaagtgtggaaatgttcactttttaactttacagtttttttaatgagcaattctacatttctaagaaaaaagatacttcatttttatataaggttacaactgctttataaaaatgtattcacaatgtcattaatctttgcgtttgtgctttatatcttctcagggcagaggttcttgaaatatgtactcaatcatttaacttttattttattttttcatttgtttttaatgaactacctcttgttgaaattttgctggcttcattctttcgggatacctgtgtcctctagtcctaccgctcttccatagcactctttccttaagcacagtatccataattggggcacttctaacttttaccttgtaatcgtttcaacagaggttttatcttcttttctggaatataagctctcgtagaacaaggcttgtctatttcttaactttgaaacctcccaggaggattgccaggaataggtatactattatttgccaattggatggatttactattttattaacattatctcttttttcagtaaacatgaactttacatttata

SEQ ID NO: 85164 - DNA, 355 bp, Homo sapiens
tcatttaattctcactactgccccgtgagattagtagtgttgttaccattttgtgcctagtgtcacaggactgccccttagcagagcagggatcagagcctgggctgtcaggcccgttaactggccatggtcaccaatatgtcgtgctacttctcatacagagacattaatgtttttctgcaaagaatcaaggcaaagaagattgagaagggttcaaaggattgagagtgttggattcaaggactctacttatgtttaaaatatccataaagaggtccgatgtggtggctcacgcctgtaatcccagcactttgggaggccaaggccggcacgaggccttgagatcacgaggtca

SEQ ID NO: 85165 - DNA, 338 bp, Homo sapiens
agttacaaaaatagtgcagcaaaatcctgtgtacccatcactcagcttcccactggtgatatataattatagtgtattatcaatactaaaaaattgattgtcacaatgtaatcaactagacagcagtacctgtttctttttaatgcctacaagacattccattctatgggtgttttatttaaccagtcctttattgctgggcattaaaattgtagtattgctggtatagggaaagataggagaaaataaagtctgtgtattcggggccactgctggcatttacattgcttttatgtgaattagaaaagagttccctctctgggtggatgtagtcccat

SEQ ID NO: 85166 - DNA, 120 bp, Homo sapiens
ggagttcgagagcagcttgggcaacatagggaaaccccatctctataaaaaaatttaaaacttagctgggtgtgtggtggtgtacctctgtagtctcagctactcaagaagcgcaggcaa

SEQ ID NO: 85167 - DNA, 814 bp, Homo sapiens
gggacaaacgcagccagacgccggacttgttgggtggcgttagaaaggctcccagaatggggaccagagatgggaagaacataggagacgttgtacacaagatctaagagaagagggagatgaagagactacaaatgatgttccccatatccagtgtggagatggctgtgacccccaaggactcagggacaacagtcagttctgcttgcaaaggatccaccagggtctgattttttatgagaagctgctaggatcggatattttcacaggggagccttctctgctccctgatagccctgtgggccagcttcatgcctccctactgggcctcagccaactcctgcagcctgagggtcaccactgggagactcagcagattccaagcctcagtcccagccagccatggcagcgtctccttctccgcttcaaaatccttcgcagcctccaggcctttgtggctgtagccgcccgggtctttgcccatggagcagcaaccctgagtccctaaaggcagcagctcaaggatggcactcagatctccatggcccagcaaggccaagataaatctaccaccccaggcacctgtgagccaacaggttaattagtccattaattttagtgggacctgcatatgttgaaaattaccaatactgactgacatgtgatgctgacctatgataaggttgagtatttattagatgggaagggaaatttggggattatttatcctcctggggacagtttggggaggattatttattgtatttatattgaattatgtacttttttcaataaagtcttatttttgtggcta

SEQ ID NO: 85168 - DNA, 810 bp, Homo sapiens
cttcggactgctcacttgccttgttcagccctgaatcatcagggctcccagaatggggaccagagatgggaagaacataggagacgttgtacacaagatctaagagaagagggagatgaagagactacaaatgatgttccccatatccagtgtggagatggctgtgacccccaaggactcagggacaacagtcagttctgcttgcaaaggatccaccagggtctgattttttatgagaagctgctaggatcggatattttcacaggggagccttctctgctccctgatagccctgtgggccagcttcatgcctccctactgggcctcagccaactcctgcagcctgagggtcaccactgggagactcagcagattccaagcctcagtcccagccagccatggcagcgtctccttctccgcttcaaaatccttcgcagcctccaggcctttgtggctgtagccgcccgggtctttgcccatggagcagcaaccctgagtccctaaaggcagcagctcaaggatggcactcagatctccatggcccagcaaggccaagataaatctaccaccccaggcacctgtgagccaacaggttaattagtccattaattttagtgggacctgcatatgttgaaaattaccaatactgactgacatgtgatgctgacctatgataaggttgagtatttattagatgggaagggaaatttggggattatttatcctcctggggacagtttggggaggattatttattgtatttatattgaattatgtacttttttcaataaagtcttatttttgtggcta

SEQ ID NO: 85169 - DNA, 855 bp, Homo sapiens
gggacaaacgcagccagacgccggacttgttgggtggcgttagaaagtaactctgtttttagtcttcttgaacaaaattacgtctagggctcccagaatggggaccagagatgggaagaacataggagacgttgtacacaagatctaagagaagagggagatgaagagactacaaatgatgttccccatatccagtgtggagatggctgtgacccccaaggactcagggacaacagtcagttctgcttgcaaaggatccaccagggtctgattttttatgagaagctgctaggatcggatattttcacaggggagccttctctgctccctgatagccctgtgggccagcttcatgcctccctactgggcctcagccaactcctgcagcctgagggtcaccactgggagactcagcagattccaagcctcagtcccagccagccatggcagcgtctccttctccgcttcaaaatccttcgcagcctccaggcctttgtggctgtagccgcccgggtctttgcccatggagcagcaaccctgagtccctaaaggcagcagctcaaggatggcactcagatctccatggcccagcaaggccaagataaatctaccaccccaggcacctgtgagccaacaggttaattagtccattaattttagtgggacctgcatatgttgaaaattaccaatactgactgacatgtgatgctgacctatgataaggttgagtatttattagatgggaagggaaatttggggattatttatcctcctggggacagtttggggaggattatttattgtatttatattgaattatgtacttttttcaataaagtcttatttttgtggcta

SEQ ID NO: 85170 - DNA, 1026 bp, Homo sapiens
ccgaattcggcacgagaacaactgagggaaccaaaccagagacgcgctgaacagagagaatcaggctcaaagcaagtggaagtgggcagagattccaccaggactggtgcaaggcgcagagccagccagatttgagaagaaggcaaaaagatgctggggagcagagctgtaatgctgctgttgctgctgccctggacagctcagggcagagctgtgcctgggggcagcagccctgcctggactcagtgccagcagctttcacagaagctctgcacactggcctggagtgcacatccactagtgggacacatggatctaagagaagagggagatgaagagactacaaatgatgttccccatatccagtgtggagatggctgtgacccccaaggactcagggacaacagtcagttctgcttgcaaaggatccaccagggtctgattttttatgagaagctgctaggatcggatattttcacaggggagccttctctgctccctgatagccctgtgggccagcttcatgcctccctactgggcctcagccaactcctgcagcctgagggtcaccactgggagactcagcagattccaagcctcagtcccagccagccatggcagcgtctccttctccgcttcaaaatccttcgcagcctccaggcctttgtggctgtagccgcccgggtctttgcccatggagcagcaaccctgagtccctaaaggcagcagctcaaggatggcactcagatctccatggcccagcaaggccaagataaatctaccaccccaggcacctgtgagccaacaggttaattagtccattaattttagtgggacctgcatatgttgaaaattaccaatactgactgacatgtgatgctgacctatgataaggttgagtatttattagatgggaagggaaatttggggattatttatcctcctggggacagtttggggaggattatttattgtatttatattgaattatgtacttttttcaataaagtcttatttttgtggcta

SEQ ID NO: 85171 - DNA, 513 bp, Homo sapiens
cgctgatctgtacaactccaaagcctgaatcacttccttatgccgtctcagccaggcggtcccaatgcccatggccggggaccacctctgcatcaagaatatgcttctcccgcccagggccctcgatttattttccattctcatctcagagatagggcctgagcctggaaagaggttaaggagacccagggcagtatcttggggtggaaagaggtgttaacaggtacaaactggagctctgtctctgagactggtggcggcctacagtatcatgctgaggatccagacccacactgtcccacaaggcagccgaaagccacatgtggctactgagcccctgaaacaggctggtctgaatggaaatatcccgtaggcattaaaatgctatcagatctcatagacttagtacaaaaaaaggtgaaatgtcttgatatttttgtatattgattattgaaataaccttttatgttgggctaaatacaaatatgttattaaaattaatttaacaacata

SEQ ID NO: 85172 - DNA, 724 bp, Homo sapiens
ctcaataacaagaaggcgtggggaagtaagggacctttgatgaggtggaaagatcagtcactgttgggaacctgtaagaataagaacatgcagctcagtcaggaaggaaaccccagggttcaagagatagagctctttttttttttttctttttttttgagacagggtcttgctctgtcgcctaggctggagtgcagtagcatgatctcggctcactgcaacctccacctcctgggttcaagcgagtctcctgcctcagccccccaagtagctgggactaaaggcatgtgccaacatgcccgactagtttttgtctttttagtagagacggggtttcgccatgttggccaggctgatcttgaactcctgacctcagatgagctgcctgcctcggccgcccaaagtgtgggggttacaactgtgagctaccaggcccggcccaagagatagagctctttaggaggagatactagtctcactagatccaacataaatggattgaaccagagctaaaaattccacctgcctctcacagaattaattttaaaagaaaataccatcatatggtattcctgttttcatttttaccagcagggtccttctgtttcattactccaatctttaattcttttctggagttctggagttgctgttagcattagaaaagttttgcatgtgatagctgtttccttaaatatcatgcaaatattcttgaaagcatcct

SEQ ID NO: 85173 - DNA, 159 bp, Homo sapiens
gtgcttttctgcctgtgtttttgatggatcttagtattgattaacatagatttcatttcaagccatctattttcattgaagatgcatgtttatgttaatccattttgatttcactcaagaagaggattggatgaactacatcaggtgacgggacatcat

SEQ ID NO: 85174 - DNA, 551 bp, Homo sapiens
cgccccctgggttcaagtgattctcccacctcagcctcccgagtagctgggactacaggtgcatgccaccacgcctggctaatttttgtattttttttggtagagatggggtttcaccatgttggccaggctggtcttgaactcctgacctcgggtgatccgcctgcttcagcctcccaaagtgctgggattagaggcgtgagccatcatgtccagccagcactgtgctgtttttgacatgcatgttctcattcactgccatgcggcagattctaggattattattattctcactttacagatgagggagtgagacttaaaggggttaggtaatttgcccacatcccccaactagcaaatggtagagccaggattggaatttgttcaggctcttaaccattgcactctttcaaaatgttaaaaataatgttgtgtctcattttaaaaaattaaataaaaactctttggaccaagcatcagttatgggaatgaatttcgttccttgtctcttttggcaccaaatatcaagacattctttcccagctaggcat

SEQ ID NO: 85175 - DNA, 336 bp, Homo sapiens
gttaaacaatttgttgacacatagttgtttagagtagactattattatcctttgtatttctatggtaccaattttaatatctccttttttgttctaattttatttacttgagatttcttttttcttggcctagtgagaggttggtcaatttttattatcttttcaaaaaatcaactcttcgtttcattcatcttttctattgtttttctagtctatttcatttatttctgctatgatctttgttatttccttctaattttgggcttgattattttttttctattttttgaggtttatttgggatcttttttttctttatttagcacttatctgtat

SEQ ID NO: 85176 - DNA, 249 bp, Homo sapiens
acactacccaacaaaatgtattagaacaaaatctctatgactctcttatttatgtcccaagaatgtgatctagcttcattacagcacaattaataggatgcctatctgttctacaaacatcaaatatgggtctatttccttttaaacgcagtcgtctaaagcttgctcagcagtagacaagctacactgctattacagatttctgttatcggccccattatttatctcttttggattaagtattagtac

SEQ ID NO: 85177 - DNA, 674 bp, Homo sapiens
agttatagggttttctctaccttgatagtcagtcaactagaaaacccttctgttgaatatctttctaaaaagtgccccttcttcctgtctcaggaagagttcattgcacatatttgactctttatttgataaatttagggtcttacaaaatgttagaatcccattttgacatccattctcattataggtggtttgaaaaatggtaactttctgtgagatgtgccattgcaaacaggaatgttttcatgcaggtcacacagtctatttatattgtacctttgaattagaaagaggcacactcagaacgtaagacttagaattaaaggcctcccccactggccatagcagcacccctagctcacaaccagttgaaggtggttttggtgtgaacactaagatgccccttcctggttgaatttgggctggttcagcccccacctccctcccggccaggtgccattttgctcgtaaccccctgtaacagccctgcaagacacagataacattttatttttttaaaaagttgttagtcccctaaaccaaagagcaacatatactgcagaaataaaaagttagtcatagcaaaggagaagtaacagtatctggttttaataatagctcatatattccattggtacatatttacaaagggccaaactcaactaatttattta

SEQ ID NO: 85178 - DNA, 114 bp, Homo sapiens
aactgggattgtttccaaggctgaagtgaaacactgtttaggtgacttgtttttgtcaccccatgacatgatctttaggaagatgttctagaagacagtggatgattttttttt

SEQ ID NO: 85179 - DNA, 280 bp, Homo sapiens
tgtcctgtatcaaatgttcgtgtccaactgtctccagctttttgctccaaaaggtttcaggctggcccgcctgtccagctggcgggttcatgcggggctggtcagccacagtgccgtcaggccccaccaaggggctctggtggagaggattatcccacaccccctctacagtgcccagaatcatgactacgacgtcgccctcctgaggctccagaccgctctcaacttctcaggctctgcagtgggggaagccaagcctgactggggaccaggaccatgt

SEQ ID NO: 85180 - DNA, 372 bp, Homo sapiens
aatttagggcatgatcatgaaaagcatcttcctctaaggttgggcaggggtgggggttggtagataatacattcggagtttacagggaatgtatgtattgatcttctcaaagaaatcttacaaaaaatcttgagcagcagatatttttagcctcatttgatagaagtgaaaatcaaggccctgcatggttaagtgatttactaaaataaaagtcgcttggctagtgtagagccatgctgtgaatcagttcctttcccttttggtctaggactccctcctctgagtcctgctgtttcctccagtctcactgcacaccactgcctcatgcttcctggggcctccagcagctccactaatggaggagaggcagta

SEQ ID NO: 85181 - DNA, 2241 bp, Homo sapiens
acgcgggatacagggaggggccatgtgcgaaccagggagacctcatcttccaaccaagcttgctgggcttgctttaatcaatgctggcctgagaacaggagcggaacattgcctagtagaccctgaggctttacaacagtgccactgacccctatgagcctgatgctggatgaccaaccccctatggaggcccagtatgcagaggagggcccaggacctgggatcttcagagcagagcctggagaccagcagcatcccatttctcaggcggtgtgctggcgttccatgcgacgtggctgtgcagtgctgggagccctggggctgctggccggtgcaggtgttggctcatggctcctagtgctgtatctgtgtcctgctgcctctcagcccatttccgggaccttgcaggatgaggagataactttgagctgctcagaggccagcgctgaggaagctctgctccctgcacttcccaaaacagtatctttcagaataaacagcgaagacttcttgctggaagcgcaagtgagggatcagccacgctggctcctggtctgccatgagggctggagccccgccctggggctgcagatctgctggagccttgggcatctcagactcactcaccacaagggagtaaacctcactgacatcaaactcaacagttcccaggagtttgctcagctctctcctagactgggaggcttcctggaggaggcgtggcagcccaggaacaactgcacttctggtcaagttgtttccctcagatgctctgagtgtggagcgaggcccctggcttcccggatagttggtgggcagtctgtggctcctgggcgctggccgtggcaggccagcgtggccctgggcttccggcacacgtgtgggggctctgtgctagcgccacgctgggtggtgactgctgcacattgtatgcacagtttcaggctggcccgcctgtccagctggcgggttcatgcggggctggtcagccacagtgccgtcaggccccaccaaggggctctggtggagaggattatcccacaccccctctacagtgcccagaatcatgactacgacgtcgccctcctgaggctccagaccgctctcaacttctcagacactgtgggcgctgtgtgcctgccggccaaggaacagcattttccgaagggctcgcggtgctgggtgtctggctggggccacacccaccctagccatacttacagctcggatatgctccaggacacggtggtgcccttgttcagcactcagctctgcaacagctcttgcgtgtacagcggagccctcaccccccgcatgctttgcgctggctacctggacggaagggctgatgcatgccagggagatagcgggggccccctagtgtgcccagatggggacacatggcgcctagtgggggtggtcagctgggggcgtggtgcgcagagcccaatcacccaggtgtctacgccaaggtagctgagtttctggactggatccatgacactgctcaggactccctcctctgagtcctgctgtttcctccagtctcactgcacaccactgcctcatgcttcctggggcctccagcagctccactaatggaggagaggcagtagcctccgacacagaacgcatggacctcctactactgtgtgtgaggaacagtcactacccactggccagccacccagccaacaggtctctcctcttgggccctgatttcagagtcctctttctcactagagactcaatgacagaagagaggctgggacttggttgggcatgctgtggttgctgagggatgagggggaggagagaggtaggagctggagatgaagaggctgctagaagcagcaggaagcctgcccttctgccctctcccctccctgcccctgtgtgagtcttttgggagggtgctgggaggtgccccccgtcccacctttttcctgtgctctaggtgggctaagtgcctccctagaggactccatggctgagaggctcctgggcagatggggtcaaggctgggccagcccagatgaagcctatgggagtcaggaccctctccactctccctctccactccccttcctgttctcacctggctgtggctggccctgtgtggggtgggtacactggaaaacaagaaggttggagttggtctaggacattggttttaaatgacagttctgtgaactggtccaaggagttctgttattaaagtgatatatggtcttggtccag

SEQ ID NO: 85182 - DNA, 2039 bp, Homo sapiens
acgcgggatacagggaggggccatgtgcgaaccagggagacctcatcttccaaccaagcttgctgggcttgctttaatcaatgctggcctgagaacaggagcggaacattgcctagtagaccctgaggctttacaacagtgccactgacccctatgtgctgtatctgtgtcctgctgcctctcagcccatttccgggaccttgcaggatgaggagataactttgagctgctcagaggccagcgctgaggaagctctgctccctgcacttcccaaaacagtatctttcagaataaacagcgaagacttcttgctggaagcgcaagtgagggatcagccacgctggctcctggtctgccatgagggctggagccccgccctggggctgcagatctgctggagccttgggcatctcagactcactcaccacaagggagtaaacctcactgacatcaaactcaacagttcccaggagtttgctcagctctctcctagactgggaggcttcctggaggaggcgtggcagcccaggaacaactgcacttctggtcaagttgtttccctcagatgctctgagtgtggagcgaggcccctggcttcccggatagttggtgggcagtctgtggctcctgggcgctggccgtggcaggccagcgtggccctgggcttccggcacacgtgtgggggctctgtgctagcgccacgctgggtggtgactgctgcacattgtatgcacagtttcaggctggcccgcctgtccagctggcgggttcatgcggggctggtcagccacagtgccgtcaggccccaccaaggggctctggtggagaggattatcccacaccccctctacagtgcccagaatcatgactacgacgtcgccctcctgaggctccagaccgctctcaacttctcagacactgtgggcgctgtgtgcctgccggccaaggaacagcattttccgaagggctcgcggtgctgggtgtctggctggggccacacccaccctagccatacttacagctcggatatgctccaggacacggtggtgcccttgttcagcactcagctctgcaacagctcttgcgtgtacagcggagccctcaccccccgcatgctttgcgctggctacctggacggaagggctgatgcatgccagggagatagcgggggccccctagtgtgcccagatggggacacatggcgcctagtgggggtggtcagctgggggcgtggtgcgcagagcccaatcacccaggtgtctacgccaaggtagctgagtttctggactggatccatgacactgctcaggactccctcctctgagtcctgctgtttcctccagtctcactgcacaccactgcctcatgcttcctggggcctccagcagctccactaatggaggagaggcagtagcctccgacacagaacgcatggacctcctactactgtgtgtgaggaacagtcactacccactggccagccacccagccaacaggtctctcctcttgggccctgatttcagagtcctctttctcactagagactcaatgacagaagagaggctgggacttggttgggcatgctgtggttgctgagggatgagggggaggagagaggtaggagctggagatgaagaggctgctagaagcagcaggaagcctgcccttctgccctctcccctccctgcccctgtgtgagtcttttgggagggtgctgggaggtgccccccgtcccacctttttcctgtgctctaggtgggctaagtgcctccctagaggactccatggctgagaggctcctgggcagatggggtcaaggctgggccagcccagatgaagcctatgggagtcaggaccctctccactctccctctccactccccttcctgttctcacctggctgtggctggccctgtgtggggtgggtacactggaaaacaagaaggttggagttggtctaggacattggttttaaatgacagttctgtgaactggtccaaggagttctgttattaaagtgatatatggtcttggtccag

SEQ ID NO: 85183 - DNA, 310 bp, Homo sapiens
gcctcagcccgtgggaatccagcctgcctccattactgccgtcaccggctccaccttcggagaacatctcaaggaggcccggggcggaggggggttcccgcgtgcacacgagtgcggctggacgtgccgacacgcggtgatgtacccatgctccgtgtgtctgtgtctgcatgtccacacgtctgatgcacctgtgtacgtgtgtcaagcctagccacctcagctgcagggaggcagaaggcaaggcaggccccacggacacacttgggctgctctgaaataaagctgttgactccacctgaaaaaaaaa

SEQ ID NO: 85184 - DNA, 2681 bp, Homo sapiens
agccacaatctctggcaagcacctaggaccttgtccccgcctgccaagtagccgcccgggccatgtgtgccctgtctcctcggcagcaagccccctgccgcgagcttggagaggcaccccagccccatctggcactcaaggaaatcagctcagagaggttgagtaactcgggaaggccacacagccagtgacgaagctgtgattcacacaggcctgggtgactccagcatggctttcctctccaggacgtcaccggtggcagctgcttccttccagagccggcaggcaggaggccagaggctccatcctgcttcagagctgccagctgcccccgcaatggctgagcaccgaagcatggacgggagaatggaagcagccacacgggggggctctcacctccaggctgcagcccagacgccccccaggccggggccaccatcagcaccaccaccaccacccaaggaggggcaccaggaggggctggtggagctgcccgcctcgttccgggagctgctcaccttcttctgcaccaatgccaccatccacggcgccatccgcctggtctgctcccgcgggaaccgcctcaagacgacgtcctgggggctgctgtccctgggagccctggtcgcgctctgctggcagctggggctcctctttgagcgtcactggcaccgcccggtcctcatggccgtctctgtgcactcggagcgcaagctgctcccgctggtcaccctgtgtgacgggaacccacgtcggccgagtccggtcctccgccatctggagctgctggacgagtttgccagggagaacattgactccctgtacaacgtcaacctcagcaaaggcagagccgccctctccgccactgtcccccgccacgagccccccttccacctggaccgggagatccgtctgcagaggctgagccactcgggcagccgggtcagagtggggttcagactgtgcaacagcacgggcggcgactgcttttaccgaggctacacgtcaggcgtggcggctgtccaggactggtaccacttccactatgtggatatcctggccctgctgcccgcggcatgggaggacagccacgggagccaggacggccacttcgtcctctcctgcagttacgatggcctggactgccaggcccgacagttccggaccttccaccaccccacctacggcagctgctacacggtcgatggcgtctggacagctcagcgccccggcatcacccacggagtcggcctggtcctcagggttgagcagcagcctcacctccctctgctgtccacgctggccggcatcagggtcatggttcacggccgtaaccacacgcccttcctggggcaccacagcttcagcgtccggccagggacggaggccaccatcagcatccgagaggacgaggtgcaccggctcgggagcccctacggccactgcaccgccggcggggaaggcgtggaggtggagctgctacacaacacctcctacaccaggcaggcctgcctggtgtcctgcttccagcagctgatggtggagacctgctcctgtggctactacctccaccctctgccggcgggggctgagtactgcagctctgcccggcaccctgcctggggacactgcttctaccgcctctaccaggacctggagacccaccggctcccctgtacctcccgctgccccaggccctgcagggagtctgcattcaagctctccactgggacctccaggtggccttccgccaagtcagctggatggactctggccacgctaggtgaacaggggctgccgcatcagagccacagacagaggagcagcctggccaaaatcaacatcgtctaccaggagctcaactaccgctcagtggaggaggcgcccgtgtactcggtgccgcagctgctctcggccatgggcagcctctgcagcctgtggtttggggcctccgtcctctccctcctggagctcctggagctgctgctcgatgcttctgccctcaccctggtgctaggcggccgccggctccgcagggcgtggttctcctggcccagagccagccctgcctcaggggcgtccagcatcaagccagaggccagtcagatgcccccgcctgcaggcggcacgtcagatgacccggagcccagcgggcctcatctcccacgggtgatgcttccaggggttctggcgggagtctcagccgaagagagctgggctgggccccagccccttgagactctggacacctgaaccagacctgccagggctgtgcgatctcttggcctggtccttgcagctgtggcagcagcaggctccccagcggcccagggtgggccagaccagcagcccaggaagcagcacacgcggccgtggggaggcaggcaccgggcatgtcggcgcctctggtcaaaccacctacactgcctggggtgggtctcaaggaggcccggggcggaggggggttcccgcgtgcacacgagtgcggctggacgtgccgacacgcggtgatgtacccatgctccgtgtgtctgtgtctgcatgtccacacgtctgatgcacctgtgtacgtgtgtcaagcctagccacctcagctgcagggaggcagaaggcaaggcaggccccacggacacacttgggctgctctgaaataaagctgttgactccacctgaaaaaaaaa

SEQ ID NO: 85185 - DNA, 2757 bp, Homo sapiens
agccacaatctctggcaagcacctaggaccttgtccccgcctgccaagtagccgcccgggccatgtgtgccctgtctcctcggcagcaagccccctgccgcgagcttggagaggcaccccagccccatctggcactcaaggaaatcagctcagagaggttgagtaactcgggaaggccacacagccagtgacgaagctgtgattcacacaggcctgggtgactccagcatggctttcctctccaggacgtcaccggtggcagctgcttccttccagagccggcaggcaggaggccagaggctccatcctgcttcagagctgccagctgcccccgcaatggctgagcaccgaagcatggacgggagaatggaagcagccacacgggggggctctcacctccaggctgcagcccagacgccccccaggccggggccaccatcagcaccaccaccaccacccaaggaggggcaccaggaggggctggtggagctgcccgcctcgttccgggagctgctcaccttcttctgcaccaatgccaccatccacggcgccatccgcctggtctgctcccgcgggaaccgcctcaagacgacgtcctgggggctgctgtccctgggagccctggtcgcgctctgctggcagctggggctcctctttgagcgtcactggcaccgcccggtcctcatggccgtctctgtgcactcggagcgcaagctgctcccgctggtcaccctgtgtgacgggaacccacgtcggccgagtccggtcctccgccatctggagctgctggacgagtttgccagggagaacattgactccctgtacaacgtcaacctcagcaaaggcagagccgccctctccgccactgtcccccgccacgagccccccttccacctggaccgggagatccgtctgcagaggctgagccactcgggcagccgggtcagagtggggttcagactgtgcaacagcacgggcggcgactgcttttaccgaggctacacgtcaggcgtggcggctgtccaggactggtaccacttccactatgtggatatcctggccctgctgcccgcggcatgggaggacagccacgggagccaggacggccacttcgtcctctcctgcagttacgatggcctggactgccaggcccgacagttccggaccttccaccaccccacctacggcagctgctacacggtcgatggcgtctggacagctcagcgccccggcatcacccacggtgggtgccagcccctggccggtgcgggggcaggggtgcaggtcaggtggcctcacaccagcccttggcctcccaggagtcggcctggtcctcagggttgagcagcagcctcacctccctctgctgtccacgctggccggcatcagggtcatggttcacggccgtaaccacacgcccttcctggggcaccacagcttcagcgtccggccagggacggaggccaccatcagcatccgagaggacgaggtgcaccggctcgggagcccctacggccactgcaccgccggcggggaaggcgtggaggtggagctgctacacaacacctcctacaccaggcaggcctgcctggtgtcctgcttccagcagctgatggtggagacctgctcctgtggctactacctccaccctctgccggcgggggctgagtactgcagctctgcccggcaccctgcctggggacactgcttctaccgcctctaccaggacctggagacccaccggctcccctgtacctcccgctgccccaggccctgcagggagtctgcattcaagctctccactgggacctccaggtggccttccgccaagtcagctggatggactctggccacgctaggtgaacaggggctgccgcatcagagccacagacagaggagcagcctggccaaaatcaacatcgtctaccaggagctcaactaccgctcagtggaggaggcgcccgtgtactcggtgccgcagctgctctcggccatgggcagcctctgcagcctgtggtttggggcctccgtcctctccctcctggagctcctggagctgctgctcgatgcttctgccctcaccctggtgctaggcggccgccggctccgcagggcgtggttctcctggcccagagccagccctgcctcaggggcgtccagcatcaagccagaggccagtcagatgcccccgcctgcaggcggcacgtcagatgacccggagcccagcgggcctcatctcccacgggtgatgcttccaggggttctggcgggagtctcagccgaagagagctgggctgggccccagccccttgagactctggacacctgaaccagacctgccagggctgtgcgatctcttggcctggtccttgcagctgtggcagcagcaggctccccagcggcccagggtgggccagaccagcagcccaggaagcagcacacgcggccgtggggaggcaggcaccgggcatgtcggcgcctctggtcaaaccacctacactgcctggggtgggtctcaaggaggcccggggcggaggggggttcccgcgtgcacacgagtgcggctggacgtgccgacacgcggtgatgtacccatgctccgtgtgtctgtgtctgcatgtccacacgtctgatgcacctgtgtacgtgtgtcaagcctagccacctcagctgcagggaggcagaaggcaaggcaggccccacggacacacttgggctgctctgaaataaagctgttgactccacctgaaaaaaaaa

SEQ ID NO: 85186 - DNA, 1931 bp, Homo sapiens
agccacaatctctggcaagcacctaggaccttgtccccgcctgccaagtagccgcccgggccatgtgtgccctgtctcctcggcagcaagccccctgccgcgagcttggagaggcaccccagccccatctggcactcaaggaaatcagctcagagaggttgagtaactcgggaaggccacacagccagtgacgaagctgtgattcacacaggcctgggtgactccagcatggctttcctctccaggacgtcaccggtggcagctgcttccttccagagccggcaggcaggaggccagaggctccatcctgcttcagagctgccagctgcccccgcaatggctgagcaccgaagcatggacgggagaatggaagcagccacacgggggggctctcacctccaggctgcagcccagacgccccccaggccggggccaccatcagcaccaccaccaccacccaaggaggggcaccaggaggggctggtggagctgcccgcctcgttccgggagctgctcaccttcttctgcaccaatgccaccatccacggcgccatccgcctggtctgctcccgcgggaaccgcctcaagacgacgtcctgggggctgctgtccctgggagccctggtcgcgctctgctggcagctggggctcctctttgagcgtcactggcaccgcccggtcctcatggccgtctctgtgcactcggagcgcaagctgctcccgctggtcaccctgtgtgacgggaacccacgtcggccgagtccggtcctccgccatctggagctgctggacgagtttgccagggagaacattgactccctgtacaacgtcaacctcagcaaaggcagagccgccctctccgccactgtcccccgccacgagccccccttccacctggaccgggagatccgtctgcagaggctgagccactcgggcagccgggtcagagtggggttcagactgtgcaacagcacgggcggcgactgcttttaccgaggctacacgtcaggcgtggcggctgtccaggactggtaccacttccactatgtggatatcctggccctgctgcccgcggcatgggaggacagccacgggagccaggacggccacttcgtcctctcctgcagttacgatggcctggactgccaggcccgacagttccggaccttccaccaccccacctacggcagctgctacacggtcgatggcgtctggacagctcagcgccccggcatcacccacggtgggtgccagcccctggccggtgcgggggcaggggtgcaggtcaggtggcctcacaccagcccttggcctcccaggagtcggcctggtcctcagggttgagcagcagcctcacctccctctgctgtccacgctggccggcatcagggtcatggttcacggccgtaaccacacgcccttcctggggcaccacagcttcagcgtccggccagggacggaggccaccatcagcatccgagaggacgaggtgcaccggctcgggagcccctacggccactgcaccgccggcggggaaggcgtggaggtggagctgctacacaacacctcctacaccaggcaggcctgcctggtgtcctgcttccagcagctgatggtggagacctgctcctgtggctactacctccaccctctgccggcgggggctgagtactgcagctctgcccggcaccctgcctggggacactggttctacagctctacaggactggagacccacgcgtccctgttacctccgttgcccaagggcctgcagggacgtcggattcaagctctcaatggggacctccaggttggcttccgcaagtcagctggatggactctggccagctggtgaccaggggtgcggatcaaagcccgacgaagacagctggccaatcaattcgttacggagctcaatacgtcatgagaag

SEQ ID NO: 85187 - DNA, 2620 bp, Homo sapiens
acctgtggggtctctgtgacatcagcaagccccctgccgcgagcttggagaggcaccccagccccatctggcactcaaggaaatcagctcagagaggttgagtaactcgggaaggccacacagccagtgacgaagctgtgattcacacaggcctgggtgactccagcatggctttcctctccaggacgtcaccggtggcagctgcttccttccagagccggcaggcaggaggccagaggctccatcctgcttcagagctgccagctgcccccgcaatggctgagcaccgaagcatggacgggagaatggaagcagccacacgggggggctctcacctccaggctgcagcccagacgccccccaggccggggccaccatcagcaccaccaccaccacccaaggaggggcaccaggaggggctggtggagctgcccgcctcgttccgggagctgctcaccttcttctgcaccaatgccaccatccacggcgccatccgcctggtctgctcccgcgggaaccgcctcaagacgacgtcctgggggctgctgtccctgggagccctggtcgcgctctgctggcagctggggctcctctttgagcgtcactggcaccgcccggtcctcatggccgtctctgtgcactcggagcgcaagctgctcccgctggtcaccctgtgtgacgggaacccacgtcggccgagtccggtcctccgccatctggagctgctggacgagtttgccagggagaacattgactccctgtacaacgtcaacctcagcaaaggcagagccgccctctccgccactgtcccccgccacgagccccccttccacctggaccgggagatccgtctgcagaggctgagccactcgggcagccgggtcagagtggggttcagactgtgcaacagcacgggcggcgactgcttttaccgaggctacacgtcaggcgtggcggctgtccaggactggtaccacttccactatgtggatatcctggccctgctgcccgcggcatgggaggacagccacgggagccaggacggccacttcgtcctctcctgcagttacgatggcctggactgccaggcccgacagttccggaccttccaccaccccacctacggcagctgctacacggtcgatggcgtctggacagctcagcgccccggcatcacccacggagtcggcctggtcctcagggttgagcagcagcctcacctccctctgctgtccacgctggccggcatcagggtcatggttcacggccgtaaccacacgcccttcctggggcaccacagcttcagcgtccggccagggacggaggccaccatcagcatccgagaggacgaggtgcaccggctcgggagcccctacggccactgcaccgccggcggggaaggcgtggaggtggagctgctacacaacacctcctacaccaggcaggcctgcctggtgtcctgcttccagcagctgatggtggagacctgctcctgtggctactacctccaccctctgccggcgggggctgagtactgcagctctgcccggcaccctgcctggggacactgcttctaccgcctctaccaggacctggagacccaccggctcccctgtacctcccgctgccccaggccctgcagggagtctgcattcaagctctccactgggacctccaggtggccttccgccaagtcagctggatggactctggccacgctaggtgaacaggggctgccgcatcagagccacagacagaggagcagcctggccaaaatcaacatcgtctaccaggagctcaactaccgctcagtggaggaggcgcccgtgtactcggtgccgcagctgctctcggccatgggcagcctctgcagcctgtggtttggggcctccgtcctctccctcctggagctcctggagctgctgctcgatgcttctgccctcaccctggtgctaggcggccgccggctccgcagggcgtggttctcctggcccagagccagccctgcctcaggggcgtccagcatcaagccagaggccagtcagatgcccccgcctgcaggcggcacgtcagatgacccggagcccagcgggcctcatctcccacgggtgatgcttccaggggttctggcgggagtctcagccgaagagagctgggctgggccccagccccttgagactctggacacctgaaccagacctgccagggctgtgcgatctcttggcctggtccttgcagctgtggcagcagcaggctccccagcggcccagggtgggccagaccagcagcccaggaagcagcacacgcggccgtggggaggcaggcaccgggcatgtcggcgcctctggtcaaaccacctacactgcctggggtgggtctcaaggaggcccggggcggaggggggttcccgcgtgcacacgagtgcggctggacgtgccgacacgcggtgatgtacccatgctccgtgtgtctgtgtctgcatgtccacacgtctgatgcacctgtgtacgtgtgtcaagcctagccacctcagctgcagggaggcagaaggcaaggcaggccccacggacacacttgggctgctctgaaataaagctgttgactccacctgaaaaaaaaa

SEQ ID NO: 85188 - DNA, 2393 bp, Homo sapiens
ctccttgcctcaaccttgtgctccgatggctgtgctgagctgggtgccccgtcgccctcccaggtccactaggctctgactcttccatgtcacccaaggaggggcaccaggaggggctggtggagctgcccgcctcgttccgggagctgctcaccttcttctgcaccaatgccaccatccacggcgccatccgcctggtctgctcccgcgggaaccgcctcaagacgacgtcctgggggctgctgtccctgggagccctggtcgcgctctgctggcagctggggctcctctttgagcgtcactggcaccgcccggtcctcatggccgtctctgtgcactcggagcgcaagctgctcccgctggtcaccctgtgtgacgggaacccacgtcggccgagtccggtcctccgccatctggagctgctggacgagtttgccagggagaacattgactccctgtacaacgtcaacctcagcaaaggcagagccgccctctccgccactgtcccccgccacgagccccccttccacctggaccgggagatccgtctgcagaggctgagccactcgggcagccgggtcagagtggggttcagactgtgcaacagcacgggcggcgactgcttttaccgaggctacacgtcaggcgtggcggctgtccaggactggtaccacttccactatgtggatatcctggccctgctgcccgcggcatgggaggacagccacgggagccaggacggccacttcgtcctctcctgcagttacgatggcctggactgccaggcccgacagttccggaccttccaccaccccacctacggcagctgctacacggtcgatggcgtctggacagctcagcgccccggcatcacccacggtgggtgccagcccctggccggtgcgggggcaggggtgcaggtcaggtggcctcacaccagcccttggcctcccaggagtcggcctggtcctcagggttgagcagcagcctcacctccctctgctgtccacgctggccggcatcagggtcatggttcacggccgtaaccacacgcccttcctggggcaccacagcttcagcgtccggccagggacggaggccaccatcagcatccgagaggacgaggtgcaccggctcgggagcccctacggccactgcaccgccggcggggaaggcgtggaggtggagctgctacacaacacctcctacaccaggcaggcctgcctggtgtcctgcttccagcagctgatggtggagacctgctcctgtggctactacctccaccctctgccggcgggggctgagtactgcagctctgcccggcaccctgcctggggacactgcttctaccgcctctaccaggacctggagacccaccggctcccctgtacctcccgctgccccaggccctgcagggagtctgcattcaagctctccactgggacctccaggtggccttccgccaagtcagctggatggactctggccacgctaggtgaacaggggctgccgcatcagagccacagacagaggagcagcctggccaaaatcaacatcgtctaccaggagctcaactaccgctcagtggaggaggcgcccgtgtactcggtgccgcagctgctctcggccatgggcagcctctgcagcctgtggtttggggcctccgtcctctccctcctggagctcctggagctgctgctcgatgcttctgccctcaccctggtgctaggcggccgccggctccgcagggcgtggttctcctggcccagagccagccctgcctcaggggcgtccagcatcaagccagaggccagtcagatgcccccgcctgcaggcggcacgtcagatgacccggagcccagcgggcctcatctcccacgggtgatgcttccaggggttctggcgggagtctcagccgaagagagctgggctgggccccagccccttgagactctggacacctgaaccagacctgccagggctgtgcgatctcttggcctggtccttgcagctgtggcagcagcaggctccccagcggcccagggtgggccagaccagcagcccaggaagcagcacacgcggccgtggggaggcaggcaccgggcatgtcggcgcctctggtcaaaccacctacactgcctggggtgggtctcaaggaggcccggggcggaggggggttcccgcgtgcacacgagtgcggctggacgtgccgacacgcggtgatgtacccatgctccgtgtgtctgtgtctgcatgtccacacgtctgatgcacctgtgtacgtgtgtcaagcctagccacctcagctgcagggaggcagaaggcaaggcaggccccacggacacacttgggctgctctgaaataaagctgttgactccacctgaaaaaaaaa

SEQ ID NO: 85189 - DNA, 850 bp, Homo sapiens
ggaggggcaccaggaggggctggtggagctgcccgcctcgttccgggagctgctcaccttcttctgcaccaatgccaccatccacggcgccatccgcctggtctgctcccgcgggaaccgcctcaagacgacgtcctgggggctgctgtccctgggagccctggtcgcgctctgctggcagctggggctcctctttgagcgtcactggcaccgcccggtcctcatggccgtctctgtgcactcggagcgcaagctgctcccgctggtcaccctgtgtgacgggaacccacgtcggtgagggccagggctgtcggcgggaggggtggccgccccagctccttgcccctgtgaccgtctctaaccgaagccccactggcccctgtagccgaggagggggctctgtgtggtcaatgccaccctcctggtcactgtgacctcccaaacctcggtgcccagcccggacctctcggactgccaaggagggggctcagtgtggtcactgccccctggagggacaccagggccctcgggagcctgggaggagaggtgggggtgggcgaggctttccagaaggagggaaggtgggaggggctgcgagcgggctgggctccggggccgacctcaccggcagccacggcctccaactccagctctgggtccagctcaccccactgggcgtcccgagtaggggaggcactgctgtcccgacagcacacactgggatgctggggccagtgtgaggccccgggccggcaactctgactccagggccctgcgtcccaggccgagtccggtcctccgccatctggagctgctggacgagtttgccagggagaacattgactccctg

SEQ ID NO: 85190 - DNA, 361 bp, Homo sapiens
agcaggatttgtactccaacccccgccagaacccccattgccaagtctgagaaactcaggattgggaatggctcccgtagggcatagatttcacttggccttttcctgcccaaacacatgcacctttgccaaatccttccctccagtggctcagatgctttttctatgtgcaaactgtctcagacagtcgtctccactggctaatgttggttcgttcaaagagcaaatgaggctggcaacccatcttggtgctcaccactcacagtgttctgtgggtagaccctgcaccccggacgtggcaagggccttctctccctctctcaaatcctggagggcccagcacaccctgactcatcctgga

SEQ ID NO: 85191 - DNA, 126 bp, Homo sapiens
tttctgaagtttatatttaatgcctgtcacataccctcattggggataattgaaaaagtcgaagtgcagggcttccaccctcccccgctgcaccatcctggtattcggtcataggggtggttttgc

SEQ ID NO: 85192 - DNA, 143 bp, Homo sapiens
gtgctggcatttcagccgtgagccatggcactctgcctctgtcttcttttctagactgtaagctccaaggcaggggctgggtctgcccttgtcattttttaaaaacgtattttattttttatttttgaaatggggtctttctc

SEQ ID NO: 85193 - DNA, 447 bp, Homo sapiens
cctggatcattacaaaagcctcctaattagttctcctgcttcagtggttctgctctcaacagtctaatctctgtgtagttgtttgtgtcctttgaagggttcggtcagattacagcaatccccagctcaacaccttctaatgatttcttgtctcactcagtagaagccaaagacttcacaattacctataaggtcctaaatgatatttttggttgcctctctgatcccatctcttagtactcacttctttactcccacatagtcatactggtcttgttaactgttgctgaaacatagttgaagcacaagcctgcttcaggtgtttaaacttggactgttctccccttagatatctgcatggcttgctccctaactttctaaggtttatgatcaaatgttaccttattagtgaggccttatctgactaccctatatttaatagccata

SEQ ID NO: 85194 - DNA, 416 bp, Homo sapiens
gtacacaggcaacaaatagcatgacgtatggaatggtacctcacacatctcaatactaacattgaatgtaaatggcctaaatgctccactttaaagaaacagaacagcagaatgggtaagaattcaccaaccaactatctgctgccttcaagagactcacctaacacataaagactcacataaacttaaagaagcagaaaaaggcatttcatgcaaatggacaccaaaagcgaggagtagctattcttacaaaagacaaaactttaaagcaacagcaattaaaaaaaagacaaagagggacattatataatggtaaaaggctttgtccaacaggaaaatatcacaatcctaaacatatttgggagctgcacacctaaaagaggagctcccaaatttataaaacaattactgctaga

SEQ ID NO: 85195 - DNA, 447 bp, Homo sapiens
actgaatatctgaatgaatgcttgggtttgctgtcatgcttctcttagcatttatttctccattggaagagcagccatgaggttgactgggactacccccactgccaggttcaggtatgtaccctcattggcttaaatcaatcagcaaaattccttcccttctgtcatggtgattgatgcagaggtaaatgtcaatggcttatgactttaggccattgcttgggaagcttgatttttctgaataatctggtatgggaatgtgaaccctaaactatagcttccattttgtcctcaagagggaagctagcctaaagttaaaggtggcacttaaaaaaggaagatccaagagaatataaaaaattggagccagagccctcatcaaactgtctcatgatttctgggctttcagttgtatcagccaataaattaaccttattgttaatgcca

SEQ ID NO: 85196 - DNA, 440 bp, Homo sapiens
ggtcaggggcacattctacaagggaaaaacagctgatacagaagcctgaaaggaaaagcgggcagagcacctgtacaggactcttacctgcggcatctaccatacaatgcgcctttccagaacacagcagtgcgcagccagcccctggggagagggatcactcaaacagcaccagaggctgcattccaacttttcttccatcaacgactccgttttcattgttagtttctccttcaacacaaacttgaaaccaattggctgaacacgcgggagcaaggaaaacctgactgaagaatgaggcgttaaaacttaagggccttgggtcctggcgcggtggctcacacctggaatcccagcactttgggaggcagaggtgggtcatttgaggtcaggagtttgagaccagcctggccaaacacggtgagaccccgtctctacta

SEQ ID NO: 85197 - DNA, 852 bp, Homo sapiens
  misc_feature (449)..(449): n is a, c, g, or t
  misc_feature (591)..(591): n is a, c, g, or t
ctttgaaaaagacttcttttgagctaactttcttatactggtacctttctaatctcactacaatatgtaacattggtgttcgatctcaagtatttctgaatatattcccctatccacagaaatatactctgggggaaaaaaaatagaacaaattcttgccgtcctgaccattgaacaagagactaattagacaatggggctagaaaaacctcaaagtaaactggaaggaggcatgcatccccagctgataccttcggttatgctgtagttttcatcttacttctcagtgtctgttttattgcaagttgttggtgactcatcacaacttttcacgctgtaagagaggcacaggagtgcacaagttagagcaccatgcaaagctcaaatgcatcaaagagaaatcagaactgaaaagtgctgaagggagcacctggaactgttgtcctatngactggagagccttccagtccaactgctattttcctcttactgacaacaagacgtgggctgagagtgaaaggaactgtcagggatgggggcccatctgatgaccatcagcacggaagctgagcagaactttattattcagtntctggatagacggctttcctatttccttggacttagagatgagaatgccaaaggtcagtggcgtgggtggaccagacgccatttaacccacgcagagtattctggcataagaatgaacccgacaactctcagggagaaaactgttgtagacttgttaataaacccaagataaatgggcctggcaatgatgtttcttgtaaactgtgaagccacgtaggattgtcaaaatacctggaaacaacatgaactagaacactctaa

SEQ ID NO: 85198 - DNA, 277 bp, Homo sapiens
gaactttcattatcatctccatggccctaattggttatgagcccattgctacaccccaatacttgtcatgaagagaatgatatatgatgacaggtctgacatgggtttttaatgagaagggtgccaagactaccagaattggctgagtgataatagattggcagacatttgcttgggataaatttattttgttttttaaagaaaagctagataatcctttcccttggtgagaggattcctgcaagtggtggcatgcataagccttttatactaagca

SEQ ID NO: 85199 - DNA, 387 bp, Homo sapiens
catagactatgacccaactctctttcgtaatcactgcattgatcctgagggagaaactggttgctaatgatttatcttagctccactgagacccatgctaatactgcctgctccagagctgcacatattaatattgtgttactactttacttggttttactggtccgtggatattgctaataaatcatgcaacccattttaattgaattgattttgataaaggtaggaaaagagtaggtgagctgctatccaaggttatgccctatctcgcattgctgagtgaccctattgcatcagctatttctgccagaaatctgcttttgtgaagggaccgttggctcactaaaacctccactcccaggaccaaagggagtgttctggtgaggc

SEQ ID NO: 85200 - DNA, 652 bp, Homo sapiens
aattttaaaactcaaaagagaaatagctaggcctcagtgttcctagccagccccatggaatcaagagagtgcagctgatcaatgtacatcaaaaagccaggccctacctgggactggcacagcatggggacagcatgcaggaggtgcatgggacaaatggcacctgggtttgggcttgagaggcatagtgaaaagacccactagcagtcactttccattttctgtttctgactccaagcaagcagagcagcagttcttcttcctgggtgggacaggttaagaagaccagtaaagggtctctccctcgccacttgtagctacactatctttcctgttcacattcaggtgtgtcttcctcatgaggactgagatgaagaggggtccagactaaagcactgtttgcacgggatttttttaaatagaatttgttatagcgatatcagtaaagcaagagttatgccaaatgctcatagtaggagtttacttcgacctctttttttttccccactcaatactgccaccagttaagacttagacttctcagggaaatccatttgctctgttaaggaaattaatagtaaatagaaatatgttagcttattttaatagatcaatgttagtgtcaaggtttgtctgcaagcagtgaatgaat

SEQ ID NO: 85201 - DNA, 376 bp, Homo sapiens
  misc_feature (5)..(5): n is a, c, g, or t
  misc_feature (11)..(11): n is a, c, g, or t
agatnttgaanaaaggaaaggtcttttcatcttgatggccccaaagcttgttggtcatggtctttatttctggccactatcttcttaaataatatatttttaagccctcatttatttttggttttgggtgaggaaagtcatgttttctaagtcctctcccctaataaaacctacccaacaatagtgctttgaaaagtggtagttatcttgaagatactcttgccaaatgcaaagataaacattcttttttttaaatgagtcatcttggggtttttataattcccttatgttcttgcccctctacacttgaaataacaaaatgccttaattttatggattagttctcttatagtagacaggcagctatatgcagcaa

SEQ ID NO: 85202 - DNA, 365 bp, Homo sapiens
ttttttaacaaatgtagatatcaataaaattgaaagttagattttccaaatagtaggcctagtgcaaaagacacccaacatgtataggaaatcaaacaaagctatgtgcacagaactgaaatgagttgggctgggaagccttctagaaaaagaagctttcacattattttattcctttctaaacatcaattggtcagtcaaagttttaaaagcaatagtaatttttccctttagagaacattaatgatgtttcagactaatactgacactaaataaaaatacaaattgtcaccaaagtatctgtttttcctccttccatttctcctgggaagctcttactcatccttcagccttcagcttgtact

SEQ ID NO: 85203 - DNA, 428 bp, Homo sapiens
tcttcttctgcaaagaactctcaacattttactcgtttaaaaagtttgattgcttgctctttgattactgagttgtaggaattctttatgtatatatatggttaggtatatgtattgtgaatatttttccccagtgtctggcttggccaattcattttttcatggtgccttttgaaaaacagacgttttcaattttgatgaagtactctggttctgcaagccagtaaaatgggtagtttctcaccagtttttctgtcctggggcctgcccttaggcaaaaaaccataaaaccggaatgtcacccagcacctctcccttctaagtattgaggtctaacatccacttggttttggtctctctccaggaccttcagggagttgtccagagcttatagttgttttcttctgcagttgatctaataggatctt

SEQ ID NO: 85204 - DNA, 250 bp, Homo sapiens
ggaacaaataaaacaggtatttcttcctttgtggccatccactggtttagaatggagttcaaaatctatgaggacttttctttgtggtatttttaataaaatcaaagaggtattcttaagtattgagagcacacctggacaatgacccagaagtacagcatgtactataaaaaattgatgacttagatttttttttactttagctttattctacagatatctcactatgaagacttttctatatgatata

SEQ ID NO: 85205 - DNA, 792 bp, Homo sapiens
tgtgtgtgtgtgtgtgtgtgtgtgtgtgtgtgtgtgtattttgttttttttacaagcccacaacatcatagctttgcagtttttaaccaggagctggtggagatctttgaaatcatttaggccaattcttttagttacatttatgatgaaactagggatctaccttaaagttttgggaagctctttcaaaacttcagacacctagaaatatatatagtgcagttcagttttagtttctgcagcatggtttggaaacaaaagatacataggatttaaactcgatttgttttcttcttacagtagaagtaaatgctcttgtggcttgaatcgcatctcccaagaaagatacgttcacgttcaaacccccagtactgtacatgtgaccttatttggaaatagggtctttttagatgcagtcaagatagaattagatcatactggattacagtgggccccaataactaggtttttttgttaaaaaaaaaaaaaaggaaatgtgaacagagagagaatgccgtgagatgatggagggatagattggaatgatgtctgcgagctaaggaatactgaggattgctgccaaccatccgaagctgggagaggagatggaacaactccctcggagcctccaagaggaaccaaccccactgatgctttgatttgggatttccggcctgaactgtaggaaaataaatttctgttcttttaagccatttttaccagtttgtggtaacttgttacagcagctgcaggaaattaataaatgccaatgttgaaaattaaaatctaaaa

SEQ ID NO: 85206 - DNA, 735 bp, Homo sapiens
attcaaaatggccaggttagggtcctcttcttaggatcagaaggcactactgaccaccagcattctttccaaccaggcagttccatccaggaacaggtatccttgttggtaactgcagccaagagtctgtgcattagaggttaagcgtcgtgttcaagatcacaaagccagtgaatggctgagctgggactccaactccaagtcttctgactcaaatccagtgacttactcaacacaaactttctgaatacaaatggttgtcctatgtatggcagtgtattaagaagggccaccagcccactgatttattcacttttcagtttatacttggacatggataaaatcctatggacttgctgaaccaaaagaaatgagcattttgaagcctttgaacattttgtcaaatgaccctccaagagaatgtaaactctcgctcagcgccaagcacagcatcatcagtgcctgtcaaagtgcctcgcatatagttcatcctcgataaatacatgttgaatagatgaatgcacaggaaaaaggaaataattttagtattgcgctaaccaagcataatactcaagctaaaactaatgtaaaacttaccaccagctgccttccggaaacaagtgaaaaaagacaagagacaccacaaacaatggtgagtcaagactggtcagtaactacagatcccaaagctccagctgaagatggctctcctacatcagactgatctaggagaac

SEQ ID NO: 85207 - DNA, 342 bp, Homo sapiens
ctttctctgcattttcccaaaattgccaccatgggtgcacatagcatatacggtgttatgaggatgttagactcaaggaaaccagctctgccacttgctagctgtctgaccttgggggaattacctaatttcttcatctgtaaagtgggaatagcgacagaacctttcttagaggtttgctccaaggattgtataaggtaacatatgtgaaatcctagcacggcatctggaatgtggcatgtgctcaggaaatgccagctagtataactggacaagcatttgtaactcgtgaaagcatgataccgtttttaaaaattaaaaccacaaatggcgactctccca

SEQ ID NO: 85208 - DNA, 214 bp, Homo sapiens
agagtagtggttgcctgggattgggctggggacaggagggaagtgggtgtggctgtgataggacacaggcagggtccttgtagtgatggaacgttctgtctggactgtgtcagtgtttgtacctgggtttgatattatactatctttttgcagggtgtttccatggatggaaactgtaaggggtacatgggatatctctgtattattgttttac

SEQ ID NO: 85209 - DNA, 343 bp, Homo sapiens
ccaggagtggtggctcacgcctgtaatcccagcacttgaggctgaagtggaaggatcgcttgaggctcaggagttcaagacaagcctagggaacatggctgtctctacaagcagcaaaacgttagtcgggcatggtggagcatgccggcagtcccagctactcaggaagctgtggtgggaggatcacttgagcgggggcgaggaaggggtcaaggctgcagtgagccatgatcataccactacactccagcctgggcaacagaggaagaccctgtctcaaaaaagaaagaaagaaattaaatatgtatctgtcatatgatcccaaaattctgataggtgtttt

SEQ ID NO: 85210 - DNA, 498 bp, Homo sapiens
tatttatttattttttaccagaaacacgtgcactttattgaatgccattgtagaaaagcgtgtgaggataaagggctgatacaggactcggctccgggggcagggcgaggaatggaagttggagtacgtgggatacaggtcatgggcagagctcctggcctcagtgatgcctcctgatctatccataggcctggaagatcagcactgggatgacgatgagcagaatggtcatgaggatgcccagaatcagggcccagatgttcaggcacttggcggtggaggcataggcctgggccccggtcacgtcgccaaccatcttcctgtccctagacttcacggagtaggcgaatgctatgaagcccaggcagcaggggttcatgaagagggtgttgaacagggaccagacgaacatggtcgggcacggaggtctcgctgcggatgtggatcacggtggacgtcggggaacagggtgttggggcggccccacaaagcaacttc

SEQ ID NO: 85211 - DNA, 417 bp, Homo sapiens
tcagaaagagcaagcagaatatttttggaaataatgaaaaatccactgatacatttagagctttcggtgggtctaagatttaagtggcgtaggagaaaagaaactgagatgtattacttgtacatttttcttctgacaccttgatattccagtttaaactacctcgaattatgccacaaatcagtgtctttaagtccacagattcttaggtctttgagatcaattcacccctagttatacagatagcaaactgttaagaaaccagtctaaagttttcttgcttctttgtgctaagttcaccagaattcaagcctctgacttttttaacgatggtgctcccttttcttataccacaacgtggatttgctcatggttatcttcctttaataaattcttgccacaagtgaatttaggctg

SEQ ID NO: 85212 - DNA, 383 bp, Homo sapiens
gacaattaattaagagtccagcagggttcccgctggcagaggcgcggtccgggagccgggaagccacagggcggtgctgaattgggacaggtaacagcagggagggaactgttttcacctgcagggctgaaggagcgcggccagagcggttacaggaagccagacaaagagagagagatacttaacaggagctgcgacctatggccaagggacacagccagcccttgatgacccagcagagagagccagggaagaggccaggcgcggtgactcgtgccagtaatcccagcactttgagaggctgaggcggacagatcgccggagctcaggagttcgagaccaccctgggcaagatggcaaaaccccatctctactaaaataca

SEQ ID NO: 85213 - DNA, 514 bp, Homo sapiens
  misc_feature (62)..(62): n is a, c, g, or t
  misc_feature (119)..(119): n is a, c, g, or t
agaggatcccggagctggttctcattaactttttatgggtctcaaaattctgtgacaatttntggtcagttgtttccattaaaaagtactgattttaaaaactaataacttaaaactgncacacgcaaaaaagaaaaccaaagtggtccacaaaacattctcctttccttctgaaggttttacgatgcattgttatcattaaccagtcttttactactaaacttaaatggccaattgaaacaaacagttctgagaccgttcttccaccactgattaagagtggggtggcaggtattagggataatattcatttagccttctgagctttctgggcagacttagtttagactctggactctctcagccttggtttcactagttagctctatcactaactacattgggcattgaaaattcctctgttgtcccacgtggtgcatggatgattgtagacgaggacactgagatcctgaaggcagaagtaatttctctaagcaacgttgttggttggtgg

SEQ ID NO: 85214 - DNA, 507 bp, Homo sapiens
gactgggtaggagaatggctagactgacagccctgtgatttggcccttttcctttggaggggtgtgaatctgatgctgtaacaatttctgccttctgttggtggtatggcttggccgtgtccccacccaaatctcattttgaattgtagctcccacagttcccatgtgtcgtgggaagaacccggtgtgagataattgaatcatgggggcagcttctcccatacagttctcctagtagtgaataggtctcacgagatctgatggtctgataaagggttaaccctttcacttgcctctccttctctcttgcctgctgccacgtaagccatgcctttcaccttccaccatgattgtgaggcctccccaaccacttggaagtatgagtccattaaacctttttttctttagaaattacccagtcttggtatgtctttatcagcagcgtgaaaacaaactaatacagccggttaatatccctgcagttccctccacccgcatctcttccct

SEQ ID NO: 85215 - DNA, 404 bp, Homo sapiens
atgtactgtgtgtttcatacacatgtttcctttagtcttaaaatctggctcatggggtaaacactattataatctccatcctccagatgaggaaagtgagacttagaggttaagtacattttaggataaagtagggtatttcgataaatgtttcaaatgtgtttctggtctctgaggactacactcccaggctgctggggatacaaaataccctttctttaccataggagcacttgggtagaatatttgcagaaacaataaactggctgatatttaaagttctcttcagctctgacattctataatttcattgaccctctttgcatttaattatgttgatttttctttctaccccttgcttagctaaaaatataccccttctttgtccatgcacaggagatgga

SEQ ID NO: 85216 - DNA, 2432 bp, Homo sapiens
  misc_feature (451)..(452): n is a, c, g, or t
  misc_feature (483)..(483): n is a, c, g, or t
ccctctgtgtcgtaccaacagccgcatcgttccgaggctgtggaggccgggcgcagcggcgtcaagatggcggctgcggcagtggcggcggcggcggcggcggccgcggctgcatctcttcaggtactggagatggagagcatggagacggccgccgccggctcggcaggactggccgccgaggtccgaggcagcggcacggtggacttcgggcctgggccggggatctctgcaatggaggcgagcgggggcgatccgggcccagaagccgaggatttcgagtgcagctctcactgctcagagctgtcctggcggcagaacgagcagcggcgccagggcctcttctgcgacattaccctgtgcttcggcggggctggaggccgcgagttccgggcccaccgctcggtactggctgccgccaccgagtacttcacgcccctggctccttcgnngggggggggcccccccaggggttttttttcnccggaaggttttcccccccccggggccccttttcggacgggtggagatgcgcaagtggagctccgagccggggcccgaacccgacacagtggaagccgtaatcgagtacatgtacaccgggcgcatccgcgtcagcacgggcagcgtgcacgaggtgctggagttggccgacaggttcctactcattcgtttaaaagaattttgtggagaatttctcaagaaaaaacttcatctctcaaattgtgtggcaattcatagcttagcacacatgtacaccctgagccaacttgctctgaaggctgctgatatgatacggagaaatttccacaaagtgattcaggatgaagaattttatacgttacctttccatctcattagagactggctttcagatttggaaattacagttgattctgaagaggttctctttgaaaccgttttgaaatgggttcagagaaatgctgaagagagagagagatactttgaagaactttttaaattgctcaggttgtcccagatgaaacctacctaccttactcgacatgtcaaaccagagaggctggtagccaataatgaagtttgtgtcaagttggtcgctgacgcagtggagagacatgctctgagagctgagaatatacaatctggcacatgccagcaccccacttctcatgtgtcactattgcctcgttatgggcaaaacatggatgtgatcatggttattggaggtgtgtcagaaggaggggactatttaagtgaatgtgtgggatattttgttgatgaggacagatgggtaaatctgccacatattcataatcacctcgatggacatgctgttgcagtaacagaatcctacgtgtatgttgctggatcaatggagccagggtttgctaaaactgtagaaaggtataacccaaatttgaatacatgggaacatgtttgtagtctgatgacaagaaagcattcttttggactaacagaagtcaaagggaagctctatagcattggaggacatggcaactttagtcctggttttaaagatgtgactgtttataatcctgagcttgataaatggcacaacttggaatcggcaccaaagattcttcgagatgtcaaagcactagccattgaagaccggtttgtatacattgccgcccgcactcctgtagaccgggacactgaagatggattaaaggctgtaattacttgctatgatacagagactcgacagtggcaagatgtggaatctttgccgcttattgacaattactgctttttccaaatgtctgtggtcaattcaaacttttatcagacagcatcatgttgtcccaagagttattgtttagaaaacgaagaggcagtaagaaaaattgccagccaagtgtctgatgagatccttgaaagcttgcctccagaagtcctaagcatcgaaggagcagccatttgctattacaaagatgatgtcttcattataggaggctggaaaaacagtgatgatattgataaacagtatcggaaagaagcctaccgatattgtgcggagaggaagaggtggatgcttcttcctcctatgccacaacctcgttgtagagccactgcttgtcacgtgaggatcccataccggtacttgcatggcacacagagataccctatgcctcaaaacctgatgtggcagaaggaccgcatcagacagatgcaagagatacatcgtcacgccctgaacatgaggcgagtgccaagctctcagattgaatgctaggttctctcaagcgtgccgattaaaactgttacacccgtttcgtgaagctgaagatacccaggctgttatttaaaaaagtatgtcgataacttattttctacatgaactgattattaccccatataaaggaaatagagttaaaaactaaagaatgggagactcagttcaatacatggtcattttgttagcttgc

SEQ ID NO: 85217 - DNA, 2386 bp, Homo sapiens
ccctctgtgtcgtaccaacagccgcatcgttccgaggctgtggaggccgggcgcagcggcgtcaagatggcggctgcggcagtggcggcggcggcggcggcggccgcggctgcatctcttcaggtactggagatggagagcatggagacggccgccgccggctcggcaggactggccgccgaggtccgaggcagcggcacggtggacttcgggcctgggccggggatctctgcaatggaggcgagcgggggcgatccgggcccagaagccgaggatttcgagtgcagctctcactgctcagagctgtcctggcggcagaacgagcagcggcgccagggcctcttctgcgacattaccctgtgcttcggcggggctggaggccgcgagttccgggcccaccgctcggtactggctgccgccaccgagtacttcacgcccctgctctcgggccagttttccgagtcccgctcgggacgggtggagatgcgcaagtggagctccgagccggggcccgaacccgacacagtggaagccgtaatcgagtacatgtacaccgggcgcatccgcgtcagcacgggcagcgtgcacgaggtgctggagttggccgacaggttcctactcattcgtttaaaagaattttgtggagaatttctcaagaaaaaacttcatctctcaaattgtgtggcaattcatagcttagcacacatgtacaccctgagccaacttgctctgaaggctgctgatatgatacggagaaatttccacaaagtgattcaggatgaagaattttatacgttacctttccatctcattagagactggctttcagatttggaaattacagttgattctgaagaggttctctttgaaaccgttttgaaatgggttcagagaaatgctgaagagagagagagatactttgaagaactttttaaattgctcaggttgtcccagatgaaacctacctaccttactcgacatgtcaaaccagagaggctggtagccaataatgaagtttgtgtcaagttggtcgctgacgcagtggagagacatgctctgagagctgagaatatacaatctggcacatgccagcaccccacttctcatgtgtcactattgcctcgttatgggcaaaacatggatgtgatcatggttattggaggtgtgtcagaaggaggggactatttaagtgaatgtgtgggatattttgttgatgaggacagatgggtaaatctgccacatattcataatcacctcgatggacatgctgttgcagtaacagaatcctacgtgtatgttgctggatcaatggagccagggtttgctaaaactgtagaaaggtataacccaaatttgaatacatgggaacatgtttgtagtctgatgacaagaaagcattcttttggactaacagaagtcaaagggaagctctatagcattggaggacatggcaactttagtcctggttttaaagatgtgactgtttataatcctgagcttgataaatggcacaacttggaatcggcaccaaagattcttcgagatgtcaaagcactagccattgaagaccggtttgtatacattgccgcccgcactcctgtagaccgggacactgaagatggattaaaggctgtaattacttgctatgatacagagactcgacagtggcaagatgtggaatctttgccgcttattgacaattactgctttttccaaatgtctgtggtcaattcaaacttttatcagacagcatcatgttgtcccaagagttattgtttagaaaacgaagaggcagtaagaaaaattgccagccaagtgtctgatgagatccttgaaagcttgcctccagaagtcctaagcatcgaaggagcagccatttgctattacaaagatgatgtcttcattataggaggctggaaaaacagtgatgatattgataaacagtatcggaaagaagcctaccgatattgtgcggagaggaagaggtggatgcttcttcctcctatgccacaacctcgttgtagagccactgcttgtcacgtgaggatcccataccggtacttgcatggcacacagagataccctatgcctcaaaacctgatgtggcagaaggaccgcatcagacagatgcaagagatacatcgtcacgccctgaacatgaggcgagtgccaagctctcagattgaatgctaggttctctcaagcgtgccgattaaaactgttacacccgtttcgtgaagctgaagatacccaggctgttatttaaaaaagtatgtcgataacttattttctacatgaactgattattaccccatataaaggaaatagagttaaaaactaaagaatgggagactcagttcaatacatggtcattttgttagcttgc

SEQ ID NO: 85218 - DNA, 320 bp, Homo sapiens
  misc_feature (48)..(48): n is a, c, g, or t
tatatctcttcttctccatcaaaaagaacccttagaggaaccgatcanactctgtaataaaccatacattcggggttcctcttccccaccgaagaaagcaaatcatatcatgcaacatttgccagttgagatttaattctgatgtctgtgtggcatgtcgtaaaaggaacatggcggccaaggtatttggagatatggactaatcactttgggtcataattaaacaattgcaggcttgaccatttaccagatgattattgtattagtcttctattgctgctaaaataaatcaccacaaactcagtggcctgaaacaacac

SEQ ID NO: 85219 - DNA, 2074 bp, Homo sapiens
aaagcttcccgagagccatggttggtccaggcaggcagtcggagcacctcgtggagcggctgctaacccagggtggggtggggtggggtggaggggtctgcttgtagtactctcagtcctgatgtcacaggcgcggcaaggacatcgcaaggaggagtcggattacagtaaggatgggcagtgcagcaggcagcccgagcgcactctccagccgccggggatcttagccctggaaaggcagcctgcaaggcgctcatcccgcggaggaggcacgctctcggcgctcactgctctccacgccggggacatttccaccgaatgtagcatgaaagggctctgctctacgtgccagccttgggtgagagctgatgctgaagacaccgcggtgggattccagctgtctgattaatgagaaacataatgtattttggtggtacatgccagagtcctgctctcccggcccttgtccgtccaccagcccctcctttgcaaccatcgctggatattaaaccatttcttccctttcctcttgacactgcagctgcagtcaacctcttccccaatttcaatgcgatggacccgattcagaaagctgtaataaaccatacattcggggttcctcttccccaccgaagaaagcaaatcatatcatgcaacatttgccagttgagatttaattctgatagccaggctgcggcccactacaaaggcacgaaacatgccaagaagctcaaagcactggaagccatgaaaaataagcagaaatctgtaactgccaaggacagcgcaaagactaccttcacctccatcactaccaataccatcaataccagctctgacaaaacagggggaaaaaaaggtgcaatgaagccctgtggtttattcttaccattctgcacaagagacggtactgcagggacaccagcaatatcaacgacgacaactgtggaaatccgcaaaagcagtgttatgacaactgagatcacctctaaagtggaaaaaagcccaacgacagccactggcaatagctcatgtccttctactgagaccgaggaagaaaaggcaaaacggcttctttactgttcgctatgcaaggttgctgtcaactctgcctcgcagctggaggcgcacaacagtggtactaagcacaaaaccatgttagaagcccggaatggaagtggcactatcaaagcctttcctagggcaggagtgaaaggcaaaggacctgttaataaaggaaacacaggcctccaaaataaaacatttcactgtgaaatctgtgatgtgcacgtcaactcggaaacgcaacttaaacagcacattagcagtagaaggcacaaagacagagctgctgggaagcccccgaaacctaaatacagtccttacaacaaactacagaagacagcacatccactgggggtaaaattagtattttcaaaagaaccttcaaagccattggctccacgaattctaccaaatcctctagcagctgcagcagccgcagcagcagtggcagtgagttcccccttcagtcttcgaactgctccagcagcaacactgttccagacttctgcgcttcctccggcactcctgcggccagctcccggacccattcggaccgcccacactcctgtgctgtttgctccttactaaattccaaataggagtaattgtactgcaataatttttcaaaaaacaaaaaacaaaacaaacaaaagagaactatgcagtgtttatttatagtttaaagtatatctgaagagccaggacttttgatagtgaattgaaaaggttataaaaaagtgggggaggtttgggggtgggagggagggagtggtattttctccacattaaagcattcctcttgaacgctgattgttttagaagtgatctccagcattgatttgtagtggtatctagaccttctgaagcctctgtgactgtgcttttgggcacctatttccctctgcattgtctgtcctgctttatgaaacaactatacattgtctaagggcattaactggttccaatgtatataaaataatttactctgtagattaaaatcgtacaaaaa

SEQ ID NO: 85220 - DNA, 1290 bp, Homo sapiens
aaagcttcccgagagccatggttggtccaggcaggcagtcggagcacctcgtggagcggctgctaacccagggtggggtggggtggggtggaggggtctgcttgtagtactctcagtcctgatgtcacaggcgcggcaaggacatcgcaaggaggagtcggattacagtaaggatgggcagtgcagcaggcagcccgagcgcactctccagccgccggggatcttagccctggaaaggcagcctgcaaggcgctcatcccgcggaggaggcacgctctcggcgctcactgctctccacgccggggacatttccaccgaatgtagcatgaaagggctctgctctacgtgccagccttgggtgagagctgatgctgaagacaccgcggtgggattccagctgtctgattaatgagaaacataatgtattttggtggtacatgccagagtcctgctctcccggcccttgtccgtccaccagcccctcctttgcaaccatcgctggatattaaaccatttcttccctttcctcttgacactgcagctgcagtcaacctcttccccaatttcaatgcgatggacccgattcagaaagctgtaataaaccatacattcggggttcctcttccccaccgaagaaagcaaatcatatcatgcaacatttgccagttgagatttaattctgatagccaggctgcggcccactacaaaggcacgaaacatgccaagaagctcaaagcactggaagccatgaaaaataagcagaaatctgtaactgccaaggacagcgcaaagactaccttcacctccatcactaccaataccatcaataccagctctgacaaaacagggggaaaaaaaggtgcaatgaagccctgtggtttattcttaccattctgcacaagagacggtactgcagggacaccagcaatatcaacgacgacaactgtggaaatccgcaaaagcagtgttatgacaactgagatcacctctaaagtggaaaaaagcccaacgacagccactggcaatagctcatgtccttctactgagaccgaggaagaaaaggcaaaacggcttctttactgttcgctatgcaaggttgctgtcaactctgcctcgcagctggaggcgcacaacagtggtgagatgcagcgatttcttttttgtttcaacagctctgcaattatcttcctctgaatagattagatcttttgcagcaggggacaaaggggtggaggaaaactggcaattattacatggaaatcattaaccattaaaaaataaaaatgacga

SEQ ID NO: 85221 - DNA, 861 bp, Homo sapiens
aaagcttcccgagagccatggttggtccaggcaggcagtcggagcacctcgtggagcggctgctaacccagggtggggtggggtggggtggaggggtctgcttgtagtactctcagtcctgatgtcacaggcgcggcaaggacatcgcaaggaggagtcggattacagtaaggatgggcagtgcagcaggcagcccgagcgcactctccagccgccggggatcttagccctggaaaggcagcctgcaaggcgctcatcccgcggaggaggcacgctctcggcgctcactgctctccacgccggggacatttccaccgaatgtagcatgaaagggctctgctctacgtgccagccttgggtgagagctgatgctgaagacaccgcggtgggattccagctgtctgattaatgagaaacataatgtattttggtggtacatgccagagtcctgctctcccggcccttgtccgtccaccagcccctcctttgcaaccatcgctggatattaaaccatttcttccctttcctcttgacactgcagctgcagtcaacctcttccccaatttcaatgcgatggacccgattcagaaagctgtaataaaccatacattcggggttcctcttccccaccgaagaaagcaaatcatatcatgcaacatttgccagttgagatttaattctgatgtctgtgtggcatgtcgtaaaaggaacatggcggccaaggtatttggagatatggactaatcactttgggtcataattaaacaattgcaggcttgaccatttaccagatgattattgtattagtcttctattgctgctaaaataaatcaccacaaactcagtggcctgaaacaacac

SEQ ID NO: 85222 - DNA, 445 bp, Homo sapiens
caaaattccaatggaactgacaagctttatttctatttgttgtatttcttttttctcattacagatggacccgattcagaaagctgtaataaaccatacattcggggttcctcttccccaccgaagaaagcaaatcatatcatgcaacatttgccagttgagatttaattctgatgtaagtttatcatttagtgttcacttaaaaaaaaaaaatacattttgctgttctaatcttgcaggagaaaagatttcttaagacattttctccagtaactgagcatgtcaaaattcaaagataacattttaactcactatgtgctttaattttggagtttattatgttatgtttggttgtttactacagaaaattcacatgtaaacaagcttaaatacttgcagtttaatatttttatttatttatttattttttagtcttttgggaatg

SEQ ID NO: 85223 - DNA, 473 bp, Homo sapiens
actgaagccccattccacaacgtattagcaacctgttttgatgccaaagccaaatagtgacagttgcagtaatgaatatttgctacagggcgctggcagaaaaatggcacagaaatgcaagcccaaaccatctcaaatctttctcttctcactgaatttcacccattatttttaactccttgtcacatatattgtcccagagtctttggtagagtagtgcaaagaaatctgaatcagcctttgggaaacagtaagaaaagcgaatcgttttcctactttctcatcttttgcagggggaaaaaaaggtgcaatgaagccctgtggtttattcttaccattctgcacaagaggttagttgagagctataggttttccttttctttcctccttctaaatgattttaagcaacttaataccttagcattatggtatttggatatacgtaattgactctagcttgggccacgcttagt

SEQ ID NO: 85224 - DNA, 2017 bp, Homo sapiens
aaagcttcccgagagccatggttggtccaggcaggcagtcggagcacctcgtggagcggctgctaacccagggtggggtggggtggggtggaggggtctgcttgtagtactctcagtcctgatgtcacaggcgcggcaaggacatcgcaaggaggagtcggattacagtaaggatgggcagtgcagcaggcagcccgagcgcactctccagccgccggggatcttagccctggaaaggcagcctgcaaggcgctcatcccgcggaggaggcacgctctcggcgctcactgctctccacgccggggacatttccaccgaatgtagcatgaaagggctctgctctacgtgccagccttgggtgagagctgatgctgaagacaccgcggtgggattccagctgtctgattaatgagaaacataatgtattttggtggtacatgccagagtcctgctctcccggcccttgtccgtccaccagcccctcctttgcaaccatcgctggatattaaaccatttcttccctttcctcttgacactgcagctgcagtcaacctcttccccaatttcaatgcgatggacccgattcagaaagctgtaataaaccatacattcggggttcctcttccccaccgaagaaagcaaatcatatcatgcaacatttgccagttgagatttaattctgatagccaggctgcggcccactacaaaggcacgaaacatgccaagaagctcaaagcactggaagccatgaaaaataagcagaaatctgtaactgccaaggacagcgcaaagactaccttcacctccatcactaccaataccatcaataccagctctgacaaaacagacggtactgcagggacaccagcaatatcaacgacgacaactgtggaaatccgcaaaagcagtgttatgacaactgagatcacctctaaagtggaaaaaagcccaacgacagccactggcaatagctcatgtccttctactgagaccgaggaagaaaaggcaaaacggcttctttactgttcgctatgcaaggttgctgtcaactctgcctcgcagctggaggcgcacaacagtggtactaagcacaaaaccatgttagaagcccggaatggaagtggcactatcaaagcctttcctagggcaggagtgaaaggcaaaggacctgttaataaaggaaacacaggcctccaaaataaaacatttcactgtgaaatctgtgatgtgcacgtcaactcggaaacgcaacttaaacagcacattagcagtagaaggcacaaagacagagctgctgggaagcccccgaaacctaaatacagtccttacaacaaactacagaagacagcacatccactgggggtaaaattagtattttcaaaagaaccttcaaagccattggctccacgaattctaccaaatcctctagcagctgcagcagccgcagcagcagtggcagtgagttcccccttcagtcttcgaactgctccagcagcaacactgttccagacttctgcgcttcctccggcactcctgcggccagctcccggacccattcggaccgcccacactcctgtgctgtttgctccttactaaattccaaataggagtaattgtactgcaataatttttcaaaaaacaaaaaacaaaacaaacaaaagagaactatgcagtgtttatttatagtttaaagtatatctgaagagccaggacttttgatagtgaattgaaaaggttataaaaaagtgggggaggtttgggggtgggagggagggagtggtattttctccacattaaagcattcctcttgaacgctgattgttttagaagtgatctccagcattgatttgtagtggtatctagaccttctgaagcctctgtgactgtgcttttgggcacctatttccctctgcattgtctgtcctgctttatgaaacaactatacattgtctaagggcattaactggttccaatgtatataaaataatttactctgtagattaaaatcgtacaaaaa

SEQ ID NO: 85225 - DNA, 1233 bp, Homo sapiens
aaagcttcccgagagccatggttggtccaggcaggcagtcggagcacctcgtggagcggctgctaacccagggtggggtggggtggggtggaggggtctgcttgtagtactctcagtcctgatgtcacaggcgcggcaaggacatcgcaaggaggagtcggattacagtaaggatgggcagtgcagcaggcagcccgagcgcactctccagccgccggggatcttagccctggaaaggcagcctgcaaggcgctcatcccgcggaggaggcacgctctcggcgctcactgctctccacgccggggacatttccaccgaatgtagcatgaaagggctctgctctacgtgccagccttgggtgagagctgatgctgaagacaccgcggtgggattccagctgtctgattaatgagaaacataatgtattttggtggtacatgccagagtcctgctctcccggcccttgtccgtccaccagcccctcctttgcaaccatcgctggatattaaaccatttcttccctttcctcttgacactgcagctgcagtcaacctcttccccaatttcaatgcgatggacccgattcagaaagctgtaataaaccatacattcggggttcctcttccccaccgaagaaagcaaatcatatcatgcaacatttgccagttgagatttaattctgatagccaggctgcggcccactacaaaggcacgaaacatgccaagaagctcaaagcactggaagccatgaaaaataagcagaaatctgtaactgccaaggacagcgcaaagactaccttcacctccatcactaccaataccatcaataccagctctgacaaaacagacggtactgcagggacaccagcaatatcaacgacgacaactgtggaaatccgcaaaagcagtgttatgacaactgagatcacctctaaagtggaaaaaagcccaacgacagccactggcaatagctcatgtccttctactgagaccgaggaagaaaaggcaaaacggcttctttactgttcgctatgcaaggttgctgtcaactctgcctcgcagctggaggcgcacaacagtggtgagatgcagcgatttcttttttgtttcaacagctctgcaattatcttcctctgaatagattagatcttttgcagcaggggacaaaggggtggaggaaaactggcaattattacatggaaatcattaaccattaaaaaataaaaatgacga

SEQ ID NO: 85226 - DNA, 322 bp, Homo sapiens
gggattataggcatgagccaccgtgcccggtcttaattatcttttatacattcgaattgtctcataaatacatatctaacagtttatgtagattcagtgttttaccacttcaggtaaaacatagaagccttacatccatataaagctctttatactccctcactgattctttaagtagttgccatgtgttttacatttgcattgtgtttctgctttcaggagtcatacatattttaaagaacttaagaggagaaaaatagtcttttatatttactcagtaatttaccacttcttttttttttttttaaaccagttctttgtt

SEQ ID NO: 85227 - DNA, 1922 bp, Homo sapiens
tctggagccaagtaatggtgatactgatgcttccttttctttgccgcgctcggattctgagtttcacaagaatgtacctgggtgccccttagcgggatatgaatagcttcttcggaaccccagcggccagctggtgcctcctggaaagtgacgtctcatctgcaccggacaaggaggcggggagggagcgcagagcactcagcgtccagcagcgcggcgggccagcctggagcggaagcctggagtggagcaggcagtccgcgggggacagacgtcggctgggattgagccggcagactgcgaaaagtagctggagccggagcagggacagaacctgttgctgcagacgggcttggtggattctggttcctgccgccgacagggctcgccgggagaggttcatcatgaatgagaaatgggacacaaactcttcagaaaactggcatcccatctggaatgtcaatgacacaaagcatcatctgtactcagatattaatattacctatgtgaactactatcttcaccagcctcaagtggcagcaatcttcattatttcctactttctgatcttctttttgtgcatgatgggaaatactgtggtttgctttattgtaatgaggaacaaacatatgcacacagtcactaatctcttcatcttaaacctggccataagtgatttactagttggcatattctgcatgcctataacactgctggacaatattatagcaggatggccatttggaaacacgatgtgcaagatcagtggattggtccagggaatatctgtcgcagcttcagtctttacgttagttgcaattgctgtagataggttccagtgtgtggtctacccttttaaaccaaagctcactatcaagacagcgtttgtcattattatgatcatctgggtcctagccatcaccattatgtctccatctgcagtaatgttacatgtgcaagaagaaaaatattaccgagtgagactcaactcccagaataaaaccagtccagtctactggtgccgggaagactggccaaatcaggaaatgaggaagatctacaccactgtgctgtttgccaacatctacctggctcccctctccctcattgtcatcatgtatggaaggattggaatttcactcttcagggctgcagttcctcacacaggcaggaagaaccaggagcagtggcacgtggtgtccaggaagaagcagaagatcattaagatgctcctgattgtggccctgctttttattctctcatggctgcccctgtggactctaatgatgctctcagactacgctgacctttctccaaatgaactgcagatcatcaacatctacatctacccttttgcacactggctggcattcggcaacagcagtgtcaatcccatcatttatggtttcttcaacgagaatttccgccgtggtttccaagaagctttccagctccagctctgccaaaaaagagcaaagcctatggaagcttatgccctaaaagctaaaagccatgtgctcataaacacatctaatcagcttgtccaggaatctacatttcaaaaccctcatggggaaaccttgctttataggaaaagtgctgaaaaaccccaacaggaattagtgatggaagaattaaaagaaactactaacagcagtgagatttaaaaagagctagtgtgataatcctaactctactacgcattatatatttaaatccattgctttttgtggctttgcacttcaaatttttcaaagaatgttctaaataaaacatttactgaaagccctctctggcaaaaaaattaaaaataaacaaaaatggtcataagatcataaacaatcttatgttgtataaaaatacgtagagtgacttagacatgtttgcatgaataaatatatttctagagaacagttaacaaa

SEQ ID NO: 85228 - DNA, 1562 bp, Homo sapiens
  misc_feature (2)..(4): n is a, c, g, or t
  misc_feature (6)..(6): n is a, c, g, or t
  misc_feature (9)..(13): n is a, c, g, or t
  misc_feature (16)..(16): n is a, c, g, or t
  misc_feature (21)..(21): n is a, c, g, or t
  misc_feature (29)..(30): n is a, c, g, or t
tnnntntgnnnnnctnttctntctcttcnntattaaggttcatcatgaatgagaaatgggacacaaactcttcagaaaactggcatcccatctggaatgtcaatgacacaaagcatcatctgtactcagatattaatattacctatgtgaactactatcttcaccagcctcaagtggcagcaatcttcattatttcctactttctgatcttctttttgtgcatgatgggaaatactgtggtttgctttattgtaatgaggaacaaacatatgcacacagtcactaatctcttcatcttaaacctggccataagtgatttactagttggcatattctgcatgcctataacactgctggacaatattatagcaggatggccatttggaaacacgatgtgcaagatcagtggattggtccagggaatatctgtcgcagcttcagtctttacgttagttgcaattgctgtagataggttccagtgtgtggtctacccttttaaaccaaagctcactatcaagacagcgtttgtcattattatgatcatctgggtcctagccatcaccattatgtctccatctgcagtaatgttacatgtgcaagaagaaaaatattaccgagtgagactcaactcccagaataaaaccagtccagtctactggtgccgggaagactggccaaatcaggaaatgaggaagatctacaccactgtgctgtttgccaacatctacctggctcccctctccctcattgtcatcatgtatggaaggattggaatttcactcttcagggctgcagttcctcacacaggcaggaagaaccaggagcagtggcacgtggtgtccaggaagaagcagaagatcattaagatgctcctgattgtggccctgctttttattctctcatggctgcccctgtggactctaatgatgctctcagactacgctgacctttctccaaatgaactgcagatcatcaacatctacatctacccttttgcacactggctggcattcggcaacagcagtgtcaatcccatcatttatggtttcttcaacgagaatttccgccgtggtttccaagaagctttccagctccagctctgccaaaaaagagcaaagcctatggaagcttatgccctaaaagctaaaagccatgtgctcataaacacatctaatcagcttgtccaggaatctacatttcaaaaccctcatggggaaaccttgctttataggaaaagtgctgaaaaaccccaacaggaattagtgatggaagaattaaaagaaactactaacagcagtgagatttaaaaagagctagtgtgataatcctaactctactacgcattatatatttaaatccattgctttttgtggctttgcacttcaaatttttcaaagaatgttctaaataaaacatttactgaaagccctctctggcaaaaaaattaaaaataaacaaaaatggtcataagatcataaacaatcttatgttgtataaaaatacgtagagtgacttagacatgtttgcatgaataaatatatttctagagaacagttaacaaa

SEQ ID NO: 85229 - DNA, 1140 bp, Homo sapiens
  misc_feature (40)..(40): n is a, c, g, or t
ttcattttttttttattagggagaggtttgaaaaacaaanaaaaacttaggttccagtgtgtggtctacccttttaaaccaaagctcactatcaagacagcgtttgtcattattatgatcatctgggtcctagccatcaccattatgtctccatctgcagtaatgttacatgtgcaagaagaaaaatattaccgagtgagactcaactcccagaataaaaccagtccagtctactggtgccgggaagactggccaaatcaggaaatgaggaagatctacaccactgtgctgtttgccaacatctacctggctcccctctccctcattgtcatcatgtatggaaggattggaatttcactcttcagggctgcagttcctcacacaggcaggaagaaccaggagcagtggcacgtggtgtccaggaagaagcagaagatcattaagatgctcctgattgtggccctgctttttattctctcatggctgcccctgtggactctaatgatgctctcagactacgctgacctttctccaaatgaactgcagatcatcaacatctacatctacccttttgcacactggctggcattcggcaacagcagtgtcaatcccatcatttatggtttcttcaacgagaatttccgccgtggtttccaagaagctttccagctccagctctgccaaaaaagagcaaagcctatggaagcttatgccctaaaagctaaaagccatgtgctcataaacacatctaatcagcttgtccaggaatctacatttcaaaaccctcatggggaaaccttgctttataggaaaagtgctgaaaaaccccaacaggaattagtgatggaagaattaaaagaaactactaacagcagtgagatttaaaaagagctagtgtgataatcctaactctactacgcattatatatttaaatccattgctttttgtggctttgcacttcaaatttttcaaagaatgttctaaataaaacatttactgaaagccctctctggcaaaaaaattaaaaataaacaaaaatggtcataagatcataaacaatcttatgttgtataaaaatacgtagagtgacttagacatgtttgcatgaataaatatatttctagagaacagttaacaaa

SEQ ID NO: 85230 - DNA, 1210 bp, Homo sapiens
ctgtttcattttcctttcaggatggccatttggaaacacgatgtgcaagatcagtggattggtccagggaatatctgtcgcagcttcagtctttacgttagttgcaattgctgtagataggttccagtgtgtggtctacccttttaaaccaaagctcactatcaagacagcgtttgtcattattatgatcatctgggtcctagccatcaccattatgtctccatctgcagtaatgttacatgtgcaagaagaaaaatattaccgagtgagactcaactcccagaataaaaccagtccagtctactggtgccgggaagactggccaaatcaggaaatgaggaagatctacaccactgtgctgtttgccaacatctacctggctcccctctccctcattgtcatcatgtatggaaggattggaatttcactcttcagggctgcagttcctcacacaggcaggaagaaccaggagcagtggcacgtggtgtccaggaagaagcagaagatcattaagatgctcctgattgtggccctgctttttattctctcatggctgcccctgtggactctaatgatgctctcagactacgctgacctttctccaaatgaactgcagatcatcaacatctacatctacccttttgcacactggctggcattcggcaacagcagtgtcaatcccatcatttatggtttcttcaacgagaatttccgccgtggtttccaagaagctttccagctccagctctgccaaaaaagagcaaagcctatggaagcttatgccctaaaagctaaaagccatgtgctcataaacacatctaatcagcttgtccaggaatctacatttcaaaaccctcatggggaaaccttgctttataggaaaagtgctgaaaaaccccaacaggaattagtgatggaagaattaaaagaaactactaacagcagtgagatttaaaaagagctagtgtgataatcctaactctactacgcattatatatttaaatccattgctttttgtggctttgcacttcaaatttttcaaagaatgttctaaataaaacatttactgaaagccctctctggcaaaaaaattaaaaataaacaaaaatggtcataagatcataaacaatcttatgttgtataaaaatacgtagagtgacttagacatgtttgcatgaataaatatatttctagagaacagttaacaaa

SEQ ID NO: 85231 - DNA, 1875 bp, Homo sapiens
aaaggcctcctgagtagctgggactacaggcgcccgccaccacgcctggctaatttttttgtatttttagtagggacggcgtttcactgtgttagccagatggtctccatctcccgacctcgtgatccacccacctcggcctcccaaagtgctgggattacaggcgtgagaccgcgcccggccaatttcctttcttagttgcctctgcccacctcttctcttctgcttccatattacaggtttcctcagttgcgaaattaggatgttaattatagcttttgacatacaagaaacatcaaaaagattgaatgtcttaataagagtgaagcatgtagatcagtgactgctatgttcatcatgaatgagaaatgggacacaaactcttcagaaaactggcatcccatctggaatgtcaatgacacaaagcatcatctgtactcagatattaatattacctatgtgaactactatcttcaccagcctcaagtggcagcaatcttcattatttcctactttctgatcttctttttgtgcatgatgggaaatactgtggtttgctttattgtaatgaggaacaaacatatgcacacagtcactaatctcttcatcttaaacctggccataagtgatttactagttggcatattctgcatgcctataacactgctggacaatattatagcaggatggccatttggaaacacgatgtgcaagatcagtggattggtccagggaatatctgtcgcagcttcagtctttacgttagttgcaattgctgtagataggttccagtgtgtggtctacccttttaaaccaaagctcactatcaagacagcgtttgtcattattatgatcatctgggtcctagccatcaccattatgtctccatctgcagtaatgttacatgtgcaagaagaaaaatattaccgagtgagactcaactcccagaataaaaccagtccagtctactggtgccgggaagactggccaaatcaggaaatgaggaagatctacaccactgtgctgtttgccaacatctacctggctcccctctccctcattgtcatcatgtatggaaggattggaatttcactcttcagggctgcagttcctcacacaggcaggaagaaccaggagcagtggcacgtggtgtccaggaagaagcagaagatcattaagatgctcctgattgtggccctgctttttattctctcatggctgcccctgtggactctaatgatgctctcagactacgctgacctttctccaaatgaactgcagatcatcaacatctacatctacccttttgcacactggctggcattcggcaacagcagtgtcaatcccatcatttatggtttcttcaacgagaatttccgccgtggtttccaagaagctttccagctccagctctgccaaaaaagagcaaagcctatggaagcttatgccctaaaagctaaaagccatgtgctcataaacacatctaatcagcttgtccaggaatctacatttcaaaaccctcatggggaaaccttgctttataggaaaagtgctgaaaaaccccaacaggaattagtgatggaagaattaaaagaaactactaacagcagtgagatttaaaaagagctagtgtgataatcctaactctactacgcattatatatttaaatccattgctttttgtggctttgcacttcaaatttttcaaagaatgttctaaataaaacatttactgaaagccctctctggcaaaaaaattaaaaataaacaaaaatggtcataagatcataaacaatcttatgttgtataaaaatacgtagagtgacttagacatgtttgcatgaataaatatatttctagagaacagttaacaaa

SEQ ID NO: 85232 - DNA, 1655 bp, Homo sapiens
  misc_feature (1)..(3): n is a, c, g, or t
nnnttaaggctggcattactgcaaacctcttggcaaaatttgatgttaattatagcttttgacatacaagaaacatcaaaaagattgaatgtcttaataagagtgaagcatgtagatcagtgactgctatgttcatcatgaatgagaaatgggacacaaactcttcagaaaactggcatcccatctggaatgtcaatgacacaaagcatcatctgtactcagatattaatattacctatgtgaactactatcttcaccagcctcaagtggcagcaatcttcattatttcctactttctgatcttctttttgtgcatgatgggaaatactgtggtttgctttattgtaatgaggaacaaacatatgcacacagtcactaatctcttcatcttaaacctggccataagtgatttactagttggcatattctgcatgcctataacactgctggacaatattatagcaggatggccatttggaaacacgatgtgcaagatcagtggattggtccagggaatatctgtcgcagcttcagtctttacgttagttgcaattgctgtagataggttccagtgtgtggtctacccttttaaaccaaagctcactatcaagacagcgtttgtcattattatgatcatctgggtcctagccatcaccattatgtctccatctgcagtaatgttacatgtgcaagaagaaaaatattaccgagtgagactcaactcccagaataaaaccagtccagtctactggtgccgggaagactggccaaatcaggaaatgaggaagatctacaccactgtgctgtttgccaacatctacctggctcccctctccctcattgtcatcatgtatggaaggattggaatttcactcttcagggctgcagttcctcacacaggcaggaagaaccaggagcagtggcacgtggtgtccaggaagaagcagaagatcattaagatgctcctgattgtggccctgctttttattctctcatggctgcccctgtggactctaatgatgctctcagactacgctgacctttctccaaatgaactgcagatcatcaacatctacatctacccttttgcacactggctggcattcggcaacagcagtgtcaatcccatcatttatggtttcttcaacgagaatttccgccgtggtttccaagaagctttccagctccagctctgccaaaaaagagcaaagcctatggaagcttatgccctaaaagctaaaagccatgtgctcataaacacatctaatcagcttgtccaggaatctacatttcaaaaccctcatggggaaaccttgctttataggaaaagtgctgaaaaaccccaacaggaattagtgatggaagaattaaaagaaactactaacagcagtgagatttaaaaagagctagtgtgataatcctaactctactacgcattatatatttaaatccattgctttttgtggctttgcacttcaaatttttcaaagaatgttctaaataaaacatttactgaaagccctctctggcaaaaaaattaaaaataaacaaaaatggtcataagatcataaacaatcttatgttgtataaaaatacgtagagtgacttagacatgtttgcatgaataaatatatttctagagaacagttaacaaa

SEQ ID NO: 85233 - DNA, 845 bp, Homo sapiens
acgatccggtggtagatctgggatatggtccaagtccagactcttccctgtcacccttgactgttagatgagatagtggatctgagggcctttgaaccatggagttagtaggacttgctgactggtcatggtttaaggagacgagaaaggtctggagcgcctctcagccatccagtttggcaatgggagtgaagtgaacagaagggtcctctggctggagagcagagttcctgcctagagcagcagccaagctgcagcccatccacccactaacccatgtttcacaggctgcccggtgccctggagaaactggccccaaggtctgaccctgccctgcaggagctatgggtctgactgggagatggccttgatcacaactttctaattctgcatgttatgagtgactccattgccctagacccagaattccctggccacctccctgcagggctgtgaagcccatgacaggcctcaccttttctctgctggagcacctgctgtcacagaggcgacagctcctgctgagcttgcctgtgtattttttataagttcttctcaagtgtcacttgtcttgccaggtagatctgcagctccctgagggcagggaccatgaggtgagtgacctccatggagggtctgatgagtcttttcaaacaggtagtcacttaaacaaaaaagagaggaacttggatggtgatggctctgctgagtgaaacggcctcatccttgaacctgaagagtcctgccctgttcaggggagaaggcctcaagtgagcacttctcagatctcagattccccaggcattttgtgtcacctgacctcaggccttagtttctgtccccag

SEQ ID NO: 85234 - DNA, 771 bp, Homo sapiens
tggatgcactacttttgcaactcttctggaaatctaaaattattttaaaataaaaagttttttaaatgacatgcagtgtgaaacacgagaggaaaatgacaaaaatactttaggaaaaacaaaactggagaaaagtttcctaggctaggccacaggccatatgacctaagacactacattaccacagtcaccagtgagtggtcataaccttaacaagaagccaaatcacacctggttctattccaaggaactgggaaaatgcagaggatgtactggttgtctgttttggaaccaactggaggaacagaaaactgaggcccaggttagaaacggcagaatgtatgtctggttagtgagacccaagatatccggcacacaagttacagaaatctcatgacttatggcaaattgaaactctacacaaagatgaaaatataagtgttgtatttatctcattgtgtggcttacacttacactccagaatgagaagtagtaagaaaagaatctgagacagaaatttcttgaattaaaaaccccagcattactcacgcactggcaacgggtgggcatcagtgcgggtaaattactaagctagtaaccttgttaggacataggctcttgcttaggttaaaacagcaacttaaatgaaaggaatgtacaggtgctttttgccacctgggaagtaaaaatatctgatgtcacccaaagatgcaataaagcctgggtttcagccaggcgcggtgtctcatccatgtcatcccagcattctgg

SEQ ID NO: 85235 - DNA, 301 bp, Homo sapiens
acaaaattttcacccaggcagaattgactctttgtccaaattgctgatacaatttgattcaaagtcgctatggataaaattttccagttttctaagattggggatgtgggtgggtgacatttccttattttttcccctctttaacagaatcatagactgatactaataacagccaggcttggagtggtggctcatgcctctaatcttggcactttaggaggctaaggcaggaggatcgcttgagcccaggagttcaaggccagcctgggcaatgtagggagacctcatcgctattaaaaaa

SEQ ID NO: 85236 - DNA, 629 bp, Homo sapiens
tgggggcattttggaaatctgtgggagcattattattgcaaagcgctgctaacatgtagtggtcagaacgcaagggtgcacaatattctctaatgtgtagaattgccccacactgcaataatcatcttgtttcccagttacttctcaaatgtcttgatcttcgaggtagggccttccatttttcttattatctccagacttgaaattgccataggttgacatatatcataagaaattttagtatccatcagcaccccacttctttcatttttctgtatgcacacagaatgtcttctggtctttactcaaatacaagcattcggtgtgcgtgaatacatgcgttagactatttcattgtttcctactgcagtcctgcataagcatttacatattaacatacaaatcattttattataaattacttttatttatcctttacattgtagttagtagatcagttttctgaaattgtaaatatatgttatataatttatcaatttagttttagaattgtacagacagctgtaaaaagggggtgatgagactgataggaagtccattctccacaagttttttgggaacatttttacttagtgaggttttcagttcctacccatctccacagcgtt

SEQ ID NO: 85237 - DNA, 471 bp, Homo sapiens
gctatttgggaggcggaggcaggagaatcacttgagctggggaggcagaggttgcagtgagccaagatgacgtcactacactccagcctgggttacagggcaagactttgtctcaaataaaaaggaaaagaaaataagaatttttaaaatcagtgctttaagctaccagtttaagaagctaggaaagggccaggtgtggtgtctcccacctgtaatcccagcactttgggaggtcaaggcgggcagattacctgaggtcaggagttcgagaccagcctggccaacatggtgaaaccccatctctacaaaaatacaaaaattagccaggtattgatggcaggtgcctgtaatcccagctactcaggaggctgaggcaggagaaacgcttgaacccgggaggcggaggttgcagtgagccgagatcacaccattgaactccagcgtgggcgacagaacaagactccatctcac

SEQ ID NO: 85238 - DNA, 1112 bp, Homo sapiens
gcacgagtaatatcagacaaaggagcttaaagatcaggatttcttccagaggtaaaggttgggggggcgttcttcgtaaagataaggatcagttcatcaagaagatacaacagtcctaaatgtgtaacttttataaaacagtatacccaacaattgcagaatattgttttaagtagacatgaactgctcaacaatatagaccaaatgctggaccataaaataagtcacactaaattccaaaaggaataaaatcatacatggtatattgttaaaccacaaaataaacttgaaattaataaagttaacttgaaaaatccccagataatttggtatcaagtaaacttgttaatcactaatggatcagaggagaatttacaagggaaattagagaatattttaaatctagaccagatgtgatagcatacacctgtaatcccagcactttgggtggtggccaaggtgggaggatcacttgaggccaggagttcaagaccagcctggggaacatagggagaccttgtctctgcaaaaaaaaaaaaaaaatttaagtagctgggtgtggttgtacatacctgtagtcctagcactcaggaggctggggtgggagacttgattgagcccaggaattcaagactgcagtgagctgtgattctgctgctgcactccaggaaaggcgacagagctagaccttttctctaaaaagaaaaaattaaattaaaaaaattttattttcaatttaatgaccagaaagtttgtgggtgtagctaaaacagtgtttagaaaaattttcatagctttaaatacatgtattagaaaacaagaattttcggctgggcgcaatggctcatgcctatgatcccagcactttgggaggctgagatgggcagatcgcttgaggtcaggagttcgagaccagcctggccaacatggtgaaaccccatctctacaaaaatacaaaaattagccaggtattgatggcaggtgcctgtaatcccagctactcaggaggctgaggcaggagaaacgcttgaacccgggaggcggaggttgcagtgagccgagatcacaccattgaactccagcgtgggcgacagaacaagactccatctcac

SEQ ID NO: 85239 - DNA, 817 bp, Homo sapiens
aaaaaaaaaaaaaaaaatcttgcttatagtgaaaaacatacaaattaaatctacactgagacaccatttctcactatcagtttggcaaaaactcaaaagcttgattatatgcatactcttggcaagtatgtgaagaatatatactctcatacattgagaagaataatataccaggtagaattaaaggactcactctgttgctgcccaggctggagtgcagtggcgcatctccgctcactgcaagctccacctccctggttcacgccattctcctgcctcagcctccctacactcaggaggctggggtgggagacttgattgagcccaggaattcaagactgcagtgagctgtgattctgctgctgcactccaggaaaggcgacagagctagaccttttctctaaaaagaaaaaattaaattaaaaaaattttattttcaatttaatgaccagaaagtttgtgggtgtagctaaaacagtgtttagaaaaattttcatagctttaaatacatgtattagaaaacaagaattttcggctgggcgcaatggctcatgcctatgatcccagcactttgggaggctgagatgggcagatcgcttgaggtcaggagttcgagaccagcctggccaacatggtgaaaccccatctctacaaaaatacaaaaattagccaggtattgatggcaggtgcctgtaatcccagctactcaggaggctgaggcaggagaaacgcttgaacccgggaggcggaggttgcagtgagccgagatcacaccattgaactccagcgtgggcgacagaacaagactccatctcac

SEQ ID NO: 85240 - DNA, 538 bp, Homo sapiens
cacaagggaggtcctacccatggaaataagaaaatagtgatccaagttttcacccaacttttgaaatttcaatattttgagccaaatgccttctgaaatgggaggctttgatagtgggaaatactgaaattatcttttccctcagacctttagtgaaacacacatatagttttcactctatgacagtataaacaactcaaatctatactgtttgttaagaacagtttcaagaattaaaaagtgctttagcgttatgatgtattgacatgtttgagcttcagttggggttcaaaacaaccccaacgaggtgaataatgcatataatacattttagatgaatgcactgaatctcagagcagtgaattcagcctgtgcagattcatatagcaaatgatagtgctgcagccagaactgggtctttagaaattacatattaacatgttttctaagtaagtcattttccatcattgccttcaaggatgttttatatcaattgttcagatttccataatatagaagatgcctccatgaaaaaaaa

SEQ ID NO: 85241 - DNA, 351 bp, Homo sapiens
ttggtagagtgattctggaagagtgcatgcatgtgcattcacatgttttattaacatgtgaatatgaaagatattaagcacccatttgtccattttaaatatataattgtatcccttctgtccaacagcatttcactgtagacatttttaagtgtcagttttttagctgaaaaactagaaaaccaaggaagtaaatcattgcccaagctagacttgatcttttcagcatgtcagagtctcatgctttagaaaaccagagaccactctcactattttgtgttcatcctctttctccatttccagtcactttttctgcactgacttcaggttaatcttccataagagggcctt

SEQ ID NO: 85242 - DNA, 712 bp, Homo sapiens
  misc_feature (55)..(55): n is a, c, g, or t
  misc_feature (126)..(126): n is a, c, g, or t
  misc_feature (285)..(285): n is a, c, g, or t
  misc_feature (703)..(712): n is a, c, g, or t
aatgaatggaccctatctagggtccttgtttctccaaaacccgaacagacacccnggtcttgtcacaaacttggcctgtgacctgcagcacatgactgtcactcttgggcctcagtttccccatcnaaaaaacagaggtcatgtgaaatgatggtctctaaggtgccttctaactgatacattatgacaatctttccaaaagcaattgttattcaatggctgagcaaaaaagttataaaattatcccttgtgggaagattcagaccaaggtccagttttctctanatgaaaatgcaacactttacaatgttgtgtaagtgcagaaagtgaaaagacaatcattaaaaagctgagaaaaataaagtcaggaaagaatgctacataaatcgctcagtctgacttcaaagggaaatttttttccaaagtaagatcatgagaattgatttatgtcctcagagccaatgcaaatgcaggatttgtacaatatccatttatcagttccaaaggagctgatttacggcccacctcttctagtttgtattctgtccagctcagaaagttaactgacaacacagaaagaaatatcctctgtctcattgcagatgacgggttataaatgagcacaacttgattctctgttctggaaaattagtgttttgaaactctcattagaaattagtcattaaagctgttcccaaacttnnnnnnnnnn

SEQ ID NO: 85243 - DNA, 466 bp, Homo sapiens
cttcattagttaccccaagacttggcaatcaccctgaccctgttattatatgctagccaatttttcagcaccaaaacaaaaccaccagggagcttgtgccttaagcaccaacatgtacacacactctcctgatatttgccaaaagccacaagtccaggagccatacaaactgctatttcaatgtaaaattgttcattcaaattccaaaccaagattaaaaataattaatcagtattagcataaaacattcaaaatccctaacaaaagcagttttgagatctttccaagattttgaaaatcctaaaaaacatatttagattcctgaagtgagggcaatctccttagcaaatctaagtggtcaagaagacaacatacacatacctcaaattaagactaatttttgcctcctatgacttgcatttctttcaaaacaccctaaagcagtggttcacaaacattagcatgc

SEQ ID NO: 85244 - DNA, 383 bp, Homo sapiens
ctaagtcaaaggtcaaaccacacacttgaaatctcatcacctgtttggccctgttttaagtgtgctttactttctttaatttctgctctaaagcttttaaataaactttcactcctgctctaaaatggaggctgaggcaggagaattgcttgaacccaggagggttcagttagttcagattattctcagggtttcttaagtgaacactctggaaatgttctggtcttcatgataaaggaaatgcaggtaaatatcttttatagctttaacatggatcttttaaagcactctactatattttgaattaaatgatattgatgattttggagcttacaatctattgagggagacaggttaaaccaataagcacagcattaaataca

SEQ ID NO: 85245 - DNA, 395 bp, Homo sapiens
aatgatgtgagggtacaaagagagaaagagaaatagagtccaaacaggggaaagatacttaagtgcctctaggaaggttggggtgtgggttggaggagctaagtgctgagtgtcttaagggagttcgcccacagaagcggagaggaaaagtcaattcaggcagggggcacactgtcaagcaaggcatagagaggaaaaacagcacagtttatgcaaactataagtggtctgttttattggtgcataacaattgctatgagaaggccaagtgtgggggctcacttctgcaatcccagcactttgggaggccaaatcaggaggatcactgcggtctagaagtttgaaaccaccttgggcaacagagtgatatctgttctctgcaacaaataaaaatt

SEQ ID NO: 85246 - DNA, 550 bp, Homo sapiens
  misc_feature (388)..(388): n is a, c, g, or t
tcctcgtttttcatcaattattgtattgttgccttcctggttattttttaatcaagtgctgaacgttgtgcatggaaaattatagttaatttgatgatgggataatgccttcttcctccaaagaagatttatttttgcactggcagatggtttgtgtgcatgcagaggtagatcatctgatttcattcaggttttgggttgtatttaattttttggtgagggctgatccatttttagttcactcttacttgtaggttgtatcttttcagcagtaccaatggaaaccctggaatgtttatcaaagccagtatgctttggcaaattaatttttgccccatcagtccagtgaaactgcccaaagctctactcaggttttcagccttccagntttctgcttttaaaatcagctaatactttaagggggatagtggtgtcaaataatgtatttatctcataaaattttctgctctatgaaatcttggcccctcaagtcttaattgtctttggcagctatgtgataccttctaacaaatgtttaaattttgtccag

SEQ ID NO: 85247 - DNA, 1320 bp, Homo sapiens
gagagaccagaaggtgccaaccgcagaggggtgcagatatctccccctattccccaccccacctcccttgggttttgttcaccgtgctgtcatctgtttttcagacctttttggcatctaacatggtgaagaaaggagtaaagaagagaacaaagtaactcctgggggagcgaagagcgctggtgaccaacaccaccaacgccaccaccagctcctgctgctgcggccacccacgtccaccatttaccgggaggctccagaggcgtaggcagcggatccgagaaaggagcgaggggagtcagccggcttttccgaggagttatggatgttggtgcattcacttctggccagatccgcgcccagagggagctaaccagcagccaccacctcgagctctctccttgccttgcatcgggtcttacccttccagtatgttccttctgatgagacaatttccagtgccgagagtttcagtacaatgtggaaatggatactgacacattgtgcctcagcctttccccacctgcccggctgctgctgctgctgctttttgttgctgttcttggtgtcttccgtccctgtcacctgccaagcccttggtcaggacatggtgtcaccagaggccaccaactcttcttcctcctccttctcctctccttccagcgcgggaaggcatgtgcggagctacaatcaccttcaaggagatgtccgctggagaaagctattctctttcaccaagtactttctcaagattgagaagaacgggaaggtcagcgggaccaagaaggagaactgcccgtacagcatcctggagataacatcagtagaaatcggagttgttgccgtcaaagccattaacagcaactattacttagccatgaacaagaaggggaaactctatggctcaaaagaatttaacaatgactgtaagctgaaggagaggatagaggaaaatggatacaatacctatgcatcatttaactggcagcataatgggaggcaaatgtatgtggcattgaatggaaaaggagctccaaggagaggacagaaaacacgaaggaaaaacacctctgctcactttcttccaatggtggtacactcatagaggaaggcaacgtttgtggatgcagtagaaccaatggctcttttgccaagaatagtggatattcttcatgaagacagtagattgaaaggcaaagacacgttgcagatgtctgcttgcttaaaagaaagccagcctttgaaggtttttgtattcactgctgacatatgatgttcttttaattagttctgtgtcatgtcttataatcaagatatagg

SEQ ID NO: 85248 - DNA, 412 bp, Homo sapiens
ttttttaaaatggtatgtcacttgcattaatttaatagcctttaaaaagcagcatcctgagcaataataagtcacctgcactcagatcaatacagagttgtaaaaggaaaaaaactattaggaatacataataggggaaaagagttctgatatgatttggctgtgtccccactgaaatctcattttgaattgtaataatccccacgtcaagggcagagcctggtggagataattgaaacatgggggcagattccctcagactgttcttgtggtagtgaataactctcacaagatctaatggttttataaatgggatttgccctgcataagctctcttgcctgccaccatgtaagttgtaactctgctcctcattcaccttctgccatgattgtgaggcctccccagccacat

SEQ ID NO: 85249 - DNA, 158 bp, Homo sapiens
aattataactacttagaaaaagtgtttggcagtatctgtgaaagctgggcacatgcatactcgatggccccagcaatctacttctacaaaggtactcacaagaagtatgcatagaatgtttaaagcagcattacaatggccacaaactagaaactacc

SEQ ID NO: 85250 - DNA, 374 bp, Homo sapiens
tccctgcagcccctggtagccatttaatctgttttctgtgtggagttgtcccagacatttcatatgagtggaatcatacactatgtgcccttttgtgtatggcgtctttcacttaccatatttttttcaagcttcagccatgttgaagcatgtgtcagtgtttattcttttttatgactgaataatattctattatatggatataccacatttttgataatccattcatcagttggtagacatttggcttgtctccactttttgtctgttatgagtaatgccactttgaacactcatgtacattttcacagtcttttaagaacgatttttaatatatagagtataaatcagtgagaaaaatgcaaattaattca

SEQ ID NO: 85251 - DNA, 432 bp, Homo sapiens
gtcacttctgaaaccaaaccgcttagcaggtcagcacctatccactgttgggccattgccatgcactccgctggttcagggtggcccctacaactctattcactgccactcagctccaagggtgcagtttgcttatgctagcagtggccacttggattctagagtagaaatatgcacttaaaatccttagtctgtcatccagacatcatggtccactcacggtggttggttctgcagcaaagaacatacacatcatgcatgttaatccatttcatgtagaagctagcagaaagtctccctcaggaaaacaccttggctcaacatgtgatgtcgccttgtgtgtgtgctcaggctgctaatgaaaactcacttagactgtacccagggagccccagagttgaattatgaataagaggatttcaaagtatatca

SEQ ID NO: 85252 - DNA, 342 bp, Homo sapiens
tcaaaacttatttaacatttaaaatattattttattcactattcttagtaaagtttcactcttattccgttattctgaaatatataacttaatatgctttgttattggcagagccctcttctttgtcagggtgtgaatttaggtaatcagtgatgtagtatgagcataatgcttgcggaagggttgtggttgtgtattttctaaggaagatcagttggctacccagacaagatcacagagcagcatttattattcgaagaccgatctgccaatgtaataaatatagaactgtctcataggatggacttaaccaagttcactgatatacaaatcaaaattcca

SEQ ID NO: 85253 - DNA, 1231 bp, Homo sapiens
aattccggcgcacggagggacgcggccggcgcccatggcgttcgcgctgctgcggcccgtcggcgcgcacgtgctgtacccggacgtgcggctgctgagcgaggacgaggagaaccgcagcgagagcgacgcgtcggaccagtcgttcggctgctgcgagggcccggaggcggcgcggcgcggcccgggccccgggggcgggcggcgggcgggcggcggcggcggcgcgggccccgtggtggtggtgcgacagcggcaggcggccaacgcgcgggagcgggaccgcactcagagcgtgaacacggccttcacggcgctgcgcacgctcatccccaccgagccggtggaccgcaagctgtccaagatcgagacgctgcgcctggcgtccagctacatcgcgcacctggccaacgtgctgctgctgggcgactcggccgacgacgggcagccgtgcttccgtgccgcgggcagtgccaagggcgccgtccccgccgcgccgacgcgccgccagccgcgctccatctgcaccttctgcctcagcaaccagcgcaaggggggtggccgtcgtgacctggggggcagctgcttgaaggtgaggggggtggccccccttcgagggccacggagatgagcctggaccctggagaaggaggccaggagccagccactggctggacagggaagaagaccccaggagccaagcccaccccttctttgtgtagggaccgggggaccatggcctgttccgggacactctgggcagggccctcgggacatctccacccgatcctggagagctgtgaggatccattcagcctgcccagctctggctggtcagagacaaggcagaacttttggaaaaacaaagactgttggtgacagggtgtgtgtgtatctgtgcgtgagtgtgagtgtgtgtgagagagaattggtgagtttaaaataaaagctatttttaaataaaagacgtcgttctgagctgaggagagtcccgtggacatcggaggtcagaggtgggccctcccctggacctagagagaggcacagatgttctgggggctgccctgagccctggaagggtgggggtggggcgggggaaggcaggcagagccccctctccgggcgccataaccaaactttcctcagtctgctgtttatcagatgttcttaacaactgttaggtgtctgatatggttggtaaagaaatcttaattttacttatttttgaata

SEQ ID NO: 85254 - DNA, 502 bp, Homo sapiens
agcagtggcagaagggaagaaggttaaggctggagagtaggaatgggcctagggataagatattcactgttaattttcaaagagaagccatggctggatttttggcatgtgaatgatgacctacagttagcttaaggttttaagaaagaacaagcagtcctggggagactgaagcaggatgcaatataaagcagggagatgaattaggatgttctagaaacttactggatgatggtatgatgagaaaaggatggctcaggcactggatgggaaagatgctacactttatgataaaactgagctgaaaaaaagcatgcttacctttttggtcttttagtatttataggcacaaaataaatgttcaatttacttccttgcctcattctctctccactcccgggagtggagagagaatgaaggggtggtggttctgggttcgatttgagttcacctgtgggcagtgggcagtgggcagtgtcttggtgaaagggaacggatacta

SEQ ID NO: 85255 - DNA, 1624 bp, Homo sapiens
tctgccttctctgcctgaggtacttgtttgcaaggagggcttaaaagaaaacggaaatcccgagggcttaaaagaaaagcggaaatccccgcaactgctcaacctctcgtgactgcctgtgttctggggttctgagagggaccgtgcgctgcctggggaagcaatgcaagtctccatagcctgcacagagcacaatttgaagagtcggaatggtgaggaccgacttctgagcaagcagagctccaccgcccccaatgtggtgaacgcagcccgggccaaattccgcacggtcgctatcatcgcgcgcagcctggggacgttcacgcctcagcatcacatttctctcaaagagtccaccgcaaagcagactggcatgaaatataggaatcttggaaaatcaggactcagagtttcttgcttgggtcttggaacatgggtgacatttggaggtcaaatttcagatgaggttgctgaacggctgatgaccatcgcctatgaaagtggtgttaacctctttgatactgccgaagtctatgctgctggaaaggctgaagtgattctggggagcatcatcaagaagaaaggctggaggaggtccagtctggtcataacaaccaaactctactggggtggaaaagctgaaacagaaagagggctgtcaagaaagcatattattgaaggattgaagggctccctccagaggctgcagctcgagtatgtggatgtggtctttgcaaatcgaccggacagtaacactcccatggaagaaattgtccgagccatgacacatgtgataaaccaaggcatggcgatgtactggggcacctcgagatggagtgctatggagatcatggaagcctattctgtagcaagacagttcaatatgatcccaccggtctgtgaacaagctgagtaccatcttttccagagagagaaagtggaggtccagctgccagagctctaccacaaaataggtgttggcgcaatgacatggtctccacttgcctgtggaatcatctcaggaaaatacggaaacggggtgcctgaaagttccagggcttcactgaagtgctaccagtggttgaaagaaagaattgtaagtgaagaagggagaaaacagcaaaacaagctaaaagacctttccccaattgcggagcgtctgggatgcacactacctcagctagctgttgcgtggtgcctgagaaatgaaggtgtgagttctgtgctcctgggatcatccactcctgaacaactcattgaaaaccttggtgccattcaggttctcccaaagatgacatcacatgtggtaaatgagattgataacatactgcgcaacaagccctacagcaagaaggactatagatcataaggcaatgcatgaaccacagaagctgcatggttaaaatagcggcctgtgcccagtacagaaaggtgttactaaccagtcttttgaatcacttagcagcttgctgctcaacctctagtgtccctccctggattcatccaggttgttcccagccctttgtccttgtctgttagggcctctttcttccatggggcgtggcaagggaatagcgacttagtgttctaaataataacatggtcatttccggagtacttgcca

SEQ ID NO: 85256 - DNA, 880 bp, Homo sapiens
aaattttttttgaggttcacatattttattgaattaccattctttgacatcagatctttaccagacattaacatttcaatgttatgcttttccccagtgctaccagtggttgaaagaaagaattgtaagtgaagaagggagaaaacagcaaaacaagctaaaagacctttccccaattgcggagcgtctgggatgcacactacctcagctagctgttggtaagaaaattactaagctatggggtggtagagggacttctgctgagatcatagttttctattgctgaccacacccttaccatgataaaatgtctattgcagggacagatgatctctgaagcataaactcctgctaaatataaagtgagttatttgaggttccccagaattttctacatgatagcaaatttttcttacttctttctccttgctcttataacatagtttgaatgagaacatgtcagtgataacatacactatcacagatgtcaggggtgaactgtgtagtgacatccatttcttctggctcaaatttctgtctgttgaaaactaaaccagggttggtgagaagataagatacagggctgtgacaggcccaaggctactgccacatgaaaagctgatcctagagaaatagcttcaccctgaaagttcttgaaggccataaacgttgttcttctaatgctgtggagtccatgaaaggtcatgattgctggtaacaattgaaaaccacacgcggccgggcgcggtggctcacgcctgtaattccagcactttgggaggccgaggcaggtggatcacgaggtcaggagatcgagaccatcctggctaacagggtgaaaccccgtctctactaaaaatacaaaaaaattacccgggtg

SEQ ID NO: 85257 - DNA, 518 bp, Homo sapiens
ctttatcgtagtgtacaattcacaccttgactaatttgctctggacttaactcaatccaaaccctcaatccaaaccctcccaaagaattaataagggttccctacctttcatattgctcttagtgaaatcggtggtgacaaatttgcttattatttggcatcctacatgtttcttggtttgtactgatttcaccaaagtaaacatttctcatgcatacaaattacagcgaagccttatttctcatcagtataaatttggttgtaatctcattcctccctaggaagcctattctgtagcaagacagttcaatatgatcccaccggtctgtgaacaagctgagtaccatcttttccagagagagaaagtggaggtccagctgccagagctctaccacaaaataggtaatcttcaaaataaaagctactgagtatttttaacaagagaaagatcactgattcggggaaaaaataaaaacagtgttattgaaatgctttcctaaatgtccctaattaacata

SEQ ID NO: 85258 - DNA, 4588 bp, Homo sapiens
tgataacccaaggtattcacagcaagatacagtgagtcttaaagttaagcaccgtgcaattagctttgcttccttgggtttttgaaacatgcatctgtataaacctgcctgtgcagacatcccgagccccaagctgggtctgccaaaatccagtgaatcggctctaaaatgtagatggcacctagcagtgaccaagactcagcctcaggcggcctgcaaacctgtgaggcccagtggagcagccgaacagaaatatgtggaaaagtttctacgtgttcatggaatttcgttgcaggaaaccaccagagcagagacgggcatggcatacaggaatcttggaaaatcaggactcagagtttcttgcttgggtcttggaacatgggtgacatttggaggtcaaatttcagatgaggttgctgaacggctgatgaccatcgcctatgaaagtggtgttaacctctttgatactgccgaagtctatgctgctggaaaggctgaagtgattctggggagcatcatcaagaagaaaggctggaggaggtccagtctggtcataacaaccaaactctactggggtggaaaagctgaaacagaaagagggctgtcaagaaagcatattattgaaggattgaagggctccctccagaggctgcagctcgagtatgtggatgtggtctttgcaaatcgaccggacagtaacactcccatggaagaaattgtccgagccatgacacatgtgataaaccaaggcatggcgatgtactggggcacctcgagatggagtgctatggagatcatggaagcctattctgtagcaagacagttcaatatgatcccaccggtctgtgaacaagctgagtaccatcttttccagagagagaaagtggaggtccagctgccagagctctaccacaaaataggtgttggcgcaatgacatggtctccacttgcctgtggaatcatctcaggaaaatacggaaacggggtgcctgaaagttccagggcttcactgaagtgctaccagtggttgaaagaaagaattgtaagtgaagaagggagaaaacagcaaaacaagctaaaagacctttccccaattgcggagcgtctgggatgcacactacctcagctagctgttgcgtggtgcctgagaaatgaaggtgtgagttctgtgctcctgggatcatccactcctgaacaactcattgaaaaccttggtgccattcaggttctcccaaagatgacatcacatgtggtaaatgagattgataacatactgcgcaacaagccctacagcaagaaggactatagatcataaggcaatgcatgaaccacagaagctgcatggttaaaatagcggcctgtgcccagtacagaaaggtgttactaaccagtcttttgaatcacttagcagcttgctgctcaacctctagtgtccctccctggattctttgaggtgtctgctgtcgctaccactgtgcacatctgaaaactcacaaccaagaaaatccattctattttcttatcttggactggagtcacctattcttgcattgctgtatacacctcatgcttatgcaatgggaagaatatgggggccagggggtgtggtactaccttcaggcatttggtaactcaaagaaggctgtacagatatattttttcaaaagaacaaaatccacagatgcaatgtgagttgcgtaagaaacagagtagatagactaaattcagtgaaggaaaggaattgagagatttttcttagtaaatagattattgttaagtaaatagttattaaaaatatatctcactgcaaaaaaaaaaaaagcagtatcttcactcaaaagtcttgcttggaagaataagcagaaagaattttatatattttttttctattttcacattcatactaacaagttttgttccatttgttattcaataaaacaaaaatttctaggtatttgctttattacctttcaaatatttactgttgcttggccccaagaatggccttgtacaacttatccagaatgtctattaggattctaatgttatgtccacttacaagtagagacagtaaaaggatgaatacccaatctttagtgacaatgcagctgatttatgaaagagagggctacactgctatggaaacttagcttcaaagaaaatgcaatgtatctgcaattaggtgttcattttttactacattttattaaaacctgctttatactttcaactgcttgtaggcacaacttctgcaagtttaaatatttgagctttacaaataaacatacacatgctcagttttttaagtaaacctgtaaaatacccaggaaggcaaatgttcattgtttaattagcactgggattttataatataatgtttggtatttttgaggcattgttaacatgaaagtcaaccactggctttgtgaaaaatgctatgtcactattcagaatatgctgggtaaattaacttgcctagtgaaaagcaaaatgttaaagaaagaacttctggttctataatcatattatatgcactaaactatatgcatgaaagttctttgcatggattaatggggcttacccttgttgcactcgaaatctgaggtgtatctagccctgccactattggctacttaccctcattaatatcccacttgagaaaaattgtgagactatactgtgtcaatatctgtaaaaagagagaaaacatgtttttttttttttgaagggggtggtgtgggagtggccctttaactctatttggctatctgaggatgtacaaaattctcatttaattttctggtcagcaagttccccacacagaaatcactctgaggtttacagaagaactgtaatattattttaaaatgcgattttctgtcattagttctagatatgtacttcatggttaaattctaaatctgaaaatgctagtgggagatatcaagaaattttctttttgattactagtacctgtattctaacagagagtttgaattttttgcccgtgttatcagaatgatggaaattgatcattttcagttgttcattgtgtattcaatccagcgaactgctgtatgtatagaggagctgaggtgctgtctaatgggaaatgtgatttgattgatttatttgcttagagtaataaaagcattttgtgcattcaatcttacaatagattttatctgatctttcactgtaaggcttatgtgtattttccatatatgtaaaacatacacatgtaaaatatatgtggccataaattaggcaataatcatctaaataaaaattatattggcagctaagctgcactgaatactcaacagaaatagtagtgatcaaaagtctgagatttaaattgcaatccaaacatattctatcatcaatcaatcaatggagattaactactgaagataccatttctcactgggttttagaacactccgcactaaggttaaggcttcacaaattcacttttaaaaacttacttgcaaatcaaaaccaaatataaatattatggcttagctgtgggaacagccagttttttatatgcgaatctgtcatggtaaatatactaatgtatttcacagttagttagttagttatgtccttaagaaaaaattccacgcactcttattattttcttttctcttccaaaaagaattccctggcagagaatctatcattccaaaaggtaacctgggtaccagccatccctatatggaaatctcaggcaaactagaaaccctgtgtctggcttcccactttaaaagaactgtcacttcatcttcatgacaagagtgccaaagtcatgaggcagatgtcagagcctgaaggaaacttagccatctgcaaagccatccctctttgacaaacgagcaaagcaggcctggatagatgatgaaaaaacttgcccaaactcacacactgctagttgatggcagaaccaggcctagaacccaagtattttgtgttctagttcagtgctccattaggtagatttttttttctttttaagctttaaagaagaagttttatgcagaaattgtttgtgagaatgttgaagttaaaaaacatagttattaatccaaactcagaaatcaaacagggataagtcagcgaaaagatgatatattgaaaattcatgaaggccaacgagaagttagcctctatcgccctgaaaatttaaaccaaccccccaaaagaccctcctaatctattaattcctctgcttgggagtcccaaggaagtgaaagagaatcccttagagctctgatacatctataaattggttttctccataaatgtacacatacatgtatccttccatcctgtctccagaagcagcagtgactggcatgcacactgaaaacaaagaaatagggcaggcaggaaggcacagcaggtacatactggcagaggcctgatgtctgccctttactgtaactgctcaatgcctttcattgcctcacatacatttgattggtaactacaaagatgtgcatttacatgtgtgagatattaaaatgatggttacatgtatacatatgtaccaaacctgcatggtcagcacatgtatcccagaact

SEQ ID NO: 85259 - DNA, 4542 bp, Homo sapiens
tgataacccaaggtattcacagcaagatacagtgagtcttaaagttaagcaccgtgcaattagctttgcttccttgggtttttgaaacatgcatctgtataaacctgcctgtgcagacatcccgagccccaagctgggtctgccaaaatccagtgaatcggctctaaaatgtagatggcacctagcagtgaccaagactcagcctcaggcggcctgcaaacctgtgaggcccagtggagcagccgaacagaaatatgtggaaaagtttctacgtgttcatggaatttcgttgcaggaaaccaccagagcagagacgggcatggcatacaggaatcttggaaaatcaggactcagagtttcttgcttgggtcttggaacatgggtgacatttggaggtcaaatttcagatgaggttgctgaacggctgatgaccatcgcctatgaaagtggtgttaacctctttgatactgccgaagtctatgctgctggaaaggctgaagtgattctggggagcatcatcaagaagaaaggctggaggaggtccagtctggtcataacaaccaaactctactggggtggaaaagctgaaacagaaagagggctgtcaagaaagcatattattgaaggattgaagggctccctccagaggctgcagctcgagtatgtggatgtggtctttgcaaatcgaccggacagtaacactcccatggaagaaattgtccgagccatgacacatgtgataaaccaaggcatggcgatgtactggggcacctcgagatggagtgctatggagatcatggaagcctattctgtagcaagacagttcaatatgatcccaccggtctgtgaacaagctgagtaccatcttttccagagagagaaagtggaggtccagctgccagagctctaccacaaaataggtgttggcgcaatgacatggtctccacttgcctgtggaatcatctcaggaaaatacggaaacggggtgcctgaaagttccagggcttcactgaagtgctaccagtggttgaaagaaagaattgtaagtgaagaagggagaaaacagcaaaacaagctaaaagacctttccccaattgcggagcgtctgggatgcacactacctcagctagctgttgcgtggtgcctgagaaatgaaggtgtgagttctgtgctcctgggatcatccactcctgaacaactcattgaaaaccttggtgccattcaggttctcccaaagatgacatcacatgtggtaaatgagattgataacatactgcgcaacaagccctacagcaagaaggactatagatcataaggcaatgcatgaaccacagaagctgcatggttaaaatagcggcctgtgcccagtacagaaaggtgttactaaccagtcttttgaatcacttagcagcttgctgctcaacctctagtgtccctccctggattctttgaggtgtctgctgtcgctaccactgtgcacatctgaaaactcacaaccaagaaaatccattctattttcttatcttggactggagtcacctattcttgcattgctgtatacacctcatgcttatgcaatgggaagaatatgggggccagggggtgtggtactaccttcaggcatttggtaactcaaagaaggctgtacagatatattttttcaaaagaacaaaatccacagatgcaatgtgagttgcgtaagaaacagagtagatagactaaattcagtgaaggaaaggaattgagagatttttcttagtaaatagattattgttaagtaaatagttattaaaaatatatctcactgcaaaaaaaaaaaaagcagtatcttcactcaaaagtcttgcttggaagaataagcagaaagaattttatatattttttttctattttcacattcatactaacaagttttgttccatttgttattcaataaaacaaaaatttctaggtatttgctttattacctttcaaatatttactgttgcttggccccaagaatggccttgtacaacttatccagaatgtctattaggattctaatgttatgtccacttacaagtagagacagtaaaaggatgaatacccaatctttagtgacaatgcagctgatttatgaaagagagggctacactgctatggaaacttagcttcaaagaaaatgcaatgtatctgcaattaggtgttcattttttactacattttattaaaacctgctttatactttcaactgcttgtaggcacaacttctgcaagtttaaatatttgagctttacaaataaacatacacatgctcagttttttaagtaaacctgtaaaatacccaggaaggcaaatgttcattgtttaattagcactgggattttataatataatgtttggtatttttgaggcattgttaacatgaaagtcaaccactggctttgtgaaaaatgctatgtcactattcagaatatgctgggtaaattaacttgcctagtgaaaagcaaaatgttaaagaaagaacttctggttctataatcatattatatgcactaaactatatgcatgaaagttctttgcatggattaatggggcttacccttgttgcactcgaaatctgaggtgtatctagccctgccactattggctacttaccctcattaatatcccacttgagaaaaattgtgagactatactgtgtcaatatctgtaaaaagagagaaaacatgtttttttttttttgaagggggtggtgtgggagtggccctttaactctatttggctatctgaggatgtacaaaattctcatttaattttctggtcagcaagttccccacacagaaatcactctgaggtttacagaagaactgtaatattattttaaaatgcgattttctgtcattagttctagatatgtacttcatggttaaattctaaatctgaaaatgctagtgggagatatcaagaaattttctttttgattactagtacctgtattctaacagagagtttgaattttttgcccgtgttatcagaatgatggaaattgatcattttcagttgttcattgtgtattcaatccagcgaactgctgtatgtatagaggagctgaggtgctgtctaatgggaaatgtgatttgattgatttatttgcttagagtaataaaagcattttgtgcattcaatcttacaatagattttatctgatctttcactgtaaggcttatgtgtattttccatatatgtaaaacatacacatgtaaaatatatgtggccataaattaggcaataatcatctaaataaaaattatattggcagctaagctgcactgaatactcaacagaaatagtagtgatcaaaagtctgagatttaaattgcaatccaaacatattctatcatggttttagaacactccgcactaaggttaaggcttcacaaattcacttttaaaaacttacttgcaaatcaaaaccaaatataaatattatggcttagctgtgggaacagccagttttttatatgcgaatctgtcatggtaaatatactaatgtatttcacagttagttagttagttatgtccttaagaaaaaattccacgcactcttattattttcttttctcttccaaaaagaattccctggcagagaatctatcattccaaaaggtaacctgggtaccagccatccctatatggaaatctcaggcaaactagaaaccctgtgtctggcttcccactttaaaagaactgtcacttcatcttcatgacaagagtgccaaagtcatgaggcagatgtcagagcctgaaggaaacttagccatctgcaaagccatccctctttgacaaacgagcaaagcaggcctggatagatgatgaaaaaacttgcccaaactcacacactgctagttgatggcagaaccaggcctagaacccaagtattttgtgttctagttcagtgctccattaggtagatttttttttctttttaagctttaaagaagaagttttatgcagaaattgtttgtgagaatgttgaagttaaaaaacatagttattaatccaaactcagaaatcaaacagggataagtcagcgaaaagatgatatattgaaaattcatgaaggccaacgagaagttagcctctatcgccctgaaaatttaaaccaaccccccaaaagaccctcctaatctattaattcctctgcttgggagtcccaaggaagtgaaagagaatcccttagagctctgatacatctataaattggttttctccataaatgtacacatacatgtatccttccatcctgtctccagaagcagcagtgactggcatgcacactgaaaacaaagaaatagggcaggcaggaaggcacagcaggtacatactggcagaggcctgatgtctgccctttactgtaactgctcaatgcctttcattgcctcacatacatttgattggtaactacaaagatgtgcatttacatgtgtgagatattaaaatgatggttacatgtatacatatgtaccaaacctgcatggtcagcacatgtatcccagaact

SEQ ID NO: 85260 - DNA, 4538 bp, Homo sapiens
tgataacccaaggtattcacagcaagatacagtgagtcttaaagttaagcaccgtgcaattagctttgcttccttgggtttttgaaacatgcatctgtataaacctgcctgtgcagacatcccgagccccaagctgggtctgccaaaatccagtgaatcggctctaaaatgtagatggcacctagcagtgaccaagactcagcctcaggcggcctgcaaacctgtgaggcccagtggagcagccgaacagaaatatgtggaaaagtttctacgtgttcatggaatttcgttgcaggaaaccaccagagcagagacgggcatggcatacaggaatcttggaaaatcaggactcagagtttcttgcttgggtcttggaacatgggtgacatttggaggtcaaatttcagatgaggttgctgaacggctgatgaccatcgcctatgaaagtggtgttaacctctttgatactgccgaagtctatgctgctggaaaggctgaagtgattctggggagcatcatcaagaagaaaggctggaggaggtccagtctggtcataacaaccaaactctactggggtggaaaagctgaaacagaaagagggctgtcaagaaagcatattattgaaggattgaagggctccctccagaggctgcagctcgagtatgtggatgtggtctttgcaaatcgaccggacagtaacactcccatggaagaaattgtccgagccatgacacatgtgataaaccaaggcatggcgatgtactggggcacctcgagatggagtgctatggagatcatggaagcctattctgtagcaagacagttcaatatgatcccaccggtctgtgaacaagctgagtaccatcttttccagagagagaaagtggaggtccagctgccagagctctaccacaaaataggtgttggcgcaatgacatggtctccacttgcctgtggaatcatctcaggaaaatacggaaacggggtgcctgaaagttccagggcttcactgaagtgctaccagtggttgaaagaaagaattgtaagtgaagaagggagaaaacagcaaaacaagctaaaagacctttccccaattgcggagcgtctgggatgcacactacctcagctagctgttgcgtggtgcctgagaaatgaaggtgtgagttctgtgctcctgggatcatccactcctgaacaactcattgaaaaccttggtgccattcaggttctcccaaagatgacatcacatgtggtaaatgagattgataacatactgcgcaacaagccctacagcaagaaggactatagatcataaggcaatgcatgaaccacagaagctgcatggttaaaatagcggcctgtgcccagtacagaaaggtgttactaaccagtcttttgaatcacttagcagcttgctgctcaacctctagtgtccctccctggattctttgaggtgtctgctgtcgctaccactgtgcacatctgaaaactcacaaccaagaaaatccattctattttcttatcttggactggagtcacctattcttgcattgctgtatacacctcatgcttatgcaatgggaagaatatgggggccagggggtgtggtactaccttcaggcatttggtaactcaaagaaggctgtacagatatattttttcaaaagaacaaaatccacagatgcaatgtgagttgcgtaagaaacagagtagatagactaaattcagtgaaggaaaggaattgagagatttttcttagtaaatagattattgttaagtaaatagttattaaaaatatatctcactgcaaaaaaaaaaaaagcagtatcttcactcaaaagtcttgcttggaagaataagcagaaagaattttatatattttttttctattttcacattcatactaacaagttttgttccatttgttattcaataaaacaaaaatttctaggtatttgctttattacctttcaaatatttactgttgcttggccccaagaatggccttgtacaacttatccagaatgtctattaggattctaatgttatgtccacttacaagtagagacagtaaaaggatgaatacccaatctttagtgacaatgcagctgatttatgaaagagagggctacactgctatggaaacttagcttcaaagaaaatgcaatgtatctgcaattaggtgttcattttttactacattttattaaaacctgctttatactttcaactgcttgtaggcacaacttctgcaagtttaaatatttgagctttacaaataaacatacacatgctcagttttttaagtaaacctgtaaaatacccaggaaggcaaatgttcattgtttaattagcactgggattttataatataatgtttggtatttttgaggcattgttaacatgaaagtcaaccactggctttgtgaaaaatgctatgtcactattcagaatatgctgggtaaattaacttgcctagtgaaaagcaaaatgttaaagaaagaacttctggttctataatcatattatatgcactaaactatatgcatgaaagttctttgcatggattaatggggcttacccttgttgcactcgaaatctgaggtgtatctagccctgccactattggctacttaccctcattaatatcccacttgagaaaaattgtgagactatactgtgtcaatatctgtaaaaagagagaaaacatgtttttttttttttgaagggggtggtgtgggagtggccctttaactctatttggctatctgaggatgtacaaaattctcatttaattttctggtcagcaagttccccacacagaaatcactctgaggtttacagaagaactgtaatattattttaaaatgcgattttctgtcattagttctagatatgtacttcatggttaaattctaaatctgaaaatgctagtgggagatatcaagaaattttctttttgattactagtacctgtattctaacagagagtttgaattttttgcccgtgttatcagaatgatggaaattgatcattttcagttgttcattgtgtattcaatccagcgaactgctgtatgtatagaggagctgaggtgctgtctaatgggaaatgtgatttgattgatttatttgcttagagtaataaaagcattttgtgcattcaatcttacaatagattttatctgatctttcactgtaaggcttatgtgtattttccatatatgtaaaacatacacatgtaaaatatatgtggccataaattaggcaataatcatctaaataaaaattatattggcagctaagctgcactgaatactcaacagaaatagtagtgatcaaaagtctgagatttaaattgcaatccaaacatattctatcatcaatcaatcaatggagattaactactgaagataccatttctcactgaaaacttacttgcaaatcaaaaccaaatataaatattatggcttagctgtgggaacagccagttttttatatgcgaatctgtcatggtaaatatactaatgtatttcacagttagttagttagttatgtccttaagaaaaaattccacgcactcttattattttcttttctcttccaaaaagaattccctggcagagaatctatcattccaaaaggtaacctgggtaccagccatccctatatggaaatctcaggcaaactagaaaccctgtgtctggcttcccactttaaaagaactgtcacttcatcttcatgacaagagtgccaaagtcatgaggcagatgtcagagcctgaaggaaacttagccatctgcaaagccatccctctttgacaaacgagcaaagcaggcctggatagatgatgaaaaaacttgcccaaactcacacactgctagttgatggcagaaccaggcctagaacccaagtattttgtgttctagttcagtgctccattaggtagatttttttttctttttaagctttaaagaagaagttttatgcagaaattgtttgtgagaatgttgaagttaaaaaacatagttattaatccaaactcagaaatcaaacagggataagtcagcgaaaagatgatatattgaaaattcatgaaggccaacgagaagttagcctctatcgccctgaaaatttaaaccaaccccccaaaagaccctcctaatctattaattcctctgcttgggagtcccaaggaagtgaaagagaatcccttagagctctgatacatctataaattggttttctccataaatgtacacatacatgtatccttccatcctgtctccagaagcagcagtgactggcatgcacactgaaaacaaagaaatagggcaggcaggaaggcacagcaggtacatactggcagaggcctgatgtctgccctttactgtaactgctcaatgcctttcattgcctcacatacatttgattggtaactacaaagatgtgcatttacatgtgtgagatattaaaatgatggttacatgtatacatatgtaccaaacctgcatggtcagcacatgtatcccagaact

SEQ ID NO: 85261 - DNA, 4586 bp, Homo sapiens
  misc_feature (231)..(231): n is a, c, g, or t
  misc_feature (252)..(254): n is a, c, g, or t
  misc_feature (285)..(286): n is a, c, g, or t
  misc_feature (290)..(290): n is a, c, g, or t
  misc_feature (302)..(302): n is a, c, g, or t
  misc_feature (305)..(305): n is a, c, g, or t
ttcagattactttgatgacagtgacttccagtcttctctgaaagatctccacgatgctggcagcccggacaggggcagcggggagtcagatctcagaggagaacaccaagttaaggagacagtctgggttttctgtagcagggaaagacaaatctcccaagaaagcctcagaaaacgctaaagacagcagccttagtccctcaggggaaagccagctcagggcgcgtcaantggctctgctgcgcgaagtgnnnatgaactggtacctaaagctctgcgacctgnncagngagcacaccacngtntgcaccacaggcatgccgcacaggaatcttggaaaatcaggactcagagtttcttgcttgggtcttggaacatgggtgacatttggaggtcaaatttcagatgaggttgctgaacggctgatgaccatcgcctatgaaagtggtgttaacctctttgatactgccgaagtctatgctgctggaaaggctgaagtgattctggggagcatcatcaagaagaaaggctggaggaggtccagtctggtcataacaaccaaactctactggggtggaaaagctgaaacagaaagagggctgtcaagaaagcatattattgaaggattgaagggctccctccagaggctgcagctcgagtatgtggatgtggtctttgcaaatcgaccggacagtaacactcccatggaagaaattgtccgagccatgacacatgtgataaaccaaggcatggcgatgtactggggcacctcgagatggagtgctatggagatcatggaagcctattctgtagcaagacagttcaatatgatcccaccggtctgtgaacaagctgagtaccatcttttccagagagagaaagtggaggtccagctgccagagctctaccacaaaataggtgttggcgcaatgacatggtctccacttgcctgtggaatcatctcaggaaaatacggaaacggggtgcctgaaagttccagggcttcactgaagtgctaccagtggttgaaagaaagaattgtaagtgaagaagggagaaaacagcaaaacaagctaaaagacctttccccaattgcggagcgtctgggatgcacactacctcagctagctgttgcgtggtgcctgagaaatgaaggtgtgagttctgtgctcctgggatcatccactcctgaacaactcattgaaaaccttggtgccattcaggttctcccaaagatgacatcacatgtggtaaatgagattgataacatactgcgcaacaagccctacagcaagaaggactatagatcataaggcaatgcatgaaccacagaagctgcatggttaaaatagcggcctgtgcccagtacagaaaggtgttactaaccagtcttttgaatcacttagcagcttgctgctcaacctctagtgtccctccctggattctttgaggtgtctgctgtcgctaccactgtgcacatctgaaaactcacaaccaagaaaatccattctattttcttatcttggactggagtcacctattcttgcattgctgtatacacctcatgcttatgcaatgggaagaatatgggggccagggggtgtggtactaccttcaggcatttggtaactcaaagaaggctgtacagatatattttttcaaaagaacaaaatccacagatgcaatgtgagttgcgtaagaaacagagtagatagactaaattcagtgaaggaaaggaattgagagatttttcttagtaaatagattattgttaagtaaatagttattaaaaatatatctcactgcaaaaaaaaaaaaagcagtatcttcactcaaaagtcttgcttggaagaataagcagaaagaattttatatattttttttctattttcacattcatactaacaagttttgttccatttgttattcaataaaacaaaaatttctaggtatttgctttattacctttcaaatatttactgttgcttggccccaagaatggccttgtacaacttatccagaatgtctattaggattctaatgttatgtccacttacaagtagagacagtaaaaggatgaatacccaatctttagtgacaatgcagctgatttatgaaagagagggctacactgctatggaaacttagcttcaaagaaaatgcaatgtatctgcaattaggtgttcattttttactacattttattaaaacctgctttatactttcaactgcttgtaggcacaacttctgcaagtttaaatatttgagctttacaaataaacatacacatgctcagttttttaagtaaacctgtaaaatacccaggaaggcaaatgttcattgtttaattagcactgggattttataatataatgtttggtatttttgaggcattgttaacatgaaagtcaaccactggctttgtgaaaaatgctatgtcactattcagaatatgctgggtaaattaacttgcctagtgaaaagcaaaatgttaaagaaagaacttctggttctataatcatattatatgcactaaactatatgcatgaaagttctttgcatggattaatggggcttacccttgttgcactcgaaatctgaggtgtatctagccctgccactattggctacttaccctcattaatatcccacttgagaaaaattgtgagactatactgtgtcaatatctgtaaaaagagagaaaacatgtttttttttttttgaagggggtggtgtgggagtggccctttaactctatttggctatctgaggatgtacaaaattctcatttaattttctggtcagcaagttccccacacagaaatcactctgaggtttacagaagaactgtaatattattttaaaatgcgattttctgtcattagttctagatatgtacttcatggttaaattctaaatctgaaaatgctagtgggagatatcaagaaattttctttttgattactagtacctgtattctaacagagagtttgaattttttgcccgtgttatcagaatgatggaaattgatcattttcagttgttcattgtgtattcaatccagcgaactgctgtatgtatagaggagctgaggtgctgtctaatgggaaatgtgatttgattgatttatttgcttagagtaataaaagcattttgtgcattcaatcttacaatagattttatctgatctttcactgtaaggcttatgtgtattttccatatatgtaaaacatacacatgtaaaatatatgtggccataaattaggcaataatcatctaaataaaaattatattggcagctaagctgcactgaatactcaacagaaatagtagtgatcaaaagtctgagatttaaattgcaatccaaacatattctatcatcaatcaatcaatggagattaactactgaagataccatttctcactgggttttagaacactccgcactaaggttaaggcttcacaaattcacttttaaaaacttacttgcaaatcaaaaccaaatataaatattatggcttagctgtgggaacagccagttttttatatgcgaatctgtcatggtaaatatactaatgtatttcacagttagttagttagttatgtccttaagaaaaaattccacgcactcttattattttcttttctcttccaaaaagaattccctggcagagaatctatcattccaaaaggtaacctgggtaccagccatccctatatggaaatctcaggcaaactagaaaccctgtgtctggcttcccactttaaaagaactgtcacttcatcttcatgacaagagtgccaaagtcatgaggcagatgtcagagcctgaaggaaacttagccatctgcaaagccatccctctttgacaaacgagcaaagcaggcctggatagatgatgaaaaaacttgcccaaactcacacactgctagttgatggcagaaccaggcctagaacccaagtattttgtgttctagttcagtgctccattaggtagatttttttttctttttaagctttaaagaagaagttttatgcagaaattgtttgtgagaatgttgaagttaaaaaacatagttattaatccaaactcagaaatcaaacagggataagtcagcgaaaagatgatatattgaaaattcatgaaggccaacgagaagttagcctctatcgccctgaaaatttaaaccaaccccccaaaagaccctcctaatctattaattcctctgcttgggagtcccaaggaagtgaaagagaatcccttagagctctgatacatctataaattggttttctccataaatgtacacatacatgtatccttccatcctgtctccagaagcagcagtgactggcatgcacactgaaaacaaagaaatagggcaggcaggaaggcacagcaggtacatactggcagaggcctgatgtctgccctttactgtaactgctcaatgcctttcattgcctcacatacatttgattggtaactacaaagatgtgcatttacatgtgtgagatattaaaatgatggttacatgtatacatatgtaccaaacctgcatggtcagcacatgtatcccagaact

SEQ ID NO: 85262 - DNA, 5355 bp, Homo sapiens
cccccagttccaactgttgtgctgcagcagatttggtctgagtctgggcagagcccctttttatggagcaaccctcccgatttgttacagcaagagcctggtgcaagtgatctttgccttcccatcgcacacaaaggcaaagagctccttaaagggacctgcctgctcctccgtgcagctgcaaacccgtgtcggtgcaggctcagcaacccaggctttcgctcgagaatgagtggggaggggtcttgaggagcccccacgtcctcccggagcggaggcgggagggagctgacagccggagtggatggagaccaccagtccgaggggacccgcttgcgattagctgcttcttgggatgctccgcgcgccagttgagcatcctgcctgtggtccaggggatgctggcggcgcatcttgcggtaagcctgcgctgatttgagccatcgcccagaagcgagcccgcattcagacaccgcggaccggctccgcgaagggctgcgtgcagtcaccatgaatgctcagctctaggcttctgtaaaaacctcccccactgcatggatttggctgtttaatcagccgagattacagcccgggaagatttgcaaacctgattctccctccagctgctgtgacaacttcggggccgtctgtttacttctctgggtccccggggactctttcctgcatcgcagccccttgtgccactttgtgggcttggctcgaaagtcagccgccaggactcctctgacggcatccccaggaagggggagcaaggagggcttaaaagaaaagcggaaatccccgcaactgctcaacctctcgtgactgcctgtgttctggggttctgagagggaccgtgcgctgcctggggaagcaatgcaagtctccatagcctgcacagagcacaatttgaagagtcggaatggtgaggaccgacttctgagcaagcagagctccaccgcccccaatgtggtgaacgcagcccgggccaaattccgcacggtcgctatcatcgcgcgcagcctggggacgttcacgcctcagcatcacatttctctcaaagagtccaccgcaaagcagactggcatgaaatataggaatcttggaaaatcaggactcagagtttcttgcttgggtcttggaacatgggtgacatttggaggtcaaatttcagatgaggttgctgaacggctgatgaccatcgcctatgaaagtggtgttaacctctttgatactgccgaagtctatgctgctggaaaggctgaagtgattctggggagcatcatcaagaagaaaggctggaggaggtccagtctggtcataacaaccaaactctactggggtggaaaagctgaaacagaaagagggctgtcaagaaagcatattattgaaggattgaagggctccctccagaggctgcagctcgagtatgtggatgtggtctttgcaaatcgaccggacagtaacactcccatggaagaaattgtccgagccatgacacatgtgataaaccaaggcatggcgatgtactggggcacctcgagatggagtgctatggagatcatggaagcctattctgtagcaagacagttcaatatgatcccaccggtctgtgaacaagctgagtaccatcttttccagagagagaaagtggaggtccagctgccagagctctaccacaaaataggtgttggcgcaatgacatggtctccacttgcctgtggaatcatctcaggaaaatacggaaacggggtgcctgaaagttccagggcttcactgaagtgctaccagtggttgaaagaaagaattgtaagtgaagaagggagaaaacagcaaaacaagctaaaagacctttccccaattgcggagcgtctgggatgcacactacctcagctagctgttgcgtggtgcctgagaaatgaaggtgtgagttctgtgctcctgggatcatccactcctgaacaactcattgaaaaccttggtgccattcaggttctcccaaagatgacatcacatgtggtaaatgagattgataacatactgcgcaacaagccctacagcaagaaggactatagatcataaggcaatgcatgaaccacagaagctgcatggttaaaatagcggcctgtgcccagtacagaaaggtgttactaaccagtcttttgaatcacttagcagcttgctgctcaacctctagtgtccctccctggattctttgaggtgtctgctgtcgctaccactgtgcacatctgaaaactcacaaccaagaaaatccattctattttcttatcttggactggagtcacctattcttgcattgctgtatacacctcatgcttatgcaatgggaagaatatgggggccagggggtgtggtactaccttcaggcatttggtaactcaaagaaggctgtacagatatattttttcaaaagaacaaaatccacagatgcaatgtgagttgcgtaagaaacagagtagatagactaaattcagtgaaggaaaggaattgagagatttttcttagtaaatagattattgttaagtaaatagttattaaaaatatatctcactgcaaaaaaaaaaaaagcagtatcttcactcaaaagtcttgcttggaagaataagcagaaagaattttatatattttttttctattttcacattcatactaacaagttttgttccatttgttattcaataaaacaaaaatttctaggtatttgctttattacctttcaaatatttactgttgcttggccccaagaatggccttgtacaacttatccagaatgtctattaggattctaatgttatgtccacttacaagtagagacagtaaaaggatgaatacccaatctttagtgacaatgcagctgatttatgaaagagagggctacactgctatggaaacttagcttcaaagaaaatgcaatgtatctgcaattaggtgttcattttttactacattttattaaaacctgctttatactttcaactgcttgtaggcacaacttctgcaagtttaaatatttgagctttacaaataaacatacacatgctcagttttttaagtaaacctgtaaaatacccaggaaggcaaatgttcattgtttaattagcactgggattttataatataatgtttggtatttttgaggcattgttaacatgaaagtcaaccactggctttgtgaaaaatgctatgtcactattcagaatatgctgggtaaattaacttgcctagtgaaaagcaaaatgttaaagaaagaacttctggttctataatcatattatatgcactaaactatatgcatgaaagttctttgcatggattaatggggcttacccttgttgcactcgaaatctgaggtgtatctagccctgccactattggctacttaccctcattaatatcccacttgagaaaaattgtgagactatactgtgtcaatatctgtaaaaagagagaaaacatgtttttttttttttgaagggggtggtgtgggagtggccctttaactctatttggctatctgaggatgtacaaaattctcatttaattttctggtcagcaagttccccacacagaaatcactctgaggtttacagaagaactgtaatattattttaaaatgcgattttctgtcattagttctagatatgtacttcatggttaaattctaaatctgaaaatgctagtgggagatatcaagaaattttctttttgattactagtacctgtattctaacagagagtttgaattttttgcccgtgttatcagaatgatggaaattgatcattttcagttgttcattgtgtattcaatccagcgaactgctgtatgtatagaggagctgaggtgctgtctaatgggaaatgtgatttgattgatttatttgcttagagtaataaaagcattttgtgcattcaatcttacaatagattttatctgatctttcactgtaaggcttatgtgtattttccatatatgtaaaacatacacatgtaaaatatatgtggccataaattaggcaataatcatctaaataaaaattatattggcagctaagctgcactgaatactcaacagaaatagtagtgatcaaaagtctgagatttaaattgcaatccaaacatattctatcatcaatcaatcaatggagattaactactgaagataccatttctcactgggttttagaacactccgcactaaggttaaggcttcacaaattcacttttaaaaacttacttgcaaatcaaaaccaaatataaatattatggcttagctgtgggaacagccagttttttatatgcgaatctgtcatggtaaatatactaatgtatttcacagttagttagttagttatgtccttaagaaaaaattccacgcactcttattattttcttttctcttccaaaaagaattccctggcagagaatctatcattccaaaaggtaacctgggtaccagccatccctatatggaaatctcaggcaaactagaaaccctgtgtctggcttcccactttaaaagaactgtcacttcatcttcatgacaagagtgccaaagtcatgaggcagatgtcagagcctgaaggaaacttagccatctgcaaagccatccctctttgacaaacgagcaaagcaggcctggatagatgatgaaaaaacttgcccaaactcacacactgctagttgatggcagaaccaggcctagaacccaagtattttgtgttctagttcagtgctccattaggtagatttttttttctttttaagctttaaagaagaagttttatgcagaaattgtttgtgagaatgttgaagttaaaaaacatagttattaatccaaactcagaaatcaaacagggataagtcagcgaaaagatgatatattgaaaattcatgaaggccaacgagaagttagcctctatcgccctgaaaatttaaaccaaccccccaaaagaccctcctaatctattaattcctctgcttgggagtcccaaggaagtgaaagagaatcccttagagctctgatacatctataaattggttttctccataaatgtacacatacatgtatccttccatcctgtctccagaagcagcagtgactggcatgcacactgaaaacaaagaaatagggcaggcaggaaggcacagcaggtacatactggcagaggcctgatgtctgccctttactgtaactgctcaatgcctttcattgcctcacatacatttgattggtaactacaaagatgtgcatttacatgtgtgagatattaaaatgatggttacatgtatacatatgtaccaaacctgcatggtcagcacatgtatcccagaact

SEQ ID NO: 85263 - DNA, 4239 bp, Homo sapiens
gctgagacttctttctttccctctccactaaaactaagaaaaataaggagtggttagtgagaggttgctgaacggctgatgaccatcgcctatgaaagtggtgttaacctctttgatactgccgaagtctatgctgctggaaaggctgaagtgattctggggagcatcatcaagaagaaaggctggaggaggtccagtctggtcataacaaccaaactctactggggtggaaaagctgaaacagaaagagggctgtcaagaaagcatattattgaaggattgaagggctccctccagaggctgcagctcgagtatgtggatgtggtctttgcaaatcgaccggacagtaacactcccatggaagaaattgtccgagccatgacacatgtgataaaccaaggcatggcgatgtactggggcacctcgagatggagtgctatggagatcatggaagcctattctgtagcaagacagttcaatatgatcccaccggtctgtgaacaagctgagtaccatcttttccagagagagaaagtggaggtccagctgccagagctctaccacaaaataggtgttggcgcaatgacatggtctccacttgcctgtggaatcatctcaggaaaatacggaaacggggtgcctgaaagttccagggcttcactgaagtgctaccagtggttgaaagaaagaattgtaagtgaagaagggagaaaacagcaaaacaagctaaaagacctttccccaattgcggagcgtctgggatgcacactacctcagctagctgttgcgtggtgcctgagaaatgaaggtgtgagttctgtgctcctgggatcatccactcctgaacaactcattgaaaaccttggtgccattcaggttctcccaaagatgacatcacatgtggtaaatgagattgataacatactgcgcaacaagccctacagcaagaaggactatagatcataaggcaatgcatgaaccacagaagctgcatggttaaaatagcggcctgtgcccagtacagaaaggtgttactaaccagtcttttgaatcacttagcagcttgctgctcaacctctagtgtccctccctggattctttgaggtgtctgctgtcgctaccactgtgcacatctgaaaactcacaaccaagaaaatccattctattttcttatcttggactggagtcacctattcttgcattgctgtatacacctcatgcttatgcaatgggaagaatatgggggccagggggtgtggtactaccttcaggcatttggtaactcaaagaaggctgtacagatatattttttcaaaagaacaaaatccacagatgcaatgtgagttgcgtaagaaacagagtagatagactaaattcagtgaaggaaaggaattgagagatttttcttagtaaatagattattgttaagtaaatagttattaaaaatatatctcactgcaaaaaaaaaaaaagcagtatcttcactcaaaagtcttgcttggaagaataagcagaaagaattttatatattttttttctattttcacattcatactaacaagttttgttccatttgttattcaataaaacaaaaatttctaggtatttgctttattacctttcaaatatttactgttgcttggccccaagaatggccttgtacaacttatccagaatgtctattaggattctaatgttatgtccacttacaagtagagacagtaaaaggatgaatacccaatctttagtgacaatgcagctgatttatgaaagagagggctacactgctatggaaacttagcttcaaagaaaatgcaatgtatctgcaattaggtgttcattttttactacattttattaaaacctgctttatactttcaactgcttgtaggcacaacttctgcaagtttaaatatttgagctttacaaataaacatacacatgctcagttttttaagtaaacctgtaaaatacccaggaaggcaaatgttcattgtttaattagcactgggattttataatataatgtttggtatttttgaggcattgttaacatgaaagtcaaccactggctttgtgaaaaatgctatgtcactattcagaatatgctgggtaaattaacttgcctagtgaaaagcaaaatgttaaagaaagaacttctggttctataatcatattatatgcactaaactatatgcatgaaagttctttgcatggattaatggggcttacccttgttgcactcgaaatctgaggtgtatctagccctgccactattggctacttaccctcattaatatcccacttgagaaaaattgtgagactatactgtgtcaatatctgtaaaaagagagaaaacatgtttttttttttttgaagggggtggtgtgggagtggccctttaactctatttggctatctgaggatgtacaaaattctcatttaattttctggtcagcaagttccccacacagaaatcactctgaggtttacagaagaactgtaatattattttaaaatgcgattttctgtcattagttctagatatgtacttcatggttaaattctaaatctgaaaatgctagtgggagatatcaagaaattttctttttgattactagtacctgtattctaacagagagtttgaattttttgcccgtgttatcagaatgatggaaattgatcattttcagttgttcattgtgtattcaatccagcgaactgctgtatgtatagaggagctgaggtgctgtctaatgggaaatgtgatttgattgatttatttgcttagagtaataaaagcattttgtgcattcaatcttacaatagattttatctgatctttcactgtaaggcttatgtgtattttccatatatgtaaaacatacacatgtaaaatatatgtggccataaattaggcaataatcatctaaataaaaattatattggcagctaagctgcactgaatactcaacagaaatagtagtgatcaaaagtctgagatttaaattgcaatccaaacatattctatcatcaatcaatcaatggagattaactactgaagataccatttctcactgggttttagaacactccgcactaaggttaaggcttcacaaattcacttttaaaaacttacttgcaaatcaaaaccaaatataaatattatggcttagctgtgggaacagccagttttttatatgcgaatctgtcatggtaaatatactaatgtatttcacagttagttagttagttatgtccttaagaaaaaattccacgcactcttattattttcttttctcttccaaaaagaattccctggcagagaatctatcattccaaaaggtaacctgggtaccagccatccctatatggaaatctcaggcaaactagaaaccctgtgtctggcttcccactttaaaagaactgtcacttcatcttcatgacaagagtgccaaagtcatgaggcagatgtcagagcctgaaggaaacttagccatctgcaaagccatccctctttgacaaacgagcaaagcaggcctggatagatgatgaaaaaacttgcccaaactcacacactgctagttgatggcagaaccaggcctagaacccaagtattttgtgttctagttcagtgctccattaggtagatttttttttctttttaagctttaaagaagaagttttatgcagaaattgtttgtgagaatgttgaagttaaaaaacatagttattaatccaaactcagaaatcaaacagggataagtcagcgaaaagatgatatattgaaaattcatgaaggccaacgagaagttagcctctatcgccctgaaaatttaaaccaaccccccaaaagaccctcctaatctattaattcctctgcttgggagtcccaaggaagtgaaagagaatcccttagagctctgatacatctataaattggttttctccataaatgtacacatacatgtatccttccatcctgtctccagaagcagcagtgactggcatgcacactgaaaacaaagaaatagggcaggcaggaaggcacagcaggtacatactggcagaggcctgatgtctgccctttactgtaactgctcaatgcctttcattgcctcacatacatttgattggtaactacaaagatgtgcatttacatgtgtgagatattaaaatgatggttacatgtatacatatgtaccaaacctgcatggtcagcacatgtatcccagaact

SEQ ID NO: 85264 - DNA, 4028 bp, Homo sapiens
cctacaccaatcactgtatactatcactccagttcacttttccatgctattccatctacctgggatgcctgttaaaccccagccatccttcaccagggataagaccaccagtcagaataaatctctccttagtctctagacctgtgctgtgtactactatggttctagccacatgtggctattgtatgcgggaaagatggtgagtcccaaacagagatgtgctttaagtgtaacatgttcacaagatgtgacttagtaccaaaaacaactgtcaagtatcttttctatattgattacatgttgaaataatgttttggatataatgaagtaaaaacatgtattaatttcactgttctttttaaggtatctaatagaaaattttaaattacaaatgtggcttgcattatatttctgttggatagagctgctctatatttctatgagccttcacttatgcctttatgccttcatttatgcagtcaatcaacaaggcccctgacctcaaggagcttacaatgtgatggtgttgggggcggggggcttagatttcagctgtggtttatgaagatatatgattctagattactttgctaaatatagagcacaaaaaaccgaatgatcaacactgctaacaatatcctttgtacttctcctcctgctctcaggttctcccaaagatgacatcacatgtggtaaatgagattgataacatactgcgcaacaagccctacagcaagaaggactatagatcataaggcaatgcatgaaccacagaagctgcatggttaaaatagcggcctgtgcccagtacagaaaggtgttactaaccagtcttttgaatcacttagcagcttgctgctcaacctctagtgtccctccctggattctttgaggtgtctgctgtcgctaccactgtgcacatctgaaaactcacaaccaagaaaatccattctattttcttatcttggactggagtcacctattcttgcattgctgtatacacctcatgcttatgcaatgggaagaatatgggggccagggggtgtggtactaccttcaggcatttggtaactcaaagaaggctgtacagatatattttttcaaaagaacaaaatccacagatgcaatgtgagttgcgtaagaaacagagtagatagactaaattcagtgaaggaaaggaattgagagatttttcttagtaaatagattattgttaagtaaatagttattaaaaatatatctcactgcaaaaaaaaaaaaagcagtatcttcactcaaaagtcttgcttggaagaataagcagaaagaattttatatattttttttctattttcacattcatactaacaagttttgttccatttgttattcaataaaacaaaaatttctaggtatttgctttattacctttcaaatatttactgttgcttggccccaagaatggccttgtacaacttatccagaatgtctattaggattctaatgttatgtccacttacaagtagagacagtaaaaggatgaatacccaatctttagtgacaatgcagctgatttatgaaagagagggctacactgctatggaaacttagcttcaaagaaaatgcaatgtatctgcaattaggtgttcattttttactacattttattaaaacctgctttatactttcaactgcttgtaggcacaacttctgcaagtttaaatatttgagctttacaaataaacatacacatgctcagttttttaagtaaacctgtaaaatacccaggaaggcaaatgttcattgtttaattagcactgggattttataatataatgtttggtatttttgaggcattgttaacatgaaagtcaaccactggctttgtgaaaaatgctatgtcactattcagaatatgctgggtaaattaacttgcctagtgaaaagcaaaatgttaaagaaagaacttctggttctataatcatattatatgcactaaactatatgcatgaaagttctttgcatggattaatggggcttacccttgttgcactcgaaatctgaggtgtatctagccctgccactattggctacttaccctcattaatatcccacttgagaaaaattgtgagactatactgtgtcaatatctgtaaaaagagagaaaacatgtttttttttttttgaagggggtggtgtgggagtggccctttaactctatttggctatctgaggatgtacaaaattctcatttaattttctggtcagcaagttccccacacagaaatcactctgaggtttacagaagaactgtaatattattttaaaatgcgattttctgtcattagttctagatatgtacttcatggttaaattctaaatctgaaaatgctagtgggagatatcaagaaattttctttttgattactagtacctgtattctaacagagagtttgaattttttgcccgtgttatcagaatgatggaaattgatcattttcagttgttcattgtgtattcaatccagcgaactgctgtatgtatagaggagctgaggtgctgtctaatgggaaatgtgatttgattgatttatttgcttagagtaataaaagcattttgtgcattcaatcttacaatagattttatctgatctttcactgtaaggcttatgtgtattttccatatatgtaaaacatacacatgtaaaatatatgtggccataaattaggcaataatcatctaaataaaaattatattggcagctaagctgcactgaatactcaacagaaatagtagtgatcaaaagtctgagatttaaattgcaatccaaacatattctatcatcaatcaatcaatggagattaactactgaagataccatttctcactgggttttagaacactccgcactaaggttaaggcttcacaaattcacttttaaaaacttacttgcaaatcaaaaccaaatataaatattatggcttagctgtgggaacagccagttttttatatgcgaatctgtcatggtaaatatactaatgtatttcacagttagttagttagttatgtccttaagaaaaaattccacgcactcttattattttcttttctcttccaaaaagaattccctggcagagaatctatcattccaaaaggtaacctgggtaccagccatccctatatggaaatctcaggcaaactagaaaccctgtgtctggcttcccactttaaaagaactgtcacttcatcttcatgacaagagtgccaaagtcatgaggcagatgtcagagcctgaaggaaacttagccatctgcaaagccatccctctttgacaaacgagcaaagcaggcctggatagatgatgaaaaaacttgcccaaactcacacactgctagttgatggcagaaccaggcctagaacccaagtattttgtgttctagttcagtgctccattaggtagatttttttttctttttaagctttaaagaagaagttttatgcagaaattgtttgtgagaatgttgaagttaaaaaacatagttattaatccaaactcagaaatcaaacagggataagtcagcgaaaagatgatatattgaaaattcatgaaggccaacgagaagttagcctctatcgccctgaaaatttaaaccaaccccccaaaagaccctcctaatctattaattcctctgcttgggagtcccaaggaagtgaaagagaatcccttagagctctgatacatctataaattggttttctccataaatgtacacatacatgtatccttccatcctgtctccagaagcagcagtgactggcatgcacactgaaaacaaagaaatagggcaggcaggaaggcacagcaggtacatactggcagaggcctgatgtctgccctttactgtaactgctcaatgcctttcattgcctcacatacatttgattggtaactacaaagatgtgcatttacatgtgtgagatattaaaatgatggttacatgtatacatatgtaccaaacctgcatggtcagcacatgtatcccagaact

SEQ ID NO: 85265 - DNA, 3399 bp, Homo sapiens
  misc_feature (30)..(31): n is a, c, g, or t
agagaaagggaaagaggaggcggcggcccnncttaggttctcccaaagatgacatcacatgtggtaaatgagattgataacatactgcgcaacaagccctacagcaagaaggactatagatcataaggcaatgcatgaaccacagaagctgcatggttaaaatagcggcctgtgcccagtacagaaaggtgttactaaccagtcttttgaatcacttagcagcttgctgctcaacctctagtgtccctccctggattctttgaggtgtctgctgtcgctaccactgtgcacatctgaaaactcacaaccaagaaaatccattctattttcttatcttggactggagtcacctattcttgcattgctgtatacacctcatgcttatgcaatgggaagaatatgggggccagggggtgtggtactaccttcaggcatttggtaactcaaagaaggctgtacagatatattttttcaaaagaacaaaatccacagatgcaatgtgagttgcgtaagaaacagagtagatagactaaattcagtgaaggaaaggaattgagagatttttcttagtaaatagattattgttaagtaaatagttattaaaaatatatctcactgcaaaaaaaaaaaaagcagtatcttcactcaaaagtcttgcttggaagaataagcagaaagaattttatatattttttttctattttcacattcatactaacaagttttgttccatttgttattcaataaaacaaaaatttctaggtatttgctttattacctttcaaatatttactgttgcttggccccaagaatggccttgtacaacttatccagaatgtctattaggattctaatgttatgtccacttacaagtagagacagtaaaaggatgaatacccaatctttagtgacaatgcagctgatttatgaaagagagggctacactgctatggaaacttagcttcaaagaaaatgcaatgtatctgcaattaggtgttcattttttactacattttattaaaacctgctttatactttcaactgcttgtaggcacaacttctgcaagtttaaatatttgagctttacaaataaacatacacatgctcagttttttaagtaaacctgtaaaatacccaggaaggcaaatgttcattgtttaattagcactgggattttataatataatgtttggtatttttgaggcattgttaacatgaaagtcaaccactggctttgtgaaaaatgctatgtcactattcagaatatgctgggtaaattaacttgcctagtgaaaagcaaaatgttaaagaaagaacttctggttctataatcatattatatgcactaaactatatgcatgaaagttctttgcatggattaatggggcttacccttgttgcactcgaaatctgaggtgtatctagccctgccactattggctacttaccctcattaatatcccacttgagaaaaattgtgagactatactgtgtcaatatctgtaaaaagagagaaaacatgtttttttttttttgaagggggtggtgtgggagtggccctttaactctatttggctatctgaggatgtacaaaattctcatttaattttctggtcagcaagttccccacacagaaatcactctgaggtttacagaagaactgtaatattattttaaaatgcgattttctgtcattagttctagatatgtacttcatggttaaattctaaatctgaaaatgctagtgggagatatcaagaaattttctttttgattactagtacctgtattctaacagagagtttgaattttttgcccgtgttatcagaatgatggaaattgatcattttcagttgttcattgtgtattcaatccagcgaactgctgtatgtatagaggagctgaggtgctgtctaatgggaaatgtgatttgattgatttatttgcttagagtaataaaagcattttgtgcattcaatcttacaatagattttatctgatctttcactgtaaggcttatgtgtattttccatatatgtaaaacatacacatgtaaaatatatgtggccataaattaggcaataatcatctaaataaaaattatattggcagctaagctgcactgaatactcaacagaaatagtagtgatcaaaagtctgagatttaaattgcaatccaaacatattctatcatcaatcaatcaatggagattaactactgaagataccatttctcactgggttttagaacactccgcactaaggttaaggcttcacaaattcacttttaaaaacttacttgcaaatcaaaaccaaatataaatattatggcttagctgtgggaacagccagttttttatatgcgaatctgtcatggtaaatatactaatgtatttcacagttagttagttagttatgtccttaagaaaaaattccacgcactcttattattttcttttctcttccaaaaagaattccctggcagagaatctatcattccaaaaggtaacctgggtaccagccatccctatatggaaatctcaggcaaactagaaaccctgtgtctggcttcccactttaaaagaactgtcacttcatcttcatgacaagagtgccaaagtcatgaggcagatgtcagagcctgaaggaaacttagccatctgcaaagccatccctctttgacaaacgagcaaagcaggcctggatagatgatgaaaaaacttgcccaaactcacacactgctagttgatggcagaaccaggcctagaacccaagtattttgtgttctagttcagtgctccattaggtagatttttttttctttttaagctttaaagaagaagttttatgcagaaattgtttgtgagaatgttgaagttaaaaaacatagttattaatccaaactcagaaatcaaacagggataagtcagcgaaaagatgatatattgaaaattcatgaaggccaacgagaagttagcctctatcgccctgaaaatttaaaccaaccccccaaaagaccctcctaatctattaattcctctgcttgggagtcccaaggaagtgaaagagaatcccttagagctctgatacatctataaattggttttctccataaatgtacacatacatgtatccttccatcctgtctccagaagcagcagtgactggcatgcacactgaaaacaaagaaatagggcaggcaggaaggcacagcaggtacatactggcagaggcctgatgtctgccctttactgtaactgctcaatgcctttcattgcctcacatacatttgattggtaactacaaagatgtgcatttacatgtgtgagatattaaaatgatggttacatgtatacatatgtaccaaacctgcatggtcagcacatgtatcccagaact

SEQ ID NO: 85266 - DNA, 1991 bp, Homo sapiens
agcgtggtcgcggccgaggtacgcggtattggctacttaccctcattaatatcccacttgagaaaaattgtgagactatactgtgtcaatatctgtaaaaagagagaaaacatgtttttttttttttgaagggggtggtgtgggagtggccctttaactctatttggctatctgaggatgtacaaaattctcatttaattttctggtcagcaagttccccacacagaaatcactctgaggtttacagaagaactgtaatattattttaaaatgcgattttctgtcattagttctagatatgtacttcatggttaaattctaaatctgaaaatgctagtgggagatatcaagaaattttctttttgattactagtacctgtattctaacagagagtttgaattttttgcccgtgttatcagaatgatggaaattgatcattttcagttgttcattgtgtattcaatccagcgaactgctgtatgtatagaggagctgaggtgctgtctaatgggaaatgtgatttgattgatttatttgcttagagtaataaaagcattttgtgcattcaatcttacaatagattttatctgatctttcactgtaaggcttatgtgtattttccatatatgtaaaacatacacatgtaaaatatatgtggccataaattaggcaataatcatctaaataaaaattatattggcagctaagctgcactgaatactcaacagaaatagtagtgatcaaaagtctgagatttaaattgcaatccaaacatattctatcatcaatcaatcaatggagattaactactgaagataccatttctcactgggttttagaacactccgcactaaggttaaggcttcacaaattcacttttaaaaacttacttgcaaatcaaaaccaaatataaatattatggcttagctgtgggaacagccagttttttatatgcgaatctgtcatggtaaatatactaatgtatttcacagttagttagttagttatgtccttaagaaaaaattccacgcactcttattattttcttttctcttccaaaaagaattccctggcagagaatctatcattccaaaaggtaacctgggtaccagccatccctatatggaaatctcaggcaaactagaaaccctgtgtctggcttcccactttaaaagaactgtcacttcatcttcatgacaagagtgccaaagtcatgaggcagatgtcagagcctgaaggaaacttagccatctgcaaagccatccctctttgacaaacgagcaaagcaggcctggatagatgatgaaaaaacttgcccaaactcacacactgctagttgatggcagaaccaggcctagaacccaagtattttgtgttctagttcagtgctccattaggtagatttttttttctttttaagctttaaagaagaagttttatgcagaaattgtttgtgagaatgttgaagttaaaaaacatagttattaatccaaactcagaaatcaaacagggataagtcagcgaaaagatgatatattgaaaattcatgaaggccaacgagaagttagcctctatcgccctgaaaatttaaaccaaccccccaaaagaccctcctaatctattaattcctctgcttgggagtcccaaggaagtgaaagagaatcccttagagctctgatacatctataaattggttttctccataaatgtacacatacatgtatccttccatcctgtctccagaagcagcagtgactggcatgcacactgaaaacaaagaaatagggcaggcaggaaggcacagcaggtacatactggcagaggcctgatgtctgccctttactgtaactgctcaatgcctttcattgcctcacatacatttgattggtaactacaaagatgtgcatttacatgtgtgagatattaaaatgatggttacatgtatacatatgtaccaaacctgcatggtcagcacatgtatcccagaact

SEQ ID NO: 85267 - DNA, 1034 bp, Homo sapiens
tgataacccaaggtattcacagcaagatacagtgagtcttaaagttaagcaccgtgcaattagctttgcttccttgggtttttgaaacatgcatctgtataaacctgcctgtgcagacatcccgagccccaagctgggtctgccaaaatccagtgaatcggctctaaaatgtagatggcacctagcagtgaccaagactcagcctcaggcggcctgcaaacctgtgaggcccagtggagcagccgaacagaaatatgtggaaaagtttctacgtgttcatggaatttcgttgcaggaaaccaccagagcagagacgggcatggcatacaggaatcttggaaaatcaggactcagagtttcttgcttgggtcttggaacatgggtgacatttggaggtcaaatttcagatgaggttgctgaacggctgatgaccatcgcctatgaaagtggtgttaacctctttgatactgccgaagtctatgctgctggaaaggctgaagtgattctggggagcatcatcaagaagaaaggctggaggaagtaacttgacaagaagctgattatccccccacacacatgcatttatgtttgctgtttattttattaactctggatgcaaaggaatgatgaaacaagaagactttgggataaataccccaaagctttcttatctgaacacatttagtcagcatctctcctgtgtgcccaggaaccctattatctggctattcagaacaatgcttcatctgctatccttgagaaacatgaggggctgtgcttacacgtccctttccaacacctcctgtagccaaagatagtggtaataagggaagctataacatctatgggcagtggggaggtaatacttccccatttcactatagatttcagccccaacagccactacttccccagcacgagtacagaattaagcaaagcccagcaaaggttactgaacaagtttggggtcctcctctgccctggcataatatctgctgattaccaaataaatgacagtgtaatgatattagtga

SEQ ID NO: 85268 - DNA, 400 bp, Homo sapiens
taaaaaggtaaatcatgtattctttattaggccaggaatcatcaagcaataaaagtaaaggaagaacttaaaatggtcattatattttcaatatcatttagtgttgttgctgcaaatggaaaatggaatgtcagtttgcccaaaggtaccatcagccttcaaaccatcaatatttcctgtcagactataatgttgtcaccaatattaggctaattttattaatcaaacaaacaattgcattaagcttctaagctttggctagaggagtaaaaatcgcataactttgaaaagtagacaaattcatgaaatgctgtctgtttgaccttccacagaaattgtccgagccatgacacatgtgataaaccaaggcatggcgatgtactggggcacctcgagatgg

SEQ ID NO: 85269 - DNA, 1225 bp, Homo sapiens
catccccagccagatttagctgctgacagctgcttgggactctgccgccagggcctggcccagacctgcctgcctctctcctctccctcagtgactcctgagccacagcccctccatggcccagaaggaagaggctgctgtggccactgaggctgcctcccagaatggggaggatctggagaacctggacgaccctgagaagctgaaagagctgattgagctgccgccctttgagattgtcacaggagaacggctgcctgccaacttctttaaattccagttccggaatgtggagtacagttccgggaggaacaagaccttcctctgctatgtggttgaagcacagggcaaggggggccaagtgcaggcatctcggggatacctagaggatgagcatgcggctgcccatgcagaggaagctttcttcaacaccatcctgccagccttcgacccagccctgcggtacaatgtcacctggtatgtgtcctccagcccctgtgcagcgtgtgctgaccgcattatcaaaacccttagcaagaccaagaacctgcgtctgctcattctggtgggtcgactcttcatgtgggaggagccggagatccaggctgctctgaagaagctgaaggaggctggctgtaaactgcgcatcatgaagccccaggacttcgaatatgtctggcagaattttgtggagcaagaagagggtgaatccaaggcctttcagccctgggaggacattcaggagaacttcctatactacgaggagaagttggcagacatcctgaagtagggcaactgggctttgcctcacgtattcctgctgccaccaagagacagcaatgacatgtacagccatctgggacatgcctgtcttcctaataccatttggagctggacaacatttgacaccaaccaatcatactggacaaggcccttagaggacttgaaatatacttctcatgctgtagtttatttaggctgtgactctctctctaatgctgctctcgggaaggacgaaagtgacctgcaaggagagaaatgcaaccatacatgggctccagtcaactatgggactgaaggtcctaattgctcacccaagggggctgcttaacacaaacagcctcagacccgaggtttagatttctgaaatatgcattttatgttaagttgggtatttttttaaaaaaagaaaaacagcaacattaataaaagaagtggtgtgttt

SEQ ID NO: 85270 - DNA, 1800 bp, Homo sapiens
tttgccaacccatgaagatacaactttcagccatttcttttaaaaagcaggacccagtcactgaagtcagtgagcctatgatagggtatactgtgtggtactctgctcacataaaataagacactttatagtggtgaacagtagtcaaaacagatttctgagggtgccctctgagaatataaaatttaacttttagaattccttgaagattttgttagtgtatgtactatcactgtaattataaacccaacatagattctacagactaaccggcagcttaaaatttaaccccagtatattttcctttcagacatctttcagagtcaagggcccaggtgcctaactagcaagtccttagagcttttttttttttttttttttttcagtgatttcaaatataactgtattatctggacccattaacatgcttccctgtcttctatttgaattgctcatgtttgtgaagggaaaggttaagatatatcaagttaaaaaaaaaaaaactggcatgagataagagtgtaatctaaaagcccaaaagaacaaccctgcttaattaaaataatcttgagaaatgagcatttgttaaataaagtgtcttattttacatacttatttcatctttcttttttttttttttaatgacaaaatagtatttaatcctatatttagtcaaaagaccagagttaaaccagatctcttctggggctttttctgtgtaaaccacatcaaaacatgaacgaaagactggcttctggtttagtcaatcctggtaaatttacccaatcctgcaaaggaaactatggaggagaaatccagggacttgttgggaagggcacacagaaaccttagttcaaaaagaaactagtcattgttcggggccagcagagctctcagtaacacattttctttgtttgttttaccaaggtattcctgctgccaccaagagacagcaatgacatgtacagccatctgggacatgcctgtcttcctaataccatttggagctggacaacatttgacaccaaccaatcatactggacaaggcccttagaggacttgaaatatacttctcatgctgtagtttatttaggctgtgactctctctctaatgctgctctcgggaaggacgaaagtgacctgcaaggagagaaatgcaaccatacatgggctccagtcaactatgggactgaaggtcctaattgctcacccaagggggctgcttaacacaaacagcctcagacccgaggtttagatttctgaaatatgcattttatgttaagttgggtatttttttaaaaaaagaaaaacagcaacattaataaaagaagtggtgtgtttaaaaaaacacacaacacaaaacaaacatccccccccccggtgagagcccgccaaggccacttcaaaaactgccaaacaccaacacaaggggcaccggggccaaaaaagggcaacggcgaaacgggggcacaagaggggagcaccaaaggaagaaaaaaccgcgggtgcacacagagacaaccacagacgaccaagcggaacaaaccacacacaaaaaataaaacacaaccgaccccagagggcaaacaacacccaccaacacgaccccgcggacacacaactgactccgcccacaagagggagagaaatctcggaaagacagtcaacaaacaaaagacgggaaactccacacagccacaacacgggagaagaaccacacaacagacgagcaagaaccacgagcaaatcagaatcagacaatgattcaagcaccccccgccccgcacgcacgaggaaagc

SEQ ID NO: 85271 - DNA, 1130 bp, Homo sapiens
ttgtcactgatgttaccacagacaagacctatttatagtaagagtgaatgcatttctgaagtactgacctggaagagctacctactctaggctggttctagaaacaagaacttatcattctttcctgtccttttgtctccttgacctacagagaacggctgcctgccaacttctttaaattccagttccggaatgtggagtacagttccgggaggaacaagaccttcctctgctatgtggttgaagcacagggcaaggggggccaagtgcaggcatctcggggatacctagaggatgagcatgcggctgcccatgcagaggaagctttcttcaacaccatcctgccagccttcgacccagccctgcggtacaatgtcacctggtatgtgtcctccagcccctgtgcagcgtgtgctgaccgcattatcaaaacccttagcaagaccaagaacctgcgtctgctcattctggtgggtcgactcttcatgtgggaggagccggagatccaggctgctctgaagaagctgaaggaggctggctgtaaactgcgcatcatgaagccccaggacttcgaatatgtctggcagaattttgtggagcaagaagagggtgaatccaaggcctttcagccctgggaggacattcaggagaacttcctatactacgaggagaagttggcagacatcctgaagtagggcaactgggctttgcctcacgtattcctgctgccaccaagagacagcaatgacatgtacagccatctgggacatgcctgtcttcctaataccatttggagctggacaacatttgacaccaaccaatcatactggacaaggcccttagaggacttgaaatatacttctcatgctgtagtttatttaggctgtgactctctctctaatgctgctctcgggaaggacgaaagtgacctgcaaggagagaaatgcaaccatacatgggctccagtcaactatgggactgaaggtcctaattgctcacccaagggggctgcttaacacaaacagcctcagacccgaggtttagatttctgaaatatgcattttatgttaagttgggtatttttttaaaaaaagaaaaacagcaacattaataaaagaagtggtgtgttt

SEQ ID NO: 85272 - DNA, 1029 bp, Homo sapiens
catccccagccagatttagctgctgacagctgcttgggactctgccgccagggcctggcccagacctgcctgcctctctcctctccctcagtgactcctgagccacagcccctccatggcccagaaggaagaggctgctgtggccactgaggctgcctcccagaatggggaggatctggagaacctggacgaccctgagaagctgaaagagctgattgagctgccgccctttgagattgtcacaggagaacggctgcctgccaacttctttaaattccagttccggaatgtggagtacagttccgggaggaacaagaccgcattatcaaaacccttagcaagaccaagaacctgcgtctgctcattctggtgggtcgactcttcatgtgggaggagccggagatccaggctgctctgaagaagctgaaggaggctggctgtaaactgcgcatcatgaagccccaggacttcgaatatgtctggcagaattttgtggagcaagaagagggtgaatccaaggcctttcagccctgggaggacattcaggagaacttcctatactacgaggagaagttggcagacatcctgaagtagggcaactgggctttgcctcacgtattcctgctgccaccaagagacagcaatgacatgtacagccatctgggacatgcctgtcttcctaataccatttggagctggacaacatttgacaccaaccaatcatactggacaaggcccttagaggacttgaaatatacttctcatgctgtagtttatttaggctgtgactctctctctaatgctgctctcgggaaggacgaaagtgacctgcaaggagagaaatgcaaccatacatgggctccagtcaactatgggactgaaggtcctaattgctcacccaagggggctgcttaacacaaacagcctcagacccgaggtttagatttctgaaatatgcattttatgttaagttgggtatttttttaaaaaaagaaaaacagcaacattaataaaagaagtggtgtgttt

SEQ ID NO: 85273 - DNA, 3134 bp, Homo sapiens
tttgccaacccatgaagatacaactttcagccatttcttttaaaaagcaggacccagtcactgaagtcagtgagcctatgatagggtatactgtgtggtactctgctcacataaaataagacactttatagtggtgaacagtagtcaaaacagatttctgagggtgccctctgagaatataaaatttaacttttagaattccttgaagattttgttagtgtatgtactatcactgtaattataaacccaacatagattctacagactaaccggcagcttaaaatttaaccccagtatattttcctttcagacatctttcagagtcaagggcccaggtgcctaactagcaagtccttagagcttttttttttttttttttttttcagtgatttcaaatataactgtattatctggacccattaacatgcttccctgtcttctatttgaattgctcatgtttgtgaagggaaaggttaagatatatcaagttaaaaaaaaaaaaactggcatgagataagagtgtaatctaaaagcccaaaagaacaaccctgcttaattaaaataatcttgagaaatgagcatttgttaaataaagtgtcttattttacatacttatttcatctttcttttttttttttttaatgacaaaatagtatttaatcctatatttagtcaaaagaccagagttaaaccagatctcttctggggctttttctgtgtaaaccacatcaaaacatgaacgaaagactggcttctggtttagtcaatcctggtaaatttacccaatcctgcaaaggaaactatggaggagaaatccagggacttgttgggaagggcacacagaaaccttagttcaaaaagaaactagtcattgttcggggccagcagagctctcagtaacacattttctttgtttgttttaccaaggtattcctgctgccaccaagagacagcaatgacatgtacagccatctgggacatgcctgtcttcctaataccatttggagctggacaacatttgacaccaaccaatcatactggacaaggcccttagaggacttgaaatatacttctcatgctgtagtttatttaggctgtgactctctctctaatgctgctctcgggaaggacgaaagtgacctgcaaggagagaaatgcaaccatacatgggctccagtcaactatgggactgaaggtcctaattgctcacccaagggggctgcttaacacaaacagcctcagacccgaggtttagatttctgaaatatgcattttatgttaagttgggtatttttttaaaaaaagaaaaacagcaacattaataaaagaagtggtgtgtttttcccgtggccagatttttaagaaacttgaacatctggaagttgccacagacaagcgagctagtccagacacagggacactccaggctatgaaccaagccatggttaaaccaagacttgcctagacaatgcagaataactctcccatacagacttcttacgacaatcaagtgagggcctttcccttctctgaaggcaagtaatagggcagaaggtggaacaaaaagcatgagaaatctaaggtagccacatcccaaatgccagttaataagcaactagcttctttattagagaggagcgggtgaaaagtagtagtttaatgttcagatatacaatcatttaaaagtattcaatacatggtgtttgatggtaatggcaggatgatgtcaagtctctctttttttttttttaaaggtttgtttgagtcctatgtggaagcaaaaattcacaggtgaatttccgggtgtttgccaaactctaactaggtttccaggaataatgtgttcactctgattaccagggcatgcctcctttcctcaggcttcaagtgtgataagtcgtcggaatttgacccaagactactatcggcaaatgacaaagtgctttatcacattcctgctaagtcccagaattccacttacagccaatcctgaatgagactaggttttgtctaaagaatcaaggctcaaacgccaagaaaaaaataataataataaccataatctctttaaaagtaaaggaagcctagaaaatccatgttttgacttgtgttaaggtttacagatggtactcaatttacaatggtttgtcttgcaatttttggactttacaacggtgcaaaagccatacacattcagtacacccttcaactgaactcaacttaagatggggttacccagacatagacctaagttgaggagcatctgtaattgcagagttaagcaaaatattttaagtttctttaagtttcttatcccccactctcactttcaattttgtgtatttagataatctctccttcctttttcccttcaactttatgtggacaaaagcaatgcttcaagaaaagcctcaatctaaaagtttgataatgaacttgaccctccactgcccctaccccaacaacatgaagaacttgtctgttccacctagaaatacaaaagtgaaatacttttttgaaactgttgcctcttatcaggctgatatgtgataagaacacagtctaaagtacaaagattatatttaaccagtactttcctggtgttttaaccagccccttctaaaatacagttgttcttttatacttgggaaagcagcaagtcctgtgacagacccaaagtcactctagggagaaaatcaatagcaagtctggctgttttaactctcaacaccactgtaagggaaaacaagaaaatgtctagtttcccgaatagctctgatactgaaccattggctaaatccatgaactttattttcctaccatgaccacaatagacgactggtctttgcagcttcggaagaaaagaggactaatatttagaccccagctggctgcacatccaaatcttctatggaggttaaaaacacaaaagtggccatcccactccaccaccaaatttttttttttaattgagatagggtcttgctctgttgcccacactggagtgcagtggcacaatcacagctcaatgcaacttcaacctcccaggctcaagccatcctcccgcctcaacctctagagtagctggaactacaggcctgcaccaccaggcccagctaatttttaatttcttt

SEQ ID NO: 85274 - DNA, 1684 bp, Homo sapiens
catccccagccagatttagctgctgacagctgcttgggactctgccgccagggcctggcccagacctgcctgcctctctcctctccctcagtgactcctgagccacagcccctccatggcccagaaggaagaggctgctgtggccactgaggctgcctcccagaatggggaggatctggagaacctggacgaccctgagaagctgaaagagctgattgagctgccgccctttgagattgtcacaggagaacggctgcctgccaacttctttaaattccagttccggaatgtggagtacagttccgggaggaacaagaccttcctctgctatgtggttgaagcacagggcaaggggggccaagtgcaggcatctcggggatacctagaggatgagcatgcggctgcccatgcagaggaagctttcttcaacaccatcctgccagccttcgacccagccctgcggtacaatgtcacctggtatgtgtcctccagcccctgtgcagcgtgtgctgaccgcattatcaaaacccttagcaagaccaagaacctgcgtctgctcattctggtgggtcgactcttcatgtgggaggagccggagatccaggctgctctgaagaagctgaaggaggctggctgtaaactgcgcatcatgaagccccaggacttcgaatatgtctggcagaattttgtggagcaagaagagggtgaatccaaggcctttcagccctgggaggacattcaggagaacttcctatactacgaggagaagttggcagacatcctgaagtagggcaactgggctttgcctcacgtattcctgctgccaccaagagacagcaatgacatgtacagccatctgggacatgcctgtcttcctaataccatttggagctggacaacatttgacaccaaccaatcatactggacaaggcccttagaggacttgaaatatacttctcatgctgtagtttatttaggctgtgactctctctctaatgctgctctcgggaaggacgaaagtgacctgcaaggagagaaatgcaaccatacatgggctccagtcaactatgggactgaaggtcctaattgctcacccaagggggctgcttaacacaaacagcctcagacccgaggtttagatttctgaaatatgcattttatgttaagttgggtatttttttaaaaaaagaaaaacagcaacattaataaaagaagtggtgtgtttaaaaaaacacacaacacaaaacaaacatccccccccccggtgagagcccgccaaggccacttcaaaaactgccaaacaccaacacaaggggcaccggggccaaaaaagggcaacggcgaaacgggggcacaagaggggagcaccaaaggaagaaaaaaccgcgggtgcacacagagacaaccacagacgaccaagcggaacaaaccacacacaaaaaataaaacacaaccgaccccagagggcaaacaacacccaccaacacgaccccgcggacacacaactgactccgcccacaagagggagagaaatctcggaaagacagtcaacaaacaaaagacgggaaactccacacagccacaacacgggagaagaaccacacaacagacgagcaagaaccacgagcaaatcagaatcagacaatgattcaagcaccccccgccccgcacgcacgaggaaagc

SEQ ID NO: 85275 - DNA, 3018 bp, Homo sapiens
catccccagccagatttagctgctgacagctgcttgggactctgccgccagggcctggcccagacctgcctgcctctctcctctccctcagtgactcctgagccacagcccctccatggcccagaaggaagaggctgctgtggccactgaggctgcctcccagaatggggaggatctggagaacctggacgaccctgagaagctgaaagagctgattgagctgccgccctttgagattgtcacaggagaacggctgcctgccaacttctttaaattccagttccggaatgtggagtacagttccgggaggaacaagaccttcctctgctatgtggttgaagcacagggcaaggggggccaagtgcaggcatctcggggatacctagaggatgagcatgcggctgcccatgcagaggaagctttcttcaacaccatcctgccagccttcgacccagccctgcggtacaatgtcacctggtatgtgtcctccagcccctgtgcagcgtgtgctgaccgcattatcaaaacccttagcaagaccaagaacctgcgtctgctcattctggtgggtcgactcttcatgtgggaggagccggagatccaggctgctctgaagaagctgaaggaggctggctgtaaactgcgcatcatgaagccccaggacttcgaatatgtctggcagaattttgtggagcaagaagagggtgaatccaaggcctttcagccctgggaggacattcaggagaacttcctatactacgaggagaagttggcagacatcctgaagtagggcaactgggctttgcctcacgtattcctgctgccaccaagagacagcaatgacatgtacagccatctgggacatgcctgtcttcctaataccatttggagctggacaacatttgacaccaaccaatcatactggacaaggcccttagaggacttgaaatatacttctcatgctgtagtttatttaggctgtgactctctctctaatgctgctctcgggaaggacgaaagtgacctgcaaggagagaaatgcaaccatacatgggctccagtcaactatgggactgaaggtcctaattgctcacccaagggggctgcttaacacaaacagcctcagacccgaggtttagatttctgaaatatgcattttatgttaagttgggtatttttttaaaaaaagaaaaacagcaacattaataaaagaagtggtgtgtttttcccgtggccagatttttaagaaacttgaacatctggaagttgccacagacaagcgagctagtccagacacagggacactccaggctatgaaccaagccatggttaaaccaagacttgcctagacaatgcagaataactctcccatacagacttcttacgacaatcaagtgagggcctttcccttctctgaaggcaagtaatagggcagaaggtggaacaaaaagcatgagaaatctaaggtagccacatcccaaatgccagttaataagcaactagcttctttattagagaggagcgggtgaaaagtagtagtttaatgttcagatatacaatcatttaaaagtattcaatacatggtgtttgatggtaatggcaggatgatgtcaagtctctctttttttttttttaaaggtttgtttgagtcctatgtggaagcaaaaattcacaggtgaatttccgggtgtttgccaaactctaactaggtttccaggaataatgtgttcactctgattaccagggcatgcctcctttcctcaggcttcaagtgtgataagtcgtcggaatttgacccaagactactatcggcaaatgacaaagtgctttatcacattcctgctaagtcccagaattccacttacagccaatcctgaatgagactaggttttgtctaaagaatcaaggctcaaacgccaagaaaaaaataataataataaccataatctctttaaaagtaaaggaagcctagaaaatccatgttttgacttgtgttaaggtttacagatggtactcaatttacaatggtttgtcttgcaatttttggactttacaacggtgcaaaagccatacacattcagtacacccttcaactgaactcaacttaagatggggttacccagacatagacctaagttgaggagcatctgtaattgcagagttaagcaaaatattttaagtttctttaagtttcttatcccccactctcactttcaattttgtgtatttagataatctctccttcctttttcccttcaactttatgtggacaaaagcaatgcttcaagaaaagcctcaatctaaaagtttgataatgaacttgaccctccactgcccctaccccaacaacatgaagaacttgtctgttccacctagaaatacaaaagtgaaatacttttttgaaactgttgcctcttatcaggctgatatgtgataagaacacagtctaaagtacaaagattatatttaaccagtactttcctggtgttttaaccagccccttctaaaatacagttgttcttttatacttgggaaagcagcaagtcctgtgacagacccaaagtcactctagggagaaaatcaatagcaagtctggctgttttaactctcaacaccactgtaagggaaaacaagaaaatgtctagtttcccgaatagctctgatactgaaccattggctaaatccatgaactttattttcctaccatgaccacaatagacgactggtctttgcagcttcggaagaaaagaggactaatatttagaccccagctggctgcacatccaaatcttctatggaggttaaaaacacaaaagtggccatcccactccaccaccaaatttttttttttaattgagatagggtcttgctctgttgcccacactggagtgcagtggcacaatcacagctcaatgcaacttcaacctcccaggctcaagccatcctcccgcctcaacctctagagtagctggaactacaggcctgcaccaccaggcccagctaatttttaatttcttt

SEQ ID NO: 85276 - DNA, 1178 bp, Homo sapiens
catccccagccagatttagctgctgacagctgcttgggactctgccgccagggcctggcccagacctgcctgcctctctcctctccctcagtgactcctgagccacagcccctccatggcccagaaggaagaggctgctgtggccactgaggctgcctcccagaatggggaggatctggagaacctggacgaccctgagaagctgaaagagctgattgagctgccgccctttgagattgtcacaggagaacggctgcctgccaacttctttaaattccagttccggaatgtggagtacagttccgggaggaacaagaccttcctctgctatgtggttgaagcacaggcatgcggctgcccatgcagaggaagctttcttcaacaccatcctgccagccttcgacccagccctgcggtacaatgtcacctggtatgtgtcctccagcccctgtgcagcgtgtgctgaccgcattatcaaaacccttagcaagaccaagaacctgcgtctgctcattctggtgggtcgactcttcatgtgggaggagccggagatccaggctgctctgaagaagctgaaggaggctggctgtaaactgcgcatcatgaagccccaggacttcgaatatgtctggcagaattttgtggagcaagaagagggtgaatccaaggcctttcagccctgggaggacattcaggagaacttcctatactacgaggagaagttggcagacatcctgaagtagggcaactgggctttgcctcacgtattcctgctgccaccaagagacagcaatgacatgtacagccatctgggacatgcctgtcttcctaataccatttggagctggacaacatttgacaccaaccaatcatactggacaaggcccttagaggacttgaaatatacttctcatgctgtagtttatttaggctgtgactctctctctaatgctgctctcgggaaggacgaaagtgacctgcaaggagagaaatgcaaccatacatgggctccagtcaactatgggactgaaggtcctaattgctcacccaagggggctgcttaacacaaacagcctcagacccgaggtttagatttctgaaatatgcattttatgttaagttgggtatttttttaaaaaaagaaaaacagcaacattaataaaagaagtggtgtgttt

SEQ ID NO: 85277 - DNA, 2927 bp, Homo sapiens
cgggagtgcagcggctgagaaggtcccttcggtgaaggcgagttccgggacaacagagagggccgcaccgtttccgagtctctcggaggctcagttctcagcgcaccattccccacagctctcctttttactttacccctacccgacacttgaccccggcagtgtgaaccccgctgggagcgtccaaagccatgcctcatcgcggctgcgcagcgcacgtgcacagcctcgcaggagtctcggcgattggctgtgacgcagtttccggcgtgagcggcgaaagccgggagggcgagcgagagagcaagcaggcagcaggctgccggcgggcgggcggacggcacagagggagggagcgagcgagcagtgagtaagccagcaagggcggtcgggtcccgaggtcagccgagatttctcaggtccctccggccccctccctggagtccacagcgcctccggtgtccagaggatcggacacggcccggcccggccatggcctcgttgctgaaggtggatcaggaagtgaagctcaaggttgattctttcagggagcggatcacaagtgaggcagaagacttggtggcaaattttttcccaaagaagttattagaacttgatagttttctgaaggaaccaatcttaaacatccatgacctaactcagatccactctgacatgaatctcccagtccctgaccccattcttctcaccaatagccatgatggactggatggtcccacttataagaagcgaaggttggatgagtgtgaagaagccttccaaggaaccaaggtgtttgtgatgcccaatgggatgctgaaaagcaaccagcagctggtggacattattgagaaagtgaaacctgagatccggctgttgattgagaaatgtaacacggtcaaaatgtgggtacagctcctgattcccaggatagaagatggaaacaactttggggtgtccattcaggaggaaacagttgcagagctaagaactgttgagagtgaagctgcatcttatctggaccagatttctagatattatattacaagagccaaattggtttctaaaatagctaaatatccccatgtggaggactatcgccgcaccgtgacagagattgatgagaaagaatatatcagccttcggctcatcatatcagagctgaggaatcaatatgtcactctacatgacatgatcctgaaaaatatcgagaagatcaaacggccccggagcagcaatgcagagactctgtactgaggccagggccagggccaggggactctgtgagtctggctcaagaccgacattgccttggtttgttacatgactatcgtgatggggaaactggctggaaatagtaatcacacctctctgtttttagttagagtctaatgaaactctcatctagttctgtgatgtgtttacctcttttttcaggcctcaggaactcttctatttccttccctaataccccacacccaacctgtcgtaatttctggagaactccaggtttgtgtgtgcaggatgttggcacaaaaatacctgtgttttcattctccccctctctccctcctgtgtcttgcgctttatgttttcttccgtttgataattagttggttaaaagctgagggaaccggaaggaaagtgctaggtgttttttaggaactagggtggcggggggacgaacttctcttcctcacatgaggttactgtttctttcctctgtggggcattggatcctcccacagttgccctggtgatgacttagggcttcccatctgtgtacatcccactttgaatcttgatcgtgacaagaaataccttaggccttcagtcaattccgaagctccttcagttgtttttataatgggcgttttcacatgcacatatgtgtatgcatgtatacgcccatacagacatgcacacacagactcctactccattagctaacataccctccctctccacaacccctgtcacatacctttcaggaggtgacagttgtcttagttgtcatctacccagacaaacgtcctgggcccgtcctccctcctgatactgtagcctcttggtacccagggtgagttggtggagaacagagagatgagaagcagagggcttggggaaagcctgttcctctctgactcagccctttttggcattattgcaagagcttgactcctggttgccttttcccagccagttttcagttggggtgaaggtttctgcaagtgtgaggtccagatgctgctgctcatgttgggctttccttttgggaactatttctctttatttatagtgtcgggcttccggggaaagcaatcattggtgtgtatgtgtatgtgcatgcacacacgtgcatatacacatttgtgtatgtggaaatgtgctgggcaagtcaaaactatagaagagttgcctcctgtctctcgaatcttccagagatatcacttaattgttaacagcttttgtgttaatccccttcagcccctagctcttttattctaccacggctggagagttgatacctgcagtcagcctgccagtgactcttagtgtctgtttctgacttatttttcctgtctctgtcttccaacccccaataatatttccaccggggatgcatcatttttactcccaatattctgtagagagggagtcaggatgctgtcttcccacgaatagtactcagtaacaaaccaattgcattttagttgggcagtgctcccacccaccctccagatcccttccagctaaaacccttcccccttccctccatgtgtttctcagtttcccgtttcgtttgttggactgttccactgcccctcctcctcaccctatcacccatggatcgtaatgtaaaattcttttaccatgtcaagaaattattaaaaatacaggtactttgacctctttctaaagccgca

SEQ ID NO: 85278 - DNA, 256 bp, Homo sapiens
gtacctatacaagaggagtacaccggtcccagaggaacgaaggactacccaggaatcgtcatgataatagaaccgaaatacagggccaatgaggccccttccctccatgtgtttctcagtttcccgtttcgtttgttggactgttccactgcccctcctcctcaccctatcacccatggatcgtaatgtaaaattcttttaccatgtcaagaaattattaaaaatacaggtactttgacctctttctaaagccgca

SEQ ID NO: 85279 - DNA, 2701 bp, Homo sapiens
  misc_feature (51)..(51): n is a, c, g, or t
aacactaccgtagaagcatacctacagggagaggaaaacattgtgcttggntcgaggtcgtggtgttgagcgagagagcaagcaggcagcaggctgccggcgggcgggcggacggcacagagggagggagcgagcgagcagtgagtaagccagcaagggcggtcgggtcccgaggtcagccgagatttctcaggtccctccggccccctccctggagtccacagcgcctccggtgtccagaggatcggacacggcccggcccggccatggcctcgttgctgaaggtggatcaggaagtgaagctcaaggttgattctttcagggagcggatcacaagtgaggcagaagacttggtggcaaattttttcccaaagaagttattagaacttgatagttttctgaaggaaccaatcttaaacatccatgacctaactcagatccactctgacatgaatctcccagtccctgaccccattcttctcaccaatagccatgatggactggatggtcccacttataagaagcgaaggttggatgagtgtgaagaagccttccaaggaaccaaggtgtttgtgatgcccaatgggatgctgaaaagcaaccagcagctggtggacattattgagaaagtgaaacctgagatccggctgttgattgagaaatgtaacacggtcaaaatgtgggtacagctcctgattcccaggatagaagatggaaacaactttggggtgtccattcaggaggaaacagttgcagagctaagaactgttgagagtgaagctgcatcttatctggaccagatttctagatattatattacaagagccaaattggtttctaaaatagctaaatatccccatgtggaggactatcgccgcaccgtgacagagattgatgagaaagaatatatcagccttcggctcatcatatcagagctgaggaatcaatatgtcactctacatgacatgatcctgaaaaatatcgagaagatcaaacggccccggagcagcaatgcagagactctgtactgaggccagggccagggccaggggactctgtgagtctggctcaagaccgacattgccttggtttgttacatgactatcgtgatggggaaactggctggaaatagtaatcacacctctctgtttttagttagagtctaatgaaactctcatctagttctgtgatgtgtttacctcttttttcaggcctcaggaactcttctatttccttccctaataccccacacccaacctgtcgtaatttctggagaactccaggtttgtgtgtgcaggatgttggcacaaaaatacctgtgttttcattctccccctctctccctcctgtgtcttgcgctttatgttttcttccgtttgataattagttggttaaaagctgagggaaccggaaggaaagtgctaggtgttttttaggaactagggtggcggggggacgaacttctcttcctcacatgaggttactgtttctttcctctgtggggcattggatcctcccacagttgccctggtgatgacttagggcttcccatctgtgtacatcccactttgaatcttgatcgtgacaagaaataccttaggccttcagtcaattccgaagctccttcagttgtttttataatgggcgttttcacatgcacatatgtgtatgcatgtatacgcccatacagacatgcacacacagactcctactccattagctaacataccctccctctccacaacccctgtcacatacctttcaggaggtgacagttgtcttagttgtcatctacccagacaaacgtcctgggcccgtcctccctcctgatactgtagcctcttggtacccagggtgagttggtggagaacagagagatgagaagcagagggcttggggaaagcctgttcctctctgactcagccctttttggcattattgcaagagcttgactcctggttgccttttcccagccagttttcagttggggtgaaggtttctgcaagtgtgaggtccagatgctgctgctcatgttgggctttccttttgggaactatttctctttatttatagtgtcgggcttccggggaaagcaatcattggtgtgtatgtgtatgtgcatgcacacacgtgcatatacacatttgtgtatgtggaaatgtgctgggcaagtcaaaactatagaagagttgcctcctgtctctcgaatcttccagagatatcacttaattgttaacagcttttgtgttaatccccttcagcccctagctcttttattctaccacggctggagagttgatacctgcagtcagcctgccagtgactcttagtgtctgtttctgacttatttttcctgtctctgtcttccaacccccaataatatttccaccggggatgcatcatttttactcccaatattctgtagagagggagtcaggatgctgtcttcccacgaatagtactcagtaacaaaccaattgcattttagttgggcagtgctcccacccaccctccagatcccttccagctaaaacccttcccccttccctccatgtgtttctcagtttcccgtttcgtttgttggactgttccactgcccctcctcctcaccctatcacccatggatcgtaatgtaaaattcttttaccatgtcaagaaattattaaaaatacaggtactttgacctctttctaaagccgca

SEQ ID NO: 85280 - DNA, 2664 bp, Homo sapiens
tatacagctaggtacgaggcctggtggtgagagcgagagagcaagcaggcagcaggctgccggcgggcgggcggacggcacagagggagggagcgagcgagcagtgagtaagccagcaagggcggtcgggtcccgaggtcagccgagatttctcaggtccctccggccccctccctggagtccacagcgcctccggtgtccagaggatcggacacggcccggcccggccatggcctcgttgctgaaggtggatcaggaagtgaagctcaaggttgattctttcagggagcggatcacaagtgaggcagaagacttggtggcaaattttttcccaaagaagttattagaacttgatagttttctgaaggaaccaatcttaaacatccatgacctaactcagatccactctgacatgaatctcccagtccctgaccccattcttctcaccaatagccatgatggactggatggtcccacttataagaagcgaaggttggatgagtgtgaagaagccttccaaggaaccaaggtgtttgtgatgcccaatgggatgctgaaaagcaaccagcagctggtggacattattgagaaagtgaaacctgagatccggctgttgattgagaaatgtaacacggtcaaaatgtgggtacagctcctgattcccaggatagaagatggaaacaactttggggtgtccattcaggaggaaacagttgcagagctaagaactgttgagagtgaagctgcatcttatctggaccagatttctagatattatattacaagagccaaattggtttctaaaatagctaaatatccccatgtggaggactatcgccgcaccgtgacagagattgatgagaaagaatatatcagccttcggctcatcatatcagagctgaggaatcaatatgtcactctacatgacatgatcctgaaaaatatcgagaagatcaaacggccccggagcagcaatgcagagactctgtactgaggccagggccagggccaggggactctgtgagtctggctcaagaccgacattgccttggtttgttacatgactatcgtgatggggaaactggctggaaatagtaatcacacctctctgtttttagttagagtctaatgaaactctcatctagttctgtgatgtgtttacctcttttttcaggcctcaggaactcttctatttccttccctaataccccacacccaacctgtcgtaatttctggagaactccaggtttgtgtgtgcaggatgttggcacaaaaatacctgtgttttcattctccccctctctccctcctgtgtcttgcgctttatgttttcttccgtttgataattagttggttaaaagctgagggaaccggaaggaaagtgctaggtgttttttaggaactagggtggcggggggacgaacttctcttcctcacatgaggttactgtttctttcctctgtggggcattggatcctcccacagttgccctggtgatgacttagggcttcccatctgtgtacatcccactttgaatcttgatcgtgacaagaaataccttaggccttcagtcaattccgaagctccttcagttgtttttataatgggcgttttcacatgcacatatgtgtatgcatgtatacgcccatacagacatgcacacacagactcctactccattagctaacataccctccctctccacaacccctgtcacatacctttcaggaggtgacagttgtcttagttgtcatctacccagacaaacgtcctgggcccgtcctccctcctgatactgtagcctcttggtacccagggtgagttggtggagaacagagagatgagaagcagagggcttggggaaagcctgttcctctctgactcagccctttttggcattattgcaagagcttgactcctggttgccttttcccagccagttttcagttggggtgaaggtttctgcaagtgtgaggtccagatgctgctgctcatgttgggctttccttttgggaactatttctctttatttatagtgtcgggcttccggggaaagcaatcattggtgtgtatgtgtatgtgcatgcacacacgtgcatatacacatttgtgtatgtggaaatgtgctgggcaagtcaaaactatagaagagttgcctcctgtctctcgaatcttccagagatatcacttaattgttaacagcttttgtgttaatccccttcagcccctagctcttttattctaccacggctggagagttgatacctgcagtcagcctgccagtgactcttagtgtctgtttctgacttatttttcctgtctctgtcttccaacccccaataatatttccaccggggatgcatcatttttactcccaatattctgtagagagggagtcaggatgctgtcttcccacgaatagtactcagtaacaaaccaattgcattttagttgggcagtgctcccacccaccctccagatcccttccagctaaaacccttcccccttccctccatgtgtttctcagtttcccgtttcgtttgttggactgttccactgcccctcctcctcaccctatcacccatggatcgtaatgtaaaattcttttaccatgtcaagaaattattaaaaatacaggtactttgacctctttctaaagccgca

SEQ ID NO: 85281 - DNA, 2643 bp, Homo sapiens
taggccgttcagtgtttacatgcatgtgtgccttggctgcgttcgagattggacaggcacagagggagggagcgagcgagcagtgagtaagccagcaagggcggtcgggtcccgaggtcagccgagatttctcaggtccctccggccccctccctggagtccacagcgcctccggtgtccagaggatcggacacggcccggcccggccatggcctcgttgctgaaggtggatcaggaagtgaagctcaaggttgattctttcagggagcggatcacaagtgaggcagaagacttggtggcaaattttttcccaaagaagttattagaacttgatagttttctgaaggaaccaatcttaaacatccatgacctaactcagatccactctgacatgaatctcccagtccctgaccccattcttctcaccaatagccatgatggactggatggtcccacttataagaagcgaaggttggatgagtgtgaagaagccttccaaggaaccaaggtgtttgtgatgcccaatgggatgctgaaaagcaaccagcagctggtggacattattgagaaagtgaaacctgagatccggctgttgattgagaaatgtaacacggtcaaaatgtgggtacagctcctgattcccaggatagaagatggaaacaactttggggtgtccattcaggaggaaacagttgcagagctaagaactgttgagagtgaagctgcatcttatctggaccagatttctagatattatattacaagagccaaattggtttctaaaatagctaaatatccccatgtggaggactatcgccgcaccgtgacagagattgatgagaaagaatatatcagccttcggctcatcatatcagagctgaggaatcaatatgtcactctacatgacatgatcctgaaaaatatcgagaagatcaaacggccccggagcagcaatgcagagactctgtactgaggccagggccagggccaggggactctgtgagtctggctcaagaccgacattgccttggtttgttacatgactatcgtgatggggaaactggctggaaatagtaatcacacctctctgtttttagttagagtctaatgaaactctcatctagttctgtgatgtgtttacctcttttttcaggcctcaggaactcttctatttccttccctaataccccacacccaacctgtcgtaatttctggagaactccaggtttgtgtgtgcaggatgttggcacaaaaatacctgtgttttcattctccccctctctccctcctgtgtcttgcgctttatgttttcttccgtttgataattagttggttaaaagctgagggaaccggaaggaaagtgctaggtgttttttaggaactagggtggcggggggacgaacttctcttcctcacatgaggttactgtttctttcctctgtggggcattggatcctcccacagttgccctggtgatgacttagggcttcccatctgtgtacatcccactttgaatcttgatcgtgacaagaaataccttaggccttcagtcaattccgaagctccttcagttgtttttataatgggcgttttcacatgcacatatgtgtatgcatgtatacgcccatacagacatgcacacacagactcctactccattagctaacataccctccctctccacaacccctgtcacatacctttcaggaggtgacagttgtcttagttgtcatctacccagacaaacgtcctgggcccgtcctccctcctgatactgtagcctcttggtacccagggtgagttggtggagaacagagagatgagaagcagagggcttggggaaagcctgttcctctctgactcagccctttttggcattattgcaagagcttgactcctggttgccttttcccagccagttttcagttggggtgaaggtttctgcaagtgtgaggtccagatgctgctgctcatgttgggctttccttttgggaactatttctctttatttatagtgtcgggcttccggggaaagcaatcattggtgtgtatgtgtatgtgcatgcacacacgtgcatatacacatttgtgtatgtggaaatgtgctgggcaagtcaaaactatagaagagttgcctcctgtctctcgaatcttccagagatatcacttaattgttaacagcttttgtgttaatccccttcagcccctagctcttttattctaccacggctggagagttgatacctgcagtcagcctgccagtgactcttagtgtctgtttctgacttatttttcctgtctctgtcttccaacccccaataatatttccaccggggatgcatcatttttactcccaatattctgtagagagggagtcaggatgctgtcttcccacgaatagtactcagtaacaaaccaattgcattttagttgggcagtgctcccacccaccctccagatcccttccagctaaaacccttcccccttccctccatgtgtttctcagtttcccgtttcgtttgttggactgttccactgcccctcctcctcaccctatcacccatggatcgtaatgtaaaattcttttaccatgtcaagaaattattaaaaatacaggtactttgacctctttctaaagccgca

SEQ ID NO: 85282 - DNA, 2860 bp, Homo sapiens
cgggagtgcagcggctgagaaggtcccttcggtgaaggcgagttccgggacaacagagagggccgcaccgtttccgagtctctcggaggctcagttctcagcgcaccattccccacagctctcctttttactttacccctacccgacacttgaccccggcagtgtgaaccccgctgggagcgtccaaagccatgcctcatcgcggctgcgcagcgcacgtgcacagcctcgcaggagtctcggcgattggctgtgacgcagtttccggcgtgagcggcgaaagccgggagggcgagcgagagagcaagcaggcagcaggctgccggcgggcgggcggacggcacagagggagggagcgagcgagcagtgagtaagccagcaagggcggtcgggtcccgaggtcagccgagatttctcaggtccctccggccccctccctggagtccacagcgcctccggtgtccagaggatcggacacggcccggcccggccatggcctcgttgctgaaggtggatcaggaagtgaagctcaaggttgattctttcagggagcggatcacaagtgaggcagaagacttggtggcaaattttttcccaaagaagttattagaacttgatagttttctgaaggaaccaatcttaaacatccatgacctaactcagatccactctgacatgaatctcccagtccctgaccccattcttctcaccaatagccatgatggactggatggtcccacttataagaagcgaaggttggatgagtgtgaagaagccttccaaggaaccaaggtgtttgtgatgcccaatgggatgctgaaaagcaaccagcagctggtggacattattgagaaagtgaaacctgagatccggctgttgattgagaaatgtaacacggtcaaaatgtgggtacagctcctgattcccaggatagaagatggaaacaactttggggtgtccattcaggaggaaacagttgcagagctaagaactgttgagagtgaagctgcatcttatctggaccagatttctagatattatattacaagagccaaattggtttctaaaatagctaaatatccccatgtggaggactatcgccgcaccgtgacagagattgatgagaaagaatatatcagccttcggctcatcatatcagagctgaggaatcaatatgtcactctacatgacatgatcctgaaaaatatcgagaagatcaaacggccccggagcagcaatgcagagactctgtactgaggccagggccagggccaggggactctgtgagtctggctcaagaccgacattgccttggtttgttacatgactatcgtgatggggaaactggctggaaatagtaatcacacctctctgtttttagttagagtctaatgaaactctcatctagttctgtgatgtgtttacctcttttttcaggcctcaggaactcttctatttccttccctaataccccacacccaacctgtcgtaatttctggagaactccaggtttgtgtgtgcaggatgttggcacaaaaatacctgtgttttcattctccccctctctccctcctgtgtcttgcgctttatgttttcttccgtttgataattagttggttaaaagctgagggaaccggaaggaaagtgctaggtgttttttaggaactagggtggcggggggacgaacttctcttcctcacatgaggttactgtttctttcctctgtggggcattggatcctcccacagttgccctggtgatgacttagggcttcccatctgtgtacatcccactttgaatcttgatcgtgacaagaaataccttaggccttcagtcaattccgaagctccttcagttgtttttataatgggcgttttcacatgcacatatgtgtatgcatgtatacgcccatacagacatgcacacacagactcctactccattagctaacataccctccctctccacaacccctgtcacatacctttcaggaggtgacagttgtcttagttgtcatctacccagacaaacgtcctgggcccgtcctccctcctgatactgtagcctcttggtacccagggtgagttggtggagaacagagagatgagaagcagagggcttggggaaagcctgttcctctctgactcagccctttttggcattattgcaagagcttgactcctggttgccttttcccagccagttttcagttggggtgaaggtttctgcaagtgtgaggtccagatgctgctgctcatgttgggctttccttttgggaactatttctctttatttatagtgtcgggcttccggggaaagcaatcattggtgtgtatgtgtatgtgcatgcacacacgtgcatatacacatttgtgtatgtggaaatgtgctgggcaagtcaaaactatagaagagttgcctcctgtctctcgaatcttccagagatatcacttaattgttaacagcttttgtgttaatccccttcagcccctagctcttttattctaccacggctggagagttgatacctgcagtcagcctgccagtgactcttagtgtctgtttctgacttatttttcctgtctctgtcttccaacccccaataatatttccaccggggatgcatcatttttactcccaatattctgtagagagggagtcaggatgctgtcttcccacgaatagtactcagtaacaaaccaattgcattttagttgggcagtgctcccacccaccctccagatcccttccagctaaaacccttcccccttccctccatgtgtttctcagtttcccgtttcgtttgttggactgttccactggatgaggcatggggatccttagagtcacctcagcatca

SEQ ID NO: 85283 - DNA, 2608 bp, Homo sapiens
ctgaccggcttcctactccccatggcgtctttgtctccctggggataccagctctgagcttccgctcggctcagcccagcccccaactcccggggtcggcttcgcgggagaggaaaatataggatggctttctgtaccgcgtctgatgatggagagtcccggggacacctccgcggacacgtgttggactcagggctttaggcccgtgacagctggttgattctttcagggagcggatcacaagtgaggcagaagacttggtggcaaattttttcccaaagaagttattagaacttgatagttttctgaaggaaccaatcttaaacatccatgacctaactcagatccactctgacatgaatctcccagtccctgaccccattcttctcaccaatagccatgatggactggatggtcccacttataagaagcgaaggttggatgagtgtgaagaagccttccaaggaaccaaggtgtttgtgatgcccaatgggatgctgaaaagcaaccagcagctggtggacattattgagaaagtgaaacctgagatccggctgttgattgagaaatgtaacacggtcaaaatgtgggtacagctcctgattcccaggatagaagatggaaacaactttggggtgtccattcaggaggaaacagttgcagagctaagaactgttgagagtgaagctgcatcttatctggaccagatttctagatattatattacaagagccaaattggtttctaaaatagctaaatatccccatgtggaggactatcgccgcaccgtgacagagattgatgagaaagaatatatcagccttcggctcatcatatcagagctgaggaatcaatatgtcactctacatgacatgatcctgaaaaatatcgagaagatcaaacggccccggagcagcaatgcagagactctgtactgaggccagggccagggccaggggactctgtgagtctggctcaagaccgacattgccttggtttgttacatgactatcgtgatggggaaactggctggaaatagtaatcacacctctctgtttttagttagagtctaatgaaactctcatctagttctgtgatgtgtttacctcttttttcaggcctcaggaactcttctatttccttccctaataccccacacccaacctgtcgtaatttctggagaactccaggtttgtgtgtgcaggatgttggcacaaaaatacctgtgttttcattctccccctctctccctcctgtgtcttgcgctttatgttttcttccgtttgataattagttggttaaaagctgagggaaccggaaggaaagtgctaggtgttttttaggaactagggtggcggggggacgaacttctcttcctcacatgaggttactgtttctttcctctgtggggcattggatcctcccacagttgccctggtgatgacttagggcttcccatctgtgtacatcccactttgaatcttgatcgtgacaagaaataccttaggccttcagtcaattccgaagctccttcagttgtttttataatgggcgttttcacatgcacatatgtgtatgcatgtatacgcccatacagacatgcacacacagactcctactccattagctaacataccctccctctccacaacccctgtcacatacctttcaggaggtgacagttgtcttagttgtcatctacccagacaaacgtcctgggcccgtcctccctcctgatactgtagcctcttggtacccagggtgagttggtggagaacagagagatgagaagcagagggcttggggaaagcctgttcctctctgactcagccctttttggcattattgcaagagcttgactcctggttgccttttcccagccagttttcagttggggtgaaggtttctgcaagtgtgaggtccagatgctgctgctcatgttgggctttccttttgggaactatttctctttatttatagtgtcgggcttccggggaaagcaatcattggtgtgtatgtgtatgtgcatgcacacacgtgcatatacacatttgtgtatgtggaaatgtgctgggcaagtcaaaactatagaagagttgcctcctgtctctcgaatcttccagagatatcacttaattgttaacagcttttgtgttaatccccttcagcccctagctcttttattctaccacggctggagagttgatacctgcagtcagcctgccagtgactcttagtgtctgtttctgacttatttttcctgtctctgtcttccaacccccaataatatttccaccggggatgcatcatttttactcccaatattctgtagagagggagtcaggatgctgtcttcccacgaatagtactcagtaacaaaccaattgcattttagttgggcagtgctcccacccaccctccagatcccttccagctaaaacccttcccccttccctccatgtgtttctcagtttcccgtttcgtttgttggactgttccactgcccctcctcctcaccctatcacccatggatcgtaatgtaaaattcttttaccatgtcaagaaattattaaaaatacaggtactttgacctctttctaaagccgca

SEQ ID NO: 85284 - DNA, 2846 bp, Homo sapiens
cgggagtgcagcggctgagaaggtcccttcggtgaaggcgagttccgggacaacagagagggccgcaccgtttccgagtctctcggaggctcagttctcagcgcaccattccccacagctctcctttttactttacccctacccgacacttgaccccggcagtgtgaaccccgctgggagcgtccaaagccatgcctcatcgcggctgcgcagcgcacgtgcacagcctcgcaggagtctcggcgattggctgtgacgcagtttccggcgtgagcggcgaaagccgggagggcgagcgagagagcaagcaggcagcaggctgccggcgggcgggcggacggcacagagggagggagcgagcgagcagtgagtaagccagcaagggcggtcgggtcccgaggtcagccgagatttctcaggtccctccggccccctccctggagtccacagcgcctccggtgtccagaggatcggacacggcccggcccggccatggcctcgttgctgaaggtggatcaggaagtgaagctcaaggttgattctttcagggagcggatcacaagtgaggcagaagacttggtggcaaattttttcccaaagaagttattagaacttgatagttttctgaaggaaccaatcttaaacatccatgacctaactcagatccactctgacatgaatctcccagtccctgaccccattcttctcaccaatagccatgatggactggatggtcccacttataagaagcgaaggttggatgagtgtgaagaagccttccaaggaaccaaggtgtttgtgatgcccaatgggatgctgaaaagcaaccagcagctggtggacattattgagaaagtgaaacctgagatccggctgttgattgagaaatgtaacacggtcaaaatgtgggtacagctcctgattcccaggatagaagatggaaacaactttggggtgtccattcaggaggaaacagttgcagagctaagaactgttgagagtgaagctgaggactatcgccgcaccgtgacagagattgatgagaaagaatatatcagccttcggctcatcatatcagagctgaggaatcaatatgtcactctacatgacatgatcctgaaaaatatcgagaagatcaaacggccccggagcagcaatgcagagactctgtactgaggccagggccagggccaggggactctgtgagtctggctcaagaccgacattgccttggtttgttacatgactatcgtgatggggaaactggctggaaatagtaatcacacctctctgtttttagttagagtctaatgaaactctcatctagttctgtgatgtgtttacctcttttttcaggcctcaggaactcttctatttccttccctaataccccacacccaacctgtcgtaatttctggagaactccaggtttgtgtgtgcaggatgttggcacaaaaatacctgtgttttcattctccccctctctccctcctgtgtcttgcgctttatgttttcttccgtttgataattagttggttaaaagctgagggaaccggaaggaaagtgctaggtgttttttaggaactagggtggcggggggacgaacttctcttcctcacatgaggttactgtttctttcctctgtggggcattggatcctcccacagttgccctggtgatgacttagggcttcccatctgtgtacatcccactttgaatcttgatcgtgacaagaaataccttaggccttcagtcaattccgaagctccttcagttgtttttataatgggcgttttcacatgcacatatgtgtatgcatgtatacgcccatacagacatgcacacacagactcctactccattagctaacataccctccctctccacaacccctgtcacatacctttcaggaggtgacagttgtcttagttgtcatctacccagacaaacgtcctgggcccgtcctccctcctgatactgtagcctcttggtacccagggtgagttggtggagaacagagagatgagaagcagagggcttggggaaagcctgttcctctctgactcagccctttttggcattattgcaagagcttgactcctggttgccttttcccagccagttttcagttggggtgaaggtttctgcaagtgtgaggtccagatgctgctgctcatgttgggctttccttttgggaactatttctctttatttatagtgtcgggcttccggggaaagcaatcattggtgtgtatgtgtatgtgcatgcacacacgtgcatatacacatttgtgtatgtggaaatgtgctgggcaagtcaaaactatagaagagttgcctcctgtctctcgaatcttccagagatatcacttaattgttaacagcttttgtgttaatccccttcagcccctagctcttttattctaccacggctggagagttgatacctgcagtcagcctgccagtgactcttagtgtctgtttctgacttatttttcctgtctctgtcttccaacccccaataatatttccaccggggatgcatcatttttactcccaatattctgtagagagggagtcaggatgctgtcttcccacgaatagtactcagtaacaaaccaattgcattttagttgggcagtgctcccacccaccctccagatcccttccagctaaaacccttcccccttccctccatgtgtttctcagtttcccgtttcgtttgttggactgttccactgcccctcctcctcaccctatcacccatggatcgtaatgtaaaattcttttaccatgtcaagaaattattaaaaatacaggtactttgacctctttctaaagccgca

SEQ ID NO: 85285 - DNA, 1965 bp, Homo sapiens
ggcatggatcagccgtggttaatcggccgagggtgacagtgaagctgcatcttatctggaccagatttctagatattatattacaagagccaaattggtttctaaaatagctaaatatccccatgtggaggactatcgccgcaccgtgacagagattgatgagaaagaatatatcagccttcggctcatcatatcagagctgaggaatcaatatgtcactctacatgacatgatcctgaaaaatatcgagaagatcaaacggccccggagcagcaatgcagagactctgtactgaggccagggccagggccaggggactctgtgagtctggctcaagaccgacattgccttggtttgttacatgactatcgtgatggggaaactggctggaaatagtaatcacacctctctgtttttagttagagtctaatgaaactctcatctagttctgtgatgtgtttacctcttttttcaggcctcaggaactcttctatttccttccctaataccccacacccaacctgtcgtaatttctggagaactccaggtttgtgtgtgcaggatgttggcacaaaaatacctgtgttttcattctccccctctctccctcctgtgtcttgcgctttatgttttcttccgtttgataattagttggttaaaagctgagggaaccggaaggaaagtgctaggtgttttttaggaactagggtggcggggggacgaacttctcttcctcacatgaggttactgtttctttcctctgtggggcattggatcctcccacagttgccctggtgatgacttagggcttcccatctgtgtacatcccactttgaatcttgatcgtgacaagaaataccttaggccttcagtcaattccgaagctccttcagttgtttttataatgggcgttttcacatgcacatatgtgtatgcatgtatacgcccatacagacatgcacacacagactcctactccattagctaacataccctccctctccacaacccctgtcacatacctttcaggaggtgacagttgtcttagttgtcatctacccagacaaacgtcctgggcccgtcctccctcctgatactgtagcctcttggtacccagggtgagttggtggagaacagagagatgagaagcagagggcttggggaaagcctgttcctctctgactcagccctttttggcattattgcaagagcttgactcctggttgccttttcccagccagttttcagttggggtgaaggtttctgcaagtgtgaggtccagatgctgctgctcatgttgggctttccttttgggaactatttctctttatttatagtgtcgggcttccggggaaagcaatcattggtgtgtatgtgtatgtgcatgcacacacgtgcatatacacatttgtgtatgtggaaatgtgctgggcaagtcaaaactatagaagagttgcctcctgtctctcgaatcttccagagatatcacttaattgttaacagcttttgtgttaatccccttcagcccctagctcttttattctaccacggctggagagttgatacctgcagtcagcctgccagtgactcttagtgtctgtttctgacttatttttcctgtctctgtcttccaacccccaataatatttccaccggggatgcatcatttttactcccaatattctgtagagagggagtcaggatgctgtcttcccacgaatagtactcagtaacaaaccaattgcattttagttgggcagtgctcccacccaccctccagatcccttccagctaaaacccttcccccttccctccatgtgtttctcagtttcccgtttcgtttgttggactgttccactgcccctcctcctcaccctatcacccatggatcgtaatgtaaaattcttttaccatgtcaagaaattattaaaaatacaggtactttgacctctttctaaagccgca

SEQ ID NO: 85286 - DNA, 2099 bp, Homo sapiens
cgggagtgcagcggctgagaaggtcccttcggtgaaggcgagttccgggacaacagagagggccgcaccgtttccgagtctctcggaggctcagttctcagcgcaccattccccacagctctcctttttactttacccctacccgacacttgaccccggcagtgtgaaccccgctgggagcgtccaaagccatgcctcatcgcggctgcgcagcgcacgtgcacagcctcgcaggagtctcggcgattggctgtgacgcagtttccggcgtgagcggcgaaagccgggagggcgagcgagagagcaagcaggcagcaggctgccggcgggcgggcggacggcacagagggagggagcgagcgagcagtgagtaagccagcaagggcggtcgggtcccgaggtcagccgagatttctcaggtccctccggccccctccctggagtccacagcgcctccggtgtccagaggatcggacacggcccggcccggccatggcctcgttgctgaaggtggatcaggaagtgaagctcaaggttgattctttcagggagcggatcacaagtgaggcagaagacttggtggcaaattttttcccaaagaagttattagaacttgatagttttctgaaggaaccaatcttaaacatccatgacctaactcagatccactctgacatgaatctcccagtccctgaccccattcttctcaccaatagccatgatggactggatggtcccacttataagaagcgaaggttggatgagtgtgaagaagccttccaaggaaccaaggtgtttgtgatgcccaatgggatgctgaaaagcaaccagcagctggtggacattattgagaaagtgaaacctgagatccggctgttgattgagaaatgtaacacggtcaaaatgtgggtacagctcctgattcccaggatagaagatggaaacaactttggggtgtccattcaggaggaaacagttgcagagctaagaactgttgagagtgaagctgcatcttatctggaccagatttctagatattatattacaagagccaaattggtttctaaaatagctaaatatccccatgtggaggactatcgccgcaccgtgacagagattgatgagaaagaatatatcagccttcggctcatcatatcagagctgaggaatcaatatgtcactctacatgacatgatcctgaaaaatatcgagaagatcaaacggccccggagcagcaatgcagagactctgtactgaggccagggccagggccaggggactctgtgagtctggctcaagaccgacattgccttggtttgttacatgactatcgtgatggggaaactggctggaaatagtaatcacacctctctgtttttagttagagtctaatgaaactctcatctagttctgtgatgtgtttacctcttttttcaggcctcaggaactcttctatttccttccctaataccccacacccaacctgtcgtaatttctggagaactccaggtttgtgtgtgcaggatgttggcacaaaaatacctgtgttttcattctccccctctctccctcctgtgtcttgcgctttatgttttcttccgtttgataattagttggttaaaagctgagggaaccggaaggaaagtgctaggtgttttttaggaactagggtggcggggggacgaacttctcttcctcacatgaggttactgtttctttcctctgtggggcattggatcctcccacagttgccctggtgatgacttagggcttcccatctgtgtacatcccactttgaatcttgatcgtgacaagaaataccttaggccttcagtcaattccgaagctccttcagttgtttttataatgggcgttttcacatgcacatatgtgtatgcatgtatacgcccatacagacatgcacacacagactcctaccccttccctccatgtgtttctcagtttcccgtttcgtttgttggactgttccactgcccctcctcctcaccctatcacccatggatcgtaatgtaaaattcttttaccatgtcaagaaattattaaaaatacaggtactttgacctctttctaaagccgca

SEQ ID NO: 85287 - DNA, 1979 bp, Homo sapiens
cgggagtgcagcggctgagaaggtcccttcggtgaaggcgagttccgggacaacagagagggccgcaccgtttccgagtctctcggaggctcagttctcagcgcaccattccccacagctctcctttttactttacccctacccgacacttgaccccggcagtgtgaaccccgctgggagcgtccaaagccatgcctcatcgcggctgcgcagcgcacgtgcacagcctcgcaggagtctcggcgattggctgtgacgcagtttccggcgtgagcggcgaaagccgggagggcgagcgagagagcaagcaggcagcaggctgccggcgggcgggcggacggcacagagggagggagcgagcgagcagtgagtaagccagcaagggcggtcgggtcccgaggtcagccgagatttctcaggtccctccggccccctccctggagtccacagcgcctccggtgtccagaggatcggacacggcccggcccggccatggcctcgttgctgaaggtggatcaggaagtgaagctcaaggttgattctttcagggagcggatcacaagtgaggcagaagacttggtggcaaattttttcccaaagaagttattagaacttgatagttttctgaaggaaccaatcttaaacatccatgacctaactcagatccactctgacatgaatctcccagtccctgaccccattcttctcaccaatagccatgatggactggatggtgaacttctcttcctcacatgaggttactgtttctttcctctgtggggcattggatcctcccacagttgccctggtgatgacttagggcttcccatctgtgtacatcccactttgaatcttgatcgtgacaagaaataccttaggccttcagtcaattccgaagctccttcagttgtttttataatgggcgttttcacatgcacatatgtgtatgcatgtatacgcccatacagacatgcacacacagactcctactccattagctaacataccctccctctccacaacccctgtcacatacctttcaggaggtgacagttgtcttagttgtcatctacccagacaaacgtcctgggcccgtcctccctcctgatactgtagcctcttggtacccagggtgagttggtggagaacagagagatgagaagcagagggcttggggaaagcctgttcctctctgactcagccctttttggcattattgcaagagcttgactcctggttgccttttcccagccagttttcagttggggtgaaggtttctgcaagtgtgaggtccagatgctgctgctcatgttgggctttccttttgggaactatttctctttatttatagtgtcgggcttccggggaaagcaatcattggtgtgtatgtgtatgtgcatgcacacacgtgcatatacacatttgtgtatgtggaaatgtgctgggcaagtcaaaactatagaagagttgcctcctgtctctcgaatcttccagagatatcacttaattgttaacagcttttgtgttaatccccttcagcccctagctcttttattctaccacggctggagagttgatacctgcagtcagcctgccagtgactcttagtgtctgtttctgacttatttttcctgtctctgtcttccaacccccaataatatttccaccggggatgcatcatttttactcccaatattctgtagagagggagtcaggatgctgtcttcccacgaatagtactcagtaacaaaccaattgcattttagttgggcagtgctcccacccaccctccagatcccttccagctaaaacccttcccccttccctccatgtgtttctcagtttcccgtttcgtttgttggactgttccactgcccctcctcctcaccctatcacccatggatcgtaatgtaaaattcttttaccatgtcaagaaattattaaaaatacaggtactttgacctctttctaaagccgca

SEQ ID NO: 85288 - DNA, 1313 bp, Homo sapiens
acctccagcaggatcatggcggcggctggccccctaggtgttttttaggaactagggtggcggggggacgaacttctcttcctcacatgaggttactgtttctttcctctgtggggcattggatcctcccacagttgccctggtgatgacttagggcttcccatctgtgtacatcccactttgaatcttgatcgtgacaagaaataccttaggccttcagtcaattccgaagctccttcagttgtttttataatgggcgttttcacatgcacatatgtgtatgcatgtatacgcccatacagacatgcacacacagactcctactccattagctaacataccctccctctccacaacccctgtcacatacctttcaggaggtgacagttgtcttagttgtcatctacccagacaaacgtcctgggcccgtcctccctcctgatactgtagcctcttggtacccagggtgagttggtggagaacagagagatgagaagcagagggcttggggaaagcctgttcctctctgactcagccctttttggcattattgcaagagcttgactcctggttgccttttcccagccagttttcagttggggtgaaggtttctgcaagtgtgaggtccagatgctgctgctcatgttgggctttccttttgggaactatttctctttatttatagtgtcgggcttccggggaaagcaatcattggtgtgtatgtgtatgtgcatgcacacacgtgcatatacacatttgtgtatgtggaaatgtgctgggcaagtcaaaactatagaagagttgcctcctgtctctcgaatcttccagagatatcacttaattgttaacagcttttgtgttaatccccttcagcccctagctcttttattctaccacggctggagagttgatacctgcagtcagcctgccagtgactcttagtgtctgtttctgacttatttttcctgtctctgtcttccaacccccaataatatttccaccggggatgcatcatttttactcccaatattctgtagagagggagtcaggatgctgtcttcccacgaatagtactcagtaacaaaccaattgcattttagttgggcagtgctcccacccaccctccagatcccttccagctaaaacccttcccccttccctccatgtgtttctcagtttcccgtttcgtttgttggactgttccactgcccctcctcctcaccctatcacccatggatcgtaatgtaaaattcttttaccatgtcaagaaattattaaaaatacaggtactttgacctctttctaaagccgca

SEQ ID NO: 85289 - DNA, 1013 bp, Homo sapiens
cactggcccctcgcaatgcagaagaactctgctgcccatcgcttcccagggagtgaggcagcatggctctgcaggcatggaagatggccttcaccgttgtcatctacccagacaaacgtcctgggcccgtcctccctcctgatactgtagcctcttggtacccagggtgagttggtggagaacagagagatgagaagcagagggcttggggaaagcctgttcctctctgactcagccctttttggcattattgcaagagcttgactcctggttgccttttcccagccagttttcagttggggtgaaggtttctgcaagtgtgaggtccagatgctgctgctcatgttgggctttccttttgggaactatttctctttatttatagtgtcgggcttccggggaaagcaatcattggtgtgtatgtgtatgtgcatgcacacacgtgcatatacacatttgtgtatgtggaaatgtgctgggcaagtcaaaactatagaagagttgcctcctgtctctcgaatcttccagagatatcacttaattgttaacagcttttgtgttaatccccttcagcccctagctcttttattctaccacggctggagagttgatacctgcagtcagcctgccagtgactcttagtgtctgtttctgacttatttttcctgtctctgtcttccaacccccaataatatttccaccggggatgcatcatttttactcccaatattctgtagagagggagtcaggatgctgtcttcccacgaatagtactcagtaacaaaccaattgcattttagttgggcagtgctcccacccaccctccagatcccttccagctaaaacccttcccccttccctccatgtgtttctcagtttcccgtttcgtttgttggactgttccactgcccctcctcctcaccctatcacccatggatcgtaatgtaaaattcttttaccatgtcaagaaattattaaaaatacaggtactttgacctctttctaaagccgca

SEQ ID NO: 85290 - DNA, 892 bp, Homo sapiens
cggacgcgtgggtcggacgcgtggtgtagcctcttggtacccagggtgagttggtggagaacagagagatgagaagcagagggcttggggaaagcctgttcctctctgactcagccctttttggcattattgcaagagcttgactcctggttgccttttcccagccagttttcagttggggtgaaggtttctgcaagtgtgaggtccagatgctgctgctcatgttgggctttccttttgggaactatttctctttatttatagtgtcgggcttccggggaaagcaatcattggtgtgtatgtgtatgtgcatgcacacacgtgcatatacacatttgtgtatgtggaaatgtgctgggcaagtcaaaactatagaagagttgcctcctgtctctcgaatcttccagagatatcacttaattgttaacagcttttgtgttaatccccttcagcccctagctcttttattctaccacggctggagagttgatacctgcagtcagcctgccagtgactcttagtgtctgtttctgacttatttttcctgtctctgtcttccaacccccaataatatttccaccggggatgcatcatttttactcccaatattctgtagagagggagtcaggatgctgtcttcccacgaatagtactcagtaacaaaccaattgcattttagttgggcagtgctcccacccaccctccagatcccttccagctaaaacccttcccccttccctccatgtgtttctcagtttcccgtttcgtttgttggactgttccactgcccctcctcctcaccctatcacccatggatcgtaatgtaaaattcttttaccatgtcaagaaattattaaaaatacaggtactttgacctctttctaaagccgca

SEQ ID NO: 85291 - DNA, 566 bp, Homo sapiens
gttagttttaccctactgatgatgtgttgttgccaagtcaaaactatagaagagttgcctcctgtctctcgaatcttccagagatatcacttaattgttaacagcttttgtgttaatccccttcagcccctagctcttttattctaccacggctggagagttgatacctgcagtcagcctgccagtgactcttagtgtctgtttctgacttatttttcctgtctctgtcttccaacccccaataatatttccaccggggatgcatcatttttactcccaatattctgtagagagggagtcaggatgctgtcttcccacgaatagtactcagtaacaaaccaattgcattttagttgggcagtgctcccacccaccctccagatcccttccagctaaaacccttcccccttccctccatgtgtttctcagtttcccgtttcgtttgttggactgttccactgcccctcctcctcaccctatcacccatggatcgtaatgtaaaattcttttaccatgtcaagaaattattaaaaatacaggtactttgacctctttctaaagccgca

SEQ ID NO: 85292 - DNA, 1134 bp, Homo sapiens
cgggagtgcagcggctgagaaggtcccttcggtgaaggcgagttccgggacaacagagagggccgcaccgtttccgagtctctcggaggctcagttctcagcgcaccattccccacagctctcctttttactttacccctacccgacacttgaccccggcagtgtgaaccccgctgggagcgtccaaagccatgcctcatcgcggctgcgcagcgcacgtgcacagcctcgcaggagtctcggcgattggctgtgacgcagtttccggcgtgagcggcgaaagccgggagggcgagcgagagagcaagcaggcagcaggctgccggcgggcgggcggacggcacagagggagggagcgagcgagcagtgagtaagccagcaagggcggtcgggtcccgaggtcagccgagatttctcaggtccctccggccccctccctggagtccacagcgcctccggtgtccagaggatcggacacggcccggcccggccatggcctcgttgctgaaggtggatcaggaagtgaagctcaagacagcttcagacacaggaggaagggagggaagggggaggacagaggagacaggcaggtgctgtcctcaaagccctgcgttcttctgagatggaaaaatggatcctcaaaaaaataaagtatttgcagtctgggggcctctcagcttcttattacagttacaaggttgattctttcagggagcggatcacaagtgaggcagaagacttggtggcaaattttttcccaaagaagttattagaacttgatagttttctgaaggaaccaatcttaaacatccatgacctaactcagatccactctgacatgaatctcccagtccctgaccccattcttctcaccaatagccatgatggactggatggtcccacttataagaagcgaaggttggatgagtgtgaagaagccttccaaggaaccaaggtgtttgtgatgcccaatgggatgctgaaaagcaaccagcagctggtggacattattgagaaagtgaaacctgagatccggctgttgattgagaaatgtaacacgcaaatgtgggtacagtcctgattcccaggttgagtgggacccttggggggcctcggcgaacgtgcagcagacgt

SEQ ID NO: 85293 - DNA, 632 bp, Homo sapiens
tatacagctaggtacgaggcctggtggtgagagcgagagagcaagcaggcagcaggctgccggcgggcgggcggacggcacagagggagggagcgagcgagcagtgagtaagccagcaagggcggtcgggtcccgaggtcagccgagatttctcaggtccctccggccccctccctggagtccacagcgcctccggtgtccagaggatcggacacggcccggcccggccatggcctcgttgctgaaggtggatcaggaagtgaagctcaaggttgattctttcagggagcggatcacaagtgaggcagaagacttggtggcaaattttttcccaaagaagttattagaacttgatagttttctgaaggaaccaatcttaaacatccatgacctaactcagatccactctgacatgaatctcccagtccctgaccccattcttctcaccaaattagcccattgattggaccttgggacttgggttaccacagactttacttaacgccaccgccgacaacgggtttggggacttgaacggttgggtggaagggaaaagggcccgttttcgcaagaggggaaagcccgaaagtggatggttaatggctggacttggccgcgaaattggaggagtg

SEQ ID NO: 85294 - DNA, 2665 bp, Homo sapiens
aactaacgcgctaggtacgaggcctgggtgttagcgagagagcaagcaggcagcaggctgccggcgggcgggcggacggcacagagggagggagcgagcgagcagtgagtaagccagcaagggcggtcgggtcccgaggtcagccgagatttctcaggtccctccggccccctccctggagtccacagcgcctccggtgtccagaggatcggacacggcccggcccggccatggcctcgttgctgaaggtggatcaggaagtgaagctcaaggttgattctttcagggagcggatcacaagtgaggcagaagacttggtggcaaattttttcccaaagaagttattagaacttgatagttttctgaaggaaccaatcttaaacatccatgacctaactcagatccactctgacatgaatctcccagtccctgaccccattcttctcaccaatagccatgatggactggatggtcccacttataagaagcgaaggttggatgagtgtgaagaagccttccaaggaaccaaggtgtttgtgatgcccaatgggatgctgaaaagcaaccagcagctggtggacattattgagaaagtgaaacctgagatccggctgttgattgagaaatgtaacacggtcaaaatgtgggtacagctcctgattcccaggatagaagatggaaacaactttggggtgtccattcaggaggaaacagttgcagagctaagaactgttgagagtgaagctgcatcttatctggaccagatttctagatattatattacaagagccaaattggtttctaaaatagctaaatatccccatgtggaggactatcgccgcaccgtgacagagattgatgagaaagaatatatcagccttcggctcatcatatcagagctgaggaatcaatatgtcactctacatgacatgatcctgaaaaatatcgagaagatcaaacggccccggagcagcaatgcagagactctgtactgaggccagggccagggccaggggactctgtgagtctggctcaagaccgacattgccttggtttgttacatgactatcgtgatggggaaactggctggaaatagtaatcacacctctctgtttttagttagagtctaatgaaactctcatctagttctgtgatgtgtttacctcttttttcaggcctcaggaactcttctatttccttccctaataccccacacccaacctgtcgtaatttctggagaactccaggtttgtgtgtgcaggatgttggcacaaaaatacctgtgttttcattctccccctctctccctcctgtgtcttgcgctttatgttttcttccgtttgataattagttggttaaaagctgagggaaccggaaggaaagtgctaggtgttttttaggaactagggtggcggggggacgaacttctcttcctcacatgaggttactgtttctttcctctgtggggcattggatcctcccacagttgccctggtgatgacttagggcttcccatctgtgtacatcccactttgaatcttgatcgtgacaagaaataccttaggccttcagtcaattccgaagctccttcagttgtttttataatgggcgttttcacatgcacatatgtgtatgcatgtatacgcccatacagacatgcacacacagactcctactccattagctaacataccctccctctccacaacccctgtcacatacctttcaggaggtgacagttgtcttagttgtcatctacccagacaaacgtcctgggcccgtcctccctcctgatactgtagcctcttggtacccagggtgagttggtggagaacagagagatgagaagcagagggcttggggaaagcctgttcctctctgactcagccctttttggcattattgcaagagcttgactcctggttgccttttcccagccagttttcagttggggtgaaggtttctgcaagtgtgaggtccagatgctgctgctcatgttgggctttccttttgggaactatttctctttatttatagtgtcgggcttccggggaaagcaatcattggtgtgtatgtgtatgtgcatgcacacacgtgcatatacacatttgtgtatgtggaaatgtgctgggcaagtcaaaactatagaagagttgcctcctgtctctcgaatcttccagagatatcacttaattgttaacagcttttgtgttaatccccttcagcccctagctcttttattctaccacggctggagagttgatacctgcagtcagcctgccagtgactcttagtgtctgtttctgacttatttttcctgtctctgtcttccaacccccaataatatttccaccggggatgcatcatttttactcccaatattctgtagagagggagtcaggatgctgtcttcccacgaatagtactcagtaacaaaccaattgcattttagttgggcagtgctcccacccaccctccagatcccttccagctaaaacccttcccccttccctccatgtgtttctcagtttcccgtttcgtttgttggactgttccactgcccctcctcctcaccctatcacccatggatcgtaatgtaaaattcttttaccatgtcaagaaattattaaaaatacaggtactttgacctctttctaaagccgca

SEQ ID NO: 85295 - DNA, 3448 bp, Homo sapiens
cgggagtgcagcggctgagaaggtcccttcggtgaaggcgagttccgggacaacagagagggccgcaccgtttccgagtctctcggaggctcagttctcagcgcaccattccccacagctctcctttttactttacccctacccgacacttgaccccggcagtgtgaaccccgctgggagcgtccaaagccatgcctcatcgcggctgcgcagcgcacgtgcacagcctcgcaggagtctcggcgattggctgtgacgcagtttccggcgtgagcggcgaaagccgggagggcgagcgagagagcaagcaggcagcaggctgccggcgggcgggcggacggcacagagggagggagcgagcgagcagtgagtaagccagcaagggcggtcgggtcccgaggtcagccgagatttctcaggtccctccggccccctccctggagtccacagcgcctccggtgtccagaggatcggacacggcccggcccggccatggcctcgttgctgaaggtggatcaggaagtgaagctcaaggttgattctttcagggagcggatcacaagtgaggcagaagacttggtggcaaattttttcccaaagaagttattagaacttgatagttttctgaaggaaccaatcttaaacatccatgacctaactcagatccactctgacatgaatctcccagtccctgaccccattcttctcaccaatagccatgatggactggatggtcccacttataagaagcgaaggttggatgagtgtgaagaagccttccaaggaaccaaggtgtttgtgatgcccaatgggatgctgaaaagcaaccagcagctggtggacattattgagaaagtgaaacctgagatccggctgttgattgagaaatgtaacacggtcaaaatgtgggtacagctcctgattcccaggatagaagatggaaacaactttggggtgtccattcaggaggaaacagttgcagagctaagaactgttgagagtgaagctgcatcttatctggaccagatttctagatattatattacaagagccaaattggtttctaaaatagctaaatatccccatgtggaggactatcgccgcaccgtgacagagattgatgagaaagaatatatcagccttcggctcatcatatcagagctgaggaatcaatatgtcactctacatgacatgatcctgaaaaatatcgagaagatcaaacggccccggagcagcaatgcagagactctgtactgaggccagggccagggccaggggactctgtgagtctggctcaagaccgacattgccttggtttgttacatgactatcgtgatggggaaactggctggaaatagtaatcacacctctctgtttttagttagagtctaatgaaactctcatctagttctgtgatgtgtttacctcttttttcaggcctcaggaactcttctatttccttccctaataccccacacccaacctgtcgtaatttctggagaactccaggtttgtgtgtgcaggatgttggcacaaaaatacctgtgttttcattctccccctctctccctcctgtgtcttgcgctttatgttttcttccgtttgataattagttggttaaaagctgagggaaccggaaggaaagtgctaggtgttttttaggaactagggtggcggggggacgaacttctcttcctcacatgaggttactgtttctttcctctgtggggcattggatcctcccacagttgccctggtgatgacttagggcttcccatctgtgtacatcccactttgaatcttgatcgtgacaagaaataccttaggccttcagtcaattccgaagctccttcagttgtttttataatgggcgttttcacatgcacatatgtgtatgcatgtatacgcccatacagacatgcacacacagactcctactccattagctaacataccctccctctccacaacccctgtcacatacctttcaggaggtgacagttgtcttagttgtcatctacccagacaaacgtcctgggcccgtcctccctcctgatactgtagcctcttggtacccagggtgagttggtggagaacagagagatgagaagcagagggcttggggaaagcctgttcctctctgactcagccctttttggcattattgcaagagcttgactcctggttgccttttcccagccagttttcagttggggtgaaggtttctgcaagtgtgaggtccagatgctgctgctcatgttgggctttccttttgggaactatttctctttatttatagtgtcgggcttccggggaaagcaatcattggtgtgtatgtgtatgtgcatgcacacacgtgcatatacacatttgtgtatgtggaaatgtgctgggcaagtcaaaactatagaagagttgcctcctgtctctcgaatcttccagagatatcacttaattgttaacagcttttgtgttaatccccttcagcccctagctcttttattctaccacggctggagagttgatacctgcagtcagcctgccagtgactcttagtgtctgtttctgacttatttttcctgtctctgtcttccaacccccaataatatttccaccggggatgcatcatttttactcccaatattctgtagagagggagtcaggatgctgtcttcccacgaatagtactcagtaacaaaccaattgcattttagttgggcagtgctcccacccaccctccagatcccttccagctaaaacccttcccccttccctccatgtgtttctcagtttcccgtttcgtttgttggactgttccactgcccctcctcctcaccctatcacccatggatcgtaatgtaaaattcttttaccatgtcaagaaattattaaaaatacaggtactttgacctctttctaaagccgcagaccctggtgcaatgctctggtggctagggatgtactcatgctcatatgtgtgcacgcttggacacccacctccatggacacctagccaccctgttgtgtgtccttatgccagttgagctgaatcttttccccagtatagtggaaagactgaggcttctgcctactgagcaaggttgggtgcttcatttgtgttcagtctgaattatgggaaagttagctcttcccagacctaagctgccttctctccctactttcagaagatcctagttccttccttcccgagtgatacccatgaactgccagtagaggctgctatcgttccatgtgtaaggaatgaactggttcaaggcgcgtcctacccagtcattttctttaccttatactaattcttcctgaataatgtcttcagtttcttgaggagactcctagttttggttttcaaattacttggagggctgcctaggaatctatctccctctgaaataaagtttcctcatcttccaccttgcaaaaagccttc

SEQ ID NO: 85296 - DNA, 3487 bp, Homo sapiens
cgggagtgcagcggctgagaaggtcccttcggtgaaggcgagttccgggacaacagagagggccgcaccgtttccgagtctctcggaggctcagttctcagcgcaccattccccacagctctcctttttactttacccctacccgacacttgaccccggcagtgtgaaccccgctgggagcgtccaaagccatgcctcatcgcggctgcgcagcgcacgtgcacagcctcgcaggagtctcggcgattggctgtgacgcagtttccggcgtgagcggcgaaagccgggagggcgagcgagagagcaagcaggcagcaggctgccggcgggcgggcggacggcacagagggagggagcgagcgagcagtgagtaagccagcaagggcggtcgggtcccgaggtcagccgagatttctcaggtccctccggccccctccctggagtccacagcgcctccggtgtccagaggatcggacacggcccggcccggccatggcctcgttgctgaaggtggatcaggaagtgaagctcaaggttgattctttcagggagcggatcacaagtgaggcagaagacttggtggcaaattttttcccaaagaagttattagaacttgatagttttctgaaggaaccaatcttaaacatccatgacctaactcagatccactctgacatgaatctcccagtccctgaccccattcttctcaccaatagccatgatggactggatggtcccacttataagaagcgaaggttggatgagtgtgaagaagccttccaaggaaccaaggtgtttgtgatgcccaatgggatgctgaaaagcaaccagcagctggtggacattattgagaaagtgaaacctgagatccggctgttgattgagaaatgtaacacgccttcaggcaaaggtcctcatatatgttttgacctccaggtcaaaatgtgggtacagctcctgattcccaggatagaagatggaaacaactttggggtgtccattcaggaggaaacagttgcagagctaagaactgttgagagtgaagctgcatcttatctggaccagatttctagatattatattacaagagccaaattggtttctaaaatagctaaatatccccatgtggaggactatcgccgcaccgtgacagagattgatgagaaagaatatatcagccttcggctcatcatatcagagctgaggaatcaatatgtcactctacatgacatgatcctgaaaaatatcgagaagatcaaacggccccggagcagcaatgcagagactctgtactgaggccagggccagggccaggggactctgtgagtctggctcaagaccgacattgccttggtttgttacatgactatcgtgatggggaaactggctggaaatagtaatcacacctctctgtttttagttagagtctaatgaaactctcatctagttctgtgatgtgtttacctcttttttcaggcctcaggaactcttctatttccttccctaataccccacacccaacctgtcgtaatttctggagaactccaggtttgtgtgtgcaggatgttggcacaaaaatacctgtgttttcattctccccctctctccctcctgtgtcttgcgctttatgttttcttccgtttgataattagttggttaaaagctgagggaaccggaaggaaagtgctaggtgttttttaggaactagggtggcggggggacgaacttctcttcctcacatgaggttactgtttctttcctctgtggggcattggatcctcccacagttgccctggtgatgacttagggcttcccatctgtgtacatcccactttgaatcttgatcgtgacaagaaataccttaggccttcagtcaattccgaagctccttcagttgtttttataatgggcgttttcacatgcacatatgtgtatgcatgtatacgcccatacagacatgcacacacagactcctactccattagctaacataccctccctctccacaacccctgtcacatacctttcaggaggtgacagttgtcttagttgtcatctacccagacaaacgtcctgggcccgtcctccctcctgatactgtagcctcttggtacccagggtgagttggtggagaacagagagatgagaagcagagggcttggggaaagcctgttcctctctgactcagccctttttggcattattgcaagagcttgactcctggttgccttttcccagccagttttcagttggggtgaaggtttctgcaagtgtgaggtccagatgctgctgctcatgttgggctttccttttgggaactatttctctttatttatagtgtcgggcttccggggaaagcaatcattggtgtgtatgtgtatgtgcatgcacacacgtgcatatacacatttgtgtatgtggaaatgtgctgggcaagtcaaaactatagaagagttgcctcctgtctctcgaatcttccagagatatcacttaattgttaacagcttttgtgttaatccccttcagcccctagctcttttattctaccacggctggagagttgatacctgcagtcagcctgccagtgactcttagtgtctgtttctgacttatttttcctgtctctgtcttccaacccccaataatatttccaccggggatgcatcatttttactcccaatattctgtagagagggagtcaggatgctgtcttcccacgaatagtactcagtaacaaaccaattgcattttagttgggcagtgctcccacccaccctccagatcccttccagctaaaacccttcccccttccctccatgtgtttctcagtttcccgtttcgtttgttggactgttccactgcccctcctcctcaccctatcacccatggatcgtaatgtaaaattcttttaccatgtcaagaaattattaaaaatacaggtactttgacctctttctaaagccgcagaccctggtgcaatgctctggtggctagggatgtactcatgctcatatgtgtgcacgcttggacacccacctccatggacacctagccaccctgttgtgtgtccttatgccagttgagctgaatcttttccccagtatagtggaaagactgaggcttctgcctactgagcaaggttgggtgcttcatttgtgttcagtctgaattatgggaaagttagctcttcccagacctaagctgccttctctccctactttcagaagatcctagttccttccttcccgagtgatacccatgaactgccagtagaggctgctatcgttccatgtgtaaggaatgaactggttcaaggcgcgtcctacccagtcattttctttaccttatactaattcttcctgaataatgtcttcagtttcttgaggagactcctagttttggttttcaaattacttggagggctgcctaggaatctatctccctctgaaataaagtttcctcatcttccaccttgcaaaaagccttc

SEQ ID NO: 85297 - DNA, 2070 bp, Homo sapiens
gcagcgatactgaatcggctgtgattgagaaggtaacacggtcaaaatgtgggtacagctcctgattcccaggatagaagatggaaacaactttggggtgtccattcaggaggaaacagttgcagagctaagaactgttgagagtgaagctgcatcttatctggaccagatttctagatattatattacaagagccaaattggtttctaaaatagctaaatatccccatgtggaggactatcgccgcaccgtgacagagattgatgagaaagaatatatcagccttcggctcatcatatcagagctgaggaatcaatatgtcactctacatgacatgatcctgaaaaatatcgagaagatcaaacggccccggagcagcaatgcagagactctgtactgaggccagggccagggccaggggactctgtgagtctggctcaagaccgacattgccttggtttgttacatgactatcgtgatggggaaactggctggaaatagtaatcacacctctctgtttttagttagagtctaatgaaactctcatctagttctgtgatgtgtttacctcttttttcaggcctcaggaactcttctatttccttccctaataccccacacccaacctgtcgtaatttctggagaactccaggtttgtgtgtgcaggatgttggcacaaaaatacctgtgttttcattctccccctctctccctcctgtgtcttgcgctttatgttttcttccgtttgataattagttggttaaaagctgagggaaccggaaggaaagtgctaggtgttttttaggaactagggtggcggggggacgaacttctcttcctcacatgaggttactgtttctttcctctgtggggcattggatcctcccacagttgccctggtgatgacttagggcttcccatctgtgtacatcccactttgaatcttgatcgtgacaagaaataccttaggccttcagtcaattccgaagctccttcagttgtttttataatgggcgttttcacatgcacatatgtgtatgcatgtatacgcccatacagacatgcacacacagactcctactccattagctaacataccctccctctccacaacccctgtcacatacctttcaggaggtgacagttgtcttagttgtcatctacccagacaaacgtcctgggcccgtcctccctcctgatactgtagcctcttggtacccagggtgagttggtggagaacagagagatgagaagcagagggcttggggaaagcctgttcctctctgactcagccctttttggcattattgcaagagcttgactcctggttgccttttcccagccagttttcagttggggtgaaggtttctgcaagtgtgaggtccagatgctgctgctcatgttgggctttccttttgggaactatttctctttatttatagtgtcgggcttccggggaaagcaatcattggtgtgtatgtgtatgtgcatgcacacacgtgcatatacacatttgtgtatgtggaaatgtgctgggcaagtcaaaactatagaagagttgcctcctgtctctcgaatcttccagagatatcacttaattgttaacagcttttgtgttaatccccttcagcccctagctcttttattctaccacggctggagagttgatacctgcagtcagcctgccagtgactcttagtgtctgtttctgacttatttttcctgtctctgtcttccaacccccaataatatttccaccggggatgcatcatttttactcccaatattctgtagagagggagtcaggatgctgtcttcccacgaatagtactcagtaacaaaccaattgcattttagttgggcagtgctcccacccaccctccagatcccttccagctaaaacccttcccccttccctccatgtgtttctcagtttcccgtttcgtttgttggactgttccactgcccctcctcctcaccctatcacccatggatcgtaatgtaaaattcttttaccatgtcaagaaattattaaaaatacaggtactttgacctctttctaaagccgca

SEQ ID NO: 85298 - DNA, 2225 bp, Homo sapiens
cgggagtgcagcggctgagaaggtcccttcggtgaaggcgagttccgggacaacagagagggccgcaccgtttccgagtctctcggaggctcagttctcagcgcaccattccccacagctctcctttttactttacccctacccgacacttgaccccggcagtgtgaaccccgctgggagcgtccaaagccatgcctcatcgcggctgcgcagcgcacgtgcacagcctcgcaggagtctcggcgattggctgtgacgcagtttccggcgtgagcggcgaaagccgggagggcgagcgagagagcaagcaggcagcaggctgccggcgggcgggcggacggcacagagggagggagcgagcgagcagtgagtaagccagcaagggcggtcgggtcccgaggtcagccgagatttctcaggtccctccggccccctccctggagtccacagcgcctccggtgtccagaggatcggacacggcccggcccggccatggcctcgttgctgaaggtggatcaggaagtgaagctcaaggttgattctttcagggagcggatcacaagtgaggcagaagacttggtggcaaattttttcccaaagaagttattagaacttgatagttttctgaaggaaccaatcttaaacatccatgacctaactcagatccactctgacatgaatctcccagtccctgaccccattcttctcaccaatagccatgatggactggatggtcccacttataagaagcgaaggttggatgagtgtgaagaagccttccaaggaaccaaggtgtttgtgatgcccaatgggatgctgaaaagcaaccagcagctggtggacattattgagaaagtgaaacctgagatccggctgttgattgagaaatgtaacacggtcaaaatgtgggtacagctcctgattcccaggatagaagatggaaacaactttggggtgtccattcaggaggaaacagttgcagagctaagaactgttgagagtgaagctgcatcttatctggaccagatttctagatattatattacaagagccaaattggtttctaaaatagctaaatatccccatgtggaggactatcgccgcaccgtgacagagattgatgagaaagaatatatcagccttcggctcatcatatcagagctgaggaatcaatatgtcactctacatgacatgatcctgaaaaatatcgagaagatcaaacggccccggagcagcaatgcagagactctgtactgaggccagggccagggccaggggactctgtgagtctggctcaagaccgacattgccttggtttgttacatgactatcgtgatggggaaactggctggaaatagtaatcacacctctctgtttttagttagagtctaatgaaactctcatctagttctgtgatgtgtttacctcttttttcaggcctcaggaactcttctatttccttccctaataccccacacccaacctgtcgtaatttctggagaactccaggtttgtgtgtgcaggatgttggcacaaaaatacccccttccctccatgtgtttctcagtttcccgtttcgtttgttggactgttccactgcccctcctcctcaccctatcacccatggatcgtaatgtaaaattcttttaccatgtcaagaaattattaaaaatacaggtactttgacctctttctaaagccgcagaccctggtgcaatgctctggtggctagggatgtactcatgctcatatgtgtgcacgcttggacacccacctccatggacacctagccaccctgttgtgtgtccttatgccagttgagctgaatcttttccccagtatagtggaaagactgaggcttctgcctactgagcaaggttgggtgcttcatttgtgttcagtctgaattatgggaaagttagctcttcccagacctaagctgccttctctccctactttcagaagatcctagttccttccttcccgagtgatacccatgaactgccagtagaggctgctatcgttccatgtgtaaggaatgaactggttcaaggcgcgtcctacccagtcattttctttaccttatactaattcttcctgaataatgtcttcagtttcttgaggagactcctagttttggttttcaaattacttggagggctgcctaggaatctatctccctctgaaataaagtttcctcatcttccaccttgcaaaaagccttc

SEQ ID NO: 85299 - DNA, 1414 bp, Homo sapiens
cgggagtgcagcggctgagaaggtcccttcggtgaaggcgagttccgggacaacagagagggccgcaccgtttccgagtctctcggaggctcagttctcagcgcaccattccccacagctctcctttttactttacccctacccgacacttgaccccggcagtgtgaaccccgctgggagcgtccaaagccatgcctcatcgcggctgcgcagcgcacgtgcacagcctcgcaggagtctcggcgattggctgtgacgcagtttccggcgtgagcggcgaaagccgggagggcgagcgagagagcaagcaggcagcaggctgccggcgggcgggcggacggcacagagggagggagcgagcgagcagtgagtaagccagcaagggcggtcgggtcccgaggtcagccgagatttctcaggtccctccggccccctccctggagtccacagcgcctccggtgtccagaggatcggacacggcccggcccggccatggcctcgttgctgaaggtggatcaggaagtgaagctcaaggttgattctttcagggagcggatcacaagtgaggcagaagacttggtggcaaattttttcccaaagaagttattagaacttgatagttttctgaaggaaccaatcttaaacatccatgacctaactcagatccactctgacatgaatctcccagtccctgaccccattcttctcaccaatagccatgatggactggatggtcccacttataagaagcgaaggttggatgagtgtgaagaagccttccaaggaaccaaggtgtttgtgatgcccaatgggatgctgaaaagcaaccagcagctggtggacattattgagaaagtgaaacctgagatccggctgttgattgagaaatgtaacacggtcaaaatgtgggtacagctcctgattcccaggatagaagatggaaacaactttggggtgtccattcaggaggaaacagttgcagagctaagaactgttgagagtgaagctgcatcttatctggaccagatttctagatattatattacaagagccaaattggtttctaaaatagctaaatatccccatgtggaggactatcgccgcaccgtgacagagattgatgagaaagaatatatcagccttcggctcatcatatcagagctgaggaatcaatatgtcactctacatgacatgatcctgaaaaatatcgagaagatcaaacggccccggagcagcaatgcagagactctgtactgaggccagggccagggccaggggactctgtgagtctggctcaagaccgacattgccttggtttgttacatgactatcgtgatggggaaactggctggaaatagtaatcacacctctctgtttttagttagagtctaatgaaactctcatctagttctgt

SEQ ID NO: 85300 - DNA, 1411 bp, Homo sapiens
cgggagtgcagcggctgagaaggtcccttcggtgaaggcgagttccgggacaacagagagggccgcaccgtttccgagtctctcggaggctcagttctcagcgcaccattccccacagctctcctttttactttacccctacccgacacttgaccccggcagtgtgaaccccgctgggagcgtccaaagccatgcctcatcgcggctgcgcagcgcacgtgcacagcctcgcaggagtctcggcgattggctgtgacgcagtttccggcgtgagcggcgaaagccgggagggcgagcgagagagcaagcaggcagcaggctgccggcgggcgggcggacggcacagagggagggagcgagcgagcagtgagtaagccagcaagggcggtcgggtcccgaggtcagccgagatttctcaggtccctccggccccctccctggagtccacagcgcctccggtgtccagaggatcggacacggcccggcccggccatggcctcgttgctgaaggtggatcaggaagtgaagctcaaggttgattctttcagggagcggatcacaagtgaggcagaagacttggtggcaaattttttcccaaagaagttattagaacttgatagttttctgaaggaaccaatcttaaacatccatgacctaactcagatccactctgacatgaatctcccagtccctgaccccattcttctcaccaatagccatgatggactggatggtcccacttataagaagcgaaggttggatgagtgtgaagaagccttccaaggaaccaaggtgtttgtgatgcccaatgggatgctgaaaagcaaccagcagctggtggacattattgagaaagtgaaacctgagatccggctgttgattgagaaatgtaacacggtcaaaatgtgggtacagctcctgattcccaggatagaagatggaaacaactttggggtgtccattcaggaggaaacagttgcagagctaagaactgttgagagtgaagctgcatcttatctggaccagatttctagatattatattacaagagccaaattggtttctaaaatagctaaatatccccatgtggaggactatcgccgcaccgtgacagagattgatgagaaagaatatatcagccttcggctcatcatatcagagctgaggaatcaatatgtcactctacatgacatgatcctgaaaaatatcgagaagatcaaacggccccggagcagcaatgcagagactctgtactgaggccagggctcccccgcaatcggtattttagtctgtcttgttcccccctcccctccggtgcgtaaccagtcccttgtgaagggaaaaatggctgcaaatatttctcacacatttcagttgtttgagcgagtaaaataaaactatcatatagtaa

SEQ ID NO: 85301 - DNA, 494 bp, Homo sapiens
attattctctgcatttaaaagtagaatttaaatagttctcccacctccacctcaatctaaggtgcacacacatacttttagctttactagagggtttttgttaatgtagtctataacagaaattgaggatttctgttatggtatttctattttactatcataccactgaaaagttaagctttctcttaagaatataagaaaaatttaagagacagcatgagctagttgaatagtcttattagtgaattagttttatataaaataaattatacaatggacattccagttatcatctgaaaatataatttagaaatttatgataatatatttctttctgggtctatttaattcagaaacattctcatacaaggtggttcaaagaatccagatttctgggaatggttttggacttcttgaagatataaaatatttgacaatgcattgttcaatatggaatcgtacttttggaaagaaaatctgccagaacattcatg

SEQ ID NO: 85302 - DNA, 245 bp, Homo sapiens
ctaacacgcggatctgactatctctcacgtacagtctcctccctgcacatgaaggagactctgctctaacacgcggatctgactatctcgcacgtagtctcttccctgtacacgaaggagactctgctctaacacgcggatctgactatctcgcacgtacagtctcttccctgtacacgaaggagactctgctctaacacgcggatctgactatctctcacgtacagtctcctccctgcacatga

SEQ ID NO: 85303 - DNA, 467 bp, Homo sapiens
ttgggtgagtaaggttcaagccccctgtatagatagatagatagatagatagatagatagattatatatgtttgtcattctcatcaattggaaaatagcgcctccactatggagcacacacggcaggtagctagagagctgtagaatcacatattcaaaatgttcaaaaagtaaaaaaaaaatccgtgtccgtggggagctccaaattggtctaccttctaattctgcctggttattgataattataagcccaattgtgatccaattttattcttggttttcaatacacactcaagaaacagatcctgtcctcttacattaagattgacaattacaatacgcactgtaagttaaaaagatgctttaacaaaatcagcactttctcccctgactgatttgacgttcaacgatttacttgagaaattaacgccctcttcaatttttcttcttggtttttaattctatgg

SEQ ID NO: 85304 - DNA, 605 bp, Homo sapiens
ctgacctgaattcttcctttttcttcctactaaactctgcttatttgctttagagggaatgtactgtaaagctaatgaatttggagacttggggcagcgtatggacttggttttctgtgttgagagcctgggaactaagaggtggggaggggaagccaggatgcattgcgagtatttctgataaattgccaaaaaagtctcacaggtacgtgaatctctcagtctctaaaaatatgtcatgatttatttctaggttctaagtatgtattcacatttatacctacttttgtatttgtcactcttcttccttttcctgtaagtaggttcccaaaattgtataagcttcaggttcctccaaacttggacctgcccccatcacttatcaccctccagcattgtgttcagctacatgttactgtagtcaccagcatcttgggagtgtgatttataggtggagggacttggtgctcttgatcagaatgatgcttttacctttattcacactgttttccatcctcccaggcacatggtggtttaatctgtagtactgaaaaaagtttaagtggcccatatagaatgagattagaagtactcatatatccttt

SEQ ID NO: 85305 - DNA, 565 bp, Homo sapiens
aggagagacgagggtagggagagagttcagaaaggagagtcctaaggccgtctggattctccttgagccccctccccatcctggtcctgggctgtgtcttcatcacagccacccctccccgatgtgctgttggttcagttaccccagacagtggatttctcagaacagaaattgctaatgttcacgtaaagatgaatgaaatgggaatgatgaaatgtgttaagagaacttaaatccagggtgtgaattgccactgatcctaacagagacgttttagcttttctacttcccacctgccggaagaaagatgagataaaccacttgtgttatttgttcagcattgctgcagcatcagagaggagtgttccccgaccctttgtttttctaggtgacttaatgggttctggcattgtgcatttatctttttaattgtggtaaaagatgcgtaacactaaagttgccattttaagcgttgttaagcatacaggtccgtggcattaagcgcattcacagtgttgtgcagtcatcaccaccatcaattagagctgttttcatcttgcaaaat

SEQ ID NO: 85306 - DNA, 370 bp, Homo sapiens
ggcagatataaccttttctcaaacatctctaattgtctgcataccccactaatattggctacataatacatttatttttgtcatttgggactaagtgccttacttagttttgttcagtgtattcattaattgaagaaatacttattcaggatttctattacttagttttgctcaatatattcactaattgaagaaatatttattcaggacttccattatatgagcactggcctttgtggtacaaagatacaacatgaatctgaaactcaatttaatctagaaagatttattaatataatctcatcagaaaagcaagacatctactgtgatagctacagtattggttagaaatggaaaagagagagcagat

SEQ ID NO: 85307 - DNA, 730 bp, Homo sapiens
ttttagcagagagaaggttttaccatgttggacaggcttgtcttgaactcctgacctcaagtgatccacctgcctcggcctcccaagtagctgggactacagttgtgcaccaccatcccagctaatatttgtattatttgtagagatggggtttcaccatgttgttcaggctgatctcgaactcctggactcaagtgatccacccacctcggcctcccaaagtgctgggattgcagacatgagccattgtgtctggctggattgacagcttttgattttctttatccttaagggttgatcaaattttcctggttctttatataacaagcaattttggaatacagacttgacattttaaatattatgttgtgagactagggccacccttgggtcaaagctgggagagaaaagaggaaaaattttaaaacagaacaaaatggaaaactgccccacttagcagattgcttctgcaagttttggcacctttcttcaatctgtctgctgttattgtaacttttcagagctcttgggtggtggctttttgtatttgtcctgtttttagttgtaatcaacgggagagataggctatagtacgctaacttcaccttggtcagcaccagagttcatgtttgatatggattctatgttctaattcttttttcttaaacagatcatcactgaggctgaggagcagggccaggttaaagaccagaggtcacagaaagagagg

SEQ ID NO: 85308 - DNA, 337 bp, Homo sapiens
acaggtgcttacaagccctgtgctgagtgctggcgactgaaaagatgagtacagcatagggaaggtgctcatggagtttgtgatctggtgggggagcgagttgtgtaatgacgaggaatgtgtctggaggtgagagtttcggggtctgggctttggttgtggatttgccaccaccaggccattgccctaagggcaggccctaacgtctttgggcctcagttttcgcatttataaaaagtggactcaatggacctacaggtcttcacttgctctagagcaacaaaactggagagctgtctcaaggagttttcctgtgcagtggagttcagcctcactg

SEQ ID NO: 85309 - DNA, 589 bp, Homo sapiens
gattacaggcgcccaccaccacgcccggctaatttttgtatatttagcagagacagggtttcaccatgttgactaggctggtcttgaacttctgacctcaggtgatccaccctccttggcctcccaaagtgctgggattataactttgttcagatgtgatagttgcattctgtgtttcatacctctaccaattctgtaattgtgttaaatttgtagctttttaaaaactcttgacattaagaattatgtttcagaagccaacatataaacctgtgggggaagaaactaagagaagcaagaggaacgttaggtttagtcttacgtgcatatgagagaatttaggagaattaaatgacttgccctaaagtcattttttaacactgtagatttagtgtatttttattctaagaataacatgatgagagattttttgtaagttctttatctttgagcagtacataatgaaatatttgcagatgaaatgttatatctcggatttgtttcaaaatgaggtagtttgggttatacatgaaatagaattgtcccagagtttgtggaatttgggtgttgggtacatgggagtttgtta

SEQ ID NO: 85310 - DNA, 932 bp, Homo sapiens
cggaagcaatgcctctgtatactgagctgctcttttccatagcaacaagagtggcagctggccactctgtaactatacgcaacagccctagggttacattcatgtgagggttacattctccagatctggatcagctctagctgggtttaaattctagctctatcataaacttaactggcagcacagccttcggcaagctatcctctgaatgttgatttccttaccagttacaagaaaatatacatgcatacagatatatatgctctaactcacagagcaataagagacttaaataagacgatgcttgtgaaagatgtagagtattgtcagacacacggtgagtgttcaagagatgctagctactttgactatgttcctggagacatgtctatgatttcttctcctacaaatgcttcttgccgtaacttctattcaatgtggagctaccctcatgctgtccatctgcactctgaatgaccccaggactgtcaaacttgcaagtgacctttctgccaaatcatccccaaggaaacccggggcctttgttggcctcacagatgactccatccccatccacacatatcacacattccctcatcccaactattctcacacagccctttcactgcaagcttccttcttccagatgatcatccattcctggaaatgttgaatcactagctgctagagtcagaggagacatatttattcatgaaaatacaaatggcatgtcttcttctgccaacaacttctagtgacacctttacctatgtagtcatacactgacagtcatgcttaggctgttgcatacagttatacaggtttcacactgcacccaggagtgccattcaagctgtagagccctgattcatgttctgggcaagtctactgatcaaactgaccagaattaaccaatgcattggagttgacct

SEQ ID NO: 85311 - DNA, 400 bp, Homo sapiens
cccagaagttttttattatgtaactgaaggtatgcacccttcgatgggtatctccccacttttccccaattcttagcccatggtaactaccattctagtctctgtttcattttttctttctttctttctttttctttctttctttaagatttcacattaaaatgagatcaagcagtatttgtctttctgtatttcgcttatttcacttagcataatgtcttcaaggttcatcaacattgttgtaaatgaaacaatttcattctttattaaagctgaaattatctctttctcacagtttacctatttatttgtatcagaggagtgcaggtacgcttggtgatactaattttatgtctattggctgtatactccaaattgggattaaagatacttctagttt

SEQ ID NO: 85312 - DNA, 415 bp, Homo sapiens
ctgggggctcaatggtgggaaacccaagctttgggcttgtcagagagcagtgactcatataattgggtatgtcccttgagggcatctggaacccgagacaatgctacaagagctatgggctcttgtggggtagggcttccaagccaagtggatctcacatccacctgacgtgagtctctttctcttgtacctgagctgacactcagagtgggaacaaagggaaaagctcctggagcctgtgtgggcctctgtgagggccactctcacggagaagtgactgtttcctggcccaagacagagctgtaggcaggacgcagtggctcatgcctgtaatcccagcactttgggaggccaaggcaagcagatcatgaggtcaggagttcgagaccagcctggccaacatggtgaaaccccg

SEQ ID NO: 85313 - DNA, 416 bp, Homo sapiens
agtttttaaactttgccataaaatatatcacttttatagttttttttaaatggcttaagctatacattcaatataaagatatacaccaggaacttaaagtaggaaaggcaggatttctctaaaataggctagaaattgaggaactctctggggccagattggacacctctatcatcaaagcagtacgcacaccctggctgcagcaatcaaggaagttaccagaacagtcttcagctggatcagtaatgccatgagacttaaaataatcttttaagggtagagtccatagcaacccaatccagctccactgaatcttgtaccccaggggtagtatcagttaagtaccacctgccagctcgtggtctgcaggaaggttcctgccacccaacagtgacttgcttgacttccccgatgca

SEQ ID NO: 85314 - DNA, 724 bp, Homo sapiens
attcaatagtctcctgttgtatagaactactcagtttttttaaacttttgtaatacaaatcactttcttcgtgttcacgtatgcaaatatttcattctttctttggtttatttatttcattaagttttggatcaactttaatgcttcctttaagatagtatacttttttgttctatattatctctctctttgaaactgcctgttcaacaattttcctagaaggtgacagcggaggaaagcctggtgaatgacaaagccatagattagtgtctggttgttacctgaccatgatagtaattaggcaatcagaatggatgagttttcagaggaatttaatgtaaaagaattacagcagaaaactaaagtctgagccttggcttttctgaagccacatccagggaactgaagataaaggagctgccacaggcagaaataatttaaataataggacaaaaatgataattaaggtcagaatgtacactaacatgggatcagcaacactttttttctgcaaatggccaggtagtaagtaaatatcttagacttttcagttcatatgtctgtcattataacatgaaagatgccataatatttaaatgaatagttgtagttgggttacaacaccttcatttctgtaaatttgaatctcatataatgtttacttgtcatgaaattgtactcctttttcttatttttttccaaccattaaaagataagaaaacat

SEQ ID NO: 85315 - DNA, 1874 bp, Homo sapiens
  misc_feature (127)..(127): n is a, c, g, or t
gagctccgtgctgggaggtgggaagggggcttgaccctggggactcaggcagtctggggacagttccaccaggggccggtgcctagaattggtgagggaggcacctcaggggctgggggagaaggancgagcgctcttcgcccctctctggcacccagcggcgcgcctgctggccggaaaggcagcgagaagtccgttctccctgtcctgcccccggcgacttgcggcccgggtgggagtccgcaggctccgggtccccagcgccgctggccagggcgcgggcaaagtttgcctctccgcgtccagccggttctttcgctcccgcagcgccgcaggtgccgcctgtcctcgccttcctgctgcaatcgccccaccatggactccccgatccagatcttccgcggggagccgggccctacctgcgccccgagcgcctgcctgccccccaacagcagcgcctggtttcccggctgggccgagcccgacagcaacggcagcgccggctcggaggacgcgcagctggagcccgcgcacatctccccggccatcccggtcatcatcacggcggtctactccgtagtgttcgtcgtgggcttggtgggcaactcgctggtcatgttcgtgatcatccgatacacaaagatgaagacagcaaccaacatttacatatttaacctggctttggcagatgctttagttactacaaccatgccctttcagagtacggtctacttgatgaattcctggccttttggggatgtgctgtgcaagatagtaatttccattgattactacaacatgttcaccagcatcttcaccttgaccatgatgagcgtggaccgctacattgccgtgtgccaccccgtgaaggctttggacttccgcacacccttgaaggcaaagatcatcaatatctgcatctggctgctgtcgtcatctgttggcatctctgcaatagtccttggaggcaccaaagtcagggaagacgtcgatgtcattgagtgctccttgcagttcccagatgatgactactcctggtgggacctcttcatgaagatctgcgtcttcatctttgccttcgtgatccctgtcctcatcatcatcgtctgctacaccctgatgatcctgcgtctcaagagcgtccggctcctttctggctcccgagagaaagatcgcaacctgcgtaggatcaccagactggtcctggtggtggtggcagtcttcgtcgtctgctggactcccattcacatattcatcctggtggaggctctggggagcacctcccacagcacagctgctctctccagctattacttctgcatcgccttaggctataccaacagtagcctgaatcccattctctacgcctttcttgatgaaaacttcaagcggtgtttccgggacttctgctttccactgaagatgaggatggagcggcagagcactagcagagtccgaaatacagttcaggatcctgcttacctgagggacatcgatgggatgaataaaccagtatgactagtcgtggagatgtcttcgtacagttcttcgggaagagaggagttcaatgatctaggtttaactcagatcactactgcagtcctgaccatgaaaagatagaatttaaaataaacttttagagatctcatggtctgaagtcatcagatgcagaccacgttcgtgatcagtggaaacatcaaggacaaaaggtccacgcaacacatgcacctcttctctagggcacagaagcgaggcagagcctcagttcctctgatgaacaagggaacaggtcttttccttctggtttgctaggtaaggttcagcacccatctgctgtggccttcctatgaaacgtagtttcaaaagctcggttt

SEQ ID NO: 85316 - DNA, 341 bp, Homo sapiens
atttttacatcagcttgtcagaaattatattaaaaacactttggggaaagctaagagcagtgcactgtttagcacagattttgtgagattctatactcttttaatgagcatttcatagggttttttttttgctgtttttttttctttttttgctttgctttactttgccaatcagttacttttataccaaattaacgaagtttctttaaaaacttcctggttaaattgtctgttatcatatagaaaagaatcaaactgaatcactttacatttctctaaagatagttcagtttttaatccatccagagtttgtgaatcagcctgatagatcataagccatt

SEQ ID NO: 85317 - DNA, 422 bp, Homo sapiens
ctcactcagaaagggaaagcacagctgtaaatggtcaacctccagctgtactgttagcaactacattggccatgaataagtactcctgttttcacaggaaaattggatcttagatatgttcaagtccagccactggactagagaaggactttctgaaaaccattgaattttgacactgtttcacttgaattttctcagttttttaatggccccctttgggcagcagcatgctttcagaaggctgcggtgtttacctccgtgagctgtgtggctgcagcacatggagaggcccgttgtgtataatggtgcaggagccagctgcacattcccaccatgccctggcccttctctggaaatatgtgaatagtcctttttgtttgtttagagcagaatttaattctgaggtctcacaggccatcaac

SEQ ID NO: 85318 - DNA, 408 bp, Homo sapiens
gcagtttgagtaaaatggtgaatacttctagataggcacaaaaattttatttcccctagttcactttttaaaaattaataaactttattttttagagcagttttagctttatggcaaaattgaggggaaagtagagttcccatattccaccccctctttttcccactgttgacatccagcacactggcacatttgtttccagtggtgaacttacattagcatattattgtcacccagtgttcatagtttacattagggtttattcttggcattgtacattctataggttttcacaaatgtttaatgacatgtatcccacattgtggtgtcatacaaaatagtttcattgcctaaaaatcctgtttattttgtctgttcattcttccttcccccttagcccctgtcagt

SEQ ID NO: 85319 - DNA, 1300 bp, Homo sapiens
ttaactatggggcgtctttcaatttggtgctcacggaccaatttgccaaatgctgcattctttgactcatcacgggatgatgtcattgctcctgggctggttggacaatgctgggaaccagtgaaggaaactcaaagctgaaaacaggtgacttgagtcacccttctagatccagccctgccatgaatttgtcacatatttatgagccagtcacaggtttcctttgtcataaaagattaattctattcattgttttatttaaaaaatagttgttgagggacaccgtgaagaaagtgaaaggacaacccacagaatgggagtaaatatttgcaaatcatatctgaggaagacttgtacccaaaatatgtaatgaattctcactctcaataataaaagaccaatttctcaattaaaaatgggcacaaaatatctgagtagacatttttccaaagcacatatgcaaatgggcaagaagcacatctaaagatgtataacatcattagtcaccagggaaatgtaagtcaaacctcaataagctactggtttacactcactaggatggctataataaaaaagacagatcattacaagtgttgatgagaatgtggagaaattgcaattctccaatttacaatgggaatgtgctaatgggaatgtaaagctgtgagaccactttggaaaactgtctggcagttcctcaaaaggtgaaacatacagctactctatgacccagcagttctctcctaaatgtatacccaacagaaatgaaaacatttgtccacacaaaatcttgtagataagtgttcatgccatcattattcacagtagccaaaaagcagaaacaatccaactgtctatcaacggataaatggatacaatttggtgtattcatattaatattatggaatattttttcacaatggaaatgaagttttgatacatgctacaatgtagatgaaccttgaaaatattattctaagtgaaaggaaccagtcacaaaaggccacattattgtatcattctgtttatataaaatgtccggatttagcaaatctatagagacagagggtagatttgtggttgggtaaggctggaagggttggtgggaaatggggagtggctgctaataggtatgagattttttgggaggtgatgaaatgttctaaaatagattgttgacctggctcactggctgttgcctgtaatcccaacactttgggaggtcaaagtgggagaatcacttgaggctagaagttcaagaccagcctgggcaataaagtgacaccttctggtctctaca

SEQ ID NO: 85320 - DNA, 490 bp, Homo sapiens
atgtctgcagtttctcagaataaccagctcaaaatatgccagagaagtatattttggggtggcatattctagtctcctccagtcatattttggggtggtgtgtcctgagccccaacaagataggtttcatttttgaaaattgctcttccagtcccactgttcatctcataagcccaggaatcaccacctgttgatttcctaggcatcttcttgctcagggtagtagatgtttggtggactagaaatgcagggagaagaaaaggaaggcttggtgatgtcaaggatttttaaaagcaaactatctcactgtgttctctcaatagtcaccctctgtgctgctcattccatgaggcttaaagctgataactgggggacaaaagggttagggtaacaatttatttttgtctcctgacaatacacacataacttttctgctgtgcttggggaaaatataactgtggattaattctgactcattgttttggaagca

SEQ ID NO: 85321 - DNA, 737 bp, Homo sapiens
ctaacgacgcggcgcccaccgagagctgggggagcccagggcggggagggcgcggccggagcgagcgccgcccgggaaacccgagccccgccagaacccctggcagccacagagctcaggcttcaacgctggcccgacaccagggccaggccagaaatcagcctgggagaagctgggtccggctccgaggctggtgggcacggccccacccggctttgttcttcgcggcgctgaggcggttagtttagcctcccacccaccagacaaaggtgcgggaaatgggaccggtttgacttgttcaggcacatggtcaccctgcacgtcaggggccggctcacccctgatattagcaaccccaagcgtcttggcgcagggagggatccccgtcagccaggtccccacgcagctccaggcagcgccagcgtccaccagggagcaggggcagcagagcccttctccccagacacccttgtgtcttcggaaaatgccaggtccccccccagctgctgttctcgtctttggaggacccggctttactggtgccacatgcctgctgcgggctgtgccatggagggcggcacctgcctcttctcacgtggcagctctggcaccgggaacttcagagaccccagctgggctgagccaccccgggctgaggccttgtgggtcgcctcaaattcaagcctcatgggcccggcctcccgccctaacggtcgctgaagtgtcctgctctcata

SEQ ID NO: 85322 - DNA, 445 bp, Homo sapiens
acatcactgcctcaccccttgcagtgctcatcaacaacccaaacaagcccaatcctgccctgatctcatgtctgtgtcactggaaccaacaggcctgcctcaaccactgtccacctgcacatctgagaggctggcaggtcaccggggctagccgtgcacgtcagttcctgggaagaaagtagaatgtgaatcatcttctctcaaacgcctatcaaaagcccagctgagatcaataattttttgggagaacagacctgtaccaattggctcggtgtttggtgaggtattgtaaatttgatcctaaatcaaagggtatccctagaaggacccacatggaatggcctcctctaaacatccctccatgttgtacttctgactctttccagcaatctcaagcacaagaagcagttgtgggaacccaggcctggcatctgttggcagccca

SEQ ID NO: 85323 - DNA, 280 bp, Homo sapiens
atctgctttctgtcactacagattggcttgtattttttctagagttttatataagggaaatcaaacagtataaactttgcatggggtctggtttctatcactcagtactgaattgagattcatttacgtagttttaaaattttacacacatctttgttactcaaaatgttgtccacaaaccaatagcaagcattacttcagttcgttaaaaatgcagaaatctccactgcacgcagtggctcacacttgtagtcccagcactttgggaggccaaggcggg

SEQ ID NO: 85324 - DNA, 343 bp, Homo sapiens
agccattcaacaagtctctagaagttctcaactttcccacattttcctgtcttcttgtgagccctccaaactgttccaacctctgcctgttacccagttccaaagtcgcttccacgttttcaggtatctttacagcatcaccccactttctggtaccaatttaccatattagtcagttctcacactgctatgaggaaatacccaagactggatagtttataaagaaaagaggtttaattgactcaaagttccgcatggctggggaggcctcaggaaacttacaatcacggcagaaggtacctcttcacagggacccaggagagggaatgagcgcaagcagggg

SEQ ID NO: 85325 - DNA, 235 bp, Homo sapiens
  misc_feature (2)..(2): n is a, c, g, or t
  misc_feature (4)..(4): n is a, c, g, or t
angncctgttgacaaaagagaataatacaggtgtcctcctgaaactgtcaccacagtgaccttcctcagtcaaaaagaaatataaatattattgtgtttctcgtgtctgaggcacctctgaaagcatttatcttttcagagagttcagcacttcatctcacgggttaattaaaccaacctgtagtggcaaagtttagtggtagtgaaaataaacataatcctctttctgttgccc

SEQ ID NO: 85326 - DNA, 801 bp, Homo sapiens
gattttacatttaactttttaacgcatgttgagttgattttcatatatggcaaaaggaagggatccagtgtcaatcttctgcatatggctagcagttataccagccccatacaatttatccttgtaacaaactttcatatgtacccccgaacctaaaataaaagttggaaaatgaaaaatagaaaagtggaacaaacttacacttcaacaaagatatattgtggcatatattgaatgctaatttcttacttataataacataaaatgagttttaagtttccaaaaaaaaaaaaaaaacagtgggtataatgtggatagtatgtacccttgatgggaggtgaggagaatggcaccttataatattcctccccaaaagtcataaccccaatttaaccatgagaaaaaaataagataaatcccaactgagggatattctacagcatacctggccccaaaactatcaagggcatcaaaaacaaggaaagtctaagaaatttcatagccaaaaagagcctaaggagatatgactattaaatgtaatgcagtatcctggatgggatcctggaacagcaaaaggccattaggaaaaactgagtaaatctgaataaagtatggacttcagttaataataatgtatcaatattggttcattcattatttaaaaacgtatcatactaatgtaaaatggggtaactggacatgaggtgtactgtaattctctgtattatcttcctaataaattttgtaagtctaaaactgttctaaaattaaaagcttatttaaacatgtttgtaaaaaagt

SEQ ID NO: 85327 - DNA, 155 bp, Homo sapiens
acagatggtaggttttttaattctttttgaaatgtattctcgttttattgctcaggctggagtgatcacagctgactgtagcctcgaactcctgggctgaagctatcctcctgcctcaacctcccaagtagctaggcccacagggtcaagtcacc

SEQ ID NO: 85328 - DNA, 338 bp, Homo sapiens
atttcatgactaagaacccgaaagcaaatgcaataaaaacaaagataaatagctgggacctaattaaactaaagagcttttgcatggcaaaaggaacagtcagcagagtaaacaggcaacccacagagtgggtgaaaatcttcaccgtctatacatctgacaaaggactaatatcccggatctacaacaaaatcaaacaaatcagtaagaaaataacaaacaatcccatcaaaaatcggccaaggacatgaatagaccgttctcaaaagaatgtatacaaatggccaacaaacatgaaaaaatgctcagcatcactaatgatcagggaaatgcaaatc

SEQ ID NO: 85329 - DNA, 403 bp, Homo sapiens
gcctaactctagttatgcatttcgttatcagctgataagagagaatacatttgtacccagatcccttaacactgagtttttttttgttgctaatgatcatctcatttaacctcttttagaaatgaggaaacttaattccaaggagtgaaatgacctatctaaagttaaaagccagctagctaatttgtttccttattcccagtgctgtattcacttaattcgacatcctgccagatctcgtatacttagtacatgaaatgataggtgaggttttattagtattttcagataagagtatatttgttcatgtctttgtaaaaagggttgctgccttagccaaactgaattccagcaacaagctacttgctttttgtttaattcaagttgtagggctaaaataaaa

SEQ ID NO: 85330 - DNA, 811 bp, Homo sapiens
gcctggagcccctcccctctggctccttccctcaggatttgcggagcctgtaataattgagggacaggcggggcgccatggctcacgcctgtaatcccagcactttgggaggcggaggcgggcggatcacgaggtcaagagatcgacaccatcctggtcaacatggcgaaaccccgtctctactaaaaatacaaaaactagctgggcgtggtggcgcgcgcctgtagtcccagcggctcgggaggctgaggcaggagaatcgcttgaacccgggaggcagaggttgcggtgagccgagatcttgccactgcaccactccagccttggctggacatgagctgaggactcgttgtctctagtaaacaacacatactaagtaaaatcaacacatctttcctgatagataataaagcatagaacaaaattaaaaacaagggagggggcgcgccgcgtcgttataaagattctccccccgaggagagggcgccaccggtagtttccgcgcaaagcaaacagaaagctttcttcgttggtcgagacacgagccaggcgagcgcccccctagctacggagagagcgagccccgcgcgtgaacaatacagcacacaaggcagcgagggagccgcccaggaagcgttgatcacaacaccacggcccgacccacacacgcgcgggagcaagcaacagccggggggcaccctcgccgggagagcactaacggtgcaggagcaagacagaagacccaaacacgacagcagcacgggggcgggggccaacaactggtggcggacgcaagcacccccccgaccga

SEQ ID NO: 85331 - DNA, 175 bp, Homo sapiens
ggaggcactccgtgcacatctcacctaggctgagaccccatctcactcgcactgccgggcacagggcctctcgctcgggtcctttctaggcagttctctgaggcagcaccaaggttcatgcagaaacacacgcgctgggatgttctgtggcagacagtacatcccgcacccatca

SEQ ID NO: 85332 - DNA, 282 bp, Homo sapiens
tctcatctgccccatcttggtggcaggatgtatagataggatggaggtaatggtgttctttttcttttccttatttggttttggactccacatcaaatggagacatgtagatgaaagtggcgtgcatttaaaatgtatgtacacatcagactgctggagatggtagatattatactgcatgtatgttttttttttctttcttttttttttttttttttttttttttttttttttttttttttttttttcaattgggggagaaaaccggggggggggaaaaag

SEQ ID NO: 85333 - DNA, 813 bp, Homo sapiens
gccaagattgcgccactgcactccagcctgggagacagagcgagactccgtctcaaaaaatataaaaataaaagggatatctggattggcggagagactgcaggacagcattcaagtggggttgaattggcccagttgcatctgacttctcacttgtagttcccaagaatgaatatagaatgtgctggaaaagcaacatcctgagaggaagggaccggtgagaaaaggacaggatgtgttccagatccccagaacaggatcccctttgttgctttaggccaacgtgccatgcatccctggagcatgaaacccaggatgggccgccttccagcctcccacagctgtgatgcaagttgaacacatacagagagactgcatctgcactgggtggttttcctgagccttggggagcagaatgcatgaatcccaggtatctgccgatctgtatgtaacaaattcacttcatgtaacttactgtgtgtccgtgagattatctctcactcaactcagacacattggcaaccagtgtgcagtgaacctgcttcacaagcaaggatgtggagaaactattttcgtacattttgtgggaatctgaaatactgcggtcagtatggaaagcagtatcatgggaaacttcctcaactcaagatcacctaccaatccttacagaatcagaatcatcatacaaactggtgaaagcatagtttcccctagaggttgggatgagggcaagaatgtcccctcttatcactactattccacacaatatgaaaggttccagccagtgaaataaaggaaaaagaaataaaagtg

SEQ ID NO: 85334 - DNA, 717 bp, Homo sapiens
gccaagattgcgccactgcactccagcctgggagacagagcgagactccgtctcaaaaaatataaaaataaaagggatatctggattggcggagagactgcaggacagcattcaagtggggttgaattggcccagttgcatctgacttctcacttgtagttcccaagaatgaatatagaatgtgctggaaaagcaacatcctgagaggaagggaccggtgagaaaaggacaggatgtgttccagatccccagaacaggatcccctttgttgctttaggccaacgtgccatgcatccctggagcatgaaacccaggatgggccgccttccagcctcccacagctgtgatgcaagttgaacacatacagagagactgcatctgcactgggtggttttcctgagccttggggagcagaatgcatgaatcccaggtatctgccgatctgtatgtaacaaattcacttcatgtaacttactgtgtgtccgtgagattatctctcactcaactcagacacattggcaaccagtgtgcagtgaacctgcttcacaagcaaggatgtggagaaactattttcgtacattttgtgggaatctgaaatactgcggtcagtatggaaagcagtatcatgggaaacttcctcaactcaagatcacctgaggtcgggaattagagaccagcctggttaacatggtgaaacgaagtctctactaaaaatac

SEQ ID NO: 85335 - DNA, 1241 bp, Homo sapiens
gaccagggcgggccgggacaaagcctgggccgggcctgcgcttccgttcgcttgactggctgcgcttgttttcagggttttggtctgaaaacggatcttacctgcgcagagcaaaatcggttgtagattatatccacgaaaattccttctattaaaatgaatttcaagtcccacctaccctggaagcagaaagagagagaagagagagagtaaagagaaagagaaaagaaagagaagttgaaaaagagaaagaaaaccaagaaagaaagagaaaaaaaccgaaaataaatggacaagaaagaaaaacggtgaaggtcaaccctgtgctcaattccagagactttcctagggacatcgtgttgggcatggaggactaagagatgtagtctggttttgttgcccaggctggtctccagcttctagcctcaagcagtcttcccatctgctcctaccaaagtgctcggattataggcatgaatcaccttgcatgggagataaggacccccacatcaagccctcaggtcactgggatcctggactacggcactgctccaggcaggcctggttatcctgcttgaggcagcaatcctcttgagcctagtgaaatgcaactggctgtacctcaatgatgttgccctgagattctgccagtcgaggtattacttcaatctcctgagaccagcctctacctccagatccagggaggccaacgtgccatgcatccctggagcatgaaacccaggatgggccgccttccagcctcccacagctgtgatgcaagttgaacacatacagagagactgcatctgcactgggtggttttcctgagccttggggagcagaatgcatgaatcccaggtatctgccgatctgtatgtaacaaattcacttcatgtaacttactgtgtgtccgtgagattatctctcactcaactcagacacattggcaaccagtgtgcagtgaacctgcttcacaagcaaggatgtggagaaactattttcgtacattttgtgggaatctgaaatactgcggtcagtatggaaagcagtatcatgggaaacttcctcaactcaagatcacctaccaatccttacagaatcagaatcatcatacaaactggtgaaagcatagtttcccctagaggttgggatgagggcaagaatgtcccctcttatcactactattccacacaatatgaaaggttccagccagtgaaataaaggaaaaagaaataaaagtg

SEQ ID NO: 85336 - DNA, 1683 bp, Homo sapiens
gaccagggcgggccgggacaaagcctgggccgggcctgcgcttccgttcgcttgactggctgcgcttgttttcagggttttggtctgaaaacggatcttacctgcgcagagcaaaatcggttgtagattatatccacgaaaattccttctattaaaatgaatttcaagtcccacctaccctggaagcagaaagagagagaagagagagagtaaagagaaagagaaaagaaagagaagttgaaaaagagaaagaaaaccaagaaagaaagagaaaaaaaccgaaaataaatggacaagaaagaaaaacggtgaaggtcaaccctgtgctcaattccagagactttcctagggacatcgtgttgggcatggaggactaaggccagtgtgaagataagtcaccgattctttaaaaaaaaaaagccagtaacttataaaaatagccataaacgacgtagttttttgttgttgttgttgttttgagacagcgtctccctctgtcccccaggcgggagtacagtggcaggcactcagctcactgtaacctccgcctcctgggttcaagtgattctcttgccccagcctccagagtagccaccacgcccggtccaacttagttttttaatactttttaaaattttaagacagggtctctgccaccgaggctgaaatgcagtggcgcaatcatagctcactgcaaccttgacttcctggggtcctgggcaggtgaccccctgtctcagcctgccgagtagctgtgagtaaaggcctgtgcctctccactgtgctaattttctactgtttgttgctttgtttttaatagagatgtagtctggttttgttgcccaggctggtctccagcttctagcctcaagcagtcttcccatctgctcctaccaaagtgctcggattataggcatgaatcaccttgcatgggagataaggacccccacatcaagccctcaggtcactgggatcctggactacggcactgctccaggcaggcctggttatcctgcttgaggcagcaatcctcttgagcctagtgaaatgcaactggctgtacctcaatgatgttgccctgagattctgccagtcgaggtattacttcaatctcctgagaccagcctctacctccagatccagggaggccaacgtgccatgcatccctggagcatgaaacccaggatgggccgccttccagcctcccacagctgtgatgcaagttgaacacatacagagagactgcatctgcactgggtggttttcctgagccttggggagcagaatgcatgaatcccaggtatctgccgatctgtatgtaacaaattcacttcatgtaacttactgtgtgtccgtgagattatctctcactcaactcagacacattggcaaccagtgtgcagtgaacctgcttcacaagcaaggatgtggagaaactattttcgtacattttgtgggaatctgaaatactgcggtcagtatggaaagcagtatcatgggaaacttcctcaactcaagatcacctaccaatccttacagaatcagaatcatcatacaaactggtgaaagcatagtttcccctagaggttgggatgagggcaagaatgtcccctcttatcactactattccacacaatatgaaaggttccagccagtgaaataaaggaaaaagaaataaaagtg

SEQ ID NO: 85337 - DNA, 453 bp, Homo sapiens
tattaaaatgaatttcaagtcccacctaccctggaagcagaaagagagagaagagagagagtaaagagaaagagaaaagaaagagaagttgaaaaagagaaagaaaaccaagaaagaaagagaaaaaaaccgaaaataaatggacaagaaagaaaagtaaggagggaagggaagggaggaagggaagggaagctttaggaattgaattaacacactttggaattgtctgtgaaggggatgatgcaagctaaaatgtgaaatgcaaaaccctgccagggtagaatgttctatttcatgccagtgcccatagaagataaatacttttcatttatcttccccattcactctagacggtgaaggtcaaccctgtgctcaattccagagactttcctagggacatcgtgttgggcatggaggactaaggccagtgtgaagataagtcaccgattcttt

SEQ ID NO: 85338 - DNA, 484 bp, Homo sapiens
aattcattagctaaaatattatagtttaataatgccataaccgttccatatggcataaaaaattaagacattattataaagcctatcatttgcaaaatgttttacagtttaaaaactactttcatgttcatataaacataatcaaatattatgtttaattataatgagagaaagcaatatgagacaagaaaaagcaggtgtcattttcccaattttacagttgaaacagcaaagcagaaatgttaagtgatttgcagtagtagagtaagaacttaaacccaagcctcttggtaccaagcccatagtttcctctccatctagggcattataaaacctgaggacgagacctagagttttgaaatacaaattaattctgccagaaagctggattctttctctacctgtgtatagccaagattcctaagaacaaaatgaaatgtcttgacatcttttgctaaagttacttaaggattaggttgggtcg

SEQ ID NO: 85339 - DNA, 360 bp, Homo sapiens
cagaaactcaggaataaagccattaactttcaaagaatatgttgtgttgttcgatattttccattcctaatccacatccacgttggtcaagtagagcttcctactcagaagcacagcagttgccatggtgttctcttccatctgaaagcagcaattttccgcagcgtccatttacagaatgtgccatatttactcagattctaatgtatattaaatatgctttggaaacttaacaagaaacgtgcaagctctcagtaaagaaaagttgtagaaaacaaaaactgaacagcaggcatctagtttctcctctcccaaaatggccttagtggattcaaaaatgggaagtgtgaataaaactgc

SEQ ID NO: 85340 - DNA, 348 bp, Homo sapiens
ctttgaatatgttttctgccttaagatattcactttcagttgtacaccctaaattttgtgatgcctcctgtgtactaagcactatgctaagtcttctaatgttttcatttattcctcaaatagctattatgcccattttacggagaacaagttacaaacattccccacagttaccaactgaaaaaatggcagaactaagatttgaatccaacatttttggctctactcctcaaaatatcattacctgaacccagagacaatcataaaataccacattttgcccctatatccttaagaaacattacctgccaattaattctattgtaaactattttctgaagtgacaca

SEQ ID NO: 85341 - DNA, 1024 bp, Homo sapiens
gaagaccaaaatatatattattataaaccacaatatcagagtttgtcaacataataaaccacttgccatttgttggacctatacaactgtacaggagtaagtccacaccaaatcaacctaatttttatttataaatatgactagaacaccaacagcaacagagaaaactgaagaaaagaaagcaactagaagatgtaaaaatattatagctcaggatgtacttcattcttgaagccaaatcagtttgatataaaaattgagtcattcagaggaccacagagtttgtgcaaattgaaagtatgattgttgacttttgttaaacagaaaggccaaacattaggatagctagagttaataagtattttggaaagtaaagctaaagacataccttttaagatatgagataaagtgggcaaatatgagaaaaaagataagagacatggagagagcaaaagttccaacttctgtttaataaagaagcaaacaaaaatagagggaagatgtattcacagacataatacaggaaaattttcctgtgttaaacaaaaaccagccttcagatagataggggcaactgactgtcaacaggaaaacaaaaacagagattgacctggatacttgctgtataattcgaaagttgaaagagaaccttttcagaaagataaactggtaatctgcgggagaatgaaaactggatcgttttctcattggcaaactgagggctagaaggcagtggatcagggccattaaagatctgatggaagttaatagccaagctaatattaaaagtaagacactttgggtatctagggactgaaaattatttcagtggaatataataggtatctagaaatagatcccagaatttcagaaaatgtaatatgaaaaaaatggttcaatcagtaagaagaaggtgaattatttaatttttggtgctggcatatgtagaagaaaataaaattgggcccacatcttagactgcttacaaaagtaaattctatcagaatcaagagattaaatacca

SEQ ID NO: 85342 - DNA, 256 bp, Homo sapiens
cagcaagaccccttaaaaaattaagtacataaaaaaagttaaatcaaagaaacaccatctatatcaagtgactgactttagtgttgactaccaacagtggctctcaagctttcttctggctccacagggattgtatgcatgacacactcctatcaatgacatttattacataatgatgtattatccttcccattttatggtgaggacactgaagtcccaggagtgggagtgcctacatgtacatgagaaaaactga

SEQ ID NO: 85343 - DNA, 337 bp, Homo sapiens
agctaacctcatactaattaatggtaaaaaactggttgctttccccctaggaacaagaatgagacaaagatgtccactccaaccacttctatttaacattctgcttgaggcattagccaggataactaggcaagaaaaagaagtagacaacccaattaagaaatggatgcaaaggatctgaatagaaatttctgcaaagaaggcatacaaatggccaatgagcacttgaaaagatgcttagtattattagttattaggggaatgaaaatcagaaccacagtgagataatgctacttcatacctactagggtgacaaaaaagacaacagtaaatgttg

SEQ ID NO: 85344 - DNA, 1392 bp, Homo sapiens
tgcgctctgcggctgacggcgcttttgtctccggtgagttttgtggcgggaagcttctgcgctggtgcttagtaaccgactttcctccggactcctgcacgacctgctcctacagccggcgatccactcccggctgttcccccggaggtgagcggccctgtgggcttccccggctccccacccccatcgctagagtgctcgccgcgctagcagcctcgcgttccagggctgggggtgcgccgccgggatcctctctgatcgcccacgccccatctgggtccccattcagccgtcagccctgttttgtcctaaggtggtcctaactaggatccacgtggcccatcccacgcccacaggtgctgagttaggcatccctgccatgccctcccagagcaccttcacgatctccttgctgtcccaacacttagcgtgttgcgtgttaactaccctttgtctataaggtttgcaatgtggccctagtatcttccagggtacctaacacattgcagatattcatggtatgtttgttaaataaatgaacttgatagatttgaccctcatagagttatttggacttgcaaaaagtttgtagttaactccaatctgtgatgtgggagagacttctaggcaggttcctttctccagggcatgttcttatatttcccattacccaccacccccctgcaaaaggactgggcctatttcaggaaggtgactgatgcctgcactgtagcacaggggttgtgcattgtgccttgcaggaacaaaattttcaataaagtaaatgtttgtttgtttgtttttgagacggagttttgcttttgttgcagtgagccgagatcgcactgctgtacccagcctgggccacagtgcaagactccatctcaaaaaaaaaagaaaagaaaaagcctgtttaatgcacaggtgtgagtggattgcttatggctatgagataggttgatctcgcccttaccccggggtctggtgtatgctgtgctttcctcagcagtatggctctgacatctcttagatgtcccaacttcagctgttgggagatggtgatattttcaaccctacttcctaaacatctgtctggggttcctttagtcttgaatgtcttatgctcaattatttggtgttgagcctctcttccacaagagctcctccatgtttggatagcagttgaagaggtgtgtgggtgggctgttgggagtgaggatggagtgttcagtgcccatttctcattttacattttaaagtcgttcctccaacatagtgtgtattggtctgaagggggtggtgggatgccaaagcctgctcaagttatggacattgtggccaccatgtggcttaaatgattttttctaactaataaagtggaatatatatttc

SEQ ID NO: 85345 - DNA, 1248 bp, Homo sapiens
tgcgctctgcggctgacggcgcttttgtctccgggtccagaggcctttcagaaggagaaggcagctctgtttctctgcagaggagtagggtcctttcagccatgaagcatgtgttgaacctctacctgttaggtgtggtactgaccctactctccatcttcgttagagtgatggagtccctagagggcttactagagagcccatcgcctgggacctcctggaccaccagaagccaactagccaacacagagcccaccaagggccttccagaccatccatccagaagcatgtgataagacctccttccatactggccatattttggaacactgacctagacatgtccagatgggagtcccattcctagcagacaagctgagcaccgttgtaaccagagaactattactaggccttgaagaacctgtctaactggatgctcattgcctgggcaaggcctgtttaggccggttgcggtggctcatgcctgtaatcctagcactttgggaggctgaggtgggtggatcacctgaggtcaggagttcgagaccagcctcgccaacatggcgaaaccccatctctactaaaaatacaaaagttagctgggtgtggtggcagaggcctgtaatcccagctccttgggaggctgaggcgggagaattgcttgaacccggggacggaggttgcagtgagccgagatcgcactgctgtacccagcctgggccacagtgcaagactccatctcaaaaaaaaaagaaaagaaaaagcctgtttaatgcacaggtgtgagtggattgcttatggctatgagataggttgatctcgcccttaccccggggtctggtgtatgctgtgctttcctcagcagtatggctctgacatctcttagatgtcccaacttcagctgttgggagatggtgatattttcaaccctacttcctaaacatctgtctggggttcctttagtcttgaatgtcttatgctcaattatttggtgttgagcctctcttccacaagagctcctccatgtttggatagcagttgaagaggtgtgtgggtgggctgttgggagtgaggatggagtgttcagtgcccatttctcattttacattttaaagtcgttcctccaacatagtgtgtattggtctgaagggggtggtgggatgccaaagcctgctcaagttatggacattgtggccaccatgtggcttaaatgattttttctaactaataaagtggaatatatatttc

SEQ ID NO: 85346 - DNA, 1362 bp, Homo sapiens
tgcgctctgcggctgacggcgcttttgtctccggtgagttttgtggcgggaagcttctgcgctggtgcttagtaaccgactttcctccggactcctgcacgacctgctcctacagccggcgatccactcccggctgttcccccggagggtccagaggcctttcagaaggagaaggcagctctgtttctctgcagaggagtagggtcctttcagccatgaagcatgtgttgaacctctacctgttaggtgtggtactgaccctactctccatcttcgttagagtgatggagtccctagagggcttactagagagcccatcgcctgggacctcctggaccaccagaagccaactagccaacacagagcccaccaagggccttccagaccatccatccagaagcatgtgataagacctccttccatactggccatattttggaacactgacctagacatgtccagatgggagtcccattcctagcagacaagctgagcaccgttgtaaccagagaactattactaggccttgaagaacctgtctaactggatgctcattgcctgggcaaggcctgtttaggccggttgcggtggctcatgcctgtaatcctagcactttgggaggctgaggtgggtggatcacctgaggtcaggagttcgagaccagcctcgccaacatggcgaaaccccatctctactaaaaatacaaaagttagctgggtgtggtggcagaggcctgtaatcccagctccttgggaggctgaggcgggagaattgcttgaacccggggacggaggttgcagtgagccgagatcgcactgctgtacccagcctgggccacagtgcaagactccatctcaaaaaaaaaagaaaagaaaaagcctgtttaatgcacaggtgtgagtggattgcttatggctatgagataggttgatctcgcccttaccccggggtctggtgtatgctgtgctttcctcagcagtatggctctgacatctcttagatgtcccaacttcagctgttgggagatggtgatattttcaaccctacttcctaaacatctgtctggggttcctttagtcttgaatgtcttatgctcaattatttggtgttgagcctctcttccacaagagctcctccatgtttggatagcagttgaagaggtgtgtgggtgggctgttgggagtgaggatggagtgttcagtgcccatttctcattttacattttaaagtcgttcctccaacatagtgtgtattggtctgaagggggtggtgggatgccaaagcctgctcaagttatggacattgtggccaccatgtggcttaaatgattttttctaactaataaagtggaatatatatttc

SEQ ID NO: 85347 - DNA, 1458 bp, Homo sapiens
tgcgctctgcggctgacggcgcttttgtctccgggtccagaggcctttcagaaggagaaggcagctctgtttctctgcagaggagtagggtcctttcagccatgaagcatgtgttgaacctctacctgttaggtgtggtactgaccctactctccatcttcgttagagtgatggagtccctagagggcttactagagagcccatcgcctgggacctcctggaccaccagaagccaactagccaacacagagcccaccaagggccttccagaccatccatccagaagcatgtgataagacctccttccatactggccatattttggaacactgacctagacatgtccagatgggagtcccattcctagcagacaagctgagcaccgttgtaaccagagaactattactaggccttgaagaacctgtctaactggatgctcattgcctgggcaaggcctgtttaggccggttgcggtggctcatgcctgtaatcctagcactttgggaggctgaggtgggtggatcacctgaggtcaggagttcgagaccagcctcgccaacatggcgaaaccccatctctactaaaaatacaaaagttagctgggtgtggtggcagaggcctgtaatcccagctccttgggaggctgaggcgggagaattgcttgaacccggggacggaggttgcagtgagccgagatcgcactgctgtacccagcctgggccacagtgcaagactccatctcaaaaaaaaaagaaaagaaaaagcctgtttaatgcacaggtgtgagtggattgcttatggctatgagataggttgatctcgcccttaccccggggtctggtgtatgctgtgctttcctcagcagtatggctctgacatctcttagatgtcccaacttcagctgttgggagatggtgatattttcaaccctacttcctaaacatctgtctggggttcctttagtcttgaatgtcttatgctcaattatttggtgttgagcctctcttccacaagagctcctccatgtttggatagcagttgaagaggtgtgtgggtgggctgttgggagtgaggatggagtgttcagtgcccatttctcattttacattttaaagtcgttcctccaacatagtgtgtattggtctgaagggggtggtgggatgccaaagcctgctcaagttatggacattgtggccaccatgtggcttaaatgattttttctaactaataaagtggaatatatatttcacacacacaccaacgggcgccccacaaaagacccccaggcccacctcagccgacccccctcccgtcaccacgccctaccaggacccctcaaccacccacgacgcccacacgcgcccgcaccgccccggccttgacgccaccgcgcggaccccacccccacaccccgacactccgcccgaccccccccaccccccaccaccaccccacccc

SEQ ID NO: 85348 - DNA, 1190 bp, Homo sapiens
tgcgctctgcggctgacggcgcttttgtctccgggtccagaggcctttcagaaggagaaggcagctctgtttctctgcagaggagtagggtcctttcagccatgaagcatgtgttgaacctctacctgttaggtgtggtactgaccctactctccatcttcgttagagtgatggagtccctagagggcttactagagagcccatcgcctgggacctcctggaccaccagaagccaactagccaacacagagcccaccaagggccttccagaccatccatccagaagcatgtgataagacctccttccatactggccatattttggaacactgacctagacatgtccagatgggagtcccattcctagcagacaagctgagcaccgttgtaaccagagaactattactaggccttgaagaacctgtctaactggatgctcattgcctgggcaaggcctgtttaggccggttgcggtggctcatgcctgtaatcctagcactttgggaggctgaggtgggtggatcacctgaggtcaggagttcgagaccagcctcgccaacatggcgaaaccccatctctactaaaaatacaaaagttagctgggtgtggtggcagaggcctgtaatcccagctccttgggaggctgaggcgggagaattgcttgaacccggggacggaggttgcagtgagccgagatcgcactgctgtacccagcctgggccacagtgcaagactccatctcaaaaaaaaaagaaaagaaaaagcctgtttaatgcacaggtgtgagtggattgcttatggctatgagataggttgatctcgcccttaccccggggtctggtgtatgctgtgctttcctcagcagtatggctctgacatctcttagatgtcccaacttcagctgttgggagatggtgatattttcaaccctacttcctaaacatctgtctggggttcctttagtcttgaatgtcttatgctcaattatttggtgttgagcctctcttccacaagagctcctccatgtttggatagcagttgaagaggtgtgtgggtgggctgttgggagtgaggatggagtgttcagtgcccatttctcattttacattttaaagtcgttcctccaacatagtgtgtattggtctgaagggggtggtgggatctcagctcacaatcactagtgaattcgc

SEQ ID NO: 85349 - DNA, 1278 bp, Homo sapiens
tgcgctctgcggctgacggcgcttttgtctccgggtccagaggcctttcagaaggagaaggcagctctgtttctctgcagaggagtagggtcctttcagccatgaagcatgtgttgaacctctacctgttaggtgtggtactgaccctactctccatcttcgttagagtgatggagtccctagagggcttactagagagcccatcgcctgggacctcctggaccaccagaagccaactagccaacacagagcccaccaagggccttccagaccatccatccagaagcatgtgataagacctccttccatactggccatattttggaacactgacctagacatgtccagatgggagtcccattcctagcagacaagctgagcaccgttgtaaccagagaactattactaggccttgaagaacctgtctaactggatgctcattgcctgggcaaggcctgtttaggccggttgcggtggctcatgcctgtaatcctagcactttgggaggctgaggtgggtggatcacctgaggtcaggagttcgagaccagcctcgccaacatggcgaaaccccatctctactaaaaatacaaaagttagctgggtgtggtggcagaggcctgtaatcccagctccttgggaggctgaggcgggagaattgcttgaacccggggacggaggttgcagtgagccgagatcgcactgctgtacccagcctgggccacagtgcaagactccatctcaaaaaaaaaagaaaagaaaaagcctgtttaatgcacaggtgtgagtggattgcttatggctatgagataggttgatctcgcccttaccccggggtctggtgtatgctgtgctttcctcagcagtatggctctgacatctcttagatgtcccaacttcagctgttgggagatggtgatattttcaaccctacttcctaaacatctgtctggggttcctttagtcttgaatgtcttatgctcaattatttggtgttgagcctctcttccacaagagctcctccatgtttggatagcagttgaagaggtgtgtgggtgggctgttgggagtgaggatggagtgttcagtgcccatttctcattttacattttaaagtcgttcctccaacatagtgtgtattggtctgaagggggtggtgggatgccaaagcctgctcaagttatggacattgtggccaccatgtggcttcccatcccttttgttcgtacctcaataaagtgagtaatataatatttggtaaagaaaagaacaaaaccaa

SEQ ID NO: 85350 - DNA, 1246 bp, Homo sapiens
tgcgctctgcggctgacggcgcttttgtctccgggtccagaggcctttcagaaggagaaggcagctctgtttctctgcagaggagtagggtcctttcagccatgaagcatgtgttgaacctctacctgttaggtgtggtactgaccctactctccatcttcgttagagtgatggagtccctagagggcttactagagagcccatcgcctgggacctcctggaccaccagaagccaactagccaacacagagcccaccaagggccttccagaccatccatccagaagcatgtgataagacctccttccatactggccatattttggaacactgacctagacatgtccagatgggagtcccattcctagcagacaagctgagcaccgttgtaaccagagaactattactaggccttgaagaacctgtctaactggatgctcattgcctgggcaaggcctgtttaggccggttgcggtggctcatgcctgtaatcctagcactttgggaggctgaggtgggtggatcacctgaggtcaggagttcgagaccagcctcgccaacatggcgaaaccccatctctactaaaaatacaaaagttagctgggtgtggtggcagaggcctgtaatcccagctccttgggaggctgaggcgggagaattgcttgaacccggggacggaggttgcagtgagccgagatcgcactgctgtacccagcctgggccacagtgcaagactccatctcaaaaaaaaaagaaaagaaaaagcctgtttaatgcacaggtgtgagtggattgcttatggctatgagataggttgatctcgcccttaccccggggtctggtgtatgctgtgctttcctcagcagtatggctctgacatctcttagatgtcccaacttcagctgttgggagatggtgatattttcaaccctacttcctaaacatctgtctggggttcctttagtcttgaatgtcttatgctcaattatttggtgttgagcctctcttccacaagagctcctccatgtttggatagcagttgaagaggtgtgtgggtgggctgttgggagtgaggatggagtgttcagtgcccatttctcattttacattttaaagtcgttcctccaacatagtgtgtctggtttcaagttaaagtaagtgagtgctcttgggcactgcgcggccgtttctgctgacttgcctggcttacaatcaatgcccaataaatataagaaggccaaaaaaaa

SEQ ID NO: 85351 - DNA, 604 bp, Homo sapiens
ttagaataacaatctgatatgaacggggtgcccagagcctttccttcccctcacatccactactagcacataatgtttccagaagccaatatgcagaacccagagaagaaagtaagtctcactgatctgccttatacaaattcttttaaatatacaatctgtatttactaggcaaatactgggtattacagaggtattacctcaaggttaaaaaaaaaaacggcgctgatgaattcccaagatcacactagctatgccacattcagaagaatgtctaaatataatcataaatccagctttgtatctactgatattcaaggacagtctccacattgtgagtaaggagaaaatcaggacatatactcaagaatataagtcttctcaatatattaatgagtagtgcaatgaacaaaaaaatagaactcaagagagtgtcttccttaggttgtacgaagggcaaagaagttgtgggattataaacagtgctgcatacatagcactactcctgactatgccagagccctcttcagaacagagataagcaacaggggaaaacatagtaagtaaccaattctgaatcaaaaacacacccaatatcaaatag

SEQ ID NO: 85352 - DNA, 298 bp, Homo sapiens
gatataaaaacatctacatcacccagaaagtttcttcatgttcctttgcattcaatcccctcccctacagaccctcggaaaacactgatgtactttacaccacaatagattagttttgtctgttgtagaatttgatataaattcaattacaaaatatgtactcttttgtgtctgacttctttcacacaacatcatgttttcagattgatttgtattgcctgtatcagtaggttacatttaggctgttcacaacttttggttattatgaataaagctactatgaacgtttatgtactgg

SEQ ID NO: 85353 - DNA, 229 bp, Homo sapiens
cttgcttgcaccctcatggaagagtcacatctctccacattatccttacactccctccttgcaggaaaagcttgatcaagactgctgggtctgtcttgatcacgtagacaggcagagcctgtgctgggtttggccctgcaggtgccttgctgtcatcactcctgcccactgttttgctgctaaaatgaacaggacttgtttacacacacacacacacacacacacacac

SEQ ID NO: 85354 - DNA, 407 bp, Homo sapiens
tatatgtaaatcttatgaattctacctcataactgtcttgaattctctcctctttatgccaccgtgaccacctttttcaggccctctcccaacatagaagtcggttgaagccagggaagtggttgtgcttccccaaggtgaacatatgaaaccatggcactaaaagggcatttgtgtgcacaatcctcatttgtggaacttttattagactacgtatgccagggctcaccattatgcattctaattctacatatctggaatgtattttgaaaaatctttccagctgattctgatgtatgtcccaggcaaaaaccactgacaatgcattattcaaacttgtggactatttgggatagcactaacccctctccatacctagcagtggaatggttgggttgtgtggtagc

SEQ ID NO: 85355 - DNA, 733 bp, Homo sapiens
tcacccacccttaaaatataaaatttaaagattaggcagtattactaatggccagtacttataaagtgacatgtaaataggacaagagtttaacaaatgtaaacatctcactaaattttagtacttcacttaccaacccttggatgtttagctaataattgctaattataactatgcatttgtttgcttatactactctggcaggaacaggcctctctcagcttactcagtaggccaagttagagattctgggttgggccctagtttttcagggatgtagtattggctcattggatttaaatcttagggaaaatctggtggagacactttgcctccacctgcagcctgctgtgctggatgtgtagtgagggaatgaagacaggataggcccgagagtaaagtggtctgtttgaatccccagttctgccactcattttttgtaaaatgggaataatgataatatctaagttctggggttattttgaggattaaatgaggtcgcatgtttaaagcatataggatgttgtccgagtgtcagcttttattgttaccattactattcttgaggaaacctagcaggtttacacttcaccaaggaagggcagctattggtttgcctataggagtatgctctctctgctctcagagggcctacaagaaaattttttttctatccaaatgtcacctttgcttttattttctttcctttccatacacggaagaaaaaatagga

SEQ ID NO: 85356 - DNA, 353 bp, Homo sapiens
ctgacatcctgcctctggtttttcctattctcctcataatcctactgtgaagtagacattggggcctttagcatcaccattttcaagttcactgctctgaactcccaggaatgccaccatttatagagaaactcaatgactagcacctacttcaactcagctgttgctgacgagctgactctgctcttctcagccctgctgtgtgagttcccagctgtgtctcacacactagtatcccaaacaccatcggggaagagagtgaagaagcagagtggcagagagaaggccaaagatgataaggaagattgtgaatggtgctttcatcagtatttcatagcagtttgattccaagc

SEQ ID NO: 85357 - DNA, 396 bp, Homo sapiens
gtgataacttgtgactgactccaggtttaggcattcaatttattcttatttagcaactttttatccagctgtcaaaggcattagatctaatcactgccattttctttagagaacagtaacctctgcaaggagatattttttcttcttttcagtgataggaaaagagccaattaagcttcgtcctgcagaggtacaatggcctaacaaacaaaacataaacctggcaactccattaaacttttgcattcgtatccctagaaaaacaaaatagggaaaaatgatgtcagccacttcaggtcccagaggttcactttctttttttaaatgaagagtatgtggggctccctttatttcttctcccttcctatagagctttatttctttagttattctccc

SEQ ID NO: 85358 - DNA, 1952 bp, Homo sapiens
ccccgcttctgcggagcggccctacaaatgtgccgagtgcggcaagtccttcaagggctcctccgggctgcgctaccacctgcgggaccacacgggcgagcggccctaccagtgtggcgagtgcggcaaggccttcaagcgctcctccctgctggccatccaccagcgggtgcacacgggcctgcgggccttcacctgtggccagtgcggcctcaccttcaagtggtcgtcccactaccagtaccacctgcggctgcactctggcgagcggccctacgcctgcggggagtgtggcaaggccttccgcaacacgtcgtgcctgcgtcgccaccgccacgtgcacactggcgagaggccccacgcctgcggtgtctgcggcaagagcttcgcgcagacctccaacctgcggcagcaccagcgcgtgcacacgggcgagcggcccttccgctgcccgctctgccccaagaccttcacccactcctccaacctgctgctgcaccagcgcacgcactcggcggagcgccccttcacctgccccatctgcggtcgcggcttcgttatggccgcctatctgcagcggcacctgaggacgcacgccccggccaacacgcctcccagcaccacagcccctgccgccggcccccagccccctgctccactggctgctgcgcgggccccgccagccacccaagatgtccacgtcctgccccacctccaggccacgctctccctcgaggtggcggggggcacggcccaggccccgagcttggggccagcagcgcccaactctcagacgttcctcctggtgcaaactgcccagggcctccagctgatccccagcagcgtgcagccccctacacctccgccccctcccgcacctcccaagctcatcctgctgccctcctccagtgctggggctgggggcggccgtgcaaggcagggcccgcgggcagtggggaaagcgggccagggggcgggagtggtctggctgccaggccctgggggtctaggggtgcagggagcggccagcgctggggccagcgggacagggcagagcctcatcgttctgcagaatgtggggggtggggaggcagggccacaggaaatgagtggggtgcagctccagcccctccgaccagccccagaagtaaccacggtccagctccagccagcgcaggaggtgaccacagtccagctccagccagcacaggaagtaaccacggtccagctccagccagcacaggaggtgaccacggtccagctccagcccgtggccggccagctctccaattccagtgggggagctgtggctactgaggcacccaacctgctggttgttcagagcggggcagctgaggagttgctcactggcccgggccccggggaggcgggggatggcgaggccagcactggtgtggtccaggatgtcctctttgagacactccagacggacgagggcttgcagagcgtgctggtgctgagcggggccgatggcgaacagactcgactctgcgtacaggaggtagaaacacttcctcctgggctgacggagccgcctgccaccggcccacccggacagaaactcctcatcatccgcagcgccccagccactgagctgctggacagcagcaacactggaggaggcaccgccacgctgcagctcctggccccaccgccgtcaggcccagcctcgggccccgcggggctccccggggctccagcctcccagatggtgcaagtggtccccgcaggagctgggcctggtgttatgacccctcagggcctgccctccatccagattgtccagactctacccgcagtccagctggtgcacacgttttgaggagaggcagtgattcccctcccgccccgcacagagaccccgactcactgccagccggggcggggcagggtgccgcaggctgggcttgctaataaagacccgagtctcc

SEQ ID NO: 85359 - DNA, 1780 bp, Homo sapiens
ccccgcttctgcggagcggccctacaaatgtgccgagtgcggcaagtccttcaagggctcctccgggctgcgctaccacctgcgggaccacacgggcgagcggccctaccagtgtggcgagtgcggcaaggccttcaagcgctcctccctgctggccatccaccagcgggtgcacacgggcctgcgggccttcacctgtggccagtgcggcctcaccttcaagtggtcgtcccactaccagtaccacctgcggctgcactctggcgagcggccctacgcctgcggggagtgtggcaaggccttccgcaacacgtcgtgcctgcgtcgccaccgccacgtgcacactggcgagaggccccacgcctgcggtgtctgcggcaagagcttcgcgcagacctccaacctgcggcagcaccagcgcgtgcacacgggcgagcggcccttccgctgcccgctctgccccaagaccttcacccactcctccaacctgctgctgcacgggccccgccagccacccaagatgtccacgtcctgccccacctccaggccacgctctccctcgaggtggcggggggcacggcccaggccccgagcttggggccagcagcgcccaactctcagacgttcctcctggtgcaaactgcccagggcctccagctgatccccagcagcgtgcagccccctacacctccgccccctcccgcacctcccaagctcatcctgctgccctcctccagtgctggggctgggggcggccgtgcaaggcagggcccgcgggcagtggggaaagcgggccagggggcgggagtggtctggctgccaggccctgggggtctaggggtgcagggagcggccagcgctggggccagcgggacagggcagagcctcatcgttctgcagaatgtggggggtggggaggcagggccacaggaaatgagtggggtgcagctccagcccctccgaccagccccagaagtaaccacggtccagctccagccagcgcaggaggtgaccacagtccagctccagccagcacaggaagtaaccacggtccagctccagccagcacaggaggtgaccacggtccagctccagcccgtggccggccagctctccaattccagtgggggagctgtggctactgaggcacccaacctgctggttgttcagagcggggcagctgaggagttgctcactggcccgggccccggggaggcgggggatggcgaggccagcactggtgtggtccaggatgtcctctttgagacactccagacggacgagggcttgcagagcgtgctggtgctgagcggggccgatggcgaacagactcgactctgcgtacaggaggtagaaacacttcctcctgggctgacggagccgcctgccaccggcccacccggacagaaactcctcatcatccgcagcgccccagccactgagctgctggacagcagcaacactggaggaggcaccgccacgctgcagctcctggccccaccgccgtcaggcccagcctcgggccccgcggggctccccggggctccagcctcccagatggtgcaagtggtccccgcaggagctgggcctggtgttatgacccctcagggcctgccctccatccagattgtccagactctacccgcagtccagctggtgcacacgttttgaggagaggcagtgattcccctcccgccccgcacagagaccccgactcactgccagccggggcggggcagggtgccgcaggctgggcttgctaataaagacccgagtctcc

SEQ ID NO: 85360 - DNA, 487 bp, Homo sapiens
aaaagttggtaatggctgtctccaaaacaaattagctaatcaaatatattcaaagaaatggaaaagtgatttgtgaaactgttttagtgatggttccttgatactataaaaccagttccttttaaaaaaaaaagaaaacttcaagaaagctgaaaacttggtgaacctgtgttttgtagctagaaatggcaattgtagtgataggagtatatcactcaggtggcatataatttgtctgaaaaccaaattagaatcgtgattttaatcacttgtgttttaagtttctgtctcacttactagaatggtcatttgagttactcacagggcatggcatagtaccagcatgaagcatggactgaaaaggaagggaactgataagtagtactaataagaaagagtaaataggaaacagatgattttaataaagtaaagcttttgtaataaattcattttcaaggacagtatgatactactcacaagagttagc

SEQ ID NO: 85361 - DNA, 429 bp, Homo sapiens
ggctcttcagcccatgcagccctcttatttgtgctactagtaaaataatgataatgctattgaatagctggattgttgaccctctggctaatatgatttgatggattttattatatggcattttaatcaaaggataagcttgtctcatttgaaatagatagaaaacctgaaaaagggacagtttaaaggtagcaatcaagtcaaaatagttttcttcttctggaatgtgataaatgtatttagtgagaggtatcttggagagcgtgattttaccacttactcatttgacaaattgctgagcttaggggccaagtcctgtaatatttccctgttgcttcaaggcaggtatactgaaaaaaatcagttattaaatatttgccatatttcctaaataacctattcattctttgcctgataacagcagttttt

SEQ ID NO: 85362 - DNA, 385 bp, Homo sapiens
ctcccttccaacttcttgggcatagactttgcttcagagtgatcccagaaggggttaatccccaattttgactttgagaattccaacaaggattaagcaaccctctactttcctgtggtttggggaaagcctgtaagtggggctttgatggaaataatacaatgaaaaattaataattcaggagataccttcactttgagtgtctcacatctgttttacaaaggaattctcagagtgaacctatagggaaaatccagaagataacaacaataacatatgatctcctaaaaatttctaaattaatcaaacaaatttaaaggcaacaggggaatttgctctctgaaagagcttagtagtgagcttttaaaagagaatctgtaatgaa

SEQ ID NO: 85363 - DNA, 681 bp, Homo sapiens
gatgtgctgcttaggtctccaaagatgcccacctgggtcaaattcagaataatgaactcaggtacatcacccagaggcatttagaatggactctctcttcacctggattatgtgctgagtgttaagtgatttttcaaatatctgggggaaggagtgggaagagatacactctggtcatcctttggtgtggtttgtgggggatacttggttgattcttgtagttaaagtgaagttgcttttctgaaaatgttccctgtcttcaggggacttacccatcccaggggacacatccatcccaggggacacagccagccctttccagggaaatacgatgtttctgagtgagaggtgatttcagtgcagataggaagagctggtgcacaccagcagggttgccttccatgccatcttccagctggtgtgggatagactaagggggcagatttttaagaaccccaccagagttgacatacacacgtgattctcgtgtctgtctctcaaagctctcaatgtctggggctgtgtttgccctcttttcattgatgctgccatgatgcaaaatgtttcttaaacattattcctggttcttagaatatgtgattactgagtattggatttctttcctgaataataactgctcattgtagaaaataagaaaaataaaatacaaaaaagactaca

SEQ ID NO: 85364 - DNA, 729 bp, Homo sapiens
  misc_feature (688)..(688): n is a, c, g, or t
  misc_feature (702)..(702): n is a, c, g, or t
  misc_feature (704)..(704): n is a, c, g, or t
gatgtgctgcttaggtctccaaagatgcccacctgggtcaaattcagaataatgaactcaggtacatcacccagaggcatttagaatggactctctcttcacctggattatgtgctgagtgttaagtgatttttcaaatatctgggggaaggagtgggaagagatacactctggtcatcctttggtgtggtttgtgggggatacttggttgattcttgtagttaaagtgaagttgcttttctgaaaatgttccctgtcttcaggggacttacccatcccaggggacacatccatcccaggggacacagccagccctttccagggaaatacgatgtttctgagtgagaggtgatttcagtgcagataggaagagctggtgcacaccagcagggttgccttccatgccatcttccagctggtgtgggatagactaagggggcagatttttaagaaccccaccagagttgacatacacacgtgattctcgtgtctgtctctcaaagctctcaatgtctggggctgtgtttgccctcttttcattgatgctgccatgatgcaaaatgtttcttaaacattattcctggttcttagaatatgtgattactgagtattggatttctttcctgaataataactgctcattgtagaaaataagaaaaataaaatacaaaaaagactacataaaatnttggggggggcccngncccttcgccctatagtgagtccgat

SEQ ID NO: 85365 - DNA, 1501 bp, Homo sapiens
gatgtgctgcttaggtctccaaagatgcccacctgggtcaaattcagaataatgaactcaggtacatcacccagaggcatttagaatggactctctcttcacctggattatgtgctgagtgttaagtgatttttcaaatatctgggggaaggagtgggaagagatacactctggtcatcctttggtgtggtttgtgggggatacttggttgattcttgtagttaaagtgaagttgcttttctgaaaatgttccctgtcttcaggggacttacccatcccaggggacacatccatcccaggggacacagccagccctttccagggaaatacgatgtttctgagtgagaggtgatttcagtgcagataggaagagctggtgcacaccagcagggttgccttccatgccatcttccagctggtgtgggatagactaagggggcagatttttaagaaccccaccagagttgacatacacacgtgattctcgtgtctgtctctcaaagctctcaatgtctggggctgtgtttgccctcttttcattgatgctgccatgatgcaaaatgtttcttaaacattattcctggttcttagaatatgtgattactgagtattggatttctttcctgaataataactgctcattgtagaaaataagaaaaataaaatacaaaaaagactacaagatttttcataatccagtcactctgaggcatctaccgcgggcccaatccaaatggtcatgacctcaaaacttccccaatgagtgcttgtctctgggttggcagctggggccatgtgagcagtgtacaccacagaaccgcactggtctgcgttgagttgaccctgtgttcctggcagcaagagtgcagggccctgagcccccagagatagcaaagaggcctaaaagtttaatgccagaccttaggggcaggatggagcagggctaaaagatgtctctttgggcctgtctgcctgctttccttccttccttttctttcctttttttttttggtcagttgccatctcaatctaatcatagatgtaagaatgcggaagccagagtaactcactcattaagctacacttgtgtaacagttactgtaaatttcactacagctctgcactgaaatgatttgtgactctgggcactgtgtcttctccatacttgaacttcctcatctacaaaatgaggataagtgataacaccttacctcatggtatattaagggtgacaaagaaattgcaaagtgatttgcaaacatgaagtgtcatatgagttatgtatgttctaattatccctcagaagaccccccgctggaatggaattctcacatcaagtgtctgtgcctcgctgctgaaggataacccagagtgcaaggtcatctttgttgctgaacagggctggacctgtcgcacttaagcacacttaaaggattctattcttcattcaggtcccccagagaaattggctccttatttttctttacctattcctagactt

SEQ ID NO: 85366 - DNA, 493 bp, Homo sapiens
ggcccgctctagaggatcctcacgttgacacttcagtcagcaaagtatggatttctcagtaacataaaaactgttaactctaagaaaaataacttctattggctgggcgcagtggctcacacctgtaatcccagcactttgggaggccgagggggcagatcacctgaggttgggagttcaagaccagcctgaccaacatggagaaacctcatctctattaaaaatacaaaattagccgggcgtggtggcacatgcctgtaaccccagctactcgggagctgaggcaggagaatctcttgaacccagaaggcagaggtgcggtgagccaagatggcgccactgcactccagcctgggcaacaagaacaaaactccgtcaaaaaaaagaaaaagaaaaagaataagaacttatatttctattataaattctaatttaaagaattaatccttatatttctggttttatctttccccatttcttattcaaaagcagg

SEQ ID NO: 85367 - DNA, 630 bp, Homo sapiens
aggaaaggataactttaatctgtttattggaaaaactaattactgtatgaacttcagactattttatattatgtgaaaggttaatttggtttgaaagcctatttttttggtacttctcggcttacttggagattacgtgtctccaaactactaaaaagaactttctacttcagtcagcaaagtatggatttctcagtaacataaaaactgttaactctaagaaaaataacttctattggctgggcgcagtggctcacacctgtaatcccagcactttgggaggccgagggggcagatcacctgaggttgggagttcaagaccagcctgaccaacatggagaaacctcatctctattaaaaatacaaaattagccgggcgtggtggcacatgcctgtaaccccagctactcgggagctgaggcaggagaatctcttgaacccagaaggcagaggtgcggtgagccaagatggcgccactgcactccagcctgggcaacaagaacaaaactccgtcaaaaaaaagaaaaagaaaaagaataagaacttatatttctattataaattctaatttaaagaattaatccttatatttctggttttatctttccccatttcttattcaaaagcagg

SEQ ID NO: 85368 - DNA, 372 bp, Homo sapiens
aacttcctcgcatttgagtttacatgtatgcaacattctttggatagaaagagaaagaatttttgtataagcacaaggtatttcagttctgtcccttaaagaacaaatatcccagaggaaaaagaaatggaattgtgaatctgctgttccctgaggttccctcaggtgtccttctctagctgtgagcacatggtggcactgggtggattctaggatttaaaaatatgtatttctcacctaatattgctctcattagtgaaatcttataatgtacaattcatagtcttttcaagggtactttaacataagcagttctcgtggatgcactggcttaagaacctcactcccacttaagttacagtttcacagtac

SEQ ID NO: 85369 - DNA, 106 bp, Homo sapiens
actttgcccacccatcctttgctgccagcctgaaaatgggtccccccaagagcaaggctgaaaaaatcaagagaagtcccatggacaaggtgctgaggtttgcaag

SEQ ID NO: 85370 - DNA, 705 bp, Homo sapiens
atcacggcacagcgttgggagggaagctttgcaggcaacttgtcctccccctgtggggaaaggctgtgaggtttggagttaatatccatgacatatcctcactattttaaatgtgagctccagaatatactctcctcctccgtaccctttctctatttgtatttgacttaatgatttatatttaacatattggaggtttgatgcttaattttaaaatcaaattaatgtattattaataaataatatgtactcaagatatattattcatatatttgataagtgttacttaaatgactaattgaatgcaatttagtaataagattcattaatattattaagaaataacatttgttaaaaagttatttaatagctggcattccatttctatgaatatggatttaaaatatagacactatttaattgtgaaacactatccatgttttctcacacaatacaatgattaagtattgcatataagcatgttcacatgtattgatcccatccttgtcaccgccagtgtccctggatctttctttactccccctctgcagggaagaagtgatgggtgggggcccaacaacagtccagggagcacaggtagtttctgctcctgactccttcccagttggggaggggagtttggggaaaatagaattatgtaaaattacacacagataccacgatatccatcactctggcctctcc

SEQ ID NO: 85371 - DNA, 1214 bp, Homo sapiens
atggagtctgatgctttgagacacagagccagctggccaggttatagggtgtaaaagtcaacacactgagttcagcatggtttcctgtgatgttctcaaaccatttttttttttttgagatagagttttgctcttcttgcccaggctggagtgaaatggcacggtctcggctcactgcaacctccgcctcccgagttgaagtgattctcctgcttcagcctcccgagtagctgggactacaggcgcccgccaccacgcctggctaatttttttgtatttttagtagagatggggtttcaccgtgttagccaggatggtctcgatctgctgacctcatgatccgcccgcctcttaagaggctagaatcctgtattttactgatcataaagtgttcagacgcccaagctttttcacaatagtcagtgacaaataccttgttcttacagccccagtagggtgcttacaacatgggatacaaacaggccaaatgtagttaaaaattgggcaattaatctcagttccttgttacttaataccaaggaaaggtatgcttgagtcataaatggagcccaaatattaaaacacaagacggaaactttctgaaggactgactcatagacctattaagagttttcccattggctgcccagttagcacctttggtaatggctctaggtgctccccggaaacagttaattaaatggaaatcaccatatatgtatcagagagagcttttggatccatgctttggccttctaaatgcctagttgaattttccataacctgtcctattggaaaagtctgatgttaacatctcagtggtagaaggcatttaatgtttttcaaaaagtatttgtgctatcccacttggttgttacaatcatttctgtgaggtaggtaagagtttgtattctaaatacagagaaactaaggaccacagagatcacagagaaagacatctgcagaaagggagcacagcttcacaccagcgttcatcacaccgccaccaccgactacagctctgggattctggagagcttgctttatttaaaacaagttgagagttttggctcatcataagccattttggaattgcactaactatcctgagagaaatgggtttgtctaatccagaagaatgactttgcaacagggtcctttgttgcagtggtgccaaggcctgggggctgaagttagggctcccgagagagagg

SEQ ID NO: 85372 - DNA, 782 bp, Homo sapiens
gatcttgtccgactccgcgggtgacacgagccggttctctctggactggtggcagcgcgcggccccgaaccgccgccaggccggcacgggggaaggagccggtgggggtagggggtgcggtggggggtggggaccctccggctcttgggggtcccagtccccgccggctgctgagcgggtggggtggtggaggagctgcagagatgtccggccagagcctgacggaccgaatcactgccgcccagcacagtgtcaccggctctgccgtatccaagacagtatgcaaggccacgacccacgagatcatggggcccaagaaaaagcacctggactacttaattcagtgcacaaatgagatgaatgtgaacatcccacagttggcagacagtttatttgaaagaactactaatagtagttgggtggtggtcttcaaatctctcattacaactcatcatttgatggtgtatggaaatgagcgttttattcagtatttggcttcaagaaacacgttgtttaacttaagcaattttttggataaaagtggattgcaaggatatgacatgtctacatttattaggcggtatagtagatatttaaatgagaaagcagtttcatacagacaagttgcatttgatttcacaaaagtgaagagaggggctgatggagttatgagaacaatgaacacagaaaaactcctaaaaactgtaccaattattcagaatcaaatggatgcacttcttgattttaatgtgagttatgcttttgtaatttaagattttaaa

SEQ ID NO: 85373 - DNA, 2077 bp, Homo sapiens
  misc_feature (1973)..(1973): n is a, c, g, or t
  misc_feature (2018)..(2018): n is a, c, g, or t
  misc_feature (2056)..(2056): n is a, c, g, or t
  misc_feature (2073)..(2073): n is a, c, g, or t
gatcttgtccgactccgcgggtgacacgagccggttctctctggactggtggcagcgcgcggccccgaaccgccgccaggccggcacgggggaaggagccggtgggggtagggggtgcggtggggggtggggaccctccggctcttgggggtcccagtccccgccggctgctgagcgggtggggtggtggaggagctgcagagatgtccggccagagcctgacggaccgaatcactgccgcccagcacagtgtcaccggctctgccgtatccaagacagtatgcaaggccacgacccacgagatcatggggcccaagaaaaagcacctggactggctgatggagttatgagaacaatgaacacagaaaaactcctaaaaactgtaccaattattcagaatcaaatggatgcacttcttgattttaatgttaatagcaatgaacttacaaatggggtaataaatgctgccttcatgctcctgttcaaagatgccattagactgtttgcagcatacaatgaaggaattattaatttgttggaaaaatattttgatatgaaaaagaaccaatgcaaagaaggtcttgacatctataagaagttcctaactaggatgacaagaatctcagagttcctcaaagttgcagagcaagttggaattgacagaggtgatataccagacctttcacaggcccctagcagtcttcttgatgctttggaacaacatttagcttccttggaaggaaagaaaatcaaagattctacagctgcaagcagggcaactacactttccaatgcagtgtcttccctggcaagcactggtctatctctgaccaaagtggatgaaagggaaaagcaggcagcattagaggaagaacaggcacgtttgaaagctttaaaggaacagcgcctaaaagaacttgcaaagaaacctcatacctctttaacaactgcagcctctcctgtatccacctcagcaggagggataatgactgcaccagccattgacatattttctacccctagttcttctaacagcacatcaaagctgcccaatgatctgcttgatttgcagcagccaacttttcacccatctgtacatcctatgtcaactgcttctcaggtagcaagtacatggggagatcctttctctgctactgtagatgctgttgatgatgccattccaagcttaaatcctttcctcacaaaaagtagtggtgatgttcacctttccatttcttcagatgtatctacttttactactaggacacctactcatgaaatgtttgttggattcactccttctccagttgcacagccacacccttcagctggccttaatgttgactttgaatctgtgtttggaaataaatctacaaatgttattgtagattctgggggctttgatgaactaggtggacttctcaaaccaacagtggcctctcagaaccagaaccttcctgttgccaaactcccacctagcaagttagtatctgatgacttggattcatctttagccaaccttgtgggcaatcttggcatcggaaatggaaccactaagaatgatgtaaattggagtcaaccaggtgaaaagaagttaactgggggatctaactgcgaaccaaaggttgcaccaacaaccgcttggaatgctgcaacaatggcaccccctgtaatggcctatcctgctactacaccaacaggcatgataggatatggaattcctccacaaatgggaagtgttcctgtaatgacgcaaccaaccttaatatacagccagcctgtcatgagacctccaaacccctttggccctgtatcaggagcacagatacagtttatgtaacttgatggaagaaaatggaattactccaaaaagacaagtgctcaagcagcaaaatccttacttccagcaaaatccaaactgctgtctcttaaatctcttaaactctcttcttccattaggatgctacaagtanctcagtgaaggcccatgaagggaattggggactagtttatagggngaacgtattcattacagtttataaaggccaggattggnttggattttaggattangttc

SEQ ID NO: 85374 - DNA, 2399 bp, Homo sapiens
  misc_feature (2295)..(2295): n is a, c, g, or t
  misc_feature (2340)..(2340): n is a, c, g, or t
  misc_feature (2378)..(2378): n is a, c, g, or t
  misc_feature (2395)..(2395): n is a, c, g, or t
gatcttgtccgactccgcgggtgacacgagccggttctctctggactggtggcagcgcgcggccccgaaccgccgccaggccggcacgggggaaggagccggtgggggtagggggtgcggtggggggtggggaccctccggctcttgggggtcccagtccccgccggctgctgagcgggtggggtggtggaggagctgcagagatgtccggccagagcctgacggaccgaatcactgccgcccagcacagtgtcaccggctctgccgtatccaagacagtatgcaaggccacgacccacgagatcatggggcccaagaaaaagcacctggactacttaattcagtgcacaaatgagatgaatgtgaacatcccacagttggcagacagtttatttgaaagaactactaatagtagttgggtggtggtcttcaaatctctcattacaactcatcatttgatggtgtatggaaatgagcgttttattcagtatttggcttcaagaaacacgttgtttaacttaagcaattttttggataaaagtggattgcaaggatatgacatgtctacatttattaggcggtatagtagatatttaaatgagaaagcagtttcatacagacaagttgcatttgatttcacaaaagtgaagagaggggctgatggagttatgagaacaatgaacacagaaaaactcctaaaaactgtaccaattattcagaatcaaatggatgcacttcttgattttaatgttaatagcaatgaacttacaaatggggtaataaatgctgccttcatgctcctgttcaaagatgccattagactgtttgcagcatacaatgaaggaattattaatttgttggaaaaatattttgatatgaaaaagaaccaatgcaaagaaggtcttgacatctataagaagttcctaactaggatgacaagaatctcagagttcctcaaagttgcagagcaagttggaattgacagaggtgatataccagacctttcacaggcccctagcagtcttcttgatgctttggaacaacatttagcttccttggaaggaaagaaaatcaaagattctacagctgcaagcagggcaactacactttccaatgcagtgtcttccctggcaagcactggtctatctctgaccaaagtggatgaaagggaaaagcaggcagcattagaggaagaacaggcacgtttgaaagctttaaaggaacagcgcctaaaagaacttgcaaagaaacctcatacctctttaacaactgcagcctctcctgtatccacctcagcaggagggataatgactgcaccagccattgacatattttctacccctagttcttctaacagcacatcaaagctgcccaatgatctgcttgatttgcagcagccaacttttcacccatctgtacatcctatgtcaactgcttctcaggtagcaagtacatggggagatcctttctctgctactgtagatgctgttgatgatgccattccaagcttaaatcctttcctcacaaaaagtagtggtgatgttcacctttccatttcttcagatgtatctacttttactactaggacacctactcatgaaatgtttgttggattcactccttctccagttgcacagccacacccttcagctggccttaatgttgactttgaatctgtgtttggaaataaatctacaaatgttattgtagattctgggggctttgatgaactaggtggacttctcaaaccaacagtggcctctcagaaccagaaccttcctgttgccaaactcccacctagcaagttagtatctgatgacttggattcatctttagccaaccttgtgggcaatcttggcatcggaaatggaaccactaagaatgatgtaaattggagtcaaccaggtgaaaagaagttaactgggggatctaactgcgaaccaaaggttgcaccaacaaccgcttggaatgctgcaacaatggcaccccctgtaatggcctatcctgctactacaccaacaggcatgataggatatggaattcctccacaaatgggaagtgttcctgtaatgacgcaaccaaccttaatatacagccagcctgtcatgagacctccaaacccctttggccctgtatcaggagcacagatacagtttatgtaacttgatggaagaaaatggaattactccaaaaagacaagtgctcaagcagcaaaatccttacttccagcaaaatccaaactgctgtctcttaaatctcttaaactctcttcttccattaggatgctacaagtanctcagtgaaggcccatgaagggaattggggactagtttatagggngaacgtattcattacagtttataaaggccaggattggnttggattttaggattangttc

SEQ ID NO: 85375 - DNA, 1183 bp, Homo sapiens
gatcttgtccgactccgcgggtgacacgagccggttctctctggactggtggcagcgcgcggccccgaaccgccgccaggccggcacgggggaaggagccggtgggggtagggggtgcggtggggggtggggaccctccggctcttgggggtcccagtccccgccggctgctgagcgggtggggtggtggaggagctgcagagatgtccggccagagcctgacggaccgaatcactgccgcccagcacagtgtcaccggctctgccgtatccaagacagtatgcaaggccacgacccacgagatcatggggcccaagaaaaagcacctggactacttaattcagtgcacaaatgagatgaatgtgaacatcccacagttggcagacagtttatttgaaagaactactaatagtagttgggtggtggtcttcaaatctctcattacaactcatcatttgatggtgtatggaaatgagcgttttattcagtatttggcttcaagaaacacgttgtttaacttaagcaattttttggataaaagtggattgcaaggatatgacatgtctacatttattaggcggtatagtagatatttaaatgagaaagcagtttcatacagacaagttgcatttgatttcacaaaagtgaagagaggggctgatggagttatgagaacaatgaacacagaaaaactcctaaaaactgtaccaattattcagaatcaaatggatgcacttcttgattttaatgttaatagcaatgaacttacaaatggggtaataaatgctgccttcatgctcctgttcaaagatgccattagactgtttgcagcatacaatgaaggaattattaatttgttggaaaaatattttgatatgaaaaagaaccaatgcaaagaaggtcttgacatctataagaagttcctaactaggatgacaagaatctcagagttcctcaaagttgcagagcaagttggaattgacagaggtgatataccagacctttcacaggtaagtttatcgttaaaataccaatccactatctgttgtgtacaagttgtgaagagtattaagataagtaacatatagcccccattgtcaaagggatcaatgcagttttggaccagttttaacattttgatgtattcctgaagattgttctaacactatgaccaggtaaaatg

SEQ ID NO: 85376 - DNA, 681 bp, Homo sapiens
gcacacatggacataaacatggggacaacagacactgtaaactactagacggagggggaagtgggcgcgggttgaaaaactacctattgggtactgtgcacactgcctaggtgcaacatacacatggaacaaacctgcgcatgtaccccctgtatctgaaataaaagttgaaaattttttttaaaaagcttaaaataatatgttctcagttatattttaccaatttaaacatggctaatgggaaaagtacattgccaactcagacatttagttggtgatattaatcgaaagcatttagttgatgatattaataaaaattatcagaatgagctggatcattctgttggggttttttggtgccttgcgggtaatttttccatgtattgctctttatctcattattgccactcccaaaccaccccccaacccccaccaactgctaaagctgaacaatggacaaagaaagccttcaagtaatccagacagaggagactctacattttaggaggcatggtctctgttgattgaagacagtacaaaatatgtcctcagcctctgctttaattaaaaggtacttactatcaatcacttgaacctaggaggcggaggtggcagtgagccaagattgtgccattgcactccagcctgggcaacaagagcaaaactccatctcaaaaaaaa

SEQ ID NO: 85377 - DNA, 267 bp, Homo sapiens
ataggtagggaggcatttgtgaacttttattcctgatatcttgccaattctgtttgaggaagaccacaaattaggacagtactcttggaacacaaaactagacagtttgttattctttttggttataggtagaataattactattcagtttctttatacaattatagtttgctatgcaagccaatatgaatattaatcaacttacattcattaggaaaataagaaacaatatgttgtgaccagtaaaaacgggcccagagcaaagat

SEQ ID NO: 85378 - DNA, 277 bp, Homo sapiens
catgttggtcaggctggtcttgaactctcgacctcaggctatctgcctgcctcggccccccaaagtgctgggattacaggcatgagccaccgtgcccagttgatgtccactctttaaatccaaaggatgtttgcttgactctcagctgcatttggcctgtgacatcccctgatccactgtcagccgctttcttgatgtctgtgatgaccattctgtttgtttgtttgtggcagagtttcgctctgttgcccaggctggagtgcggtggtgcgatctt

SEQ ID NO: 85379 - DNA, 532 bp, Homo sapiens
ccaagggcagataaggctccgctgtgccggaagagtgggtgtgagccctcagagagggctgacccaattagatggcaaagtgaagacagacaaagagctccaaaactctccagagatttcaagtgaagacagagaaagagctccaaaactctccagagatttctagctttaacaaatgagtagatgagacgtgttgaccataataggtaggagacacagcttcagtgagggagatgtgtcctcggctctgttttgatgtggaacagctcggagcccacacctagtgttaggtctgcagctcagggggacagctcaggtgtatatctatatcacctgccaatgcacagatgtgggcataggtgagttcagccagtgcacctgggcaggtagaaggaactgtcctctagacatgcacttaatatcatgcctacctgagaggagacctcacttgcctaaggggacacagagcaaggaaagatttaagctagggcaagagagtactgaggcgaaatctgggaagacttccaagagg

SEQ ID NO: 85380 - DNA, 209 bp, Homo sapiens
tgattcttaacattgaaacaaacgttaagtatttctaatgatccatttatatttctaatttaattgtgatcttttaataaccctatttatgatctgttgttgtctgtctgctgcttttattgtttatttaaaatcaaatatgttttacaaatgttttttcagacaagattctgtaacatcatgtaaagcttttttgtacattcttggtg

SEQ ID NO: 85381 - DNA, 431 bp, Homo sapiens
actggacacagcagtagggtggacgagtcaggttataaatgaccctgtctcctttgttctatatactcatggggcacaactactggcgagtgtaccctttctgcagaaagtgtaaaaatggccttgctgaggaaattaaatttatgttcaagtactatttctttacggcaccggggaacaagcatttcaaacacgtacttgctgcagactctgccctctggaatggctgcgatcctgtctcaaatggatttgagcagaaaaggggaagtgactggcagaaaagcccagagatagatctgtgtttaggtaaggttgtttgtccagagatagaactgtgtttagatagggttgcttgtagggccagggatgacagcgtcaagccctgcctctttttactcttggctctctgctttcttctctgttggcttcct

SEQ ID NO: 85382 - DNA, 870 bp, Homo sapiens
tggtcttgagctcgtgacatcgtgatctgcctgcctcagccacctcggcctcccaaagtgctcggattacaggcgtgagccaccgtgcccggcctctagtgcctgttattgcatgatacttactcttttcctgactgtgtgaaagagtaatgataatgcttcaattatcattatctttttgtaaattgaattaattgtcttttaaggatgttgtaatattaactagtatatccccaaattaacagactgtccaggaacagtaaacatgccagaaagtttttgttgattaaattaacatagtagcctagaaaaacaatgattcttagctttaccttggagaggtgccttaccttgatttgactgtttttccttggagagtaaaggctagctttttctgatttgggtcaaagtatgagttctgctctaacattttcaagcaatgtccttctggaaaagtcattatggatggttgttatagttaaataaaataatgagagtagaagagcttagttagctttccttctttaaaccaatcactggcaattaagagtgttactgattttcagaccattcaagactcaaaccttgagtttacaggttgatgaaacccttgaagcccaagcaatttggtggatactaacacctcaaaaaatccgacattcttccatgcaagaaagtagagtttggaaagctggtcatgtgttgattggagaacagtcactttttatagaggttgatgtctctttgtgccttagttttctgtttttcctatttctgtcattgcagattaaagcctatacttctttagaaagaaaggatattattcgatcacgatctgattcaaactttgcttggatctttgtctctcca

SEQ ID NO: 85383 - DNA, 798 bp, Homo sapiens
ttgacttttaccactaacttccactccattgccttgcctgtctttggagcaaaatgccttaaaataatcgcttatcttttgctgtctacaatctacctcttcccactctctcctaaccccattccagggaggccgctggctctccaccttcatccgagttgcctgagttgccctcggcagggtcacctgacctctcagttgttatatctgctggttatgtctgtgtcctgcgacagcgttttgatgctgttggccactctctccgtccttggcatggcctccagcacagcactctcctctggcgcccctcctgccgggccagtcccccttctctctgtcctttgctagttccttctcttttcattcttttcttagtatcaccatcttaatgttattagctgtcctttcaaactaattttttttttttactaagtcagcttccttagtggttatattccatttttctgttttttctttcttattttggtaattaatgtttgaatctgttaggtttagatttacctgcaagcaaaagaaagctaaaacattagtggcgtaaatgaagtataaagtgttttatctcatgggtcagtctagaggtagccatccaggtggcagtgaccctgacgccttctgcctcattcctccacagcatgatgtgacctcccttcctcagggtgcctcacaggccagcatagcttcagcttccagccagcaagagggagaaaagggaggaaggagaaggcctgcccttctccttcaggatatttactggaagttggacagcacttccactta

SEQ ID NO: 85384 - DNA, 885 bp, Homo sapiens
cgccctctgtgacttcaggggcttggggccgacaccccgcgggcctcggtgccagcctcccgcttacccggtcagcccctgggccgagtacccctgggagagaaagcgctaaattcccccaacactcccgtgatgggggcacagggagcgccgtgggacacctgaggaaactgaggcccaagtgttaattaacttgccctgatcacctagcacgtggagccacgacttgctcaagccctgcctgattccagccccggcctttgttcattcagtaaatgtggaaggcgcaagggtaactcgaggcctgcggagggaacgagatgagggaggccgcaagagtcaccgcagagaagagggattggctgtcttggaccctccgagggcctcggggaaggactgcaggagagcggattcttgatggggcttcacaggatgcgcaggagctctccaggctacagagcgcatttcaggaactggactgggatgtacagaggcaccatggtgggaaacagctgggccttcctgcaaagaggggagaggctcttggaggtgcagggcttgcgttttctcaacccagactgcctctgagaacagggcagggggtgtgaagagctgatgccctggccctccccactggctagctttccggggactaaggactaaggctgggccaggattctggggttctaggggctctgcctccacacgccagtgcctgtctgttgagttcacttctctctaaaatctcattttacaccacgacccagtacaaaccactcagaaaaatgtttcattaaaagttcggcatactacatgcatgcactctaatattttcatgtagtctattatttctctaaaaactaaaatgctgatcatgacccacag

SEQ ID NO: 85385 - DNA, 1228 bp, Homo sapiens
ggcctccctaagtgctaggattacaggtgtgagccactgcgcctggccatgttatatactctttgtgactttttaatattctctagctcttttttagacacttgcggcttaccactttgtatatgatgagatactttgaaattataatttgagcttaagtgtcttgtctgtcataagaaggttgtactaccatttatatggatttggttggttttaatcttactgtacatgaaaatgtgtttacctttagtgactgagctttttaaaggttggcagttttgaatgtagctggacaaaaatcctagaacacatcaatatcatttcgcatgacaatgttctggacctctggcacctttgaaaatactaacttaccatatagtctcttttcatgtgctgaatttacaaaatttgtctgaagaggatagcagaatgtacattgcatattttcctgaggttggcacattagacttgatggctttgtgtgtctgtctttaggaatgcatttgcatgtcttgagtgtctggaaaagataaaaactctgccatcgtatgtttaaatttgctgtttagaaagtgtttatccattgccttaatgttaaacaagttatacagtctttcagctttgaaatcatatgttacataatactttgtcagttgatcataatcataaataattatgtttcatgtcaaaaagatcttaaaaatcccagccatctaaatatgtttcccaactccattaagtaaggtaaaataatatttgtatttatgttcagatgttgaagctgtcattctcgaataaaactacactttagaaatggcttcttagttataagtagtttggcctattgttacagtttgaatatactttgattctatttatgtgtcataagtgttcttggaaaagtcctcagaataggtaattgtatatattaagttaggtttttcatattgatttaaaatgcactcccttcaaattttagatagtaattgggaaccttcaaagaagcattgtatctttttttttaatgtggtctatccatagttaaatctcccatactgccctcagaacttagagaagtagtaacatgcaatctttttgaagtgcaagtaaagtcaaattatataatttgttcccatttcattagaaattttcattgcccttaagactttcaactagcttattgtaggagtgttaattttttcttctattgaagaacaatcctgccaaa

SEQ ID NO: 85386 - DNA, 2754 bp, Homo sapiens
cacacacacacatacacagaatcctcagataacaggaggcaataaatccaacagcacatccacgttcagagaacagtgtccctgctgtcttgctaacagctgccaatacctcactgagtgcctcacaccaacatgggctccaagtgagtttccttcgtctgggcagactccctcccctcttccataaaggctgcaggagacctgtagctgtcacaggaccttccctaagagcccgcaggggaagactgccccagtccggccatcaccatgctccggaccattctggatgctccccagcggttgctgaaggaggggagagcgtcccggcagctggtgctggtggtggtattcgtcgctttgctcctggacaacatgctgtttactgtggtggtgccaattgtgcccaccttcctatatgacatggagttcaaagaagtcaactcttctctgcacctcggccatgccggaagttccccacatgccctcgcctctcctgccttttccaccatcttctccttcttcaacaacaacaccgtggctgttgaagaaagcgtacctagtggaatagcatggatgaatgacactgccagcaccatcccacctccagccactgaagccatctcagctcataaaaacaactgcttgcaaggcacaggtttcttggaggaagagattacccgggtcggggttctgtttgcttcaaaggctgtgatgcaacttctggtcaacccattcgtgggccctctcaccaacaggattggatatcatatccccatgtttgctggctttgttatcatgtttctctccacagttatgtttgctttttctgggacctatactctactctttgtggcccgaacccttcaaggcattggatcttcattttcatctgttgcaggtcttggaatgctggccagtgtctacactgatgaccatgagagaggacgagccatgggaactgctctggggggcctggccttggggttgctggtgggagctccctttggaagtgtaatgtacgagtttgttgggaagtctgcacccttcctcatcctggccttcctggcactactggatggagcactccagctttgcatcctacagccttccaaagtctctcctgagagtgccaaggggactcccctctttatgcttctcaaagacccttacatcctggtggctgcagggtccatctgctttgccaacatgggggtggccatcctggagcccacactgcccatctggatgatgcagaccatgtgctcccccaagtggcagctgggtctagctttcttgcctgccagtgtgtcctacctcattggcaccaacctctttggtgtgttggccaacaagatgggtcggtggctgtgttccctaatcgggatgctggtagtaggtaccagcttgctctgtgttcctctggctcacaatatttttggtctcattggccccaatgcagggcttggccttgccataggcatggtggattcttctatgatgcccatcatggggcacctggtggatctacgccacacctcggtgtatgggagtgtctacgccatcgctgatgtggctttttgcatgggctttgctataggtccatccaccggtggtgccattgtaaaggccatcggttttccctggctcatggtcatcactggggtcatcaacatcgtctatgctccactctgctactacctgcggagccccccggcaaaggaagagaagcttgctattctgagtcaggactgccccatggagacccggatgtatgcaacccagaagcccacgaaggaatttcctctgggggaggacagtgatgaggagcctgaccatgaggagtagcagcagaaggtgctccttgaattcatgatgcctcagtgaccacctctttccctgggaccagatcaccatggctgagcccacggctcagtgggcttcacatacctctgcctgggaatcttctttcctcccctcccatggacactgtccctgatactcttctcacctgtgtaacttgtagctcttcctctatgccttggtgccgcagtggcccatcttttatgggaagacagagtgatgcaccttcccgctgctgtgaggttgattaaacttgagctgtgacgggttctgcaaggggtgactcattgcatagaggtggtagtgagtaatgtgcccctgaaaccagtggggtgactgacaagcctctttaatctgttgcctgattttctctggcatagtcccaacagatcggaagagtgttaccctcttttcctcaacgtgttctttcccgggttttcccagccgagttgagaaaatgttctcagcattgtcttgctgccaaatgccagcttgaagagttttgttttgttttttttccatttattttttttttttaataaagtgagtgatttttctgtggctaaatctagagctgctaaaagggctttaccctcagtgaaaagtgtcttctattttcattatctttcagaaacaggagcccatttctcttctgctggagttattgacattctcctgacctcccctgtgtgttcctaccttttctgaacctcttagactcttagaaataaaagtagaagaaagacagaaaaaataactgattagacccaagatttcatgggaagaagttaaaagaaactgccttgaaatccctcctgattgtagatttcctaataggaggggtgtaatgtgacattgttcatacttgctaataaatacattattgcctaattc

SEQ ID NO: 85387 - DNA, 2862 bp, Homo sapiens
cacacacacacatacacagaatcctcagataacaggaggcaataaatccaacagcacatccacgttcagagaacagtgtccctgctgtcttgctaacagctgccaatacctcactgagtgcctcacaccaacatgggctccaagatgaaggcatctttctgatcaggggtttgtagctcaaacaaaagaatgagcgtgcttctagaaccacagagcaagggaacatggtagaggataagctggcaagttgaaaagcgtgggatttcatccaagtttgacactaactgtgcaaccccaaacaaatctcctaaccttcagaggctcggatttcttgtctatgagatgaagtgagtttccttcgtctgggcagactccctcccctcttccataaaggctgcaggagacctgtagctgtcacaggaccttccctaagagcccgcaggggaagactgccccagtccggccatcaccatgctccggaccattctggatgctccccagcggttgctgaaggaggggagagcgtcccggcagctggtgctggtggtggtattcgtcgctttgctcctggacaacatgctgtttactgtggtggtgccaattgtgcccaccttcctatatgacatggagttcaaagaagtcaactcttctctgcacctcggccatgccggaagttccccacatgccctcgcctctcctgccttttccaccatcttctccttcttcaacaacaacaccgtggctgttgaagaaagcgtacctagtggaatagcatggatgaatgacactgccagcaccatcccacctccagccactgaagccatctcagctcataaaaacaactgcttgcaaggcacaggtttcttggaggaagagattacccgggtcggggttctgtttgcttcaaaggctgtgatgcaacttctggtcaacccattcgtgggccctctcaccaacaggattggatatcatatccccatgtttgctggctttgttatcatgtttctctccacagttatgtttgctttttctgggacctatactctactctttgtggcccgaacccttcaaggcattggatcttcattttcatctgttgcaggtcttggaatgctggccagtgtctacactgatgaccatgagagaggacgagccatgggaactgctctggggggcctggccttggggttgctggtgggagctccctttggaagtgtaatgtacgagtttgttgggaagtctgcacccttcctcatcctggccttcctggcactactggatggagcactccagctttgcatcctacagccttccaaagtctctcctgagagtgccaaggggactcccctctttatgcttctcaaagacccttacatcctggtggctgcaggtctagctttcttgcctgccagtgtgtcctacctcattggcaccaacctctttggtgtgttggccaacaagatgggtcggtggctgtgttccctaatcgggatgctggtagtaggtaccagcttgctctgtgttcctctggctcacaatatttttggtctcattggccccaatgcagggcttggccttgccataggcatggtggattcttctatgatgcccatcatggggcacctggtggatctacgccacacctcggtgtatgggagtgtctacgccatcgctgatgtggctttttgcatgggctttgctataggtccatccaccggtggtgccattgtaaaggccatcggttttccctggctcatggtcatcactggggtcatcaacatcgtctatgctccactctgctactacctgcggagccccccggcaaaggaagagaagcttgctattctgagtcaggactgccccatggagacccggatgtatgcaacccagaagcccacgaaggaatttcctctgggggaggacagtgatgaggagcctgaccatgaggagtagcagcagaaggtgctccttgaattcatgatgcctcagtgaccacctctttccctgggaccagatcaccatggctgagcccacggctcagtgggcttcacatacctctgcctgggaatcttctttcctcccctcccatggacactgtccctgatactcttctcacctgtgtaacttgtagctcttcctctatgccttggtgccgcagtggcccatcttttatgggaagacagagtgatgcaccttcccgctgctgtgaggttgattaaacttgagctgtgacgggttctgcaaggggtgactcattgcatagaggtggtagtgagtaatgtgcccctgaaaccagtggggtgactgacaagcctctttaatctgttgcctgattttctctggcatagtcccaacagatcggaagagtgttaccctcttttcctcaacgtgttctttcccgggttttcccagccgagttgagaaaatgttctcagcattgtcttgctgccaaatgccagcttgaagagttttgttttgttttttttccatttattttttttttttaataaagtgagtgatttttctgtggctaaatctagagctgctaaaagggctttaccctcagtgaaaagtgtcttctattttcattatctttcagaaacaggagcccatttctcttctgctggagttattgacattctcctgacctcccctgtgtgttcctaccttttctgaacctcttagactcttagaaataaaagtagaagaaagacagaaaaaataactgattagacccaagatttcatgggaagaagttaaaagaaactgccttgaaatccctcctgattgtagatttcctaataggaggggtgtaatgtgacattgttcatacttgctaataaatacattattgcctaattc

SEQ ID NO: 85388 - DNA, 2856 bp, Homo sapiens
cacacacacacatacacagaatcctcagataacaggaggcaataaatccaacagcacatccacgttcagagaacagtgtccctgctgtcttgctaacagctgccaatacctcactgagtgcctcacaccaacatgggctccaagtgagtttccttcgtctgggcagactccctcccctcttccataaaggctgcaggagacctgtagctgtcacaggaccttccctaagagcccgcaggggaagactgccccagtccggccatcaccatgctccggaccattctggatgctccccagcggttgctgaaggaggggagagcgtcccggcagctggtgctggtggtggtattcgtcgctttgctcctggacaacatgctgtttactgtggtggtgccaattgtgcccaccttcctatatgacatggagttcaaagaagtcaactcttctctgcacctcggccatgccggaagttccccacatgccctcgcctctcctgccttttccaccatcttctccttcttcaacaacaacaccgtggctgttgaagaaagcgtacctagtggaatagcatggatgaatgacactgccagcaccatcccacctccagccactgaagccatctcagctcataaaaacaactgcttgcaaggcacaggtttcttggaggaagagattacccgggtcggggttctgtttgcttcaaaggctgtgatgcaacttctggtcaacccattcgtgggccctctcaccaacaggattggatatcatatccccatgtttgctggctttgttatcatgtttctctccacagttatgtttgctttttctgggacctatactctactctttgtggcccgaacccttcaaggcattggatcttcattttcatctgttgcaggtcttggaatgctggccagtgtctacactgatgaccatgagagaggacgagccatgggaactgctctggggggcctggccttggggttgctggtgggagctccctttggaagtgtaatgtacgagtttgttgggaagtctgcacccttcctcatcctggccttcctggcactactggatggagcactccagctttgcatcctacagccttccaaagtctctcctgagagtgccaaggggactcccctctttatgcttctcaaagacccttacatcctggtggctgcagggtccatctgctttgccaacatgggggtggccatcctggagcccacactgcccatctggatgatgcagaccatgtgctcccccaagtggcagctgggtctagctttcttgcctgccagtgtgtcctacctcattggcaccaacctctttggtgtgttggccaacaagatgggtcggtggctgtgttccctaatcgggatgctggtagtaggtaccagcttgctctgtctaccaagttagaagtctaaatgaaacctttcagtgatgtccataatggaaaacagaggcaactttattccatgaagaatgagaccaggagtgtatgtttaggttcctctggctcacaatatttttggtctcattggccccaatgcagggcttggccttgccataggcatggtggattcttctatgatgcccatcatggggcacctggtggatctacgccacacctcggtgtatgggagtgtctacgccatcgctgatgtggctttttgcatgggctttgctataggtccatccaccggtggtgccattgtaaaggccatcggttttccctggctcatggtcatcactggggtcatcaacatcgtctatgctccactctgctactacctgcggagccccccggcaaaggaagagaagcttgctattctgagtcaggactgccccatggagacccggatgtatgcaacccagaagcccacgaaggaatttcctctgggggaggacagtgatgaggagcctgaccatgaggagtagcagcagaaggtgctccttgaattcatgatgcctcagtgaccacctctttccctgggaccagatcaccatggctgagcccacggctcagtgggcttcacatacctctgcctgggaatcttctttcctcccctcccatggacactgtccctgatactcttctcacctgtgtaacttgtagctcttcctctatgccttggtgccgcagtggcccatcttttatgggaagacagagtgatgcaccttcccgctgctgtgaggttgattaaacttgagctgtgacgggttctgcaaggggtgactcattgcatagaggtggtagtgagtaatgtgcccctgaaaccagtggggtgactgacaagcctctttaatctgttgcctgattttctctggcatagtcccaacagatcggaagagtgttaccctcttttcctcaacgtgttctttcccgggttttcccagccgagttgagaaaatgttctcagcattgtcttgctgccaaatgccagcttgaagagttttgttttgttttttttccatttattttttttttttaataaagtgagtgatttttctgtggctaaatctagagctgctaaaagggctttaccctcagtgaaaagtgtcttctattttcattatctttcagaaacaggagcccatttctcttctgctggagttattgacattctcctgacctcccctgtgtgttcctaccttttctgaacctcttagactcttagaaataaaagtagaagaaagacagaaaaaataactgattagacccaagatttcatgggaagaagttaaaagaaactgccttgaaatccctcctgattgtagatttcctaataggaggggtgtaatgtgacattgttcatacttgctaataaatacattattgcctaattc

SEQ ID NO: 85389 - DNA, 5639 bp, Homo sapiens
caacaggcacctggctgcagccaggaaggaccgcacgccctttcgcgcaggagagtggaaggagggagctgtttgccagcaccgaggtcttgcggcacaggcaacgcttgacctgagtcttgcagaatgagtaagagtttgggcacgcgatttgtatttattttactgtgaatctctggccttatatcagaaaaaaaaaaattgtgccaccctcggcacagagaacgttggtggcgtcgtaagcgcccttaagcttctttccatcgccaaggagtaggggtcagggaagaggacagcgggaacaggatttgagagccgggaacccctggctcggcacgggagagggcaggagaggacctaagcgcggggctcgccgtctgctggggacccgagcccgcctgtggccctcggggaacagaagacgcgccctcagcgaccctgaagagtcagctaagctctctgcgggctaaggagacggtgaaggaaccgggactaactggggtaggggttagaaggcagcccgcgagtgggctacgaggggagctgggctcggcagttggggaacccgagggggcaagcgggcggggagcaggagaggggcggagctccggggccggggccggggccgcagcggccgcccagagggtctgcgggggctgctgtggccggacccgaaggcgggcgccgggagcgcagcgagccagacgcgcctctccaagaccgtgaccttggcatagggagcggggctgcgcgcagtcctgagatcagaccagagctcatcctcgtggagacccacggccgaggggcggagctgcctctgtgcgagggagccctggccgcggcgcagaaggcatcacaggaggcctctgcatgatgtggcttccaaagactcaaggaccacccacattacaagtctggattgaggaaggcagaaatggagattcaaacaccacgtcttctattattttattaatcaatctgtagacatgtgtccccactgcagggagtgaactgctccaagggagaaacttctgggagcctccaaactcctagctgtctcatcccttgccctggagagacggcagaaccatggcattttatagctgctgctgggtcctcttggcactcacctggcacacctctgcctacgggccagaccagcgagcccaaaagaagggggacattatccttggggggctctttcctattcattttggagtagcagctaaagatcaagatctcaaatcaaggccggagtctgtggaatgtatcaggtataatttccgtgggtttcgctggttacaggctatgatatttgccatagaggagataaacagcagcccagcccttcttcccaacttgacgctgggatacaggatatttgacacttgcaacaccgtttctaaggccttggaagccaccctgagttttgttgctcaaaacaaaattgattctttgaaccttgatgagttctgcaactgctcagagcacattccctctacgattgctgtggtgggagcaactggctcaggcgtctccacggcagtggcaaatctgctggggctcttctacattccccaggtcagttatgcctcctccagcagactcctcagcaacaagaatcaattcaagtctttcctccgaaccatccccaatgatgagcaccaggccactgccatggcagacatcatcgagtatttccgctggaactgggtgggcacaattgcagctgatgacgactatgggcggccggggattgagaaattccgagaggaagctgaggaaagggatatctgcatcgacttcagtgaactcatctcccagtactctgatgaggaagagatccagcatgtggtagaggtgattcaaaattccacggccaaagtcatcgtggttttctccagtggcccagatcttgagcccctcatcaaggagattgtccggcgcaatatcacgggcaagatctggctggccagcgaggcctgggccagctcctccctgatcgccatgcctcagtacttccacgtggttggcggcaccattggattcgctctgaaggctgggcagatcccaggcttccgggaattcctgaagaaggtccatcccaggaagtctgtccacaatggttttgccaaggagttttgggaagaaacatttaactgccacctccaagaaggtgcaaaaggacctttacctgtggacacctttctgagaggtcacgaagaaagtggcgacaggtttagcaacagctcgacagccttccgacccctctgtacaggggatgagaacatcagcagtgtcgagaccccttacatagattacacgcatttacggatatcctacaatgtgtacttagcagtctactccattgcccacgccttgcaagatatatatacctgcttacctgggagagggctcttcaccaatggctcctgtgcagacatcaagaaagttgaggcgtggcaggtcctgaagcacctacggcatctaaactttacaaacaatatgggggagcaggtgacctttgatgagtgtggtgacctggtggggaactattccatcatcaactggcacctctccccagaggatggctccatcgtgtttaaggaagtcgggtattacaacgtctatgccaagaagggagaaagactcttcatcaacgaggagaaaatcctgtggagtgggttctccagggaggtgcccttctccaactgcagccgagactgcctggcagggaccaggaaagggatcattgagggggagcccacctgctgctttgagtgtgtggagtgtcctgatggggagtatagtgatgagacagatgccagtgcctgtaacaagtgcccagatgacttctggtccaatgagaaccacacctcctgcattgccaaggagatcgagtttctgtcgtggacggagccctttgggatcgcactcaccctctttgccgtgctgggcattttcctgacagcctttgtgctgggtgtgtttatcaagttccgcaacacacccattgtcaaggccaccaaccgagagctctcctacctcctcctcttctccctgctctgctgcttctccagctccctgttcttcatcggggagccccaggactggacgtgccgcctgcgccagccggcctttggcatcagcttcgtgctctgcatctcatgcatcctggtgaaaaccaaccgtgtcctcctggtgtttgaggccaagatccccaccagcttccaccgcaagtggtgggggctcaacctgcagttcctgctggttttcctctgcaccttcatgcagattgtcatctgtgtgatctggctctacaccgcgcccccctcaagctaccgcaaccaggagctggaggatgagatcatcttcatcacgtgccacgagggctccctcatggccctgggcttcctgatcggctacacctgcctgctggctgccatctgcttcttctttgccttcaagtcccggaagctgccggagaacttcaatgaagccaagttcatcaccttcagcatgctcatcttcttcatcgtctggatctccttcattccagcctatgccagcacctatggcaagtttgtctctgccgtagaggtgattgccatcctggcagccagctttggcttgctggcgtgcatcttcttcaacaagatctacatcattctcttcaagccatcccgcaacaccatcgaggaggtgcgttgcagcaccgcagctcacgctttcaaggtggctgcccgggccacgctgcgccgcagcaacgtctcccgcaagcggtccagcagccttggaggctccacgggatccaccccctcctcctccatcagcagcaagagcaacagcgaagacccattcccacagcccgagaggcagaagcagcagcagccgctggccctaacccagcaagagcagcagcagcagcccctgaccctcccacagcagcaacgatctcagcagcagcccagatgcaagcagaaggtcatctttggcagcggcacggtcaccttctcactgagctttgatgagcctcagaagaacgccatggcccacaggaattctacgcaccagaactccctggaggcccagaaaagcagcgatacgctgacccgacaccagccattactcccgctgcagtgcggggaaacggacttagatctgaccgtccaggaaacaggtctgcaaggacctgtgggtggagaccagcggccagaggtggaggaccctgaagagttgtccccagcacttgtagtgtccagttcacagagctttgtcatcagtggtggaggcagcactgttacagaaaacgtagtgaattcataaaatggaaggagaagactgggctagggagaatgcagagaggtttcttggggtcccagggatgaggaatcgccccagactcctttcctctgaggaagaagggataatagacacatcaaatgccccgaatttagtcacaccatcttaaatgacagtgaattgacccatgttccctttaaaattaaaaaaaagaagagccttgtgtttctgtggttgcatttgtcaaagcattgagatctccacggtcagatttgctgttcacccacatctaatgtctcttcctctgttctatcccacccaacagctcagagatgaaactatggctttaaactaccctccagagtgtgcagactgatgggacatcaaatttgccaccactagagctgagagtctgaaagacagaatgtcaccagtcctgcccaatgccttgacaacagactgaattttaaatgttcacaacataaggagaatgtatctcctcctatttatgaaaaccatatgatattttgtctcctacctgctgctgctattatgtaacatccagaaggtttgcacccctcctataccatatgtctggttctgtccaggacatgatactgatgccatgtttagattccaggatcacaagaatcacctcaaattgttaggaagggactgcataaaccaatgagctgtatctgtaattaatattcctatatgtagctttatccttaggaaaatgcttctgttgtaatagtccatggacaatataaactgaaaaatgtcagtctggtttatataaggcagtattattgagctctatttccccaccccactatcctcactcccataagctaagccttatgtgagccccttcagggactcaagggtccagaagtccctcccatctctaccccaaagaattcctgaagccagatccaccctatccctgtacagagtaagttctcaattattggcctgctaatagctgctagggtaggaaagcgtggttccaagaaagatccaccctcaaatgtcagagctatgttccctccagcagtggtattaatactgccggtcacccaggctctggagccagagagacagaccggggttcaagccatggcttcgtcatttgcaagctgagtgactgtaggcagggaaccttaacctctctaagccacagcttcttcatctttaaaataaggataataatcattccttcccctcagagctcttatgtggattaaacgagataatgtatataaagtactttagcctggtacctagcacacaataagcattcaataaatattagttaatattaaaaaaaaaaa

SEQ ID NO: 85390 - DNA, 4069 bp, Homo sapiens
caacaggcacctggctgcagccaggaaggaccgcacgccctttcgcgcaggagagtggaaggagggagctgtttgccagcaccgaggtcttgcggcacaggcaacgcttgacctgagtcttgcagaatgagtaagagtttgggcacgcgatttgtatttattttactgtgaatctctggccttatatcagaaaaaaaaaaattgtgccaccctcggcacagagaacgttggtggcgtcgtaagcgcccttaagcttctttccatcgccaaggagtaggggtcagggaagaggacagcgggaacaggatttgagagccgggaacccctggctcggcacgggagagggcaggagaggacctaagcgcggggctcgccgtctgctggggacccgagcccgcctgtggccctcggggaacagaagacgcgccctcagcgaccctgaagagtcagctaagctctctgcgggctaaggagacggtgaaggaaccgggactaactggggtaggggttagaaggcagcccgcgagtgggctacgaggggagctgggctcggcagttggggaacccgagggggcaagcgggcggggagcaggagaggggcggagctccggggccggggccggggccgcagcggccgcccagagggtctgcgggggctgctgtggccggacccgaaggcgggcgccgggagcgcagcgagccagacgcgcctctccaagaccgtgaccttggcatagggagcggggctgcgcgcagtcctgagatcagaccagagctcatcctcgtggagacccacggccgaggggcggagctgcctctgtgcgagggagccctggccgcggcgcagaaggcatcacaggaggcctctgcatgatgtggcttccaaagactcaaggaccacccacattacaagtctggattgaggaaggcagaaatggagattcaaacaccacgtcttctattattttattaatcaatctgtagacatgtgtccccactgcagggagtgaactgctccaagggagaaacttctgggagcctccaaactcctagctgtctcatcccttgccctggagagacggcagaaccatggcattttatagctgctgctgggtcctcttggcactcacctggcacacctctgcctacgggccagaccagcgagcccaaaagaagggggacattatccttggggggctctttcctattcattttggagtagcagctaaagatcaagatctcaaatcaaggccggagtctgtggaatgtatcaggtataatttccgtgggtttcgctggttacaggctatgatatttgccatagaggagataaacagcagcccagcccttcttcccaacttgacgctgggatacaggatatttgacacttgcaacaccgtttctaaggccttggaagccaccctgagttttgttgctcaaaacaaaattgattctttgaaccttgatgagttctgcaactgctcagagcacattccctctacgattgctgtggtgggagcaactggctcaggcgtctccacggcagtggcaaatctgctggggctcttctacattccccaggtcagttatgcctcctccagcagactcctcagcaacaagaatcaattcaagtctttcctccgaaccatccccaatgatgagcaccaggccactgccatggcagacatcatcgagtatttccgctggaactgggtgggcacaattgcagctgatgacgactatgggcggccggggattgagaaattccgagaggaagctgaggaaagggatatctgcatcgacttcagtgaactcatctcccagtactctgatgaggaagagatccagcatgtggtagaggtgattcaaaattccacggccaaagtcatcgtggttttctccagtggcccagatcttgagcccctcatcaaggagattgtccggcgcaatatcacgggcaagatctggctggccagcgaggcctgggccagctcctccctgatcgccatgcctcagtacttccacgtggttggcggcaccattggattcgctctgaaggctgggcagatcccaggcttccgggaattcctgaagaaggtccatcccaggaagtctgtccacaatggttttgccaaggagttttgggaagaaacatttaactgccacctccaagaaggtgcaaaaggacctttacctgtggacacctttctgagaggtcacgaagaaagtggcgacaggtttagcaacagctcgacagccttccgacccctctgtacaggggatgagaacatcagcagtgtcgagaccccttacatagattacacgcatttacggatatcctacaatgtgtacttagcagtctgaccctcccacagcagcaacgatctcagcagcagcccagatgcaagcagaaggtcatctttggcagcggcacggtcaccttctcactgagctttgatgagcctcagaagaacgccatggcccacaggaattctacgcaccagaactccctggaggcccagaaaagcagcgatacgctgacccgacaccagccattactcccgctgcagtgcggggaaacggacttagatctgaccgtccaggaaacaggtctgcaaggacctgtgggtggagaccagcggccagaggtggaggaccctgaagagttgtccccagcacttgtagtgtccagttcacagagctttgtcatcagtggtggaggcagcactgttacagaaaacgtagtgaattcataaaatggaaggagaagactgggctagggagaatgcagagaggtttcttggggtcccagggatgaggaatcgccccagactcctttcctctgaggaagaagggataatagacacatcaaatgccccgaatttagtcacaccatcttaaatgacagtgaattgacccatgttccctttaaaattaaaaaaaagaagagccttgtgtttctgtggttgcatttgtcaaagcattgagatctccacggtcagatttgctgttcacccacatctaatgtctcttcctctgttctatcccacccaacagctcagagatgaaactatggctttaaactaccctccagagtgtgcagactgatgggacatcaaatttgccaccactagagctgagagtctgaaagacagaatgtcaccagtcctgcccaatgccttgacaacagactgaattttaaatgttcacaacataaggagaatgtatctcctcctatttatgaaaaccatatgatattttgtctcctacctgctgctgctattatgtaacatccagaaggtttgcacccctcctataccatatgtctggttctgtccaggacatgatactgatgccatgtttagattccaggatcacaagaatcacctcaaattgttaggaagggactgcataaaccaatgagctgtatctgtaattaatattcctatatgtagctttatccttaggaaaatgcttctgttgtaatagtccatggacaatataaactgaaaaatgtcagtctggtttatataaggcagtattattgagctctatttccccaccccactatcctcactcccataagctaagccttatgtgagccccttcagggactcaagggtccagaagtccctcccatctctaccccaaagaattcctgaagccagatccaccctatccctgtacagagtaagttctcaattattggcctgctaatagctgctagggtaggaaagcgtggttccaagaaagatccaccctcaaatgtcagagctatgttccctccagcagtggtattaatactgccggtcacccaggctctggagccagagagacagaccggggttcaagccatggcttcgtcatttgcaagctgagtgactgtaggcagggaaccttaacctctctaagccacagcttcttcatctttaaaataaggataataatcattccttcccctcagagctcttatgtggattaaacgagataatgtatataaagtactttagcctggtacctagcacacaataagcattcaataaatattagttaatattaaaaaaaaaaa

SEQ ID NO: 85391 - DNA, 1833 bp, Homo sapiens
caacaggcacctggctgcagccaggaaggaccgcacgccctttcgcgcaggagagtggaaggagggagctgtttgccagcaccgaggtcttgcggcacaggcaacgcttgacctgagtcttgcagaatgagtaagagtttgggcacgcgatttgtatttattttactgtgaatctctggccttatatcagaaaaaaaaaaattgtgccaccctcggcacagagaacgttggtggcgtcgtaagcgcccttaagcttctttccatcgccaaggagtaggggtcagggaagaggacagcgggaacaggatttgagagccgggaacccctggctcggcacgggagagggcaggagaggacctaagcgcggggctcgccgtctgctggggacccgagcccgcctgtggccctcggggaacagaagacgcgccctcagcgaccctgaagagtcagctaagctctctgcgggctaaggagacggtgaaggaaccgggactaactggggtaggggttagaaggcagcccgcgagtgggctacgaggggagctgggctcggcagttggggaacccgagggggcaagcgggcggggagcaggagaggggcggagctccggggccggggccggggccgcagcggccgcccagagggtctgcgggggctgctgtggccggacccgaaggcgggcgccgggagcgcagcgagccagacgcgcctctccaagaccgtgaccttggcatagggagcggggctgcgcgcagtcctgagatcagaccagagctcatcctcgtggagacccacggccgaggggcggagctgcctctgtgcgagggagccctggccgcggcgcagaaggcatcacaggaggcctctgcatgatgtggcttccaaagactcaaggaccacccacattacaagtctggattgaggaaggcagaaatggagattcaaacaccacgtcttctattattttattaatcaatctgtagacatgtgtccccactgcagggagtgaactgctccaagggagaaacttctgggagcctccaaactcctagctgtctcatcccttgccctggagagacggcagaaccatggcattttatagctgctgctgggtcctcttggcactcacctggcacacctctgcctacgggccagaccagcgagcccaaaagaagggggacattatccttggggggctctttcctattcattttggagtagcagctaaagatcaagatctcaaatcaaggccggagtctgtggaatgtatcaggtataatttccgtgggtttcgctggttacaggctatgatatttgccatagaggagataaacagcagcccagcccttcttcccaacttgacgctgggatacaggatatttgacacttgcaacaccgtttctaaggccttggaagccaccctgagttttgttgctcaaaacaaaattgattctttgaaccttgatgagttctgcaactgctcagagcacattccctctacgattgctgtggtgggagcaactggctcaggcgtctccacggcagtggcaaatctgctggggctcttctacattccccaggtactcaagccttctcagacggggcactgggagcaggatcagaagaagcaggcttgggggtgccatgcccaatagccatacggtttaccatattcccatctctggcacaaaagacctatgatttagttgatatgctgtatcatgaccatttgggatttctgaaactccagtgtccacaatatcaatgataccttcactatgcttccaaaattcttttaaatgtaccttgcataaaactgtgtctttttttaa

SEQ ID NO: 85392 - DNA, 693 bp, Homo sapiens
caacaggcacctggctgcagccaggaaggaccgcacgccctttcgcgcaggagagtggaaggagggagctgtttgccagcaccgaggtcttgcggcacaggcaacgcttgacctgagtcttgcagaatgagtaagagtttgggcacgcgatttgtatttattttactgtgaatctctggccttatatcagaaaaaaaaaaattgtgccaccctcggcacagagaacgttggtggcgtcgtaagcgcccttaagcttcctcccatctctaccccaaagaattcctgaagccagatccaccctatccctgtacagagtaagttctcaattattggcctgctaatagctgctagggtaggaaagcgtggttccaagaaagatccaccctcaaatgtcagagctatgttccctccagcagtggtattaatactgccggtcacccaggctctggagccagagagacagaccggggttcaagccatggcttcgtcatttgcaagctgagtgactgtaggcagggaaccttaacctctctaagccacagcttcttcatctttaaaataaggataataatcattccttcccctcagagctcttatgtggattaaacgagataatgtatataaagtactttagcctggtacctagcacacaataagcattcaataaatattagttaatattaaaaaaaaaaa

SEQ ID NO: 85393 - DNA, 1107 bp, Homo sapiens
caacaggcacctggctgcagccaggaaggaccgcacgccctttcgcgcaggagagtggaaggagggagctgtttgccagcaccgaggtcttgcggcacaggcaacgcttgacctgagtcttgcagaatgagtaagagtttgggcacgcgatttgtatttattttactgtgaatctctggccttatatcagaaaaaaaaaaattgtgccaccctcggcacagagaacgttggtggcgtcgtaagcgcccttaagcttctttccatcgccaaggagtaggggtcagggaagaggacagcgggaacaggatttgagagccgggaacccctggctcggcacgggagagggcaggagaggacctaagcgcggggctcgccgtctgctggggacccgagcccgcctgtggccctcggggaacagaagacgcgccctcagcgaccctgaagagtcagctaagctctctgcgggctaaggagacggtgaaggaaccgggactaactggggtaggggttagaaggcagcccgcgagtgggctacgaggggagctgggctcggcagttggggaacccgagggggcaagcgggcggggagcaggagaggggcggagctccggggccggggccggggccgcagcggccgcccagagggtctgcgggggctgctgtggccggacccgaaggcgggcgccgggagcgcagcgagccagacgcgcctctccaagaccgtgaccttggcatagggagcggggctgcgcgcagtcctgagatcagaccagagctcatcctcgtggagacccacggccgaggggcggagctgcctctgtgcgagggagccctggccgcggcgcaggtaggaccggggaacccaaggagggcgggaggaaagcgcccctggtgggggaggggccgtggcggggtctgggggccaagggctccgggccgaacgaggggcacacgccggagcagctccagcctgggagcattgggcgtgaacgtgggggaaagtagggaccagattacaggatcaaggctttccccggctcagaactggattgttcagtgcccctagaaggggagcgggtcgcccacgcgaatgaacgggagcgcgca

SEQ ID NO: 85394 - DNA, 4922 bp, Homo sapiens
caacaggcacctggctgcagccaggaaggaccgcacgccctttcgcgcaggagagtggaaggagggagctgtttgccagcaccgaggtcttgcggcacaggcaacgcttgacctgagtcttgcagaatgaaaggcatcacaggaggcctctgcatgatgtggcttccaaagactcaaggaccacccacattacaagtctggattgaggaaggcagaaatggagattcaaacaccacgtcttctattattttattaatcaatctgtagacatgtgtccccactgcagggagtgaactgctccaagggagaaacttctgggagcctccaaactcctagctgtctcatcccttgccctggagagacggcagaaccatggcattttatagctgctgctgggtcctcttggcactcacctggcacacctctgcctacgggccagaccagcgagcccaaaagaagggggacattatccttggggggctctttcctattcattttggagtagcagctaaagatcaagatctcaaatcaaggccggagtctgtggaatgtatcaggtataatttccgtgggtttcgctggttacaggctatgatatttgccatagaggagataaacagcagcccagcccttcttcccaacttgacgctgggatacaggatatttgacacttgcaacaccgtttctaaggccttggaagccaccctgagttttgttgctcaaaacaaaattgattctttgaaccttgatgagttctgcaactgctcagagcacattccctctacgattgctgtggtgggagcaactggctcaggcgtctccacggcagtggcaaatctgctggggctcttctacattccccaggtcagttatgcctcctccagcagactcctcagcaacaagaatcaattcaagtctttcctccgaaccatccccaatgatgagcaccaggccactgccatggcagacatcatcgagtatttccgctggaactgggtgggcacaattgcagctgatgacgactatgggcggccggggattgagaaattccgagaggaagctgaggaaagggatatctgcatcgacttcagtgaactcatctcccagtactctgatgaggaagagatccagcatgtggtagaggtgattcaaaattccacggccaaagtcatcgtggttttctccagtggcccagatcttgagcccctcatcaaggagattgtccggcgcaatatcacgggcaagatctggctggccagcgaggcctgggccagctcctccctgatcgccatgcctcagtacttccacgtggttggcggcaccattggattcgctctgaaggctgggcagatcccaggcttccgggaattcctgaagaaggtccatcccaggaagtctgtccacaatggttttgccaaggagttttgggaagaaacatttaactgccacctccaagaaggtgcaaaaggacctttacctgtggacacctttctgagaggtcacgaagaaagtggcgacaggtttagcaacagctcgacagccttccgacccctctgtacaggggatgagaacatcagcagtgtcgagaccccttacatagattacacgcatttacggatatcctacaatgtgtacttagcagtctactccattgcccacgccttgcaagatatatatacctgcttacctgggagagggctcttcaccaatggctcctgtgcagacatcaagaaagttgaggcgtggcaggtcctgaagcacctacggcatctaaactttacaaacaatatgggggagcaggtgacctttgatgagtgtggtgacctggtggggaactattccatcatcaactggcacctctccccagaggatggctccatcgtgtttaaggaagtcgggtattacaacgtctatgccaagaagggagaaagactcttcatcaacgaggagaaaatcctgtggagtgggttctccagggaggtgcccttctccaactgcagccgagactgcctggcagggaccaggaaagggatcattgagggggagcccacctgctgctttgagtgtgtggagtgtcctgatggggagtatagtgatgagacagatgccagtgcctgtaacaagtgcccagatgacttctggtccaatgagaaccacacctcctgcattgccaaggagatcgagtttctgtcgtggacggagccctttgggatcgcactcaccctctttgccgtgctgggcattttcctgacagcctttgtgctgggtgtgtttatcaagttccgcaacacacccattgtcaaggccaccaaccgagagctctcctacctcctcctcttctccctgctctgctgcttctccagctccctgttcttcatcggggagccccaggactggacgtgccgcctgcgccagccggcctttggcatcagcttcgtgctctgcatctcatgcatcctggtgaaaaccaaccgtgtcctcctggtgtttgaggccaagatccccaccagcttccaccgcaagtggtgggggctcaacctgcagttcctgctggttttcctctgcaccttcatgcagattgtcatctgtgtgatctggctctacaccgcgcccccctcaagctaccgcaaccaggagctggaggatgagatcatcttcatcacgtgccacgagggctccctcatggccctgggcttcctgatcggctacacctgcctgctggctgccatctgcttcttctttgccttcaagtcccggaagctgccggagaacttcaatgaagccaagttcatcaccttcagcatgctcatcttcttcatcgtctggatctccttcattccagcctatgccagcacctatggcaagtttgtctctgccgtagaggtgattgccatcctggcagccagctttggcttgctggcgtgcatcttcttcaacaagatctacatcattctcttcaagccatcccgcaacaccatcgaggaggtgcgttgcagcaccgcagctcacgctttcaaggtggctgcccgggccacgctgcgccgcagcaacgtctcccgcaagcggtccagcagccttggaggctccacgggatccaccccctcctcctccatcagcagcaagagcaacagcgaagacccattcccacagcccgagaggcagaagcagcagcagccgctggccctaacccagcaagagcagcagcagcagcccctgaccctcccacagcagcaacgatctcagcagcagcccagatgcaagcagaaggtcatctttggcagcggcacggtcaccttctcactgagctttgatgagcctcagaagaacgccatggcccacaggaattctacgcaccagaactccctggaggcccagaaaagcagcgatacgctgacccgacaccagccattactcccgctgcagtgcggggaaacggacttagatctgaccgtccaggaaacaggtctgcaaggacctgtgggtggagaccagcggccagaggtggaggaccctgaagagttgtccccagcacttgtagtgtccagttcacagagctttgtcatcagtggtggaggcagcactgttacagaaaacgtagtgaattcataaaatggaaggagaagactgggctagggagaatgcagagaggtttcttggggtcccagggatgaggaatcgccccagactcctttcctctgaggaagaagggataatagacacatcaaatgccccgaatttagtcacaccatcttaaatgacagtgaattgacccatgttccctttaaaattaaaaaaaagaagagccttgtgtttctgtggttgcatttgtcaaagcattgagatctccacggtcagatttgctgttcacccacatctaatgtctcttcctctgttctatcccacccaacagctcagagatgaaactatggctttaaactaccctccagagtgtgcagactgatgggacatcaaatttgccaccactagagctgagagtctgaaagacagaatgtcaccagtcctgcccaatgccttgacaacagactgaattttaaatgttcacaacataaggagaatgtatctcctcctatttatgaaaaccatatgatattttgtctcctacctgctgctgctattatgtaacatccagaaggtttgcacccctcctataccatatgtctggttctgtccaggacatgatactgatgccatgtttagattccaggatcacaagaatcacctcaaattgttaggaagggactgcataaaccaatgagctgtatctgtaattaatattcctatatgtagctttatccttaggaaaatgcttctgttgtaatagtccatggacaatataaactgaaaaatgtcagtctggtttatataaggcagtattattgagctctatttccccaccccactatcctcactcccataagctaagccttatgtgagccccttcagggactcaagggtccagaagtccctcccatctctaccccaaagaattcctgaagccagatccaccctatccctgtacagagtaagttctcaattattggcctgctaatagctgctagggtaggaaagcgtggttccaagaaagatccaccctcaaatgtcagagctatgttccctccagcagtggtattaatactgccggtcacccaggctctggagccagagagacagaccggggttcaagccatggcttcgtcatttgcaagctgagtgactgtaggcagggaaccttaacctctctaagccacagcttcttcatctttaaaataaggataataatcattccttcccctcagagctcttatgtggattaaacgagataatgtatataaagtactttagcctggtacctagcacacaataagcattcaataaatattagttaatattaaaaaaaaaaa

SEQ ID NO: 85395 - DNA, 5669 bp, Homo sapiens
caacaggcacctggctgcagccaggaaggaccgcacgccctttcgcgcaggagagtggaaggagggagctgtttgccagcaccgaggtcttgcggcacaggcaacgcttgacctgagtcttgcagaatgagtaagagtttgggcacgcgatttgtatttattttactgtgaatctctggccttatatcagaaaaaaaaaaattgtgccaccctcggcacagagaacgttggtggcgtcgtaagcgcccttaagcttctttccatcgccaaggagtaggggtcagggaagaggacagcgggaacaggatttgagagccgggaacccctggctcggcacgggagagggcaggagaggacctaagcgcggggctcgccgtctgctggggacccgagcccgcctgtggccctcggggaacagaagacgcgccctcagcgaccctgaagagtcagctaagctctctgcgggctaaggagacggtgaaggaaccgggactaactggggtaggggttagaaggcagcccgcgagtgggctacgaggggagctgggctcggcagttggggaacccgagggggcaagcgggcggggagcaggagaggggcggagctccggggccggggccggggccgcagcggccgcccagagggtctgcgggggctgctgtggccggacccgaaggcgggcgccgggagcgcagcgagccagacgcgcctctccaagaccgtgaccttggcatagggagcggggctgcgcgcagtcctgagatcagaccagagctcatcctcgtggagacccacggccgaggggcggagctgcctctgtgcgagggagccctggccgcggcgcagaaggcatcacaggaggcctctgcatgatgtggcttccaaagactcaaggaccacccacattacaagtctggattgaggaaggcagaaatggagattcaaacaccacgtcttctattattttattaatcaatctgtagacatgtgtccccactgcagggagtgaactgctccaagggagaaacttctgggagcctccaaactcctagctgtctcatcccttgccctggagagacggcagaaccatggcattttatagctgctgctgggtcctcttggcactcacctggcacacctctgcctacgggccagaccagcgagcccaaaagaagggggacattatccttggggggctctttcctattcattttggagtagcagctaaagatcaagatctcaaatcaaggccggagtctgtggaatgtatcaggtataatttccgtgggtttcgctggttacaggctatgatatttgccatagaggagataaacagcagcccagcccttcttcccaacttgacgctgggatacaggatatttgacacttgcaacaccgtttctaaggccttggaagccaccctgagttttgttgctcaaaacaaaattgattctttgaaccttgatgagttctgcaactgctcagagcacattccctctacgattgctgtggtgggagcaactggctcaggcgtctccacggcagtggcaaatctgctggggctcttctacattccccaggtcagttatgcctcctccagcagactcctcagcaacaagaatcaattcaagtctttcctccgaaccatccccaatgatgagcaccaggccactgccatggcagacatcatcgagtatttccgctggaactgggtgggcacaattgcagctgatgacgactatgggcggccggggattgagaaattccgagaggaagctgaggaaagggatatctgcatcgacttcagtgaactcatctcccagtactctgatgaggaagagatccagcatgtggtagaggtgattcaaaattccacggccaaagtcatcgtggttttctccagtggcccagatcttgagcccctcatcaaggagattgtccggcgcaatatcacgggcaagatctggctggccagcgaggcctgggccagctcctccctgatcgccatgcctcagtacttccacgtggttggcggcaccattggattcgctctgaaggctgggcagatcccaggcttccgggaattcctgaagaaggtccatcccaggaagtctgtccacaatggttttgccaaggagttttgggaagaaacatttaactgccacctccaagaaggtgcaaaaggacctttacctgtggacacctttctgagaggtcacgaagaaagtggcgacaggtttagcaacagctcgacagccttccgacccctctgtacaggggatgagaacatcagcagtgtcgagaccccttacatagattacacgcatttacggatatcctacaatgtgtacttagcagtctactccattgcccacgccttgcaagatatatatacctgcttacctgggagagggctcttcaccaatggctcctgtgcagacatcaagaaagttgaggcgtggcaggtcctgaagcacctacggcatctaaactttacaaacaatatgggggagcaggtgacctttgatgagtgtggtgacctggtggggaactattccatcatcaactggcacctctccccagaggatggctccatcgtgtttaaggaagtcgggtattacaacgtctatgccaagaagggagaaagactcttcatcaacgaggagaaaatcctgtggagtgggttctccagggagccactcacctttgtgctgtctgtcctccaggtgcccttctccaactgcagccgagactgcctggcagggaccaggaaagggatcattgagggggagcccacctgctgctttgagtgtgtggagtgtcctgatggggagtatagtgatgagacagatgccagtgcctgtaacaagtgcccagatgacttctggtccaatgagaaccacacctcctgcattgccaaggagatcgagtttctgtcgtggacggagccctttgggatcgcactcaccctctttgccgtgctgggcattttcctgacagcctttgtgctgggtgtgtttatcaagttccgcaacacacccattgtcaaggccaccaaccgagagctctcctacctcctcctcttctccctgctctgctgcttctccagctccctgttcttcatcggggagccccaggactggacgtgccgcctgcgccagccggcctttggcatcagcttcgtgctctgcatctcatgcatcctggtgaaaaccaaccgtgtcctcctggtgtttgaggccaagatccccaccagcttccaccgcaagtggtgggggctcaacctgcagttcctgctggttttcctctgcaccttcatgcagattgtcatctgtgtgatctggctctacaccgcgcccccctcaagctaccgcaaccaggagctggaggatgagatcatcttcatcacgtgccacgagggctccctcatggccctgggcttcctgatcggctacacctgcctgctggctgccatctgcttcttctttgccttcaagtcccggaagctgccggagaacttcaatgaagccaagttcatcaccttcagcatgctcatcttcttcatcgtctggatctccttcattccagcctatgccagcacctatggcaagtttgtctctgccgtagaggtgattgccatcctggcagccagctttggcttgctggcgtgcatcttcttcaacaagatctacatcattctcttcaagccatcccgcaacaccatcgaggaggtgcgttgcagcaccgcagctcacgctttcaaggtggctgcccgggccacgctgcgccgcagcaacgtctcccgcaagcggtccagcagccttggaggctccacgggatccaccccctcctcctccatcagcagcaagagcaacagcgaagacccattcccacagcccgagaggcagaagcagcagcagccgctggccctaacccagcaagagcagcagcagcagcccctgaccctcccacagcagcaacgatctcagcagcagcccagatgcaagcagaaggtcatctttggcagcggcacggtcaccttctcactgagctttgatgagcctcagaagaacgccatggcccacaggaattctacgcaccagaactccctggaggcccagaaaagcagcgatacgctgacccgacaccagccattactcccgctgcagtgcggggaaacggacttagatctgaccgtccaggaaacaggtctgcaaggacctgtgggtggagaccagcggccagaggtggaggaccctgaagagttgtccccagcacttgtagtgtccagttcacagagctttgtcatcagtggtggaggcagcactgttacagaaaacgtagtgaattcataaaatggaaggagaagactgggctagggagaatgcagagaggtttcttggggtcccagggatgaggaatcgccccagactcctttcctctgaggaagaagggataatagacacatcaaatgccccgaatttagtcacaccatcttaaatgacagtgaattgacccatgttccctttaaaattaaaaaaaagaagagccttgtgtttctgtggttgcatttgtcaaagcattgagatctccacggtcagatttgctgttcacccacatctaatgtctcttcctctgttctatcccacccaacagctcagagatgaaactatggctttaaactaccctccagagtgtgcagactgatgggacatcaaatttgccaccactagagctgagagtctgaaagacagaatgtcaccagtcctgcccaatgccttgacaacagactgaattttaaatgttcacaacataaggagaatgtatctcctcctatttatgaaaaccatatgatattttgtctcctacctgctgctgctattatgtaacatccagaaggtttgcacccctcctataccatatgtctggttctgtccaggacatgatactgatgccatgtttagattccaggatcacaagaatcacctcaaattgttaggaagggactgcataaaccaatgagctgtatctgtaattaatattcctatatgtagctttatccttaggaaaatgcttctgttgtaatagtccatggacaatataaactgaaaaatgtcagtctggtttatataaggcagtattattgagctctatttccccaccccactatcctcactcccataagctaagccttatgtgagccccttcagggactcaagggtccagaagtccctcccatctctaccccaaagaattcctgaagccagatccaccctatccctgtacagagtaagttctcaattattggcctgctaatagctgctagggtaggaaagcgtggttccaagaaagatccaccctcaaatgtcagagctatgttccctccagcagtggtattaatactgccggtcacccaggctctggagccagagagacagaccggggttcaagccatggcttcgtcatttgcaagctgagtgactgtaggcagggaaccttaacctctctaagccacagcttcttcatctttaaaataaggataataatcattccttcccctcagagctcttatgtggattaaacgagataatgtatataaagtactttagcctggtacctagcacacaataagcattcaataaatattagttaatattaaaaaaaaaaa

SEQ ID NO: 85396 - DNA, 502 bp, Homo sapiens
cttttattagtaaagataccttcttttacggactccactttatggactcccttaggcccaatgtcgaagcccccatcgctgggtcaatagtacttgccccagtactcttgaaactaggcggctatggtataatatgcctcatcagcgattgctccatcgctgatgaggcataagtggtatcagttttcatttttctaattgtttaaactgtgttttataccagtgtttgcaagtaattgggtgttagcttgagatggttaaaggtggtttggggagggacttcgttgtaatggttttgctgtaaaaaatgtttccaactccgctgaaatgttgctgaaaagcatggtgctggtaacagttcaacaatccgtggctgctcattcttgcctactttactctcccactgaagcaggttagcgttgaaggtggtatggaaaagcctgcatgcctgttcaggggggaagtttattttgagttgtgctgatgacaagaccccacgggt

SEQ ID NO: 85397 - DNA, 264 bp, Homo sapiens
agacaatcaaaggtggttttttttttttaacttttgcttaattcaggtatatattacacattctaagtgtatggtttaatgagtttagcctagtagaaggtacactcctcccctccttcgctcgctcaacctcttttgttcagtatgtgtaacttgaagctaatttgtactactggatatctgactggagccacagatacagaatctgtattgttcttactgaaacacagcatggaattaacattaaacttaaataaaacaaac

SEQ ID NO: 85398 - DNA, 692 bp, Homo sapiens
agaagcacggtgtccatgcagtctggccagcaggttgtcgatacgagcatacttggtggcatgctcaatcacatactgtatctggcatagatgtgaagcttacatcttcagaagtaaaccccctatctgtcgcttctactatatgtcattggctctacaatatcgtcttatcactcatccgtgactcttcaacctacgccatgatacaccggtgcgtgtatcatcacggggcatccatacttatactcgaacttgtcgggcattcgttcttactgatctccgtcttttttgtagttacttgctggaaccaccgtagcgaaacctcattccagcagctaacactggcgagtccaaggttttctattataaaattgtaggttctatactagaagggaaaatgtaagattgaaagttggtccttttagaaccataactttgttctatgtaggttttcaacttttatttaagaataattgttcaatgttagaaggatagttaatattggaatgaaaaggtggttgggctattatgaaaatgtattagcttttgcttatttatattcttttgtttttgtgagacctatcccattcccctcccccaaacggcatacatttcacagtgcttagtgttatatatagacattttattttatgattaataaactgtcatgccattccttggaaccacttgct

SEQ ID NO: 85399 - DNA, 377 bp, Homo sapiens
tactactactaaattcgcggccgcgtcgttcaacaatccgtggctgctcattcttgcctactttactctcccactgaagcaggttagcgttgaaggtggtatggaaaagcctgcatgcctgttcaattcttttgtttcttctccttccccctccccctacctccttcccctcactcctcccctccttcgctcgctcaacctcttttgttcagtatgtgtaacttgaagctaatttgtactactggatatctgactggagccacagatacagaatctgtattgttcttactgaaacacagcatggaattaacattaaacttaaataaaacaaacctaaattaaaaatgccaaaaaaaaaagtcgacgcggccgcgaat

SEQ ID NO: 85400 - DNA, 710 bp, Homo sapiens
tttctcaagtgattttagtctcttcaccctgtggtaagaggattgtttcatatacgaatccataggtaggaaatacatgttctccctgcctgttcccctctctccaaaatgtagatacactgggcaaagaaacatagccaaggaatcctttttcccctaatatctgtatgtctttcaagaggatattacttccttctcagagtagaagggaggaggagtagacagattgttgcttagagtgaagtttacacgaagtaagaccaaagtccggctcctgtatcattgttttcctttgtcctgctctgttggtttatttttcttgtaatgttgctttcatatgattgttctccctccctttttccttgcaatatagattcctaaaggaaaacccaactcttcctttcctaaaaactctactttgtaagtcacgttcatggcacagtgaattccgctttcagttttggttcttcactaatcatgcctgcgtatgatcgtcctgttgcttacagactctgcctgttccaccttccagggcgctgacctaagccttttccggcctgctcctcctgcctactgtggttggatgtgatgtatatgacagtgacatttttatgccaaagttacttggaacttctggcacatctcatggttgcttacaagcgagttgtgttctagtgtttgtgttaatgatactttggcagtgatttgct

SEQ ID NO: 85401 - DNA, 375 bp, Homo sapiens
ttcagggaaatatggcgggtgggggcggtggcttttccccggaggccccgtgtggggcggcggccgtggagtctcacaaaggaggacctttgagagcgatgggcttcctcaggcctgaggctcggaatgctggtctgtacttcgtgggggatcttaacctattccaggcgctcggctgaggctgggttttttgagttatgaaggttgaagatcctgttgctttctttttttccgttttaaataaatgggtttatgtagaaatattagtaggtcctctttgttcgttgttcttttgcccctaatgggttctccagtcctttttcagaacttcatcgaatgtccattgtgtctgtccagtcattgtcaggaagttta

SEQ ID NO: 85402 - DNA, 2271 bp, Homo sapiens
tatgcgaaacgagataatggtggaccagtgaataacgtagcaggatgatgtggagctgacagttgaagaaagaaacctcctatctgttgcatatagaatgtgattggagctagaagagcctcctggagaataatcagcagcattgaatagaaagaagaaaacaaggatcgacaagacatcgctctgcatgcttcgggactttcgcgtcagctgtgcgtgatagaggcgccgccatttttgctgcccggacgcggagcgagaggctgagagagtcggagacactatccgcttccatccgtcgcgcagaccctgccggagccgctgccgctatggatgatcgagaggatctggtgtaccaggcgaagctggccgagcaggctgagcgatacgacgaaatggtggagtcaatgaagaaagtagcagggatggatgtggagctgacagttgaagaaagaaacctcctatctgttgcatataagaatgtgattggagctagaagagcctcctggagaataatcagcagcattgaacagaaagaagaaaacaagggaggagaagacaagctaaaaatgattcgggaatatcggcaaatggttgagactgagctaaagttaatctgttgtgacattctggatgtactggacaaacacctcattccagcagctaacactggcgagtccaaggttttctattataaaatgaaaggggactaccacaggtatctggcagaatttgccacaggaaacgacaggaaggaggctgcggagaacagcctagtggcttataaagctgctagtgatattgcaatgacagaacttccaccaacgcatcctattcgcttaggtcttgctctcaatttttccgtattctactacgaaattcttaattcccctgaccgtgcctgcaggttggcaaaagcagcttttgatgatgcaattgcagaactggatacgctgagtgaagaaagctataaggactctacacttatcatgcagttgttacgtgataatctgacactatggacttcagacatgcagggtgacggtgaagagcagaataaagaagcgctgcaggacgtggaagacgaaaatcagtgagacataagccaacaagagaaaccatctctgaccaccccctcctccccatcccaccctttggaaactccccattgtcactgagaaccaccaaatctgacttttacatttggtctcagaatttaggttcctgccctgttggttttttttttttttttttaaacagttttcaaaagttcttaaaggcaagagtgaatttctgtggattttactggtcccagcttttaggttctttaagacactaacaggactacatagaggctttttcagcattactgtgtcgtctccgtgccagatgtggcaagatcaccattagcaaatggaaattacatttgaaagccattagacttataggtgatgcaagcatctaagagagaggttaatcacactatagaggcataagtggtatcagttttcatttttctaattgtttaaactgtgttttataccagtgtttgcaagtaattgggtgttagcttgagatggttaaaggtggtttggggagggacttcgttgtaatggttttgctgtaaaaaatgtttccaactccgctgaaatgttgctgaaaagcatggtgctggtaacagttcaacaatccgtggctgctcattcttgcctactttactctcccactgaagcaggttagcgttgaaggtggtatggaaaagcctgcatgcctgttcaattcttttgtttcttctccttccccctccccctacctccttcccctcactcctcccctccttcgctcgctcaacctcttttgttcagtatgtgtaacttgaagctaatttgtactactggatatctgactggagccacagatacagaatctgtattgttcttactgaaacacagcatggaattaacattaaacttaaataaaacaaacctaaattaaaaatgccaaatatcgcgcctccatcctttatacttctaaaataaaatctctagtccaaacacactgacagtattatgtttgcctgaatgtgaaacattcctccttttttcttccataaataatttgtttgcttcccaaagatgtatgttttggaaaaaaattgcctgtagtctggttgtgaagaacactgagtcagttgatggtgtgtcttgtcctccagaccaggcagcaacatggtatttattttaatcattaaagtacaacatgagtagtaca

SEQ ID NO: 85403 - DNA, 2200 bp, Homo sapiens
tatgcgaaacgagataatggtggaccagtgaataacgtagcaggatgatgtggagctgacagttgaagaaagaaacctcctatctgttgcatatagaatgtgattggagctagaagagcctcctggagaataatcagcagcattgaatagaaagaagaaaacaaggatcgacaagacatcgctctgcatgcttcgggactttcgcgtcagctgtgcgtgatagaggcgccgccatttttgctgcccggacgcggagcgagaggctgagagagtcggagacactatccgcttccatccgtcgcgcagaccctgccggagccgctgccgctatggatgatcgagaggatctggtgtaccaggcgaagctggccgagcaggctgagcgatacgacgaaatggtggagtcaatgaagaaagtagcagggatggatgtggagctgacagttgaagaaagaaacctcctatctgttgcatataagaatgtgattggagctagaagagcctcctggagaataatcagcagcattgaacagaaagaagaaaacaagggaggagaagacaagctaaaaatgattcgggaatatcggcaaatggttgagactgagctaaagttaatctgttgtgacattctggatgtactggacaaacacctcattccagcagctaacactggcgagtccaaggttttctattataaaatgaaaggggactaccacaggtatctggcagaatttgccacaggaaacgacaggaaggaggctgcggagaacagcctagtggcttataaagctgctagtgatattgcaatgacagaacttccaccaacgcatcctattcgcttaggtcttgctctcaatttttccgtattctactacgaaattcttaattcccctgaccgtgcctgcaggttggcaaaagcagcttttgatgatgcaattgcagaactggatacgctgagtgaagaaagctataaggactctacacttatcatgcagttgttacgtgataatctgacactatggacttcagacatgcagggtgacggtgaagagcagaataaagaagcgctgcaggacgtggaagacgaaaatcagtgagacataagccaacaagagaaaccatctctgaccaccccctcctccccatcccaccctttggaaactccccattgtcactgagaaccaccaaatctgacttttacatttggtctcagaatttaggttcctgccctgttggttttttttttttttttttaaacagttttcaaaagttcttaaaggcaagagtgaatttctgtggattttactggtcccagcttttaggttctttaagacactaacaggactacatagaggctttttcagcattactgtgtcgtctccgtgccagatgtggcaagatcaccattagcaaatggaaattacatttgaaagccattagacttataggtgatgcaagcatctaagagagaggttaatcacactatagaggcataagtggtatcagttttcatttttctaattgtttaaactgtgttttataccagtgtttgcaagtaattgggtgttagcttgagatggttaaaggtggtttggggagggacttcgttgtaatggttttgctgtaaaaaatgtttccaactccgctgaaatgttgctgaaaagcatggtgctggtaacagttcaacaatccgtggctgctcattcttgcctactttactctcccactgaagcaggttagcgttgaaggtggtatggaaaagcctgcatgcctgttcaattcttttgtttcttctccttccccctccccctacctccttcccctcactcctcccctccttcgctcgctcaacctcttttgttcagtatgtgtaacttgaagctaatttgtactactggatatctgactggagccacagatacagaatctgtattgttcttactgaaacacagcatggaattaacattaaacttaaataaaacaaacctaaattaaaaatgccaaaaaacacaaataacacacaaaacaaacacgaatcaccaccctctaccgcaaacgtagcctcacaacaacccaaccgacctatcaccgctcccacagccactcacatccccacccaccctaatccacaccactcaactaccgcatacatgtactactgtaagacgtaacacctatccacacaaacttagagaccgga

SEQ ID NO: 85404 - DNA, 2097 bp, Homo sapiens
ggccagggctgggtgaccccggcccccggggagatgttaacggaggataatgcgtcgaaacctccagcggccgttcacggagcgagaggctgagagagtcggagacactatccgcttccatccgtcgcgcagaccctgccggagccgctgccgctatggatgatcgagaggatctggtgtaccaggcgaagctggccgagcaggctgagcgatacgacgaaatggtggagtcaatgaagaaagtagcagggatggatgtggagctgacagttgaagaaagaaacctcctatctgttgcatataagaatgtgattggagctagaagagcctcctggagaataatcagcagcattgaacagaaagaagaaaacaagggaggagaagacaagctaaaaatgattcgggaatatcggcaaatggttgagactgagctaaagttaatctgttgtgacattctggatgtactggacaaacacctcattccagcagctaacactggcgagtccaaggttttctattataaaatgaaaggggactaccacaggtatctggcagaatttgccacaggaaacgacaggaaggaggctgcggagaacagcctagtggcttataaagctgctagtgatattgcaatgacagaacttccaccaacgcatcctattcgcttaggtcttgctctcaatttttccgtattctactacgaaattcttaattcccctgaccgtgcctgcaggttggcaaaagcagcttttgatgatgcaattgcagaactggatacgctgagtgaagaaagctataaggactctacacttatcatgcagttgttacgtgataatctgacactatggacttcagacatgcagggtgacggtgaagagcagaataaagaagcgctgcaggacgtggaagacgaaaatcagtgagacataagccaacaagagaaaccatctctgaccaccccctcctccccatcccaccctttggaaactccccattgtcactgagaaccaccaaatctgacttttacatttggtctcagaatttaggttcctgccctgttggttttttttttttttttttaaacagttttcaaaagttcttaaaggcaagagtgaatttctgtggattttactggtcccagcttttaggttctttaagacactaacaggactacatagaggctttttcagcattactgtgtcgtctccgtgccagatgtggcaagatcaccattagcaaatggaaattacatttgaaagccattagacttataggtgatgcaagcatctaagagagaggttaatcacactatagaggcataagtggtatcagttttcatttttctaattgtttaaactgtgttttataccagtgtttgcaagtaattgggtgttagcttgagatggttaaaggtggtttggggagggacttcgttgtaatggttttgctgtaaaaaatgtttccaactccgctgaaatgttgctgaaaagcatggtgctggtaacagttcaacaatccgtggctgctcattcttgcctactttactctcccactgaagcaggttagcgttgaaggtggtatggaaaagcctgcatgcctgttcaattcttttgtttcttctccttccccctccccctacctccttcccctcactcctcccctccttcgctcgctcaacctcttttgttcagtatgtgtaacttgaagctaatttgtactactggatatctgactggagccacagatacagaatctgtattgttcttactgaaacacagcatggaattaacattaaacttaaataaaacaaacctaaattaaaaatgccaaatatcgcgcctccatcctttatacttctaaaataaaatctctagtccaaacacactgacagtattatgtttgcctgaatgtgaaacattcctccttttttcttccataaataatttgtttgcttcccaaagatgtatgttttggaaaaaaattgcctgtagtctggttgtgaagaacactgagtcagttgatggtgtgtcttgtcctccagaccaggcagcaacatggtatttattttaatcattaaagtacaacatgagtagtaca

SEQ ID NO: 85405 - DNA, 2045 bp, Homo sapiens
cggtacccgactgcatcaacgccgcgggagcgagaggctgagagagtcggagacactatccgcttccatccgtcgcgcagaccctgccggagccgctgccgctatggatgatcgagaggatctggtgtaccaggcgaagctggccgagcaggctgagcgatacgacgaaatggtggagtcaatgaagaaagtagcagggatggatgtggagctgacagttgaagaaagaaacctcctatctgttgcatataagaatgtgattggagctagaagagcctcctggagaataatcagcagcattgaacagaaagaagaaaacaagggaggagaagacaagctaaaaatgattcgggaatatcggcaaatggttgagactgagctaaagttaatctgttgtgacattctggatgtactggacaaacacctcattccagcagctaacactggcgagtccaaggttttctattataaaatgaaaggggactaccacaggtatctggcagaatttgccacaggaaacgacaggaaggaggctgcggagaacagcctagtggcttataaagctgctagtgatattgcaatgacagaacttccaccaacgcatcctattcgcttaggtcttgctctcaatttttccgtattctactacgaaattcttaattcccctgaccgtgcctgcaggttggcaaaagcagcttttgatgatgcaattgcagaactggatacgctgagtgaagaaagctataaggactctacacttatcatgcagttgttacgtgataatctgacactatggacttcagacatgcagggtgacggtgaagagcagaataaagaagcgctgcaggacgtggaagacgaaaatcagtgagacataagccaacaagagaaaccatctctgaccaccccctcctccccatcccaccctttggaaactccccattgtcactgagaaccaccaaatctgacttttacatttggtctcagaatttaggttcctgccctgttggttttttttttttttttttaaacagttttcaaaagttcttaaaggcaagagtgaatttctgtggattttactggtcccagcttttaggttctttaagacactaacaggactacatagaggctttttcagcattactgtgtcgtctccgtgccagatgtggcaagatcaccattagcaaatggaaattacatttgaaagccattagacttataggtgatgcaagcatctaagagagaggttaatcacactatagaggcataagtggtatcagttttcatttttctaattgtttaaactgtgttttataccagtgtttgcaagtaattgggtgttagcttgagatggttaaaggtggtttggggagggacttcgttgtaatggttttgctgtaaaaaatgtttccaactccgctgaaatgttgctgaaaagcatggtgctggtaacagttcaacaatccgtggctgctcattcttgcctactttactctcccactgaagcaggttagcgttgaaggtggtatggaaaagcctgcatgcctgttcaattcttttgtttcttctccttccccctccccctacctccttcccctcactcctcccctccttcgctcgctcaacctcttttgttcagtatgtgtaacttgaagctaatttgtactactggatatctgactggagccacagatacagaatctgtattgttcttactgaaacacagcatggaattaacattaaacttaaataaaacaaacctaaattaaaaatgccaaatatcgcgcctccatcctttatacttctaaaataaaatctctagtccaaacacactgacagtattatgtttgcctgaatgtgaaacattcctccttttttcttccataaataatttgtttgcttcccaaagatgtatgttttggaaaaaaattgcctgtagtctggttgtgaagaacactgagtcagttgatggtgtgtcttgtcctccagaccaggcagcaacatggtatttattttaatcattaaagtacaacatgagtagtaca

SEQ ID NO: 85406 - DNA, 2064 bp, Homo sapiens
agcggaggtggaggggtgggctggcgtgatgtccgtcttccgctgggagcgagaggctgagagagtcggagacactatccgcttccatccgtcgcgcagaccctgccggagccgctgccgctatggatgatcgagaggatctggtgtaccaggcgaagctggccgagcaggctgagcgatacgacgaaatggtggagtcaatgaagaaagtagcagggatggatgtggagctgacagttgaagaaagaaacctcctatctgttgcatataagaatgtgattggagctagaagagcctcctggagaataatcagcagcattgaacagaaagaagaaaacaagggaggagaagacaagctaaaaatgattcgggaatatcggcaaatggttgagactgagctaaagttaatctgttgtgacattctggatgtactggacaaacacctcattccagcagctaacactggcgagtccaaggttttctattataaaatgaaaggggactaccacaggtatctggcagaatttgccacaggaaacgacaggaaggaggctgcggagaacagcctagtggcttataaagctgctagtgatattgcaatgacagaacttccaccaacgcatcctattcgcttaggtcttgctctcaatttttccgtattctactacgaaattcttaattcccctgaccgtgcctgcaggttggcaaaagcagcttttgatgatgcaattgcagaactggatacgctgagtgaagaaagctataaggactctacacttatcatgcagttgttacgtgataatctgacactatggacttcagacatgcagggtgacggtgaagagcagaataaagaagcgctgcaggacgtggaagacgaaaatcagtgagacataagccaacaagagaaaccatctctgaccaccccctcctccccatcccaccctttggaaactccccattgtcactgagaaccaccaaatctgacttttacatttggtctcagaatttaggttcctgccctgttggttttttttttttttttttaaacagttttcaaaagttcttaaaggcaagagtgaatttctgtggattttactggtcccagcttttaggttctttaagacactaacaggactacatagaggctttttcagcattactgtgtcgtctccgtgccagatgtggcaagatcaccattagcaaatggaaattacatttgaaagccattagacttataggtgatgcaagcatctaagagagaggttaatcacactatagaggcataagtggtatcagttttcatttttctaattgtttaaactgtgttttataccagtgtttgcaagtaattgggtgttagcttgagatggttaaaggtggtttggggagggacttcgttgtaatggttttgctgtaaaaaatgtttccaactccgctgaaatgttgctgaaaagcatggtgctggtaacagttcaacaatccgtggctgctcattcttgcctactttactctcccactgaagcaggttagcgttgaaggtggtatggaaaagcctgcatgcctgttcaattcttttgtttcttctccttccccctccccctacctccttcccctcactcctcccctccttcgctcgctcaacctcttttgttcagtatgtgtaacttgaagctaatttgtactactggatatctgactggagccacagatacagaatctgtattgttcttactgaaacacagcatggaattaacattaaacttaaataaaacaaacctaaattaaaaatgccaaatatcgcgcctccatcctttatacttctaaaataaaatctctagtccaaacacactgacagtattatgtttgcctgaatgtgaaacattcctccttttttcttccataaataatttgtttgcttcccaaagatgtatgttttggaaaaaaattgcctgtagtctggttgtgaagaacactgagtcagttgatggtgtgtcttgtcctccagaccaggcagcaacatggtatttattttaatcattaaagtacaacatgagtagtaca

SEQ ID NO: 85407 - DNA, 2481 bp, Homo sapiens
  misc_feature (1990)..(1990): n is a, c, g, or t
  misc_feature (2252)..(2252): n is a, c, g, or t
tatgcgaaacgagataatggtggaccagtgaataacgtagcaggatgatgtggagctgacagttgaagaaagaaacctcctatctgttgcatatagaatgtgattggagctagaagagcctcctggagaataatcagcagcattgaatagaaagaagaaaacaaggatcgacaagacatcgctctgcatgcttcgggactttcgcgtcagctgtgcgtgatagaggcgccgccatttttgctgcccggacgcggagcgagaggctgagagagtcggagacactatccgcttccatccgtcgcgcagaccctgccggagccgctgccgctatggatgatcgagaggatctggtgtaccaggcgaagctggccgagcaggctgagcgatacgacgaaatggtggagtcaatgaagaaagtagcagggatggatgtggagctgacagttgaagaaagaaacctcctatctgttgcatataagaatgtgattggagctagaagagcctcctggagaataatcagcagcattgaacagaaagaagaaaacaagggaggagaagacaagctaaaaatgattcgggaatatcggcaaatggttgagactgagctaaagttaatctgttgtgacattctggatgtactggacaaacacctcattccagcagctaacactggcgagtccaaggttttctattataaaatgaaaggggactaccacaggtatctggcagaatttgccacaggaaacgacaggaaggaggctgcggagaacagcctagtggcttataaagctgctagtgatattgcaatgacagaacttccaccaacgcatcctattcgcttaggtcttgctctcaatttttccgtattctactacgaaattcttaattcccctgaccgtgcctgcaggttggcaaaagcagcttttgatgatgcaattgcagaactggatacgctgagtgaagaaagctataaggactctacacttatcatgcagttgttacgtgataatctgacactatggacttcagacatgcagggtgacggtgaagagcagaataaagaagcgctgcaggacgtggaagacgaaaatcagtgagacataagccaacaagagaaaccatctctgaccaccccctcctccccatcccaccctttggaaactccccattgtcactgagaaccaccaaatctgacttttacatttggtctcagaatttaggttcctgccctgttggttttttttttttttttttaaacagttttcaaaagttcttaaaggcaagagtgaatttctgtggattttactggtcccagcttttaggttctttaagacactaacaggactacatagaggctttttcagcattactgtgtcgtctccgtgccagatgtggcaagatcaccattagcaaatggaaattacatttgaaagccattagacttataggtgatgcaagcatctaagagagaggttaatcacactatagaggcataagtggtatcagttttcatttttctaattgtttaaactgtgttttataccagtgtttgcaagtaattgggtgttagcttgagatggttaaaggtggtttggggagggacttcgttgtaatggttttgctgtaaaaaatgtttccaactccgctgaaatgttgctgaaaagcatggtgctggtaacagttcaacaatccgtggctgctcattcttgcctactttactctcccactgaagcaggttagcgttgaaggtggtatggaaaagcctgcatgcctgttcaattcttttgtttcttctccttccccctccccctacctccttcccctcactcctcccctccttcgctcgctcaacctcttttgttcagtatgtgtaacttgaagctaatttgtactactggatatctgactggagccacagatacagaatctgtattgttcttactgaaacacagcatggaattaacattaaacttaaataaaacaaacaaanaaaaaaacaaaaaacaaaaaaaaaatattttgggccgcaccgcgccctgggaagagttttaaacaccattgttttggggccgcgggccccaaaggtaaggtgacacatgtggacataaatgtgtacctaaagaagaacccgggccactacaaaacggtcgtaggcgatcatatccacaaataaaaaaacagggcgggggggagaaaccggcaggtttttgcaaacaactcaccaagtgggggtctcaggaagggcacaaccncggcagtcacacagacaggagattccaaaggagcgtaggaaattaaaaattaccccgacggctcgtgggaagagagaaccagacgaagcaaaaacgaagcacaaccaagcaaacaacaagacgaagcaaagaagagagaagcaaccagagtctagcagccgagaccaaccaagagcaaaaagagaaataaaccagacacagaaaatcacagaacgtatcgtcggtggag

SEQ ID NO: 85408 - DNA, 2030 bp, Homo sapiens
tatgcgaaacgagataatggtggaccagtgaataacgtagcaggatgatgtggagctgacagttgaagaaagaaacctcctatctgttgcatatagaatgtgattggagctagaagagcctcctggagaataatcagcagcattgaatagaaagaagaaaacaaggatcgacaagacatcgctctgcatgcttcgggactttcgcgtcagctgtgcgtgatagaggcgccgccatttttgctgcccggacgcggagcgagaggctgagagagtcggagacactatccgcttccatccgtcgcgcagaccctgccggagccgctgccgctatggatgatcgagaggatctggtgtaccaggcgaagctggccgagcaggctgagcgatacgacgaaatggtggagtcaatgaagaaagtagcagggatggatgtggagctgacagttgaagaaagaaacctcctatctgttgcatataagaatgtgattggagctagaagagcctcctggagaataatcagcagcattgaacagaaagaagaaaacaagggaggagaagacaagctaaaaatgattcgggaatatcggcaaatggttgagactgagctaaagttaatctgttgtgacattctggatgtactggacaaacacctcattccagcagctaacactggcgagtccaaggttttctattataaaatgaaaggggactaccacaggtatctggcagaatttgccacaggaaacgacaggaaggaggctgcggagaacagcctagtggcttataaagctgctagtgatattgcaatgacagaacttccaccaacgcatcctattcgcttaggtcttgctctcaatttttccgtattctactacgaaattcttaattcccctgaccgtgcctgcaggttggcaaaagcagcttttgatgatgcaattgcagaactggatacgctgagtgaagaaagctataaggactctacacttatcatgcagttgttacgtgataatctgacactatggacttcagacatgcagggtgacggtgaagagcagaataaagaagcgctgcaggacgtggaagacgaaaatcagtgagacataagccaacaagagaaaccatctctgaccaccccctcctccccatcccaccctttggaaactccccattgtcactgagaaccaccaaatctgacttttacatttggtctcagaatttaggttcctgccctgttggttttttttttttttttttaaacagttttcaaaagttcttaaaggcaagagtgaatttctgtggattttactggtcccagcttttaggttctttaagacactaacaggactacatagaggctttttcagcattactgtgtcgtctccgtgccagatgtggcaagatcaccattagcaaatggaaattacatttgaaagccattagacttataggtgatgcaagcatctaagagagaggttaatcacactatagaggcataagtggtatcagttttcatttttctaattgtttaaactgtgttttataccagtgtttgcaagtaattgggtgttagcttgagatggttaaaggtggtttggggagggacttcgttgtaatggttttgctgtaaaaaatgtttccaactccgctgaaatgttgctgaaaagcatggtgctggtaacagttcaacaatccgtggctgctcattcttgcctactttactctcccactgaagcaggttagcgttgaaggtggtatggaaaagcctgcatgcctgttcaattcttttgtttcttctccttccccctccccctacctccttcccctcactcctcccctccttcgctcgctcaacctcttttgttcagtatgtgtaacttgaagctaatttgtactactggatatctgactggagccacagatacagaatctgtattgttcttactgaaacacaggtggggagcacacaggtggggatgagcacacaggagcacacaggtggggatgagcacacaggtggggatgagcacaca

SEQ ID NO: 85409 - DNA, 1858 bp, Homo sapiens
tatgcgaaacgagataatggtggaccagtgaataacgtagcaggatgatgtggagctgacagttgaagaaagaaacctcctatctgttgcatatagaatgtgattggagctagaagagcctcctggagaataatcagcagcattgaatagaaagaagaaaacaaggatcgacaagacatcgctctgcatgcttcgggactttcgcgtcagctgtgcgtgatagaggcgccgccatttttgctgcccggacgcggagcgagaggctgagagagtcggagacactatccgcttccatccgtcgcgcagaccctgccggagccgctgccgctatggatgatcgagaggatctggtgtaccaggcgaagctggccgagcaggctgagcgatacgacgaaatggtggagtcaatgaagaaagtagcagggatggatgtggagctgacagttgaagaaagaaacctcctatctgttgcatataagaatgtgattggagctagaagagcctcctggagaataatcagcagcattgaacagaaagaagaaaacaagggaggagaagacaagctaaaaatgattcgggaatatcggcaaatggttgagactgagctaaagttaatctgttgtgacattctggatgtactggacaaacacctcattccagcagctaacactggcgagtccaaggttttctattataaaatgaaaggggactaccacaggtatctggcagaatttgccacaggaaacgacaggaaggaggctgcggagaacagcctagtggcttataaagctgctagtgatattgcaatgacagaacttccaccaacgcatcctattcgcttaggtcttgctctcaatttttccgtattctactacgaaattcttaattcccctgaccgtgcctgcaggttggcaaaagcagcttttgatgatgcaattgcagaactggatacgctgagtgaagaaagctataaggactctacacttatcatgcagttgttacgtgataatctgacactatggacttcagacatgcagggtgacggtgaagagcagaataaagaagcgctgcaggacgtggaagacgaaaatcagtgagacataagccaacaagagaaaccatctctgaccaccccctcctccccatcccaccctttggaaactccccattgtcactgagaaccaccaaatctgacttttacatttggtctcagaatttaggttcctgccctgttggttttttttttttttttttaaacagttttcaaaagttcttaaaggcaagagtgaatttctgtggattttactggtcccagcttttaggttctttaagacactaacaggactacatagaggctttttcagcattactgtgtcgtctccgtgccagatgtggcaagatcaccattagcaaatggaaattacatttgaaagccattagacttataggtgatgcaagcatctaagagagaggttaatcacactatagaggcataagtggtatcagttttcatttttctaattgtttaaactgtgttttataccagtgtttgcaagtaattgggtgttagcttgagatggttaaaggtggtttggggagggacttcgttgtaatggttttgctgtaaaaaatgtttccaactccgctgaaatgttgctgaaaagcatggtgctggtaacagttcaacaatccgtggctgctcattcttgcctactttactctcccactgaagcaggttagcgttgaaggtggtatggaaaagcctgcatgcctgttcaattcttttgtttcttctccttccccctccccctacctccttcccctagcactccagcgtgctgaaacagggatcctcaga

SEQ ID NO: 85410 - DNA, 2314 bp, Homo sapiens
tatgcgaaacgagataatggtggaccagtgaataacgtagcaggatgatgtggagctgacagttgaagaaagaaacctcctatctgttgcatatagaatgtgattggagctagaagagcctcctggagaataatcagcagcattgaatagaaagaagaaaacaaggatcgacaagacatcgctctgcatgcttcgggactttcgcgtcagctgtgcgtgatagaggcgccgccatttttgctgcccggacgcggagcgagaggctgagagagtcggagacactatccgcttccatccgtcgcgcagaccctgccggagccgctgccgctatggatgatcgagaggatctggtgtaccaggcgaagctggccgagcaggctgagcgatacgacgaaatggtggagtcaatgaagaaagtagcagggatggatgtggagctgacagttgaagaaagaaacctcctatctgttgcatataagaatgtgattggagctagaagagcctcctggagaataatcagcagcattgaacagaaagaagaaaacaagggaggagaagacaagctaaaaatgattcgggaatatcggcaaatggttgagactgagctaaagttaatctgttgtgacattctggatgtactggacaaacacctcattccagcagctaacactggcgagtccaaggttttctattataaaatgaaaggggactaccacaggtatctggcagaatttgccacaggaaacgacaggaaggaggctgcggagaacagcctagtggcttataaagctgctagtgatattgcaatgacagaacttccaccaacgcatcctattcgcttaggtcttgctctcaatttttccgtattctactacgaaattcttaattcccctgaccgtgcctgcaggttggcaaaagcagcttttgatgatgcaattgcagaactggatacgctgagtgaagaaagctataaggactctacacttatcatgcagttgttacgtgataatctgacactatggacttcagacatgcagggtgacgattcctaaaggaaaacccaactcttcctttcctaaaaactctagtgaagagcagaataaagaagcgctgcaggacgtggaagacgaaaatcagtgagacataagccaacaagagaaaccatctctgaccaccccctcctccccatcccaccctttggaaactccccattgtcactgagaaccaccaaatctgacttttacatttggtctcagaatttaggttcctgccctgttggttttttttttttttttttaaacagttttcaaaagttcttaaaggcaagagtgaatttctgtggattttactggtcccagcttttaggttctttaagacactaacaggactacatagaggctttttcagcattactgtgtcgtctccgtgccagatgtggcaagatcaccattagcaaatggaaattacatttgaaagccattagacttataggtgatgcaagcatctaagagagaggttaatcacactatagaggcataagtggtatcagttttcatttttctaattgtttaaactgtgttttataccagtgtttgcaagtaattgggtgttagcttgagatggttaaaggtggtttggggagggacttcgttgtaatggttttgctgtaaaaaatgtttccaactccgctgaaatgttgctgaaaagcatggtgctggtaacagttcaacaatccgtggctgctcattcttgcctactttactctcccactgaagcaggttagcgttgaaggtggtatggaaaagcctgcatgcctgttcaattcttttgtttcttctccttccccctccccctacctccttcccctcactcctcccctccttcgctcgctcaacctcttttgttcagtatgtgtaacttgaagctaatttgtactactggatatctgactggagccacagatacagaatctgtattgttcttactgaaacacagcatggaattaacattaaacttaaataaaacaaacctaaattaaaaatgccaaatatcgcgcctccatcctttatacttctaaaataaaatctctagtccaaacacactgacagtattatgtttgcctgaatgtgaaacattcctccttttttcttccataaataatttgtttgcttcccaaagatgtatgttttggaaaaaaattgcctgtagtctggttgtgaagaacactgagtcagttgatggtgtgtcttgtcctccagaccaggcagcaacatggtatttattttaatcattaaagtacaacatgagtagtaca

SEQ ID NO: 85411 - DNA, 2173 bp, Homo sapiens
tatgcgaaacgagataatggtggaccagtgaataacgtagcaggatgatgtggagctgacagttgaagaaagaaacctcctatctgttgcatatagaatgtgattggagctagaagagcctcctggagaataatcagcagcattgaatagaaagaagaaaacaaggatcgacaagacatcgctctgcatgcttcgggactttcgcgtcagctgtgcgtgatagaggcgccgccatttttgctgcccggacgcggagcgagaggctgagagagtcggagacactatccgcttccatccgtcgcgcagaccctgccggagccgctgccgctatggatgatcgagaggatctggtgtaccaggcgaagctggccgagcaggctgagcgatacgacgaaatggtggagtcaatgaagaaagtagcagggatggatgtggagctgacagttgaagaaagaaacctcctatctgttgcatataagaatgtgattggagctagaagagcctcctggagaataatcagcagcattgaacagaaagaagaaaacaagggaggagaagacaagctaaaaatgattcgggaatatcggcaaatggttgagactgagctaaagttaatctgttgtgacattctggatgtactggacaaacacctcattccagcagctaacactggcgagtccaaggttttctattataaaatgaaaggggactaccacaggtatctggcagaatttgccacaggaaacgacaggaaggaggctgcggagaacagcctagtggcttataaagctgctagtgatattgcaatgacagaacttccaccaacgcatcctattcgcttaggtcttgctctcaatttttccgtattctactacgaaattcttaattcccctgaccgtgcctgcaggttggcaaaagcagcttttgatgatgcaattgcagaactggatacgctgagtgaagaaagctataaggactctacacttatcatgcagttgttacgtgataatctgacactatggacttcagacatgcagggtgacggtgaagagcagaataaagaagcgctgcaggacgtggaagacgaaaatcagtgagacataagccaacaagagaaaccatctctgaccaccccctcctccccatcccaccctttggaaactccccattgtcactgagaaccaccaaatctgacttttacatttggtctcagaatttaggttcctgccctgttggttttttttttttttttttaaacagttttcaaaagttcttaaaggcaagagtgaatttctgtggattttactggtcccagcttttaggttctttaagacactaacaggactacatagaggctttttcagcattactgtgtcgtctccgtgccagatgtggcaagatcaccattagcaaatggaaattacatttgaaagccattagacttataggtgatgcaagcatctaagagagaggttaatcacactatagaggcataagtggtatcagttttcatttttctaattgtttaaactgtgttttataccagtgtttgcaagtaattgggtgttagcttgagatggttaaaggtggtttggggagggacttcgttgtaatggttttgctgtaaaaaatgtttccaactccgctgaaatgttgctgaaaagcatggtgctggtaacagttcaacaatccgtggctgctcattcttgcctactttactctcccacactcctcccctccttcgctcgctcaacctcttttgttcagtatgtgtaacttgaagctaatttgtactactggatatctgactggagccacagatacagaatctgtattgttcttactgaaacacagcatggaattaacattaaacttaaataaaacaaacctaaattaaaaatgccaaatatcgcgcctccatcctttatacttctaaaataaaatctctagtccaaacacactgacagtattatgtttgcctgaatgtgaaacattcctccttttttcttccataaataatttgtttgcttcccaaagatgtatgttttggaaaaaaattgcctgtagtctggttgtgaagaacactgagtcagttgatggtgtgtcttgtcctccagaccaggcagcaacatggtatttattttaatcattaaagtacaacatgagtagtaca

SEQ ID NO: 85412 - DNA, 1888 bp, Homo sapiens
tatgcgaaacgagataatggtggaccagtgaataacgtagcaggatgatgtggagctgacagttgaagaaagaaacctcctatctgttgcatatagaatgtgattggagctagaagagcctcctggagaataatcagcagcattgaatagaaagaagaaaacaaggatcgacaagacatcgctctgcatgcttcgggactttcgcgtcagctgtgcgtgatagaggcgccgccatttttgctgcccggacgcggagcgagaggctgagagagtcggagacactatccgcttccatccgtcgcgcagaccctgccggagccgctgccgctatggatgatcgagaggatctggtgtaccaggcgaagctggccgagcaggctgagcgatacgacgaaatggtggagtcaatgaagaaagtagcagggatggatgtggagctgacagttgaagaaagaaacctcctatctgttgcatataagaatgtgattggagctagaagagcctcctggagaataatcagcagcattgaacagaaagaagaaaacaagggaggagaagacaagctaaaaatgattcgggaatatcggcaaatggttgagactgagctaaagttaatctgttgtgacattctggatgtactggacaaacacctcattccagcagctaacactggcgagtccaaggttttctattataaaatgaaaggggactaccacaggtatctggcagaatttgccacaggaaacgacaggaaggaggctgcggagaacagcctagtggcttataaagctgctagtgatattgcaatgacagaacttccaccaacgcatcctattcgcttaggtcttgctctcaatttttccgtattctactacgaaattcttaattcccctgaccgtgcctgcaggttggcaaaagcagcttttgatgatgcaattgcagaactggatacgctgagtgaagaaagctataaggactctacacttatcatgcagttgttacgtgataatctgacactatggacttcagacatgcagggtgacggtgaagagcagaataaagaagcgctgcaggacgtggaagacgaaaatcagtgagacataagccaacaagagaaaccatctctgaccaccccctcctccccatcccaccctttggaaactccccattgtcactgagaaccaccaaatctgacttttacatttggtctcagaatttaggttcctgccctgttggttttttttttttttttttaaacagttttcaaaagttcttaaaggcaagagtgaatttctgtggattttactggtcccagcttttaggttctttaagacactaacaggactacatagaggctttttcagcattactgtgtcgtctccgtgccagatgtggcaagatcaccattagcaaatggaaattacatttgaaagccattagacttataggtgatgcaagcatctaagagagaggttaatcacactatagaggcataagtggtatcagttttcatttttctaattgtttaaactgtgttttataccagtgtttgcaagtaattgggtgttagcttgagatggttaaaggtggtttggggagggacttcgttgtaatggttttgctgtaaaaaatgtttccaactccgctgaaatgttgctgaaaagcatggtgctggtaacagttcaacaatccgtggctgctcattcttgcctactttactctcccacactcctcccctccttcgctcgctcaacctcttttgttcagtatgtgtaacttgaagctaatttgtactactggatatctgactggagccacagatacagaatctgtattgttcttactgaaacacagcatggaattaacattaaacttaaataaaacaaac

SEQ ID NO: 85413 - DNA, 1754 bp, Homo sapiens
tatgcgaaacgagataatggtggaccagtgaataacgtagcaggatgatgtggagctgacagttgaagaaagaaacctcctatctgttgcatatagaatgtgattggagctagaagagcctcctggagaataatcagcagcattgaatagaaagaagaaaacaaggatcgacaagacatcgctctgcatgcttcgggactttcgcgtcagctgtgcgtgatagaggcgccgccatttttgctgcccggacgcggagcgagaggctgagagagtcggagacactatccgcttccatccgtcgcgcagaccctgccggagccgctgccgctatggatgatcgagaggatctggtgtaccaggcgaagctggccgagcaggctgagcgatacgacgaaatggtggagtcaatgaagaaagtagcagggatggatgtggagctgacagttgaagaaagaaacctcctatctgttgcatataagaatgtgattggagctagaagagcctcctggagaataatcagcagcattgaacagaaagaagaaaacaagggaggagaagacaagctaaaaatgattcgggaatatcggcaaatggttgagactgagctaaagttaatctgttgtgacattctggatgtactggacaaacacctcattccagcagctaacactggcgagtccaaggttttctattataaaatgaaaggggactaccacaggtatctggcagaatttgccacaggaaacgacaggaaggaggctgcggagaacagcctagtggcttataaagctgctagtgatattgcaatgacagaacttccaccaacgcatcctattcgcttaggtcttgctctcaatttttccgtattctactacgaaattcttaattcccctgaccgtgcctgcaggttggcaaaagcagcttttgatgatgcaattgcagaactggatacgctgagtgaagaaagctataaggactctacacttatcatgcagttgttacgtgataatctgacactatggacttcagacatgcagggtgacggtgaagagcagaataaagaagcgctgcaggacgtggaagacgaaaatcagtgagacataagccaacaagagaaaccatctctgaccaccccctcctccccatcccaccctttggaaactccccattgtcactgagaaccaccaaatctgacttttacatttggtctcagaatttaggttcctgccctgttggttttttttttttttttttaaacagttttcaaaagttcttaaaggcaagagtgaatttctgtggattttactggtcccagcttttaggttctttaagacactaacaggactacatagaggctttttcagcattactgtgtcgtctccgtgccagatgtggcaagatcaccattagcaaatggaaattacatttgaaagccattagacttataggtgatgcaagcatctaagagagaggttaatcacactatagaggcataagtggtatcagttttcatttttctaattgtttaaactgtgttttataccagtgtttgcaagtaattgggtgttagcttgagatggttaaaggtggtttggggagggacttcgttgtaatggttttgctgtaaaaaatgtttccaactccgctgaaatgttgctgaaaagcatggtgctggtaacagttcaacaatccgtggctgctcattcttgcctactttactctcccatgtcaacgtggggatactctagaggcga

SEQ ID NO: 85414 - DNA, 1995 bp, Homo sapiens
taccattcgagctcgcacccaagcttaatagacctgccggagccgctgccgctatggatgatcgagaggatctggtgtaccaggcgaagctggccgagcaggctgagcgatacgacgaaatggtggagtcaatgaagaaagtagcagggatggatgtggagctgacagttgaagaaagaaacctcctatctgttgcatataagaatgtgattggagctagaagagcctcctggagaataatcagcagcattgaacagaaagaagaaaacaagggaggagaagacaagctaaaaatgattcgggaatatcggcaaatggttgagactgagctaaagttaatctgttgtgacattctggatgtactggacaaacacctcattccagcagctaacactggcgagtccaaggttttctattataaaatgaaaggggactaccacaggtatctggcagaatttgccacaggaaacgacaggaaggaggctgcggagaacagcctagtggcttataaagctgctagtgatattgcaatgacagaacttccaccaacgcatcctattcgcttaggtcttgctctcaatttttccgtattctactacgaaattcttaattcccctgaccgtgcctgcaggttggcaaaagcagcttttgatgatgcaattgcagaactggatacgctgagtgaagaaagctataaggactctacacttatcatgcagttgttacgtgataatctgacactatggacttcagacatgcagggtgacggtgaagagcagaataaagaagcgctgcaggacgtggaagacgaaaatcagtgagacataagccaacaagagaaaccatctctgaccaccccctcctccccatcccaccctttggaaactccccattgtcactgagaaccaccaaatctgacttttacatttggtctcagaatttaggttcctgccctgttggttttttttttttttttttaaacagttttcaaaagttcttaaaggcaagagtgaatttctgtggattttactggtcccagcttttaggttctttaagacactaacaggactacatagaggctttttcagcattactgtgtcgtctccgtgccagatgtggcaagatcaccattagcaaatggaaattacatttgaaagccattagacttataggtgatgcaagcatctaagagagaggttaatcacactatagaggcataagtggtatcagttttcatttttctaattgtttaaactgtgttttataccagtgtttgcaagtaattgggtgttagcttgagatggttaaaggtggtttggggagggacttcgttgtaatggttttgctgtaaaaaatgtttccaactccgctgaaatgttgctgaaaagcatggtgctggtaacagttcaacaatccgtggctgctcattcttgcctactttactctcccactgaagcaggttagcgttgaaggtggtatggaaaagcctgcatgcctgttcaattcttttgtttcttctccttccccctccccctacctccttcccctcactcctcccctccttcgctcgctcaacctcttttgttcagtatgtgtaacttgaagctaatttgtactactggatatctgactggagccacagatacagaatctgtattgttcttactgaaacacagcatggaattaacattaaacttaaataaaacaaacctaaattaaaaatgccaaatatcgcgcctccatcctttatacttctaaaataaaatctctagtccaaacacactgacagtattatgtttgcctgaatgtgaaacattcctccttttttcttccataaataatttgtttgcttcccaaagatgtatgttttggaaaaaaattgcctgtagtctggttgtgaagaacactgagtcagttgatggtgtgtcttgtcctccagaccaggcagcaacatggtatttattttaatcattaaagtacaacatgagtagtaca

SEQ ID NO: 85415 - DNA, 2302 bp, Homo sapiens
tatgcgaaacgagataatggtggaccagtgaataacgtagcaggatgatgtggagctgacagttgaagaaagaaacctcctatctgttgcatatagaatgtgattggagctagaagagcctcctggagaataatcagcagcattgaatagaaagaagaaaacaaggatcgacaagacatcgctctgcatgcttcgggactttcgcgtcagctgtgcgtgatagaggcgccgccatttttgctgcccggacgcggagcgagaggctgagagagtcggagacactatccgcttccatccgtcgcgcagaccctgccggagccgctgccgctatggatgatcgagaggatctggtgtaccaggcgaagctggccgagcaggctgagcgatacgacgtgctctggaactgaacccgcagtatcttccaaaatggtggagtcaatgaagaaagtagcagggatggatgtggagctgacagttgaagaaagaaacctcctatctgttgcatataagaatgtgattggagctagaagagcctcctggagaataatcagcagcattgaacagaaagaagaaaacaagggaggagaagacaagctaaaaatgattcgggaatatcggcaaatggttgagactgagctaaagttaatctgttgtgacattctggatgtactggacaaacacctcattccagcagctaacactggcgagtccaaggttttctattataaaatgaaaggggactaccacaggtatctggcagaatttgccacaggaaacgacaggaaggaggctgcggagaacagcctagtggcttataaagctgctagtgatattgcaatgacagaacttccaccaacgcatcctattcgcttaggtcttgctctcaatttttccgtattctactacgaaattcttaattcccctgaccgtgcctgcaggttggcaaaagcagcttttgatgatgcaattgcagaactggatacgctgagtgaagaaagctataaggactctacacttatcatgcagttgttacgtgataatctgacactatggacttcagacatgcagggtgacggtgaagagcagaataaagaagcgctgcaggacgtggaagacgaaaatcagtgagacataagccaacaagagaaaccatctctgaccaccccctcctccccatcccaccctttggaaactccccattgtcactgagaaccaccaaatctgacttttacatttggtctcagaatttaggttcctgccctgttggttttttttttttttttttaaacagttttcaaaagttcttaaaggcaagagtgaatttctgtggattttactggtcccagcttttaggttctttaagacactaacaggactacatagaggctttttcagcattactgtgtcgtctccgtgccagatgtggcaagatcaccattagcaaatggaaattacatttgaaagccattagacttataggtgatgcaagcatctaagagagaggttaatcacactatagaggcataagtggtatcagttttcatttttctaattgtttaaactgtgttttataccagtgtttgcaagtaattgggtgttagcttgagatggttaaaggtggtttggggagggacttcgttgtaatggttttgctgtaaaaaatgtttccaactccgctgaaatgttgctgaaaagcatggtgctggtaacagttcaacaatccgtggctgctcattcttgcctactttactctcccactgaagcaggttagcgttgaaggtggtatggaaaagcctgcatgcctgttcaattcttttgtttcttctccttccccctccccctacctccttcccctcactcctcccctccttcgctcgctcaacctcttttgttcagtatgtgtaacttgaagctaatttgtactactggatatctgactggagccacagatacagaatctgtattgttcttactgaaacacagcatggaattaacattaaacttaaataaaacaaacctaaattaaaaatgccaaatatcgcgcctccatcctttatacttctaaaataaaatctctagtccaaacacactgacagtattatgtttgcctgaatgtgaaacattcctccttttttcttccataaataatttgtttgcttcccaaagatgtatgttttggaaaaaaattgcctgtagtctggttgtgaagaacactgagtcagttgatggtgtgtcttgtcctccagaccaggcagcaacatggtatttattttaatcattaaagtacaacatgagtagtaca

SEQ ID NO: 85416 - DNA, 1529 bp, Homo sapiens
tatgcgaaacgagataatggtggaccagtgaataacgtagcaggatgatgtggagctgacagttgaagaaagaaacctcctatctgttgcatatagaatgtgattggagctagaagagcctcctggagaataatcagcagcattgaatagaaagaagaaaacaaggatcgacaagacatcgctctgcatgcttcgggactttcgcgtcagctgtgcgtgatagaggcgccgccatttttgctgcccggacgcggagcgagaggctgagagagtcggagacactatccgcttccatccgtcgcgcagaccctgccggagccgctgccgctatggatgatcgagaggatctggtgtaccaggcgaagctggccgagcaggctgagcgatacgacgaaatggtggagtcaatgaagaaagtagcagggatggatgtggagctgacagttgaagaaagaaacctcctatctgttgcatataagaatgtgattggagctagaagagcctcctggagaataatcagcagcattgaacagaaagaagaaaacaagggaggagaagacaagctaaaaatgattcgggaatatcggcaaatggttgagactgagctaaagttaatctgttgtgacattctggatgtactggacaaacacctcattccagcagctaacactggcgagtccaaggttttctattataaaatgaaaggggactaccacaggtatctggcagaatttgccacaggaaacgacaggaaggaggctgcggagaacagcctagtggcttataaagctgctagtgatattgcaatgacagaacttccaccaacgcatcctattcgcttaggtcttgctctcaatttttccgtattctactacgaaattcttaattcccctgaccgtgcctgcaggttggcaaaagcagcttttgatgatgcaattgcagaactggatacgctgagtgaagaaagctataaggactctacacttatcatgcagttgttacgtgataatctgacactatggacttcagacatgcagggtgacggtgaagagcagaataaagaagcgctgcaggacgtggaagacgaaaatcagtgagacataagccaacaagagaaaccatctctgaccaccccctcctccccatcccaccctttggaaactccccattgtcactgagaaccaccaaatctgacttttacatttggtctcagaatttaggttcctgccctgttggttttttttttttttttttaaacagttttcaaaagttcttaaaggcaagagtgaatttctgtggattttactggtcccagcttttaggttctttaagacactaacaggactacatagaggctttttcagcattactgtgtcgtctccgtgccagatgtggcaagatcaccattagcaaatggaaattacatttgaaagccattagacttataggtgatgcaagcatctaagagagaggttaatcacactatagaggcataagtggtatcagcctctacctgcacgacaacacat

SEQ ID NO: 85417 - DNA, 1876 bp, Homo sapiens
ggccgcccgtggcaggtatcttccacagggatggatgtggagctgacagttgaagaaagaaacctcctatctgttgcatataagaatgtgattggagctagaagagcctcctggagaataatcagcagcattgaacagaaagaagaaaacaagggaggagaagacaagctaaaaatgattcgggaatatcggcaaatggttgagactgagctaaagttaatctgttgtgacattctggatgtactggacaaacacctcattccagcagctaacactggcgagtccaaggttttctattataaaatgaaaggggactaccacaggtatctggcagaatttgccacaggaaacgacaggaaggaggctgcggagaacagcctagtggcttataaagctgctagtgatattgcaatgacagaacttccaccaacgcatcctattcgcttaggtcttgctctcaatttttccgtattctactacgaaattcttaattcccctgaccgtgcctgcaggttggcaaaagcagcttttgatgatgcaattgcagaactggatacgctgagtgaagaaagctataaggactctacacttatcatgcagttgttacgtgataatctgacactatggacttcagacatgcagggtgacggtgaagagcagaataaagaagcgctgcaggacgtggaagacgaaaatcagtgagacataagccaacaagagaaaccatctctgaccaccccctcctccccatcccaccctttggaaactccccattgtcactgagaaccaccaaatctgacttttacatttggtctcagaatttaggttcctgccctgttggttttttttttttttttttaaacagttttcaaaagttcttaaaggcaagagtgaatttctgtggattttactggtcccagcttttaggttctttaagacactaacaggactacatagaggctttttcagcattactgtgtcgtctccgtgccagatgtggcaagatcaccattagcaaatggaaattacatttgaaagccattagacttataggtgatgcaagcatctaagagagaggttaatcacactatagaggcataagtggtatcagttttcatttttctaattgtttaaactgtgttttataccagtgtttgcaagtaattgggtgttagcttgagatggttaaaggtggtttggggagggacttcgttgtaatggttttgctgtaaaaaatgtttccaactccgctgaaatgttgctgaaaagcatggtgctggtaacagttcaacaatccgtggctgctcattcttgcctactttactctcccactgaagcaggttagcgttgaaggtggtatggaaaagcctgcatgcctgttcaattcttttgtttcttctccttccccctccccctacctccttcccctcactcctcccctccttcgctcgctcaacctcttttgttcagtatgtgtaacttgaagctaatttgtactactggatatctgactggagccacagatacagaatctgtattgttcttactgaaacacagcatggaattaacattaaacttaaataaaacaaacctaaattaaaaatgccaaatatcgcgcctccatcctttatacttctaaaataaaatctctagtccaaacacactgacagtattatgtttgcctgaatgtgaaacattcctccttttttcttccataaataatttgtttgcttcccaaagatgtatgttttggaaaaaaattgcctgtagtctggttgtgaagaacactgagtcagttgatggtgtgtcttgtcctccagaccaggcagcaacatggtatttattttaatcattaaagtacaacatgagtagtaca

SEQ ID NO: 85418 - DNA, 2243 bp, Homo sapiens
tatgcgaaacgagataatggtggaccagtgaataacgtagcaggatgatgtggagctgacagttgaagaaagaaacctcctatctgttgcatatagaatgtgattggagctagaagagcctcctggagaataatcagcagcattgaatagaaagaagaaaacaaggatcgacaagacatcgctctgcatgcttcgggactttcgcgtcagctgtgcgtgatagaggcgccgccatttttgctgcccggacgcggagcgagaggctgagagagtcggagacactatccgcttccatccgtcgcgcagaccctgccggagccgctgccgctatggatgatcgagaggatctggtgtaccaggcgaagctggccgagcaggctgagcgatacgacgaaatggtggagtcaatgaagaaagtagcagggatggatgtggagctgacagttgaagaaagaaacctcctatctgttgcatataagaatgtgattggagctagaagagcctcctggagaataatcagcagcattgaacagaaagaagaaaacaagggaggagaagacaagctaaaaatgattcgggaatatcggcaaatggttgagactgagctaaagttaatctgttgtgacattctggatgtactggacaaacacctcattccagcagctaacactggaaaggggactaccacaggtatctggcagaatttgccacaggaaacgacaggaaggaggctgcggagaacagcctagtggcttataaagctgctagtgatattgcaatgacagaacttccaccaacgcatcctattcgcttaggtcttgctctcaatttttccgtattctactacgaaattcttaattcccctgaccgtgcctgcaggttggcaaaagcagcttttgatgatgcaattgcagaactggatacgctgagtgaagaaagctataaggactctacacttatcatgcagttgttacgtgataatctgacactatggacttcagacatgcagggtgacggtgaagagcagaataaagaagcgctgcaggacgtggaagacgaaaatcagtgagacataagccaacaagagaaaccatctctgaccaccccctcctccccatcccaccctttggaaactccccattgtcactgagaaccaccaaatctgacttttacatttggtctcagaatttaggttcctgccctgttggttttttttttttttttttaaacagttttcaaaagttcttaaaggcaagagtgaatttctgtggattttactggtcccagcttttaggttctttaagacactaacaggactacatagaggctttttcagcattactgtgtcgtctccgtgccagatgtggcaagatcaccattagcaaatggaaattacatttgaaagccattagacttataggtgatgcaagcatctaagagagaggttaatcacactatagaggcataagtggtatcagttttcatttttctaattgtttaaactgtgttttataccagtgtttgcaagtaattgggtgttagcttgagatggttaaaggtggtttggggagggacttcgttgtaatggttttgctgtaaaaaatgtttccaactccgctgaaatgttgctgaaaagcatggtgctggtaacagttcaacaatccgtggctgctcattcttgcctactttactctcccactgaagcaggttagcgttgaaggtggtatggaaaagcctgcatgcctgttcaattcttttgtttcttctccttccccctccccctacctccttcccctcactcctcccctccttcgctcgctcaacctcttttgttcagtatgtgtaacttgaagctaatttgtactactggatatctgactggagccacagatacagaatctgtattgttcttactgaaacacagcatggaattaacattaaacttaaataaaacaaacctaaattaaaaatgccaaatatcgcgcctccatcctttatacttctaaaataaaatctctagtccaaacacactgacagtattatgtttgcctgaatgtgaaacattcctccttttttcttccataaataatttgtttgcttcccaaagatgtatgttttggaaaaaaattgcctgtagtctggttgtgaagaacactgagtcagttgatggtgtgtcttgtcctccagaccaggcagcaacatggtatttattttaatcattaaagtacaacatgagtagtaca

SEQ ID NO: 85419 - DNA, 1806 bp, Homo sapiens
ctggggtaatttcactgctgatgggcaagagtggaatcaagaaaactagttaggaggctactgctgtaattgaagggagagatgacagtgtgcagtctggaatagggtgatttggggatatgctttgagttgagactgagctaaagttaatctgttgtgacattctggatgtactggacaaacacctcattccagcagctaacactggcgagtccaaggttttctattataaaatgaaaggggactaccacaggtatctggcagaatttgccacaggaaacgacaggaaggaggctgcggagaacagcctagtggcttataaagctgctagtgatattgcaatgacagaacttccaccaacgcatcctattcgcttaggtcttgctctcaatttttccgtattctactacgaaattcttaattcccctgaccgtgcctgcaggttggcaaaagcagcttttgatgatgcaattgcagaactggatacgctgagtgaagaaagctataaggactctacacttatcatgcagttgttacgtgataatctgacactatggacttcagacatgcagggtgacggtgaagagcagaataaagaagcgctgcaggacgtggaagacgaaaatcagtgagacataagccaacaagagaaaccatctctgaccaccccctcctccccatcccaccctttggaaactccccattgtcactgagaaccaccaaatctgacttttacatttggtctcagaatttaggttcctgccctgttggttttttttttttttttttaaacagttttcaaaagttcttaaaggcaagagtgaatttctgtggattttactggtcccagcttttaggttctttaagacactaacaggactacatagaggctttttcagcattactgtgtcgtctccgtgccagatgtggcaagatcaccattagcaaatggaaattacatttgaaagccattagacttataggtgatgcaagcatctaagagagaggttaatcacactatagaggcataagtggtatcagttttcatttttctaattgtttaaactgtgttttataccagtgtttgcaagtaattgggtgttagcttgagatggttaaaggtggtttggggagggacttcgttgtaatggttttgctgtaaaaaatgtttccaactccgctgaaatgttgctgaaaagcatggtgctggtaacagttcaacaatccgtggctgctcattcttgcctactttactctcccactgaagcaggttagcgttgaaggtggtatggaaaagcctgcatgcctgttcaattcttttgtttcttctccttccccctccccctacctccttcccctcactcctcccctccttcgctcgctcaacctcttttgttcagtatgtgtaacttgaagctaatttgtactactggatatctgactggagccacagatacagaatctgtattgttcttactgaaacacagcatggaattaacattaaacttaaataaaacaaacctaaattaaaaatgccaaatatcgcgcctccatcctttatacttctaaaataaaatctctagtccaaacacactgacagtattatgtttgcctgaatgtgaaacattcctccttttttcttccataaataatttgtttgcttcccaaagatgtatgttttggaaaaaaattgcctgtagtctggttgtgaagaacactgagtcagttgatggtgtgtcttgtcctccagaccaggcagcaacatggtatttattttaatcattaaagtacaacatgagtagtaca

SEQ ID NO: 85420 - DNA, 2222 bp, Homo sapiens
tatgcgaaacgagataatggtggaccagtgaataacgtagcaggatgatgtggagctgacagttgaagaaagaaacctcctatctgttgcatatagaatgtgattggagctagaagagcctcctggagaataatcagcagcattgaatagaaagaagaaaacaaggatcgacaagacatcgctctgcatgcttcgggactttcgcgtcagctgtgcgtgatagaggcgccgccatttttgctgcccggacgcggagcgagaggctgagagagtcggagacactatccgcttccatccgtcgcgcagaccctgccggagccgctgccgctatggatgatcgagaggatctggtgtaccaggcgaagctggccgagcaggctgagcgatacgacgaaatggtggagtcaatgaagaaagtagcagggatggatgtggagctgacagttgaagaaagaaacctcctatctgttgcatataagaatgtgattggagctagaagagcctcctggagaataatcagcagcattgaacagaaagaagaaaacaagggaggagaagacaagctaaaaatgattcgggaatatcggcaaatggttgagactgagctaaagttaatctgttgtgacattctggatgtactggacaaacacctcattccagcagctaacactggcgagtccaaggttttctattataaaataggaaggaggctgcggagaacagcctagtggcttataaagctgctagtgatattgcaatgacagaacttccaccaacgcatcctattcgcttaggtcttgctctcaatttttccgtattctactacgaaattcttaattcccctgaccgtgcctgcaggttggcaaaagcagcttttgatgatgcaattgcagaactggatacgctgagtgaagaaagctataaggactctacacttatcatgcagttgttacgtgataatctgacactatggacttcagacatgcagggtgacggtgaagagcagaataaagaagcgctgcaggacgtggaagacgaaaatcagtgagacataagccaacaagagaaaccatctctgaccaccccctcctccccatcccaccctttggaaactccccattgtcactgagaaccaccaaatctgacttttacatttggtctcagaatttaggttcctgccctgttggttttttttttttttttttaaacagttttcaaaagttcttaaaggcaagagtgaatttctgtggattttactggtcccagcttttaggttctttaagacactaacaggactacatagaggctttttcagcattactgtgtcgtctccgtgccagatgtggcaagatcaccattagcaaatggaaattacatttgaaagccattagacttataggtgatgcaagcatctaagagagaggttaatcacactatagaggcataagtggtatcagttttcatttttctaattgtttaaactgtgttttataccagtgtttgcaagtaattgggtgttagcttgagatggttaaaggtggtttggggagggacttcgttgtaatggttttgctgtaaaaaatgtttccaactccgctgaaatgttgctgaaaagcatggtgctggtaacagttcaacaatccgtggctgctcattcttgcctactttactctcccactgaagcaggttagcgttgaaggtggtatggaaaagcctgcatgcctgttcaattcttttgtttcttctccttccccctccccctacctccttcccctcactcctcccctccttcgctcgctcaacctcttttgttcagtatgtgtaacttgaagctaatttgtactactggatatctgactggagccacagatacagaatctgtattgttcttactgaaacacagcatggaattaacattaaacttaaataaaacaaacctaaattaaaaatgccaaatatcgcgcctccatcctttatacttctaaaataaaatctctagtccaaacacactgacagtattatgtttgcctgaatgtgaaacattcctccttttttcttccataaataatttgtttgcttcccaaagatgtatgttttggaaaaaaattgcctgtagtctggttgtgaagaacactgagtcagttgatggtgtgtcttgtcctccagaccaggcagcaacatggtatttattttaatcattaaagtacaacatgagtagtaca

SEQ ID NO: 85421 - DNA, 1593 bp, Homo sapiens
tgacgagcttggtatgacgagcgaaaggggactaccacaggtatctggcagaatttgccacaggaaacgacaggaaggaggctgcggagaacagcctagtggcttataaagctgctagtgatattgcaatgacagaacttccaccaacgcatcctattcgcttaggtcttgctctcaatttttccgtattctactacgaaattcttaattcccctgaccgtgcctgcaggttggcaaaagcagcttttgatgatgcaattgcagaactggatacgctgagtgaagaaagctataaggactctacacttatcatgcagttgttacgtgataatctgacactatggacttcagacatgcagggtgacggtgaagagcagaataaagaagcgctgcaggacgtggaagacgaaaatcagtgagacataagccaacaagagaaaccatctctgaccaccccctcctccccatcccaccctttggaaactccccattgtcactgagaaccaccaaatctgacttttacatttggtctcagaatttaggttcctgccctgttggttttttttttttttttttaaacagttttcaaaagttcttaaaggcaagagtgaatttctgtggattttactggtcccagcttttaggttctttaagacactaacaggactacatagaggctttttcagcattactgtgtcgtctccgtgccagatgtggcaagatcaccattagcaaatggaaattacatttgaaagccattagacttataggtgatgcaagcatctaagagagaggttaatcacactatagaggcataagtggtatcagttttcatttttctaattgtttaaactgtgttttataccagtgtttgcaagtaattgggtgttagcttgagatggttaaaggtggtttggggagggacttcgttgtaatggttttgctgtaaaaaatgtttccaactccgctgaaatgttgctgaaaagcatggtgctggtaacagttcaacaatccgtggctgctcattcttgcctactttactctcccactgaagcaggttagcgttgaaggtggtatggaaaagcctgcatgcctgttcaattcttttgtttcttctccttccccctccccctacctccttcccctcactcctcccctccttcgctcgctcaacctcttttgttcagtatgtgtaacttgaagctaatttgtactactggatatctgactggagccacagatacagaatctgtattgttcttactgaaacacagcatggaattaacattaaacttaaataaaacaaacctaaattaaaaatgccaaatatcgcgcctccatcctttatacttctaaaataaaatctctagtccaaacacactgacagtattatgtttgcctgaatgtgaaacattcctccttttttcttccataaataatttgtttgcttcccaaagatgtatgttttggaaaaaaattgcctgtagtctggttgtgaagaacactgagtcagttgatggtgtgtcttgtcctccagaccaggcagcaacatggtatttattttaatcattaaagtacaacatgagtagtaca

SEQ ID NO: 85422 - DNA, 1302 bp, Homo sapiens
tatgcgaaacgagataatggtggaccagtgaataacgtagcaggatgatgtggagctgacagttgaagaaagaaacctcctatctgttgcatatagaatgtgattggagctagaagagcctcctggagaataatcagcagcattgaatagaaagaagaaaacaaggatcgacaagacatcgctctgcatgcttcgggactttcgcgtcagctgtgcgtgatagaggcgccgccatttttgctgcccggacgcggagcgagaggctgagagagtcggagacactatccgcttccatccgtcgcgcagaccctgccggagccgctgccgctatggatgatcgagaggatctggtgtaccaggcgaagctggccgagcaggctgagcgatacgacgaaatggtggagtcaatgaagaaagtagcagggatggatgtggagctgacagttgaagaaagaaacctcctatctgttgcatataagaatgtgattggagctagaagagcctcctggagaataatcagcagcattgaacagaaagaagaaaacaagggaggagaagacaagctaaaaatgattcgggaatatcggcaaatggttgagactgagctaaagttaatctgttgtgacattctggatgtactggacaaacacctcattccagcagctaacactggcgagtccaaggttttctattataaaatgaaaggggactaccacaggtatctggcagaatttgccacaggaaacgacaggaaggaggctgcggagaacagcctagtggcttataaagctgctagtgatattgcaatgacagaacttccaccaacgcatcctattcgcttaggtcttgctctcaatttttccgtattctactacgaaattcttaattcccctgaccgtgcctgcaggttggcaaaagcagcttttgatgatgcaattgcagaactggatacgctgagtgaagaaagctataaggactctacacttatcatgcagttgttacgtgataatctgacactatggacttcagacatgcagggtgacggtgaagagcagaataaagaagcgctgcaggacgtggaagacgaaaatcagtgagacataagccaacaagagaaaccatctctgaccaccccctcctcactcctcccctccttcgctcgctcaacctcttttgttcagtatgtgtaacttgaagctaatttgtactactggatatctgactggagccacagatacagaatctgtattgttcttactgaaacacagcatggaattaacattaaacttaaataaaacaaac

SEQ ID NO: 85423 - DNA, 1652 bp, Homo sapiens
  misc_feature (1622)..(1622): n is a, c, g, or t
tatgcgaaacgagataatggtggaccagtgaataacgtagcaggatgatgtggagctgacagttgaagaaagaaacctcctatctgttgcatatagaatgtgattggagctagaagagcctcctggagaataatcagcagcattgaatagaaagaagaaaacaaggatcgacaagacatcgctctgcatgcttcgggactttcgcgtcagctgtgcgtgatagaggcgccgccatttttgctgcccggacgcggagcgagaggctgagagagtcggagacactatccgcttccatccgtcgcgcagaccctgccggagccgctgccgctatggatgatcgagaggatctggtgtaccaggcgaagctggccgagcaggctgagcgatacgacgaaatggtggagtcaatgaagaaagtagcagggatggatgtggagctgacagttgaagaaagaaacctcctatctgttgcatataagaatgtgattggagctagaagagcctcctggagaataatcagcagcattgaacagaaagaagaaaacaagggaggagaagacaagctaaaaatgattcgggaatatcggcaaatggttgagactgagctaaagttaatctgttgtgacattctggatgtactggacaaacacctcattccagcagctaacactggcgagtccaaggttttctattataaaatgaaaggggactaccacaggtatctggcagaatttgccacaggaaacgacaggaaggaggctgcggagaacagcctagtggcttataaagctgctagtgatattgcaatgacagaacttccaccaacgcatcctattcgcttaggtcttgctctcaatttttccgtattctactacgaaattcttaattcccctgaccgtgcctgcaggttggcaaaagcagcttttgatgatgcaattgcagaactggatacgctgagtgaagaaagctataaggactctacacttatcatgcagttgttacgtgataatctgacactatggacttcagacatgcagggtgacggtgaagagcagaataaagaagcgctgcaggacgtggaagacgaaaatcagtgagacataagccaacaagagaaaccatctctgaccaccccctccttaggattggagctagaagagcctcctggagaataatcagcagcattgaacagaaagaagaaaacaagggaggagaagacaagctaaaaatgattcgggaatatcggcagccatttgagaactgcactagctgacatcactaaaacattatcagctaaagccaaaaccaaataaaggcccagagcaacatcctggctctctaaaacctgtccaaaatcattaagtgaaaggcagtaaatgcaggactgtggatcatgtcactgcagctgacaatgattaacaataggagacatgcaacccccattaaggttaaaagtccaaaactagtcacacgcatctctttatgggggaaaagtgagactattatgcattcttggtaggtttgcaaccttgcactgaagagcacccattgcatttctttcatctttcagaaagcaccggtatctgttccaagggcctaacagtacggaaatacattctggnatcacacctctgaaaccaagactgttctca

SEQ ID NO: 85424 - DNA, 1414 bp, Homo sapiens
ggacgcgtgggtcgacccacgcgtccgcggacgcgttggggtgcctgcaggttggcaaaagcagcttttgatgatgcaattgcagaactggatacgctgagtgaagaaagctataaggactctacacttatcatgcagttgttacgtgataatctgacactatggacttcagacatgcagggtgacggtgaagagcagaataaagaagcgctgcaggacgtggaagacgaaaatcagtgagacataagccaacaagagaaaccatctctgaccaccccctcctccccatcccaccctttggaaactccccattgtcactgagaaccaccaaatctgacttttacatttggtctcagaatttaggttcctgccctgttggttttttttttttttttttaaacagttttcaaaagttcttaaaggcaagagtgaatttctgtggattttactggtcccagcttttaggttctttaagacactaacaggactacatagaggctttttcagcattactgtgtcgtctccgtgccagatgtggcaagatcaccattagcaaatggaaattacatttgaaagccattagacttataggtgatgcaagcatctaagagagaggttaatcacactatagaggcataagtggtatcagttttcatttttctaattgtttaaactgtgttttataccagtgtttgcaagtaattgggtgttagcttgagatggttaaaggtggtttggggagggacttcgttgtaatggttttgctgtaaaaaatgtttccaactccgctgaaatgttgctgaaaagcatggtgctggtaacagttcaacaatccgtggctgctcattcttgcctactttactctcccactgaagcaggttagcgttgaaggtggtatggaaaagcctgcatgcctgttcaattcttttgtttcttctccttccccctccccctacctccttcccctcactcctcccctccttcgctcgctcaacctcttttgttcagtatgtgtaacttgaagctaatttgtactactggatatctgactggagccacagatacagaatctgtattgttcttactgaaacacagcatggaattaacattaaacttaaataaaacaaacctaaattaaaaatgccaaatatcgcgcctccatcctttatacttctaaaataaaatctctagtccaaacacactgacagtattatgtttgcctgaatgtgaaacattcctccttttttcttccataaataatttgtttgcttcccaaagatgtatgttttggaaaaaaattgcctgtagtctggttgtgaagaacactgagtcagttgatggtgtgtcttgtcctccagaccaggcagcaacatggtatttattttaatcattaaagtacaacatgagtagtaca

SEQ ID NO: 85425 - DNA, 1348 bp, Homo sapiens
cccacgcgtccgccacgcgtcgccacgcgtccggaggaagaaagctataaggactctacacttatcatgcagttgttacgtgataatctgacactatggacttcagacatgcagggtgacggtgaagagcagaataaagaagcgctgcaggacgtggaagacgaaaatcagtgagacataagccaacaagagaaaccatctctgaccaccccctcctccccatcccaccctttggaaactccccattgtcactgagaaccaccaaatctgacttttacatttggtctcagaatttaggttcctgccctgttggttttttttttttttttttaaacagttttcaaaagttcttaaaggcaagagtgaatttctgtggattttactggtcccagcttttaggttctttaagacactaacaggactacatagaggctttttcagcattactgtgtcgtctccgtgccagatgtggcaagatcaccattagcaaatggaaattacatttgaaagccattagacttataggtgatgcaagcatctaagagagaggttaatcacactatagaggcataagtggtatcagttttcatttttctaattgtttaaactgtgttttataccagtgtttgcaagtaattgggtgttagcttgagatggttaaaggtggtttggggagggacttcgttgtaatggttttgctgtaaaaaatgtttccaactccgctgaaatgttgctgaaaagcatggtgctggtaacagttcaacaatccgtggctgctcattcttgcctactttactctcccactgaagcaggttagcgttgaaggtggtatggaaaagcctgcatgcctgttcaattcttttgtttcttctccttccccctccccctacctccttcccctcactcctcccctccttcgctcgctcaacctcttttgttcagtatgtgtaacttgaagctaatttgtactactggatatctgactggagccacagatacagaatctgtattgttcttactgaaacacagcatggaattaacattaaacttaaataaaacaaacctaaattaaaaatgccaaatatcgcgcctccatcctttatacttctaaaataaaatctctagtccaaacacactgacagtattatgtttgcctgaatgtgaaacattcctccttttttcttccataaataatttgtttgcttcccaaagatgtatgttttggaaaaaaattgcctgtagtctggttgtgaagaacactgagtcagttgatggtgtgtcttgtcctccagaccaggcagcaacatggtatttattttaatcattaaagtacaacatgagtagtaca

SEQ ID NO: 85426 - DNA, 1413 bp, Homo sapiens
agcggaggtggaggggtgggctggcgtgatgtccgtcttccgctgggagcgagaggctgagagagtcggagacactatccgcttccatccgtcgcgcagaccctgccggagccgctgccgctatggatgatcgagaggatctggtgtaccaggcgaagctggccgagcaggctgagcgatacgacggtgaagagcagaataaagaagcgctgcaggacgtggaagacgaaaatcagtgagacataagccaacaagagaaaccatctctgaccaccccctcctccccatcccaccctttggaaactccccattgtcactgagaaccaccaaatctgacttttacatttggtctcagaatttaggttcctgccctgttggttttttttttttttttttaaacagttttcaaaagttcttaaaggcaagagtgaatttctgtggattttactggtcccagcttttaggttctttaagacactaacaggactacatagaggctttttcagcattactgtgtcgtctccgtgccagatgtggcaagatcaccattagcaaatggaaattacatttgaaagccattagacttataggtgatgcaagcatctaagagagaggttaatcacactatagaggcataagtggtatcagttttcatttttctaattgtttaaactgtgttttataccagtgtttgcaagtaattgggtgttagcttgagatggttaaaggtggtttggggagggacttcgttgtaatggttttgctgtaaaaaatgtttccaactccgctgaaatgttgctgaaaagcatggtgctggtaacagttcaacaatccgtggctgctcattcttgcctactttactctcccactgaagcaggttagcgttgaaggtggtatggaaaagcctgcatgcctgttcaattcttttgtttcttctccttccccctccccctacctccttcccctcactcctcccctccttcgctcgctcaacctcttttgttcagtatgtgtaacttgaagctaatttgtactactggatatctgactggagccacagatacagaatctgtattgttcttactgaaacacagcatggaattaacattaaacttaaataaaacaaacctaaattaaaaatgccaaatatcgcgcctccatcctttatacttctaaaataaaatctctagtccaaacacactgacagtattatgtttgcctgaatgtgaaacattcctccttttttcttccataaataatttgtttgcttcccaaagatgtatgttttggaaaaaaattgcctgtagtctggttgtgaagaacactgagtcagttgatggtgtgtcttgtcctccagaccaggcagcaacatggtatttattttaatcattaaagtacaacatgagtagtaca

SEQ ID NO: 85427 - DNA, 1068 bp, Homo sapiens
tatgcgaaacgagataatggtggaccagtgaataacgtagcaggatgatgtggagctgacagttgaagaaagaaacctcctatctgttgcatatagaatgtgattggagctagaagagcctcctggagaataatcagcagcattgaatagaaagaagaaaacaaggatcgacaagacatcgctctgcatgcttcgggactttcgcgtcagctgtgcgtgatagaggcgccgccatttttgctgcccggacgcggagcgagaggctgagagagtcggagacactatccgcttccatccgtcgcgcagaccctgccggagccgctgccgctatggatgatcgagaggatctggtgtaccaggcgaagctggccgagcaggctgagcgatacgacgaaatggtggagtcaatgaagaaagtagcagggatggatgtggagctgacagttgaagaaagaaacctcctatctgttgcatataagaatgtgattggagctagaagagcctcctggagaataatcagcagcattgaacagaaagaagaaaacaagggaggagaagacaagctaaaaatgattcgggaatatcggcaaatggttgagactgagctaaagttaatctgttgtgacattctggatgtactggacaaacacctcattccagcagctaacactggcgagtccaaggttttctattataaaatgaaaggggactaccacaggtatctggcagaatttgccacaggaaacgacaggaaggaggctgcggagaacagcctagtggcttataaagctgctagtgatattgcaatgacagaacttccaccaacgcatcctattcgcttaggtcttgctctcaatttttccgtattctactacgaaattcttaattcccctgaccgtgcctgcaggttggcaaaagcagcttttgatgatgcaattgcagaactggatacgctgagtgaagaaagctataaggactctacacttatcatgcagttgttacgtgataatctgacactatggacttcagacatgcagggtgacgggtaagcaagcacggagtgaaaca

SEQ ID NO: 85428 - DNA, 1115 bp, Homo sapiens
tatgcgaaacgagataatggtggaccagtgaataacgtagcaggatgatgtggagctgacagttgaagaaagaaacctcctatctgttgcatatagaatgtgattggagctagaagagcctcctggagaataatcagcagcattgaatagaaagaagaaaacaaggatcgacaagacatcgctctgcatgcttcgggactttcgcgtcagctgtgcgtgatagaggcgccgccatttttgctgcccggacgcggagcgagaggctgagagagtcggagacactatccgcttccatccgtcgcgcagaccctgccggagccgctgccgctatggatgatcgagaggatctggtgtaccaggcgaagctggccgagcaggctgagcgatacgacgaaatggtggagtcaatgaagaaagtagcagggatggatgtggagctgacagttgaagaaagaaacctcctatctgttgcatataagaatgtgattggagctagaagagcctcctggagaataatcagcagcattgaacagaaagaagaaaacaagggaggagaagacaagctaaaaatgattcgggaatatcggcaaatggttgagactgagctaaagttaatctgttgtgacattctggatgtactggacaaacacctcattccagcagctaacactggcgagtccaaggttttctattataaaatgaaaggggactaccacaggtatctggcagaatttgccacaggaaacgacaggaaggaggctgcggagaacagcctagtggcttataaagctgctagtgatattgcaatgacagaacttccaccaacgcatcctattcgcttaggtcttgctctcaatttttccgtattctactacgaaattcttaattcccctgaccgtgcctgcaggttggcaaaagcagcttttgatgatgcaattgcagaactggatacgctgagtgaagaaagctataaggactctacacttatcatgcagttgttacgtgataatctgacactatggacttcagacatgcagggtgacgccgatgaatagcgaggtgccgatgaataagcgaggtgccgatgaatagcgagtgccgataatagcggtccg

SEQ ID NO: 85429 - DNA, 906 bp, Homo sapiens
tagtgatctagaggatccctcataggtcgcagggatcaccattagcaaatggaaattacatttgaaagccattagacttataggtgatgcaagcatctaagagagaggttaatcacactatagaggcataagtggtatcagttttcatttttctaattgtttaaactgtgttttataccagtgtttgcaagtaattgggtgttagcttgagatggttaaaggtggtttggggagggacttcgttgtaatggttttgctgtaaaaaatgtttccaactccgctgaaatgttgctgaaaagcatggtgctggtaacagttcaacaatccgtggctgctcattcttgcctactttactctcccactgaagcaggttagcgttgaaggtggtatggaaaagcctgcatgcctgttcaattcttttgtttcttctccttccccctccccctacctccttcccctcactcctcccctccttcgctcgctcaacctcttttgttcagtatgtgtaacttgaagctaatttgtactactggatatctgactggagccacagatacagaatctgtattgttcttactgaaacacagcatggaattaacattaaacttaaataaaacaaacctaaattaaaaatgccaaatatcgcgcctccatcctttatacttctaaaataaaatctctagtccaaacacactgacagtattatgtttgcctgaatgtgaaacattcctccttttttcttccataaataatttgtttgcttcccaaagatgtatgttttggaaaaaaattgcctgtagtctggttgtgaagaacactgagtcagttgatggtgtgtcttgtcctccagaccaggcagcaacatggtatttattttaatcattaaagtacaacatgagtagtaca

SEQ ID NO: 85430 - DNA, 948 bp, Homo sapiens
cttttattagtaaagataccttcttttacggactccactttatggactcccttaggcccaatgtcgaagcccccatcgctgggtcaatagtacttgccccagtactcttgaaactaggcggctatggtataatatgcctcatcagcgattgctccatcgctgatgaggcataagtggtatcagttttcatttttctaattgtttaaactgtgttttataccagtgtttgcaagtaattgggtgttagcttgagatggttaaaggtggtttggggagggacttcgttgtaatggttttgctgtaaaaaatgtttccaactccgctgaaatgttgctgaaaagcatggtgctggtaacagttcaacaatccgtggctgctcattcttgcctactttactctcccactgaagcaggttagcgttgaaggtggtatggaaaagcctgcatgcctgttcaattcttttgtttcttctccttccccctccccctacctccttcccctcactcctcccctccttcgctcgctcaacctcttttgttcagtatgtgtaacttgaagctaatttgtactactggatatctgactggagccacagatacagaatctgtattgttcttactgaaacacagcatggaattaacattaaacttaaataaaacaaacctaaattaaaaatgccaaatatcgcgcctccatcctttatacttctaaaataaaatctctagtccaaacacactgacagtattatgtttgcctgaatgtgaaacattcctccttttttcttccataaataatttgtttgcttcccaaagatgtatgttttggaaaaaaattgcctgtagtctggttgtgaagaacactgagtcagttgatggtgtgtcttgtcctccagaccaggcagcaacatggtatttattttaatcattaaagtacaacatgagtagtaca

SEQ ID NO: 85431 - DNA, 1240 bp, Homo sapiens
tatgcgaaacgagataatggtggaccagtgaataacgtagcaggatgatgtggagctgacagttgaagaaagaaacctcctatctgttgcatatagaatgtgattggagctagaagagcctcctggagaataatcagcagcattgaatagaaagaagaaaacaaggatcgacaagacatcgctctgcatgcttcgggactttcgcgtcagctgtgcgtgatagaggcgccgccatttttgctgcccggacgcggagcgagaggctgagagagtcggagacactatccgcttccatccgtcgcgcagaccctgccggagccgctgccgctatggatgatcgagaggatctggtgtaccaggcgaagctggccgagcaggctgagcgatacgacgaaatggtggagtcaatgaagaaagtagcagggatggatgtggagctgacagttgaagaaagaaacctcctatctgttgcatataagaatgtgattggagctagaagagcctcctggagaataatcagcagcattgaacagaaagaagaaaacaagggaggagaagacaagctaaaaatgattcgggaatatcggcaaatgtaaaaaatgtttccaactccgctgaaatgttgctgaaaagcatggtgctggtaacagttcaacaatccgtggctgctcattcttgcctactttactctcccactgaagcaggttagcgttgaaggtggtatggaaaagcctgcatgcctgttcaattcttttgtttcttctccttccccctccccctacctccttcccctcactcctcccctccttcgctcgctcaacctcttttgttcagtatgtgtaacttgaagctaatttgtactactggatatctgactggagccacagatacagaatctgtattgttcttactgaaacacagcatggaattaacattaaacttaaataaaacaaacctaaattaaaaatgccaaatatcgcgcctccatcctttatacttctaaaataaaatctctagtccaaacacactgacagtattatgtttgcctgaatgtgaaacattcctccttttttcttccataaataatttgtttgcttcccaaagatgtatgttttggaaaaaaattgcctgtagtctggttgtgaagaacactgagtcagttgatggtgtgtcttgtcctccagaccaggcagcaacatggtatttattttaatcattaaagtacaacatgagtagtaca

SEQ ID NO: 85432 - DNA, 1168 bp, Homo sapiens
tatgcgaaacgagataatggtggaccagtgaataacgtagcaggatgatgtggagctgacagttgaagaaagaaacctcctatctgttgcatatagaatgtgattggagctagaagagcctcctggagaataatcagcagcattgaatagaaagaagaaaacaaggatcgacaagacatcgctctgcatgcttcgggactttcgcgtcagctgtgcgtgatagaggcgccgccatttttgctgcccggacgcggagcgagaggctgagagagtcggagacactatccgcttccatccgtcgcgcagaccctgccggagccgctgccgctatggatgatcgagaggatctggtgtaccaggcgaagctggccgagcaggctgagcgatacgacgaaatggtggagtcaatgaagaaagtagcagggatggatgtggagctgacagttgaagaaagaaacctcctatctgttgcatataagaatgtgattggagctagaagagcctcctggagaataatcagcagcattgaacagaaagaagaaaacaagggaggagaagacaagctaaaaatgattcgggaatatcggcaaatggttgagactgagctaaagttaatctgttgtgacattctggatgtactggacaaacacctcattccagcagctaacactggcgagtccaaggttttctattataaaatgaaaggggactaccacaggtatctggcagaatttgccacaggaaacgacaggaaggaggctgcggagaacagcctagtggcttataaagctgctagtgatattgcaatgacagaacttccaccaacgcatcctattcgcttaggtcttgctctcaatttttccgtattctactacgaaattcttaattcccctgaccgtgcctgcaggtaagttgtggggaagaacagcagcgctcagcgtgaaagttaaggggggcgctgtttgggttttccgtgttgtttcttgggcctgtctttgtagacttggctgcatagtaattcttttggctcttactgaaactactttggatagtattaaaacagacctgtctcaacccactagcatagcagtcagcataattattttgatgtgggatatttttgttgctggtagatgcggtgtttggggatccttagagtcacctcgcg

SEQ ID NO: 85433 - DNA, 1020 bp, Homo sapiens
tatgcgaaacgagataatggtggaccagtgaataacgtagcaggatgatgtggagctgacagttgaagaaagaaacctcctatctgttgcatatagaatgtgattggagctagaagagcctcctggagaataatcagcagcattgaatagaaagaagaaaacaaggatcgacaagacatcgctctgcatgcttcgggactttcgcgtcagctgtgcgtgatagaggcgccgccatttttgctgcccggacgcggagcgagaggctgagagagtcggagacactatccgcttccatccgtcgcgcagaccctgccggagccgctgccgctatggatgatcgagaggatctggtgtaccaggcgaagctggccgagcaggctgagcgatacgacgaaatggtggagtcaatgaagaaagtagcagggatggatgtggagctgacagttgaagaaagaaacctcctatctgttgcatataagaatgtgattggagctagaagagcctcctggagaataatcagcagcattgaacagaaagaagaaaacaagggaggagaagacaagctaaaaatgattcgggaatatcggcaaatggttgagactgagctaaagttaatctgttgtgacattctggatgtactggacaaacacctcattccagcagctaacactggcgagtccaaggttttctattataaaattgtaggttctatactagaagggaaaatgtaagattgaaagttggtccttttagaaccataactttgttctatgtaggttttcaacttttatttaagaataattgttcaatgttagaaggatagttaatattggaatgaaaaggtggttgggctattatgaaaatgtattagcttttgcttatttatattcttttgtttttgtgagacctatcccattcccctcccccaaacggcatacatttcacagtgcttagtgttatatatagacattttattttatgattaataaactgtcatgccattccttggaaccacttgct

SEQ ID NO: 85434 - DNA, 1040 bp, Homo sapiens
tatgcgaaacgagataatggtggaccagtgaataacgtagcaggatgatgtggagctgacagttgaagaaagaaacctcctatctgttgcatatagaatgtgattggagctagaagagcctcctggagaataatcagcagcattgaatagaaagaagaaaacaaggatcgacaagacatcgctctgcatgcttcgggactttcgcgtcagctgtgcgtgatagaggcgccgccatttttgctgcccggacgcggagcgagaggctgagagagtcggagacactatccgcttccatccgtcgcgcagaccctgccggagccgctgccgctatggatgatcgagaggatctggtgtaccaggcgaagctggccgagcaggctgagcgatacgacgaaatggtggagtcaatgaagaaagtagcagggatggatgtggagctgacagttgaagaaagaaacctcctatctgttgcatataagaatgtgattggagctagaagagcctcctggagaataatcagcagcattgaacagaaagaagaaaacaagggaggagaagacaagctaaaaatgattcgggaatatcggcaaatgcactcctcccctccttcgctcgctcaacctcttttgttcagtatgtgtaacttgaagctaatttgtactactggatatctgactggagccacagatacagaatctgtattgttcttactgaaacacagcatggaattaacattaaacttaaataaaacaaacctaaattaaaaatgccaaatatcgcgcctccatcctttatacttctaaaataaaatctctagtccaaacacactgacagtattatgtttgcctgaatgtgaaacattcctccttttttcttccataaataatttgtttgcttcccaaagatgtatgttttggaaaaaaattgcctgtagtctggttgtgaagaacactgagtcagttgatggtgtgtcttgtcctccagaccaggcagcaacatggtatttattttaatcattaaagtacaacatgagtagtaca

SEQ ID NO: 85435 - DNA, 755 bp, Homo sapiens
tatgcgaaacgagataatggtggaccagtgaataacgtagcaggatgatgtggagctgacagttgaagaaagaaacctcctatctgttgcatatagaatgtgattggagctagaagagcctcctggagaataatcagcagcattgaatagaaagaagaaaacaaggatcgacaagacatcgctctgcatgcttcgggactttcgcgtcagctgtgcgtgatagaggcgccgccatttttgctgcccggacgcggagcgagaggctgagagagtcggagacactatccgcttccatccgtcgcgcagaccctgccggagccgctgccgctatggatgatcgagaggatctggtgtaccaggcgaagctggccgagcaggctgagcgatacgacgaaatggtggagtcaatgaagaaagtagcagggatggatgtggagctgacagttgaagaaagaaacctcctatctgttgcatataagaatgtgattggagctagaagagcctcctggagaataatcagcagcattgaacagaaagaagaaaacaagggaggagaagacaagctaaaaatgattcgggaatatcggcaaatgcactcctcccctccttcgctcgctcaacctcttttgttcagtatgtgtaacttgaagctaatttgtactactggatatctgactggagccacagatacagaatctgtattgttcttactgaaacacagcatggaattaacattaaacttaaataaaacaaac

SEQ ID NO: 85436 - DNA, 643 bp, Homo sapiens
  misc_feature (595)..(595): n is a, c, g, or t
  misc_feature (597)..(597): n is a, c, g, or t
tatgcgaaacgagataatggtggaccagtgaataacgtagcaggatgatgtggagctgacagttgaagaaagaaacctcctatctgttgcatatagaatgtgattggagctagaagagcctcctggagaataatcagcagcattgaatagaaagaagaaaacaaggatcgacaagacatcgctctgcatgcttcgggactttcgcgtcagctgtgcgtgatagaggcgccgccatttttgctgcccggacgcggagcgagaggctgagagagtcggagacactatccgcttccatccgtcgcgcagaccctgccggagccgctgccgctatggatgatcgagaggatctggtgtaccaggcgaagctggccgagcaggctgagcgatacgacgaaatggtggagtcaatgaagaaagtagcagggatggatgtggagctgacagttgaagaaagaaacctcctatctgttgcatataagaatgtgattggagctagaagagcctcctggagaataatcagcagcattgaacagaaagaagaaaacaagggaggagaagacaagctaaaaatgattcgggaatatcggcaaatgcncngtcagaggtgggaactcggacagaggtgagaactcggtcagaggtg

SEQ ID NO: 85437 - DNA, 671 bp, Homo sapiens
taaatggcttcctgtcaatctgcagagcgggagagcgatggagagacagcaagatgaacagagagagggagtggttctgttctcggagagagagagagcgagagagagagagaaaacgtgtgtgattctaatatcgggcaatcagggaaaacatttatctccgcccgctttgagtgaggcatgcggcttcccgcctacttcccgtcgtatcttcctcttcattgcactcctcccctccttcgctcgctcaacctcttttgttcagtatgtgtaacttgaagctaatttgtactactggatatctgactggagccacagatacagaatctgtattgttcttactgaaacacagcatggaattaacattaaacttaaataaaacaaacctaaattaaaaatgccaaatatcgcgcctccatcctttatacttctaaaataaaatctctagtccaaacacactgacagtattatgtttgcctgaatgtgaaacattcctccttttttcttccataaataatttgtttgcttcccaaagatgtatgttttggaaaaaaattgcctgtagtctggttgtgaagaacactgagtcagttgatggtgtgtcttgtcctccagaccaggcagcaacatggtatttattttaatcattaaagtacaacatgagtagtaca

SEQ ID NO: 85438 - DNA, 573 bp, Homo sapiens
cctccagtggtagcctccagagcatgtgtgcacgtggtgtcagtgtgccggggccggccagacacagcctaatgctggaggtgcacgagggtgctcaacaccccccaggattaaaaatgaaggcaacactcctcccctccttcgctcgctcaacctcttttgttcagtatgtgtaacttgaagctaatttgtactactggatatctgactggagccacagatacagaatctgtattgttcttactgaaacacagcatggaattaacattaaacttaaataaaacaaacctaaattaaaaatgccaaatatcgcgcctccatcctttatacttctaaaataaaatctctagtccaaacacactgacagtattatgtttgcctgaatgtgaaacattcctccttttttcttccataaataatttgtttgcttcccaaagatgtatgttttggaaaaaaattgcctgtagtctggttgtgaagaacactgagtcagttgatggtgtgtcttgtcctccagaccaggcagcaacatggtatttattttaatcattaaagtacaacatgagtagtaca

SEQ ID NO: 85439 - DNA, 844 bp, Homo sapiens
agcggaggtggaggggtgggctggcgtgatgtccgtcttccgctgggagcgagaggctgagagagtcggagacactatccgcttccatccgtcgcgcagaccctgccggagccgctgccgctatggatgatcgagaggatctggtgtaccaggcgaagctggccgagcaggctgagcgatacgacgtgctctggaactgaacccgcagtatcttccaaaatggtggagtcaatgaagaaagtagcagggatggatgtggagctgacagttgaagaaagaaacctcctatctgttgcatataagaatgtgattggagctagaagagcctcctggagaataatcagcagcattgaacagaaagaagaaaacaagggaggagaagacaagctaaaaatgattcgggaatatcggcaaatggttgagactgagctaaagttaatctgttgtgacattctggatgtactggacaaacacctcattccagcagctaacactggcgagtccaaggttttctattataaaattgtaggttctatactagaagggaaaatgtaagattgaaagttggtccttttagaaccataactttgttctatgtaggttttcaacttttatttaagaataattgttcaatgttagaaggatagttaatattggaatgaaaaggtggttgggctattatgaaaatgtattagcttttgcttatttatattcttttgtttttgtgagacctatcccattcccctcccccaaacggcatacatttcacagtgcttagtgttatatatagacattttattttatgattaataaactgtcatgccattccttggaaccacttgct

SEQ ID NO: 85440 - DNA, 823 bp, Homo sapiens
tatgcgaaacgagataatggtggaccagtgaataacgtagcaggatgatgtggagctgacagttgaagaaagaaacctcctatctgttgcatatagaatgtgattggagctagaagagcctcctggagaataatcagcagcattgaatagaaagaagaaaacaaggatcgacaagacatcgctctgcatgcttcgggactttcgcgtcagctgtgcgtgatagaggcgccgccatttttgctgcccggacgcggagcgagaggctgagagagtcggagacactatccgcttccatccgtcgcgcagaccctgccggagccgctgccgctatggatgatcgagaggatctggtgtaccaggcgaagctggccgagcaggctgagcgatacgacgaaatgtcggagccaatgaaggccgcagggatgcatgcgcagcccgcagatccagacagtaacctcctatctgccgcatatacgaccgcgcccgcagctcgcttacgcctctccagacctctcactagccttctaccgcaagctgcccaccaggtcgcaccagcccccctcctccacgaccgtcccctatcaacatccgctttgagtctcaacctactcgttcaacccgccctcacatcgccgcccccctcctcacaccccactccatcctccaccttccccatccccatccccaccgcttgctctttctctccgccatagctgctctcccttcggtccttctcctcactgctctactccgctctctcacccgccttcacttcctgcctaccactcccatcccgtctctccgctgccacttctcattctcc

SEQ ID NO: 85441 - DNA, 2051 bp, Homo sapiens
tatgcgaaacgagataatggtggaccagtgaataacgtagcaggatgatgtggagctgacagttgaagaaagaaacctcctatctgttgcatatagaatgtgattggagctagaagagcctcctggagaataatcagcagcattgaatagaaagaagaaaacaaggatcgacaagacatcgctctgcatgcttcgggactttcgcgtcagctgtgcgtgatagaggcgccgccatttttgctgcccggacgcggagcgagaggctgagagagtcggagacactatccgcttccatccgtcgcgcagaccctgccggagccgctgccgctatggatgatcgagaggatctggtgtaccaggcgaagctggccgagcaggctgagcgatacgacgaaatggtggagtcaatgaagaaagtagcagggatggatgtggagctgacagttgaagaaagaaacctcctatctgttgcatataagaatgtgattggagctagaagagcctcctggagaataatcagcagcattgaacagaaagaagaaaacaagggaggagaagacaagctaaaaatgattcgggaatatcggcaaatggttgagactgagctaaagttaatctgttgtgacattctggatgtactggacaaacacctcattccagcagctaacactggcgagtccaaggttttctattataaaatgaaaggggactaccacaggtatctggcagaatttgccacaggaaacgacaggaaggaggctgcggagaacagcctagtggcttataaagctgctagtgatattgcaatgacagaacttccaccaacgcatcctattcgcttaggtcttgctctcaatttttccgtattctactacgaaattcttaattcccctgaccgtgcctgcaggttggcaaaagcagcttttgatgatgcaattgcagaactggatacgctgagtgaagaaagctataaggactctacacttatcatgcagttgttacgtgataatctgacactatggacttcagacatgcagggtgacggtgaagagcagaataaagaagcgctgcaggacgtggaagacgaaaatcagtgagacataagccaacaagagaaaccatctctgaccaccccctcctccccatcccaccctttggaaactccccattgtcactgagaaccaccaaatctgacttttacatttggtctcagaatttaggttcctgccctgttggttttttttttttttttttaaacagttttcaaaagttcttaaaggcaagagtgaatttctgtggattttactggtcccagcttttaggttctttaagacactaacaggactacatagaggctttttcagcattactgtgtcgtctccgtgccagatgtggcaagatcaccattagcaaatggaaattacatttgaaagccattagacttataggtgatgcaagcatctaagagagaggttaatcacactatagaggcataagtggtatcagttttcatttttctaattgtttaaactgtgttttataccagtgtttgcaagtaattgggtgttagcttgagatggttaaaggtggtttggggagggacttcgttgtaatggttttgctgtaaaaaatgtttccaactccgctgaaatgttgctgaaaagcatggtgctggtaacagttcaacaatccgtggctgctcattcttgcctactttactctcccactgaagcaggttagcgttgaaggtggtatggaaaagcctgcatgcctgttcaattcttttgtttcttctccttccccctccccctacctccttcccctcactcctcccctccttcgctcgctcaacctcttttgttcagtatgtgtaacttgaagctaatttgtactactggatatctgactggagccacagatacagaatctgtattgttcttactgaaacacagcatggaattaacattaaacttaaataaaacaaacctaaattaaaaatgccaaagagaaaagaaccaaaaaaaaagggggggccggtcaaggagaatccg

SEQ ID NO: 85442 - DNA, 1986 bp, Homo sapiens
tatgcgaaacgagataatggtggaccagtgaataacgtagcaggatgatgtggagctgacagttgaagaaagaaacctcctatctgttgcatatagaatgtgattggagctagaagagcctcctggagaataatcagcagcattgaatagaaagaagaaaacaaggatcgacaagacatcgctctgcatgcttcgggactttcgcgtcagctgtgcgtgatagaggcgccgccatttttgctgcccggacgcggagcgagaggctgagagagtcggagacactatccgcttccatccgtcgcgcagaccctgccggagccgctgccgctatggatgatcgagaggatctggtgtaccaggcgaagctggccgagcaggctgagcgatacgacgaaatggtggagtcaatgaagaaagtagcagggatggatgtggagctgacagttgaagaaagaaacctcctatctgttgcatataagaatgtgattggagctagaagagcctcctggagaataatcagcagcattgaacagaaagaagaaaacaagggaggagaagacaagctaaaaatgattcgggaatatcggcaaatggttgagactgagctaaagttaatctgttgtgacattctggatgtactggacaaacacctcattccagcagctaacactggcgagtccaaggttttctattataaaatgaaaggggactaccacaggtatctggcagaatttgccacaggaaacgacaggaaggaggctgcggagaacagcctagtggcttataaagctgctagtgatattgcaatgacagaacttccaccaacgcatcctattcgcttaggtcttgctctcaatttttccgtattctactacgaaattcttaattcccctgaccgtgcctgcaggttggcaaaagcagcttttgatgatgcaattgcagaactggatacgctgagtgaagaaagctataaggactctacacttatcatgcagttgttacgtgataatctgacactatggacttcagacatgcagggtgacggtgaagagcagaataaagaagcgctgcaggacgtggaagacgaaaatcagtgagacataagccaacaagagaaaccatctctgaccaccccctcctccccatcccaccctttggaaactccccattgtcactgagaaccaccaaatctgacttttacatttggtctcagaatttaggttcctgccctgttggttttttttttttttttttaaacagttttcaaaagttcttaaaggcaagagtgaatttctgtggattttactggtcccagcttttaggttctttaagacactaacaggactacatagaggctttttcagcattactgtgtcgtctccgtgccagatgtggcaagatcaccattagcaaatggaaattacatttgaaagccattagacttataggtgatgcaagcatctaagagagaggttaatcacactatagaggcataagtggtatcagttttcatttttctaattgtttaaactgtgttttataccagtgtttgcaagtaattgggtgttagcttgagatggttaaaggtggtttggggagggacttcgttgtaatggttttgctgtaaaaaatgtttccaactccgctgaaatgttgctgaaaagcatggtgctggtaacagttcaacaatccgtggctgctcattcttgcctactttactctcccactgaagcaggttagcgttgaaggtggtatggaaaagcctgcatgcctgttcaattcttttgtttcttctccttccccctccccctacctccttcccctcactcctcccctccttcgctcgctcaacctcttttgttcagtatgtgtaacttgaagctaatttgtactactggatatctgactggagccacagatacagaatctgtattgttcttactgaaacacagcatggaattaacattaaacttaaataaaacaaac

SEQ ID NO: 85443 - DNA, 2243 bp, Homo sapiens
tatgcgaaacgagataatggtggaccagtgaataacgtagcaggatgatgtggagctgacagttgaagaaagaaacctcctatctgttgcatatagaatgtgattggagctagaagagcctcctggagaataatcagcagcattgaatagaaagaagaaaacaaggatcgacaagacatcgctctgcatgcttcgggactttcgcgtcagctgtgcgtgatagaggcgccgccatttttgctgcccggacgcggagcgagaggctgagagagtcggagacactatccgcttccatccgtcgcgcagaccctgccggagccgctgccgctatggatgatcgagaggatctggtgtaccaggcgaagctggccgagcaggctgagcgatacgacgaaatggtggagtcaatgaagaaagtagcagggatggatgtggagctgacagttgaagaaagaaacctcctatctgttgcatataagaatgtgattggagctagaagagcctcctggagaataatcagcagcattgaacagaaagaagaaaacaagggaggagaagacaagctaaaaatgattcgggaatatcggcaaatggttgagactgagctaaagttaatctgttgtgacattctggatgtactggacaaacacctcattccagcagctaacactggcgagtccaaggttttctattataaaatgaaaggggactaccacaggtatctggcagaatttgccacaggaaacgacaggaaggaggctgcggagaacagcctagtggcttataaagctgctagtgatattgcaatgacagaacttccaccaacgcatcctattcgcttaggtcttgctctcaatttttccgtattctactacgaaattcttaattcccctgaccgtgcctgcaggttggcaaaagcagcttttgatgatgcaattgcagaactggatacgctgagtgaagaaagctataaggactctacacttatcatgcagttgttacgtgataatctgacactatggacttcagacatgcagggtgacggtgaagagcagaataaagaagcgctgcaggacgtggaagacgaaaatcagtgagacataagccaacaagagaaaccatctctgaccaccccctcctccccatcccaccctttggaaactccccattgtcactgagaaccaccaaatctgacttttacatttggtctcagaatttaggttcctgccctgttggttttttttttttttttttaaacagttttcaaaagttcttaaaggcaagagtgaatttctgtggattttactggtcccagcttttaggttctttaagacactaacaggactacatagaggctttttcagcattactgtgtcgtctccgtgccagatgtggcaagatcaccattagcaaatggaaattacatttgaaagccattagacttataggtgatgcaagcatctaagagagaggttaatcacactatagaggcataagtggtatcagttttcatttttctaattgtttaaactgtgttttataccagtgtttgcaagtaattgggtgttagcttgagatggttaaaggtggtttggggagggacttcgttgtaatggttttgctggttgctgaaaagcatggtgctggtaacagttcaacaatccgtggctgctcattcttgcctactttactctcccactgaagcaggttagcgttgaaggtggtatggaaaagcctgcatgcctgttcaattcttttgtttcttctccttccccctccccctacctccttcccctcactcctcccctccttcgctcgctcaacctcttttgttcagtatgtgtaacttgaagctaatttgtactactggatatctgactggagccacagatacagaatctgtattgttcttactgaaacacagcatggaattaacattaaacttaaataaaacaaacctaaattaaaaatgccaaatatcgcgcctccatcctttatacttctaaaataaaatctctagtccaaacacactgacagtattatgtttgcctgaatgtgaaacattcctccttttttcttccataaataatttgtttgcttcccaaagatgtatgttttggaaaaaaattgcctgtagtctggttgtgaagaacactgagtcagttgatggtgtgtcttgtcctccagaccaggcagcaacatggtatttattttaatcattaaagtacaacatgagtagtaca

SEQ ID NO: 85444 - DNA, 1803 bp, Homo sapiens
tatgcgaaacgagataatggtggaccagtgaataacgtagcaggatgatgtggagctgacagttgaagaaagaaacctcctatctgttgcatatagaatgtgattggagctagaagagcctcctggagaataatcagcagcattgaatagaaagaagaaaacaaggatcgacaagacatcgctctgcatgcttcgggactttcgcgtcagctgtgcgtgatagaggcgccgccatttttgctgcccggacgcggagcgagaggctgagagagtcggagacactatccgcttccatccgtcgcgcagaccctgccggagccgctgccgctatggatgatcgagaggatctggtgtaccaggcgaagctggccgagcaggctgagcgatacgacgaaatggtggagtcaatgaagaaagtagcagggatggatgtggagctgacagttgaagaaagaaacctcctatctgttgcatataagaatgtgattggagctagaagagcctcctggagaataatcagcagcattgaacagaaagaagaaaacaagggaggagaagacaagctaaaaatgattcgggaatatcggcaaatggttgagactgagctaaagttaatctgttgtgacattctggatgtactggacaaacacctcattccagcagctaacactggcgagtccaaggttttctattataaaatgaaaggggactaccacaggtatctggcagaatttgccacaggaaacgacaggaaggaggctgcggagaacagcctagtggcttataaagctgctagtgatattgcaatgacagaacttccaccaacgcatcctattcgcttaggtcttgctctcaatttttccgtattctactacgaaattcttaattcccctgaccgtgcctgcaggttggcaaaagcagcttttgatgatgcaattgcagaactggatacgctgagtgaagaaagctataaggactctacacttatcatgcagttgttacgtgataatctgacactatggacttcagacatgcagggtgacggtgaagagcagaataaagaagcgctgcaggacgtggaagacgaaaatcagtgagacataagccaacaagagaaaccatctctgaccaccccctcctccccatcccaccctttggaaactccccattgtcactgagaaccaccaaatctgacttttacatttggtctcagaatttaggttcctgccctgttggttttttttttttttttttaaacagttttcaaaagttcttaaaggcaagagtgaatttctgtggattttactggtcccagcttttaggttctttaagacactaacaggactacatagaggctttttcagcattactgtgtcgtctccgtgccagatgtggcaagatcaccattagcaaatggaaattacatttgaaagccattagacttataggtgatgcaagcatctaagagagaggttaatcacactatagaggcataagtggtatcagttttcatttttctaattgtttaaactgtgttttataccagtgtttgcaagtaattgggtgttagcttgagatggttaaaggtggtttggggagggacttcgttgtaatggttttgctgtaaaaaatgtttccaactccgctgaaatgttgctgaaaagcatggtgctggtaacagttcaacaatccgtggctgctcattcttgcctactttactctcccactgaagcaggttagcgttgaaggtggtatggaaaagcctgcatgcctgttcaatcagcgatgcaagatccgctagac

SEQ ID NO: 85445 - DNA, 2068 bp, Homo sapiens
agcggaggtggaggggtgggctggcgtgatgtccgtcttccgctgggagcgagaggctgagagagtcggagacactatccgcttccatccgtcgcgcagaccctgccggagccgctgccgctatggatgatcgagaggatctggtgtaccaggcgaagctggccgagcaggctgagcgatacgacgtgctctggaactgaacccgcagtatcttccaaaatggtggagtcaatgaagaaagtagcagggatggatgtggagctgacagttgaagaaagaaacctcctatctgttgcatataagaatgtgattggagctagaagagcctcctggagaataatcagcagcattgaacagaaagaagaaaacaagggaggagaagacaagctaaaaatgattcgggaatatcggcaaatgtgtgacattctggatgtactggacaaacacctcattccagcagctaacactggcgagtccaaggttttctattataaaatgaaaggggactaccacaggtatctggcagaatttgccacaggaaacgacaggaaggaggctgcggagaacagcctagtggcttataaagctgctagtgatattgcaatgacagaacttccaccaacgcatcctattcgcttaggtcttgctctcaatttttccgtattctactacgaaattcttaattcccctgaccgtgcctgcaggttggcaaaagcagcttttgatgatgcaattgcagaactggatacgctgagtgaagaaagctataaggactctacacttatcatgcagttgttacgtgataatctgacactatggacttcagacatgcagggtgacggtgaagagcagaataaagaagcgctgcaggacgtggaagacgaaaatcagtgagacataagccaacaagagaaaccatctctgaccaccccctcctccccatcccaccctttggaaactccccattgtcactgagaaccaccaaatctgacttttacatttggtctcagaatttaggttcctgccctgttggttttttttttttttttttaaacagttttcaaaagttcttaaaggcaagagtgaatttctgtggattttactggtcccagcttttaggttctttaagacactaacaggactacatagaggctttttcagcattactgtgtcgtctccgtgccagatgtggcaagatcaccattagcaaatggaaattacatttgaaagccattagacttataggtgatgcaagcatctaagagagaggttaatcacactatagaggcataagtggtatcagttttcatttttctaattgtttaaactgtgttttataccagtgtttgcaagtaattgggtgttagcttgagatggttaaaggtggtttggggagggacttcgttgtaatggttttgctgtaaaaaatgtttccaactccgctgaaatgttgctgaaaagcatggtgctggtaacagttcaacaatccgtggctgctcattcttgcctactttactctcccactgaagcaggttagcgttgaaggtggtatggaaaagcctgcatgcctgttcaattcttttgtttcttctccttccccctccccctacctccttcccctcactcctcccctccttcgctcgctcaacctcttttgttcagtatgtgtaacttgaagctaatttgtactactggatatctgactggagccacagatacagaatctgtattgttcttactgaaacacagcatggaattaacattaaacttaaataaaacaaacctaaattaaaaatgccaaatatcgcgcctccatcctttatacttctaaaataaaatctctagtccaaacacactgacagtattatgtttgcctgaatgtgaaacattcctccttttttcttccataaataatttgtttgcttcccaaagatgtatgttttggaaaaaaattgcctgtagtctggttgtgaagaacactgagtcagttgatggtgtgtcttgtcctccagaccaggcagcaacatggtatttattttaatcattaaagtacaacatgagtagtaca

SEQ ID NO: 85446 - DNA, 2134 bp, Homo sapiens
tatgcgaaacgagataatggtggaccagtgaataacgtagcaggatgatgtggagctgacagttgaagaaagaaacctcctatctgttgcatatagaatgtgattggagctagaagagcctcctggagaataatcagcagcattgaatagaaagaagaaaacaaggatcgacaagacatcgctctgcatgcttcgggactttcgcgtcagctgtgcgtgatagaggcgccgccatttttgctgcccggacgcggagcgagaggctgagagagtcggagacactatccgcttccatccgtcgcgcagaccctgccggagccgctgccgctatggatgatcgagaggatctggtgtaccaggcgaagctggccgagcaggctgagcgatacgacgaaatggtggagtcaatgaagaaagtagcagggatggatgtggagctgacagttgaagaaagaaacctcctatctgttgcatataagaatgtgattggagctagaagagcctcctggagaataatcagcagcattgaacagaaagaagaaaacaagggaggagaagacaagctaaaaatgattcgggaatatcggcaaatggttgagactgagctaaagttaatctgttgtgacattctggatgtactggacaaacacctcattccagcagctaacactggcgagtccaaggttttctattataaaatgaaaggggactaccacaggtatctggcagaatttgccacaggaaacgacaggaaggaggctgcggagaacagcctagtggcttataaagctgctagtgatattgcaatgacagaacttccaccaacgcatcctattcgcttaggtcttgctctcaatttttccgtattctactacgaaattcttaattcccctgaccgtgcctgcaggtgaagagcagaataaagaagcgctgcaggacgtggaagacgaaaatcagtgagacataagccaacaagagaaaccatctctgaccaccccctcctccccatcccaccctttggaaactccccattgtcactgagaaccaccaaatctgacttttacatttggtctcagaatttaggttcctgccctgttggttttttttttttttttttaaacagttttcaaaagttcttaaaggcaagagtgaatttctgtggattttactggtcccagcttttaggttctttaagacactaacaggactacatagaggctttttcagcattactgtgtcgtctccgtgccagatgtggcaagatcaccattagcaaatggaaattacatttgaaagccattagacttataggtgatgcaagcatctaagagagaggttaatcacactatagaggcataagtggtatcagttttcatttttctaattgtttaaactgtgttttataccagtgtttgcaagtaattgggtgttagcttgagatggttaaaggtggtttggggagggacttcgttgtaatggttttgctgtaaaaaatgtttccaactccgctgaaatgttgctgaaaagcatggtgctggtaacagttcaacaatccgtggctgctcattcttgcctactttactctcccactgaagcaggttagcgttgaaggtggtatggaaaagcctgcatgcctgttcaattcttttgtttcttctccttccccctccccctacctccttcccctcactcctcccctccttcgctcgctcaacctcttttgttcagtatgtgtaacttgaagctaatttgtactactggatatctgactggagccacagatacagaatctgtattgttcttactgaaacacagcatggaattaacattaaacttaaataaaacaaacctaaattaaaaatgccaaatatcgcgcctccatcctttatacttctaaaataaaatctctagtccaaacacactgacagtattatgtttgcctgaatgtgaaacattcctccttttttcttccataaataatttgtttgcttcccaaagatgtatgttttggaaaaaaattgcctgtagtctggttgtgaagaacactgagtcagttgatggtgtgtcttgtcctccagaccaggcagcaacatggtatttattttaatcattaaagtacaacatgagtagtaca

SEQ ID NO: 85447 - DNA, 1734 bp, Homo sapiens
actaatgatacgggaatatcagcgcagagtgcatggaaactgagtctaaaggagtcattcacgtaggtgaccttctggatgttcgtgtacaaacagctcagttccagcagtcatctagcagctaggcgcaagttccatatgtttttctgattgctatagatttgaaaggggactaccacaggtatctggcagaatttgccacaggaaacgacaggaaggaggctgcggagaacagcctagtggcttataaagctgctagtgatattgcaatgacagaacttccaccaacgcatcctattcgcttaggtcttgctctcaatttttccgtattctactacgaaattcttaattcccctgaccgtgcctgcaggttggcaaaagcagcttttgatgatgcaattgcagaactggatacgctgagtgaagaaagctataaggactctacacttatcatgcagttgttacgtgataatctgacactatggacttcagacatgcagggtgacggtgaagagcagaataaagaagcgctgcaggacgtggaagacgaaaatcagtgagacataagccaacaagagaaaccatctctgaccaccccctcctccccatcccaccctttggaaactccccattgtcactgagaaccaccaaatctgacttttacatttggtctcagaatttaggttcctgccctgttggttttttttttttttttttaaacagttttcaaaagttcttaaaggcaagagtgaatttctgtggattttactggtcccagcttttaggttctttaagacactaacaggactacatagaggctttttcagcattactgtgtcgtctccgtgccagatgtggcaagatcaccattagcaaatggaaattacatttgaaagccattagacttataggtgatgcaagcatctaagagagaggttaatcacactatagaggcataagtggtatcagttttcatttttctaattgtttaaactgtgttttataccagtgtttgcaagtaattgggtgttagcttgagatggttaaaggtggtttggggagggacttcgttgtaatggttttgctgtaaaaaatgtttccaactccgctgaaatgttgctgaaaagcatggtgctggtaacagttcaacaatccgtggctgctcattcttgcctactttactctcccactgaagcaggttagcgttgaaggtggtatggaaaagcctgcatgcctgttcaattcttttgtttcttctccttccccctccccctacctccttcccctcactcctcccctccttcgctcgctcaacctcttttgttcagtatgtgtaacttgaagctaatttgtactactggatatctgactggagccacagatacagaatctgtattgttcttactgaaacacagcatggaattaacattaaacttaaataaaacaaacctaaattaaaaatgccaaatatcgcgcctccatcctttatacttctaaaataaaatctctagtccaaacacactgacagtattatgtttgcctgaatgtgaaacattcctccttttttcttccataaataatttgtttgcttcccaaagatgtatgttttggaaaaaaattgcctgtagtctggttgtgaagaacactgagtcagttgatggtgtgtcttgtcctccagaccaggcagcaacatggtatttattttaatcattaaagtacaacatgagtagtaca

SEQ ID NO: 85448 - DNA, 1587 bp, Homo sapiens
tatgcgaaacgagataatggtggaccagtgaataacgtagcaggatgatgtggagctgacagttgaagaaagaaacctcctatctgttgcatatagaatgtgattggagctagaagagcctcctggagaataatcagcagcattgaatagaaagaagaaaacaaggatcgacaagacatcgctctgcatgcttcgggactttcgcgtcagctgtgcgtgatagaggcgccgccatttttgctgcccggacgcggagcgagaggctgagagagtcggagacactatccgcttccatccgtcgcgcagaccctgccggagccgctgccgctatggatgatcgagaggatctggtgtaccaggcgaagctggccgagcaggctgagcgatacgacgaaatggtggagtcaatgaagaaagtagcagggatggatgtggagctgacagttgaagaaagaaacctcctatctgttgcatataagaatgtgattggagctagaagagcctcctggagaataatcagcagcattgaacagaaagaagaaaacaagggaggagaagacaagctaaaaatgattcgggaatatcggcaaatggttgagactgagctaaagttaatctgttgtgacattctggatgtactggacaaacacctcattccagcagctaacactggcgagtccaaggttttctattataaaatgaaaggggactaccacaggtatctggcagaatttgccacaggaaacgacaggaaggaggctgcggagaacagcctagtggcttataaagctgctagtgatattgcaatgacagaacttccaccaacgcatcctattcgcttaggtcttgctctcaatttttccgtattctactacgaaattcttaattcccctgaccgtgcctgcaggttggcaaaagcagcttttgatgatgcaattgcagaactggatacgctgagtgaagaaagctataaggactctacacttatcatgcagttgttacgtgataatctgacactatggacttcagacatgcagggtgacggtgaagagcagaataaagaagcgctgcaggacgtggaagacgaaaatcagtgagacataagccaacaagagaaaccatctctgaccaccccctcctcactcctcccctccttcgctcgctcaacctcttttgttcagtatgtgtaacttgaagctaatttgtactactggatatctgactggagccacagatacagaatctgtattgttcttactgaaacacagcatggaattaacattaaacttaaataaaacaaacctaaattaaaaatgccaaatatcgcgcctccatcctttatacttctaaaataaaatctctagtccaaacacactgacagtattatgtttgcctgaatgtgaaacattcctccttttttcttccataaataatttgtttgcttcccaaagatgtatgttttggaaaaaaattgcctgtagtctggttgtgaagaacactgagtcagttgatggtgtgtcttgtcctccagaccaggcagcaacatggtatttattttaatcattaaagtacaacatgagtagtaca

SEQ ID NO: 85449 - DNA, 1657 bp, Homo sapiens
agtccactgataccatacgatagaatcacggggcactacacggtagagtgttctgtgataataggtcgaagcgaaaggaatgcgcagggaacgagctagctgagatgacatcaggcctacttcgagccctaataaaagacatggcctacgggagggataagccgatgagctgaagatatccaactacacgatgtcctatctcgacgtgttcagtcatcggctctcaatctaaccccgaatctcattacctaagaacgtatctttcaatatccaccgtgcaccggtgcgtgcaggttggcaaaagcagcttttgatgatgcaattgcagaactggatacgctgagtgaagaaagctataaggactctacacttatcatgcagttgttacgtgataatctgacactatggacttcagacatgcagggtgacggtgaagagcagaataaagaagcgctgcaggacgtggaagacgaaaatcagtgagacataagccaacaagagaaaccatctctgaccaccccctcctccccatcccaccctttggaaactccccattgtcactgagaaccaccaaatctgacttttacatttggtctcagaatttaggttcctgccctgttggttttttttttttttttttaaacagttttcaaaagttcttaaaggcaagagtgaatttctgtggattttactggtcccagcttttaggttctttaagacactaacaggactacatagaggctttttcagcattactgtgtcgtctccgtgccagatgtggcaagatcaccattagcaaatggaaattacatttgaaagccattagacttataggtgatgcaagcatctaagagagaggttaatcacactatagaggcataagtggtatcagttttcatttttctaattgtttaaactgtgttttataccagtgtttgcaagtaattgggtgttagcttgagatggttaaaggtggtttggggagggacttcgttgtaatggttttgctgtaaaaaatgtttccaactccgctgaaatgttgctgaaaagcatggtgctggtaacagttcaacaatccgtggctgctcattcttgcctactttactctcccactgaagcaggttagcgttgaaggtggtatggaaaagcctgcatgcctgttcaattcttttgtttcttctccttccccctccccctacctccttcccctcactcctcccctccttcgctcgctcaacctcttttgttcagtatgtgtaacttgaagctaatttgtactactggatatctgactggagccacagatacagaatctgtattgttcttactgaaacacagcatggaattaacattaaacttaaataaaacaaacctaaattaaaaatgccaaatatcgcgcctccatcctttatacttctaaaataaaatctctagtccaaacacactgacagtattatgtttgcctgaatgtgaaacattcctccttttttcttccataaataatttgtttgcttcccaaagatgtatgttttggaaaaaaattgcctgtagtctggttgtgaagaacactgagtcagttgatggtgtgtcttgtcctccagaccaggcagcaacatggtatttattttaatcattaaagtacaacatgagtagtaca

SEQ ID NO: 85450 - DNA, 1496 bp, Homo sapiens
aagaactctcaccgttgaagtgtcagtagaaacaattagaaacccccagcagcaagaatccctaaagcatgccacaaggattattgatgaggtggtcaataagtttctggatgatttgggaaatgccaagagtcatttaatgtcgctctacagtgcatgttcatctgaggacccacgcgtccgggaagaaagctataaggactctacacttatcatgcagttgttacgtgataatctgacactatggacttcagacatgcagggtgacggtgaagagcagaataaagaagcgctgcaggacgtggaagacgaaaatcagtgagacataagccaacaagagaaaccatctctgaccaccccctcctccccatcccaccctttggaaactccccattgtcactgagaaccaccaaatctgacttttacatttggtctcagaatttaggttcctgccctgttggttttttttttttttttttaaacagttttcaaaagttcttaaaggcaagagtgaatttctgtggattttactggtcccagcttttaggttctttaagacactaacaggactacatagaggctttttcagcattactgtgtcgtctccgtgccagatgtggcaagatcaccattagcaaatggaaattacatttgaaagccattagacttataggtgatgcaagcatctaagagagaggttaatcacactatagaggcataagtggtatcagttttcatttttctaattgtttaaactgtgttttataccagtgtttgcaagtaattgggtgttagcttgagatggttaaaggtggtttggggagggacttcgttgtaatggttttgctgtaaaaaatgtttccaactccgctgaaatgttgctgaaaagcatggtgctggtaacagttcaacaatccgtggctgctcattcttgcctactttactctcccactgaagcaggttagcgttgaaggtggtatggaaaagcctgcatgcctgttcaattcttttgtttcttctccttccccctccccctacctccttcccctcactcctcccctccttcgctcgctcaacctcttttgttcagtatgtgtaacttgaagctaatttgtactactggatatctgactggagccacagatacagaatctgtattgttcttactgaaacacagcatggaattaacattaaacttaaataaaacaaacctaaattaaaaatgccaaatatcgcgcctccatcctttatacttctaaaataaaatctctagtccaaacacactgacagtattatgtttgcctgaatgtgaaacattcctccttttttcttccataaataatttgtttgcttcccaaagatgtatgttttggaaaaaaattgcctgtagtctggttgtgaagaacactgagtcagttgatggtgtgtcttgtcctccagaccaggcagcaacatggtatttattttaatcattaaagtacaacatgagtagtaca

SEQ ID NO: 85451 - DNA, 1221 bp, Homo sapiens
tatgcgaaacgagataatggtggaccagtgaataacgtagcaggatgatgtggagctgacagttgaagaaagaaacctcctatctgttgcatatagaatgtgattggagctagaagagcctcctggagaataatcagcagcattgaatagaaagaagaaaacaaggatcgacaagacatcgctctgcatgcttcgggactttcgcgtcagctgtgcgtgatagaggcgccgccatttttgctgcccggacgcggagcgagaggctgagagagtcggagacactatccgcttccatccgtcgcgcagaccctgccggagccgctgccgctatggatgatcgagaggatctggtgtaccaggcgaagctggccgagcaggctgagcgatacgacgaaatggtggagtcaatgaagaaagtagcagggatggatgtggagctgacagttgaagaaagaaacctcctatctgttgcatataagaatgtgattggagctagaagagcctcctggagaataatcagcagcattgaacagaaagaagaaaacaagggaggagaagacaagctaaaaatgattcgggaatatcggcaaatggttgagactgagctaaagttaatctgttgtgacattctggatgtactggacaaacacctcattccagcagctaacactggcgagtccaaggttttctattataaaatgaaaggggactaccacaggtatctggcagaatttgccacaggaaacgacaggaaggaggctgcggagaacagcctagtggcttataaagctgctagtgatattgcaatgacagaacttccaccaacgcatcctattcgcttaggtcttgctctcaatttttccgtattctactacgaaattcttaattcccctgaccgtgcctgcaggttggcaaaagcagcttttgatgatgcaattgcagaactggatacgctgagtgaagaaagctataaggactctacacttatcatgcagttgttacgtgataatctgacactatggacttcagacatgcagggtgacggaagagcagaataaagaacgtgagactggaaacaaatagtgggaatagccacagggactcttttccacgcctttctcacacttggggatcctcggttggagacccctgtttttggtgaaaaaggggccgggtgttttacggtcataggaaatgctgcccgctttctaagagaggttg

SEQ ID NO: 85452 - DNA, 989 bp, Homo sapiens
tatgcgaaacgagataatggtggaccagtgaataacgtagcaggatgatgtggagctgacagttgaagaaagaaacctcctatctgttgcatatagaatgtgattggagctagaagagcctcctggagaataatcagcagcattgaatagaaagaagaaaacaaggatcgacaagacatcgctctgcatgcttcgggactttcgcgtcagctgtgcgtgatagaggcgccgccatttttgctgcccggacgcggagcgagaggctgagagagtcggagacactatccgcttccatccgtcgcgcagaccctgccggagccgctgccgctatggatgatcgagaggatctggtgtaccaggcgaagctggccgagcaggctgagcgatacgacgaaatggtggagtcaatgaagaaagtagcagggatggatgtggagctgacagttgaagaaagaaacctcctatctgttgcatataagaatgtgattggagctagaagagcctcctggagaataatcagcagcattgaacagaaagaagaaaacaagggaggagaagacaagctaaaaatgattcgggaatatcggcaaatggttgagactgagctaaagttaatctgttgtgacattctggatgtactggacaaacacctcattccagcagctaacactggcgagtccaaggttttctattataaaatgaaaggggactaccacaggtatctggcagaatttgccacaggaaacgacaggaaggaggctgcggagaacagcctagtggcttataaagctgctagtgatattgcaatgacagaacttccaccaacgcatcctattcgcttaggtcttgctctcaatttttccgtattctactacgaaattcttaattcccctgaccgtgcctgcaggttggcaaaagcagcttttgatgatgcaattgcagaactggatacgctgagtctgaaatgtgacgggatccgctagagtcgc

SEQ ID NO: 85453 - DNA, 1618 bp, Homo sapiens
tatgcgaaacgagataatggtggaccagtgaataacgtagcaggatgatgtggagctgacagttgaagaaagaaacctcctatctgttgcatatagaatgtgattggagctagaagagcctcctggagaataatcagcagcattgaatagaaagaagaaaacaaggatcgacaagacatcgctctgcatgcttcgggactttcgcgtcagctgtgcgtgatagaggcgccgccatttttgctgcccggacgcggagcgagaggctgagagagtcggagacactatccgcttccatccgtcgcgcagaccctgccggagccgctgccgctatggatgatcgagaggatctggtgtaccaggcgaagctggccgagcaggctgagcgatacgacgtgctctggaactgaacccgcagtatcttccaaaatggtggagtcaatgaagaaagtagcagggatggatgtggagctgacagttgaagaaagaaacctcctatctgttgcatataagaatgtgattggagctagaagagcctcctggagaataatcagcagcattgaacagaaagaagaaaacaagggaggagaagacaagctaaaaatgattcgggaatatcggcaaatggttgagactgagctaaagttaatctgttgtgacattctggatgtactggacaaacacctcattccagcagctaacactggcgagtccaaggttttctattataaaatgaaaggggactaccacaggtatctggcagaatttgccacaggaaacgacaggaaggaggctgcggagaacagcctagtggcttataaagctgctagtgatattgcaatgacagaacttccaccaacgcatcctattcgcttaggtcttgctctcaatttttccgtattctactacgaaattcttaattcccctgaccgtgcctgcaggttggcaaaagcagcttttgatgatgcaattgcagaactggatacgctgagtgaagaaagctataaggactctacacttatcatgcagttgttacgtgataatctgacactatggacttcagacatgcagggtgacggtgaagagcagaataaagaagcgctgcaggacgtggaagacgaaaatcagtgagacataagccaacaagagaaaccatctctgaccaccccctcctcactcctcccctccttcgctcgctcaacctcttttgttcagtatgtgtaacttgaagctaatttgtactactggatatctgactggagccacagatacagaatctgtattgttcttactgaaacacagcatggaattaacattaaacttaaataaaacaaacctaaattaaaaatgccaaatatcgcgcctccatcctttatacttctaaaataaaatctctagtccaaacacactgacagtattatgtttgcctgaatgtgaaacattcctccttttttcttccataaataatttgtttgcttcccaaagatgtatgttttggaaaaaaattgcctgtagtctggttgtgaagaacactgagtcagttgatggtgtgtcttgtcctccagaccaggcagcaacatggtatttattttaatcattaaagtacaacatgagtagtaca

SEQ ID NO: 85454 - DNA, 830 bp, Homo sapiens
tatgcgaaacgagataatggtggaccagtgaataacgtagcaggatgatgtggagctgacagttgaagaaagaaacctcctatctgttgcatatagaatgtgattggagctagaagagcctcctggagaataatcagcagcattgaatagaaagaagaaaacaaggatcgacaagacatcgctctgcatgcttcgggactttcgcgtcagctgtgcgtgatagaggcgccgccatttttgctgcccggacgcggagcgagaggctgagagagtcggagacactatccgcttccatccgtcgcgcagaccctgccggagccgctgccgctatggatgatcgagaggatctggtgtaccaggcgaagctggccgagcaggctgagcgatacgacgaaatggtggagtcaatgaagaaagtagcagggatggatgtggagctgacagttgaagaaagaaacctcctatctgttgcatataagaatgtgattggagctagaagagcctcctggagaataatcagcagcattgaacagaaagaagaaaacaagggaggagaagacaagctaaaaatgattcgggaatatcggcaaatggttgagactgagctaaagttaatctgttgtgacattctggatgtactggacaaacacctcattccagcagctaacactggcgagtccaaggttttctattataaaatataagaggactaccacaggataacgccaggggggtcaagtcacgacaggaaggaaggagcggagaacagcatagtggatgataacagtgcgacgtgataagtcggctaccgagacagagtaatgagatgc

SEQ ID NO: 85455 - DNA, 632 bp, Homo sapiens
  misc_feature (632)..(632): n is a, c, g, or t
tatgcgaaacgagataatggtggaccagtgaataacgtagcaggatgatgtggagctgacagttgaagaaagaaacctcctatctgttgcatatagaatgtgattggagctagaagagcctcctggagaataatcagcagcattgaatagaaagaagaaaacaaggatcgacaagacatcgctctgcatgcttcgggactttcgcgtcagctgtgcgtgatagaggcgccgccatttttgctgcccggacgcggagcgagaggctgagagagtcggagacactatccgcttccatccgtcgcgcagaccctgccggagccgctgccgctatggatgatcgagaggatctggtgtaccaggcgaagctggccgagcaggctgagcgatacgacgaaatggtggagtcaatgaagaaagtagcagggatggatgtggagctgacagttgaagaaagaaacctcctatctgttgcatataagaatgtgattggagctagaagagcctcctggagaataatcagcagcattgaacagaaagaagaaaacaagggaggagaagacaagctaaaaatgattcgggaatatcggcaaatggctatgtgacattctggatgtactggaccacctcttccn

SEQ ID NO: 85456 - DNA, 692 bp, Homo sapiens
agcggaggtggaggggtgggctggcgtgatgtccgtcttccgctgggagcgagaggctgagagagtcggagacactatccgcttccatccgtcgcgcagaccctgccggagccgctgccgctatggatgatcgagaggatctggtgtaccaggcgaagctggccgagcaggctgagcgatacgacgacttaaaacaggagatctcgaagttcctgtaacctttctctggctccatcacccgtgggttctgatggatagaaccaggaggccacgactctgagagttcgagcctttgtagagcccgagcctccgtccccccgtttgtaaaaacgatgactttacagtttgtgcgcaccgtgatgacaaatgggaagacctgttgaaataaagttatttccaatagtgttcagtaactgtattttggttgactctgcaggctcggaatgctggtctgtacttcgtgggggatcttaacctattccaggcgctcggctgaggctgggttttttgagttatgaaggttgaagatcctgttgctttctttttttccgttttaaataaatgggtttatgtagaaatattagtaggtcctctttgttcgttgttcttttgcccctaatgggttctccagtcctttttcagaacttcatcgaatgtccattgtgtctgtccagtcattgtcaggaagttta

SEQ ID NO: 85457 - DNA, 247 bp, Homo sapiens
agcggaggtggaggggtgggctggcgtgatgtccgtcttccgctgggagcgagaggctgagagagtcggagacactatccgcttccatccgtcgcgcagaccctgccggagccgctgccgctatggatgatcgagaggatctggtgtaccaggcgaagctggccgagcaggctgagcgatacgacggtgagttgggggggcaacggggggctggaattctcggaccctctgccgccgcccacagagg

SEQ ID NO: 85458 - DNA, 568 bp, Homo sapiens
ggagtaaaggggccccaaaagcggcagaaggggatgtgcccacccaaacttggaattcaccgtgggcaagtactagactggtccttgctgactatgtcaagaaatcttttgactactgttaggttcttagctattcctgtagcagcctctgcaatccttagcatcatagtctttactccagtgatttcaagggagagcagttcctacccaaacctccagcaactctgcaccctgcattactgagagctgcatggtctcctgtgttctgactgcaggccttaactccaccttgggactgaccactcagccttgaggctgaggcttacacattttgattctcaatgcatttatctataaaatggaatctgttaggaaaaacctgaactgttactcctgtacagtgctttggttggacctgcatctaaaagactccttccaaatgaagactgtatttggagtccagcttttcctctgctcaaggagtttcataacgattacagagtctttgtgggacaatatagatagataatttatgttcaaatatacaaatggaagccctgttagggag

SEQ ID NO: 85459 - DNA, 436 bp, Homo sapiens
tttgtattttttgtaggacggggttttgccatgtttcccaggctggtctcaaactcctgagctcaggcaatcacctgcctcagcctccaaaagtgctggaattacaagcatgagccactgtgcccagcctaatttgtttaaaatgcatttaaatgtggctgattaacaacatgagtttatctttatttcatgaacctgagtgcataagcaaactggagggtataaaagacaatagaggagaatatagaagcagacatgagatgtcaagtttttggtggtgagaaaatagaagagtggtgactgacttagcagagcctgcagaaaagtatactggcacaaggatgttcctgggaagacagaggccttggagacagtgggcattatggaagaaagagggctgaaaatggggattcattgaaattctaatgtcagatcc

SEQ ID NO: 85460 - DNA, 648 bp, Homo sapiens
tgtacagaagggcctcaggacttggcaatttagggaggaaatcaaagaaagggaggagtcagagttctgtagaaactggctggctcgcatctgtaatcccagcacttcgggaggccaaggcaggcggatcatgaggtcaggagttcgagaccagcctggccaatatggtgaaaccccgtctctactaaaaatacaaaaattagcaggcatgcgtgcccgcctgtagtcctggctgctagggaggctgaggcagaagaatcacttgaacctgggaggtggaggttgcagtgagccaaaatcgtgccactgcactccagcctgggtgacaaagcgagactctgtctcaaaaaaaacaaaaacaaaaacaaaacaaaacaaaacaaaagcgcagttctgtagcaactaaaataaggagtgtagaagaaaggctggatgcagaaatttatttctagtgtatttatttctagtgtatttgcatataaatgttttaaaagaagactagaatatatggctatggggccgagggaaacctttgtttggacatgaaaaaaaatccaaaatctatttatagagctgtcaaattagcggaatgtgcaactttctgagaataactgtacaataatatactattctaatagtgtggggtag

SEQ ID NO: 85461 - DNA, 1006 bp, Homo sapiens
ccctggagcgcagtcactttacaaccaccttcctccccaaatgccagcatggacaaattagatccagaagccctgcacacagccatcctcagggagaaagcacagttggctgggccttgattcacgaagggggcctgccccatgccacggcggtccctcctggcacccgcctcctgataaccctcgtgctgtgtcgataccacagatcctgttccgggccaaagacctggatcccgagcccaggagccacatcgtgcgagggaaccacacgcagtcggccctgctggcaggcctgcgcaagttcgtgctctacgagctccaggtgctggcgttcacccgcatcgggaacggggtccccagcacgcccctcatcctggagcgcaccaaagacgatgccccaggcccaccagtgaggctcgtgttccccgaagtgagactcacctccgtgcggatagtgtggcaacctccggaggagcccaacggcatcatcctggggtaccagattgcctaccgcctggccagcagcagcccccacaccttcaccaccgtggaggtcggcgccacagtgaggcagttcacagccaccgacctggccccggagtccgcatacatcttcaggctgtccgccaagacgaggcagggctggggggagccactggaggccaccgtcatcaccaccgagaagagagagcggccggcaccccccagagagctcctggtgccccaggcagaagtgaccgcacgcagcctccggctccagtgggtcccgggcagcgacggggcctcccccatccggtacttcaccatgcaggtgcgagagctgcctcggggtgagtggcagacctactcctcgtccatcagccatgaggcgacagcatgcgtcgttgacagactgaggcccttcacctcctacaagctgcgcctgaaagccaccaacgacattggggacagtgacttcagttcagagacagaggcggtgaccacgctgcaggatggtgagcaaccc

SEQ ID NO: 85462 - DNA, 800 bp, Homo sapiens
ggacctgaaaaatagaatccattgacttgagcattagggagtcattgacattgttcacttatattatggatcaaatgttaaataggtattaattttttaaatatcagcagtggtaagatttttaggtcttataaaagagcatgcaaatccatgtcaaaacatttaagataaagaaaatttggcatttaaaaagaccctccttatataataagaaaatgtagttttgaaaggtgcttttatgtaatatcagtttcccagggctgccttaacaaagtactacaaactgggtggcttaaaacagcagatatgtgttgcctcgcagttctggaggccagaagtctgaagtcatggtgttggcagagccatgctccctctgaagggacctgggaaggatctgtcccaggtctctctcctaacttctggtagtctcaggcattccatggcttgtaaatgtatcactggagtcctttgtcttcataccatctttctgtgtgtaattgtgtccacatttcctctttttataaggacaccagtcgtaatgggttagaacccaccctaagtattccttttaacttgattacctctctaaagaccctgtttccaaataagattacattctgagtcactgggagttaggacttcaacatatctttttgggggaacaaaattcagcccgtatcggtgcttcagtttgacagctacacatcataccaagaaaacccttcagttgtttatagtgtctagtctcctaaattatttctctagagactcttgctgaatcctagatttttaatgatatg

SEQ ID NO: 85463 - DNA, 455 bp, Homo sapiens
tcaccgtgttagccaggatgcataacacctcctttgaagtagacacaaccattgttctcagttcacagattagaaaactgagacttaagtgcgtcactgtctagtgcagttctaccctcacgacaaagccatgtttcttccccgtgaatgaagagaaaggcaaatttacagtatttgcctttcgggactcattggtattctctcttgaaacacttcttactgcataattcagagttctcggcagcgtatccatctcttagaaagggctcttcctgggaaggctggaaagaaaggctctcttctaacgaggccggtgtctccagcactccactaaatatgaagaggtacttgcttgatttttacaaaatcagctttgtgagaggatgagtggtccagcccctcgcccagctgtgtgagtcctgagcacctgcgcttcagagtaaggctgttggacc

SEQ ID NO: 85464 - DNA, 218 bp, Homo sapiens
catttttatttgtcctcaatcaaccctctgatagtcctgaaacagatgcttttaaatgggaactgcggctcagtattttttacaaatatgcacaataaaagagaaacagtttcaaattacttgtgatatttaaaaaaaaaataagtcagcaactaacagaagaaggtttccactgacattcaagagtagcaaaccatcccaagattaacagtttgtgc

SEQ ID NO: 85465 - DNA, 547 bp, Homo sapiens
atactggcatttgtgtcgttttggatgagtactcaagaccaaactcctcttctgtaaagtggggtaataatctctaccctgcttgcacatgggattctttcaaggagcaaactgaggtctcgcatgggagacagctgagcaacctgcaaggttgtgggaaggaggaggggtggtctgagccaccacgctgtcccagtgtgtcaaggagcttgatagcctctttccacacctcgattccttccactccaagggacagtaacttaatcacctgatttgtaactttgggaataataaactgggcatgcacttacctgatgccctcagctataatagttcacacaagaggagaaaaacagatagccctatagaatgctacaggagatttcaatcttctttagctgaaactccctgacttcccatcatgtctgagaatttggcaaatataaacccagctgtgtgtttagggatctttgagtttctaaatcatcacactatccctacacagctttgctggaggttttgcaggtttccctttccccggtagagt

SEQ ID NO: 85466 - DNA, 375 bp, Homo sapiens
tgattacttcctcattcctttgatatactacctcaggtaacctcctaagaaacagggtatggggatatattttcaaattcctgcatagctggaaatgtcttaattctatcctcacacttaactgatagtttggctaagtacagaattctaagtaatttgttttagccaattgctttaggtgagcagacaaaaagttggcaattaaacttggggatccttaaaggtcagaatgtggaagaccttcttcctgtgtagcaccaactctgcactagctgtctttgttttgtttattacagacggttcattcaatgtttttttgtttgtttgtttgtttttttgagacagagtttcactcttgctgcccaggctggagtg

SEQ ID NO: 85467 - DNA, 341 bp, Homo sapiens
agagcttccctcggctgctggctgcaaggtggtggaactcggtttattgcctggttggcccctctgcaggatacacactgcgtggtgctggttggaatactgttctaatgaagtcaccatctgggtccactggttggtcccctgtcgtgacaattgccttcatcctgtccaatcagccacctcacaaaccttggccagggatcccatggagagtctgactacagagaaatttaaagatatttgtcttcttgtctgtggcctaagcagcctgaatttcatactatggtaatactgacagaatcacctgtttatggagtggtgaatgaacctgtttatagtaa

SEQ ID NO: 85468 - DNA, 1739 bp, Homo sapiens
tgagccaggtgtgggatatagtctcgtggtgcgccgtttcttaagccggtctgaaaagcgcaatattcgggtgggagtgacccgattttccagggactttataattgatggcttatcagtggagagaaatcatgttcttgttagaataaatcttgttggtgggccattggaacggattttgcctccgaggttactcgaaaagagtgataatccatatccttggccaatgttttcatcatatccattgccaaactgctatctgtcagacattacaagaaatgctggtataaaacaagacaatgatcttgacaagcttttattatgcctcaaaatatctgataaacaaactgaatggatagaaaactgccaaagacaattttgcaaaatgatgaaagccaaacctgatataatcagtggagaggtgctcccaatttttaggtttttcctgtgtgagataccatcgagagtataaaatgaaccttaatagaattacttgaaaaatttgtgcttcatctcactgaaagcccatctgaatgctacttcccttcagtggagtatacagctactgatgcaaatgtgaagaatgaaagtctttcatctgtgcagcagcttggcattaaaatgactgtcaggtatggcaaattcctcagtctcttaaaagatggtgcagaaaatgatcttacctgggttttaaagcattgtgagagattcctgaaacagcagcaaacttccataaaatcttctcttctctgcctgcaagggaattatgctggccatgactggtttgtatcttctctgttcatgataatgttgggagacaaagaaaaaacattccaatttcttcatcaattctccaggcttctgacttctgcttttctttggttgccaaggctacatatttctagttaccttcctaatgacactgtagaatctggcatccatccagtatatttttgcagcacccattatattgaaatgctactgaaggctgagttgcctcttgtgttttcagcttttcacatgtctggttttgcaccatcacagatttgcctgcaatggataacccagtgtttttggaattacttagattggatagaaatctgccattatattgctacttgtgttttccttggtcctgattatcaagtgtatatctgtatagctgtattcaaacatttacagcaagacattctacagcacactcagactcaagatctgcaagttttcctaaaagaagaagcactgcatgggtttcgagtgagtgattattttgaatacatggaaattttggaacaaaactaccgaacagtgctgctgagagacatgcggaacattagactgcagagcacatagatcatgagacacacggtttaaatttaggttttatttatttttaaacacagcaggggggcttgatgtttttctgtgtctgtaacaacatttactttgtgaatatacatattgtaaatactgagaagtataacgatatatttaagtaggtatgagctcaatttgtgaattcatttttgtaaatttgttgttttgtaaggttattatagaatcagatctagcttacttttagttcttattcatgtttaagagttagtcctggccaggcgcggtggctcactgcctgtaatcccagcactttggtaggctaaggcaggaggattgcttgaggccaggagttaaagaccagcctgggcaataaagcgagaccctgcctctgcaaaaaaaaa

SEQ ID NO: 85469 - DNA, 457 bp, Homo sapiens
catttactttgtgaatatacatattgtaaatactgagaagtataacgatatatttaagtaggtatgagctcaatttgtgaattcatttttgtaaatttgttgttttgtaaggttattatagaatcagatctagcttacttttagttcttattcatgtttaagagttagtcctggccaggcgcggtggctcactgcctgtaatcccagcactttgggagtctgaggtgggcggatcacgaggtcaagagatcgagaccatcctggccaaaatggtgaaacctcgtctctgctaacaatactgaaattagctgggtgcagtgatgcgcctgtagtccctgctacttgggaggctgaggcaggagaatcgcttgaacccgggaggcggaggttgcagtgagccaagattgtgcccctgtactccagccaggccacagagtgagactctgtctcaaaaaaa

SEQ ID NO: 85470 - DNA, 302 bp, Homo sapiens
  misc_feature (7)..(7): n is a, c, g, or t
agcaggnggagactgccacctcagcgaggggagctgcccgctcaggcccttgaccgcgtacttcccgcagcagggtacagccgctctcttccgctgctgcttctatggttgaccaaggcgtacatatgttctagttaccttcctaatgacactgtagaatctggcatccatccagtatatttttgcagcacccattatattgaaatgctactgaaggctgagttgcctcttgtgttttcagcttttcacatgtctggttttgcaccatcacaggtaatccataagggagtagcatttctcca

SEQ ID NO: 85471 - DNA, 1022 bp, Homo sapiens
tgagccaggtgtgggatatagtctcgtggtgcgccgtttcttaagccggtctgaaaagcgcaatattcgggtgggagtgacccgattttccagggactttataattgatggcttatcagtggagagaaatcatgttcttgttagaataaatcttgttggtgggccattggaacggattttgcctccgaggttactcgaaaagagtgataatccatatccttggccaatgttttcatcatatccattgccaaactgctatctgtcagacattacaagaaatgctggtataaaacaagacaatgatcttgacaagcttttattatgcctcaaaatatctgataaacaaactgaatggatagaaaactgccaaagacaattttgcaaaatgatgaaagccaaacctgatataatcagtggagaggtgctcccaatttttaggtttttcctgtgtgagataccatcgagagtataaaatgaaccttaatagaattacttgaaaaatttgtgcttcatctcactgaaagcccatctgaatgctacttcccttcagtggagtatacagctactgatgcaaatgtgaagaatgaaagtctttcatctgtgcagcagcttggcattaaaatgactgtcaggtatggcaaattcctcagtctcttaaaagatggtgcagaaaatgatcttacctgggttttaaagcattgtgagagattcctgaaacagcagcaaacttccataaaatcttctcttctctgcctgcaagggaattatgctggccatgactggtttgtatcttctctgttcatgataatgttgggagacaaagaaaaaacattccaatttcttcatcaattctccaggcttctgacttctgcttttctttggttgccaaggctacatatttctgtaagacttcaatctgtttttaaaggagggtttgaaattttaagaacattatacttacattcactggggcataattttatttgtgaaggactttgtaataaattatactcatttttcta

SEQ ID NO: 85472 - DNA, 391 bp, Homo sapiens
agctggtgggggcagcccggtgtggactgcagactgcctgctagcttcttccttttcttcccaacgcgtaagaagcaatccttgagtagagacatgtaatagatgctcagacctggctggacatggtggtttatgtctgtaatcccagaactttgggaggctgaggcaaagccatgagttcaagaccagcctgggcaacatagtgagaccctgtcagtgcccccccaccccccaaaaaaaaaaattacccaggtgtggtggggcatgtctgtagtcctagctacacaagaggctgagatgggaagattgcttgagaccaggagtttgaggctacagtgagctgattgcaccactgcactccagcctaggtggcagagtgagaccctgtcta

SEQ ID NO: 85473 - DNA, 272 bp, Homo sapiens
gttcccctctcttgcctgttttcttttttatttatttcttttataaaattattaaccaatgtctagaattaagcaagcaattttcactttttgccgaagagctgattataaaaatacttatttttaatttaagttacatttcctttaaaatattagttaaaaaattcaaacagtttttaaaagggcttttctctttctttctttctttgttttttttttctttctttctctttctttctctctctttcttttttctttctttcttgtcgacc

SEQ ID NO: 85474 - DNA, 668 bp, Homo sapiens
gcattttttttccccatatgagctttaaaattagcttgtctggttcttgaggggaaattggtacttttatcaagatcaagttaaataaatagattaataagaacaggcttaatcatacggaggcttctatccaaaaacatggctatatgtcttttttttgagatggggtctcactctgtcacccaggctgaagtgcagtggtgcattcttggctcactgaaacctctgcctcccgagtagctgggattacaggctcccaccaccatgcccagctaatttttgtatttttagtagagacggggtttcaccatgttggccaggctggtcatgaacggttatgtgtttttccatttgttccaatggtctttgtatgtctcagttttcaaatttttaccatttatgtctcgcatatttttaaaggtttgtctcttggatgttttaagtgggattcttctcctgctatactttgtaactagttgtgtatagaaaagctattgatttcagctatcttgttgaattatcatgggggaatatcttttatttgactcttttgatatacctggaaaaatattgtttggctacttaatttttacacttattcttgtttaaatgctctgaaatatccagaatattaaatatggtgggagtaaaattgcttgtctgaatcc

SEQ ID NO: 85475 - DNA, 498 bp, Homo sapiens
ctattcatacctacccagactaacaagtagcaggcagatgataaatatatttttaggtggttaggtgatgaaacacctcctccaaatgaaggcataaacaacaatgcatggggatccaagaaacagtgactccaacccaagagagcagtgaacaaatccacaggacagcagctaagtaggaggcctaaacatcacctggggcagatggggcgagagagcagagagcttgggaaagaagtctctgaggagaaagaatgaggcaataagtcagatgcgtatttgcggacctcagaaaaatttgagtacataggaaacaatagatgaaggatagaaataatccattcagattctctcctttgcatgatgaccacattaaacttacagagtaagaaatgtcattctagatttgattctactgtttgtctttgcagtgagctatgtttttttataacatgtagaagtgaaataaacttgtcacaaaaatgcaaaatgtgtcac

SEQ ID NO: 85476 - DNA, 103 bp, Homo sapiens
aaagacagtctcaggacaacttatcatcaagactaaataaataaatgctccccccaacaaccccccagcctgaggaagtaagttccctccttttttgcggggg

SEQ ID NO: 85477 - DNA, 414 bp, Homo sapiens
atttttaaaaaatgattagtaaattaggaacagaagggaaaagccttaattttattacaaaaaaaaaaaatagaacaaacattattctgaattaactaatgttagaagctttccctttaaagtcagaaactggccttgcagctggtctgcctgagacctctagtgccaaccccaataccccacgaagtttaatttccactcacgaaattccactttcgttttcattataaaatgaaaaagccctcacaaaccatgaaaaacttgccagatttcaagcacaattgtgcactggtaaaaaggaactgccctcagatgatacagcaaacattatctgttaaaacagatgataaaaaaaatcttcagttttcctgaaagaaagtagaaataggcaatatctctgatactaaagaggta

SEQ ID NO: 85478 - DNA, 603 bp, Homo sapiens
tgaaggactggtcaggggccctaaactcttatctaatatttctggagaaataaatggcaccaaatgcaaacatcctttggaatactcatatagaattcctgactagtcatcttctaaatccacccttctaacttaaggtcctaatcttctcttccactactttagaatttctagagcctctattttactccacgagaactacaattctgtagtgatctccatggattgcaaattagactaaatggatgtctaaatatttggaaaagtgttttttttgtttgtttgtttgtttttcatgaaaccgaggaggacactgtctcctcaaatccattgctctgggtctccacacctgtaaaggaataattaggggtaaaacattggcattctgattctgtcctgctgaggtcaccattctttacataacttttaatacagcaagacaaaccaaaaaacgacaaaaaaccaagtgtagtttgattgatctgctaaggatttttcttttgtttattgtttatgacatatatgtattttgtattagtcagcttatgctgccagaacaaaataccatagatttgatggctttacaggaatttgtttctcaca

SEQ ID NO: 85479 - DNA, 641 bp, Homo sapiens
tccagatcagccagcattactaacctgtcactggatagatctggttctcctatggtaccttcatatgagacatctgtcagtccccaggctaaccgaacatatgttaggacagagaccactgaggatgaacgcaaaattcttctggacagtgtgcagttaaaagacctgtggaaaaaaatctgccatcacagcagtggaatggagtttcaggatcaccgctactggttgagaacgcatcccaactgcattgtaggaaaggaattagtcaactggctaatccgaaatgggcatattgccacaagggcacaagctatagcaattggacaagcaatggttgatggacgttggctggattgtgttagtcatcacgaccagcttttcagagatgagtatgcgctgtatagaccactgcaggtacttttcagtgtttactgccaattagaatgtagcaagcttattttatagtctttcttcatcagtgggaataaaaagtagtttattagaagatgatttttctaacattttttcctgctgtttgaggaaagttaaaactttttttacttggtaggcagcagtgatgaaaaagctgccattagaatcaaacattttattgtttactttaaatttgatcagacaataaa

SEQ ID NO: 85480 - DNA, 475 bp, Homo sapiens
ttacttatccaagggccatttgaaattctaactctgattagaactgaaaaaaaatattttaaggttgtgtcttatctggtacttaactattctgactgacttttaaaacttttcatttttgtgggtcttgattcagggcacaagctatagcaattggacaagcaatggttgatggacgttggctggattgtgttagtcatcacgaccagcttttcagagatgagtatgcgctgtatagaccactgcaggtacttttcagtgtttactgccaattagaatgtagcaagcttattttatagtctttcttcatcagtgggaataaaaagtagtttattagaagatgatttttctaacattttttcctgctgtttgaggaaagttaaaactttttttacttggtaggcagcagtgatgaaaaagctgccattagaatcaaacattttattgtttactttaaatttgatcagacaataaa

SEQ ID NO: 85481 - DNA, 514 bp, Homo sapiens
aattgtgtgagttagctaccataaagaaatccaagttaggtttccttttatgagtctaaaaatcacaggaaaacatctgaaaaggtatatagcatttttctcaagggtaactacttgctgttaatgtgattgcaggacagtgtgcagttaaaagacctgtggaaaaaaatctgccatcacagcagtggaatggagtttcaggatcaccgctactggttgagaacgcatcccaactgcattgtaggaaaggaattagtcaactggctaatccgaaatgggcatattgccacaaggtattctgatcttagaaggtttcaatattatttgtttattttgaatgagaaaacatatttgaagatagtaagagttacagatttctttgtagagttagggtgctctttgttttatgtaattgatggtttagggtgctaattacttaaccctcctccaatctgagttttaaccagcagagaacagatgcaaggagtacaaggagccaaataggatcttaatt

SEQ ID NO: 85482 - DNA, 496 bp, Homo sapiens
tcgtttcgtcctttacttatccaagggccatttgaaattctaactctgattagaactgaaaaaaaatattttaaggttgtgtcttatctggtacttaactattctgactgacttttaaaacttttcatttttgtgggtcttgattcagggcacaagctatagcaattggacaagcaatggttgatggacgttggctggattgtgttagtcatcacgaccagcttttcagagatgagtatgcgctgtatagaccactgcaggtacttttcagtgtttactgccaattagaatgtagcaagcttattttatagtctttcttcatcagtgggaataaaaagtagtttattagaagatgatttttctaacattttttcctgctgtttgaggaaagttaaaactttttttacttggtaggcagcagtgatgaaaaagctgccattagaatcaaacattttattgtttactttaaatttgatcagacaataaaaaaggaaaa

SEQ ID NO: 85483 - DNA, 921 bp, Homo sapiens
ctactgttcttactgattcagctcagtttccttccttccttccttccttccttccttccttccttccttccttccttccattctttcgttctttctttctttctaatgtaggccactgtcatctcttttctggattacttaacatacttccttatttgctttctgtggtgctagtttactttgccaatgaattcttatactgtagctggagtaaatgtcttagaataaaatcgactctttaaaatgaatcattgcatgatttttaaacatgtcttttactgtctgcctctcactgtacattctattccaattgaatcttgatttccttagttccttaattatgttctctcattctaggccctcctcatatgcctaactgcctgctctaccttttccctgttttcttgattattgtgctacttctacaaagcctttctgaatttagacatcatattctctgagaaatcttatctttaggcctgattattagttgctccttgtgtgctgtgttgtagttataattgcctgtaaatgtgtacaagagaccataagctctttgagagaatcatgtctgtctggttggttgatgtatcggtggtgaaatttcaagcattatactgctttgaaaatgtcagagaaaaatttagcatgcttttcatagtagaaaaatttaaataccattatttgactttcaagattctgaattttatatagtgttagtgattttttaacatttaaattttcgaaagaaaaatatgcgatatcatcattcatatggttaatttaactcagctatgtggagacatataagaggagtctcatgtttacagatgagttgtccgagtttgttacctagtggtaaaatcatgtttttacatggtcatataagaaatgtaagttcagtttttaataataccagac

SEQ ID NO: 85484 - DNA, 457 bp, Homo sapiens
acctaccaaattgcagccaaaaaaagaaaacatggaatgtggagttcaaaagtttcttagacaacttcctctcagacttggttcagaaaaggataataggatgctctacttttactttgctttttagattctttgtgaaataagataggatatagaataaatgtctaaacttataatgccctgcaaggctgaggcatctctgctggctgtagcttcagttgtccagttacagccttcttgcccatttaactcttacctttgcttcagatcctgttcttaactctgagttgctctgctcattcccaagcttacctttgttggagatgctttttccaattaatacatttatggagcacttactgtgtgtcagattcaggcacaagggatgctgtttttcttttctatgctaactctgccttcttgcatcccaacctcagctggatttctggagctcctt

SEQ ID NO: 85485 - DNA, 841 bp, Homo sapiens
atgtctgaaggattgtttctagactttcctgttccatttgtctatttgatattctaatgcaaacactacagtgtctaacttactataataagccttgacatctagtaatgtaattccaccaactttattcttctttatgatcatcttgcctacttttgtctctttgcgtatcgctaaataatttagaatgagggtgtcaaattccacaataaacttgctagtgttttataaagaaagcattagagctacagattaattttggaagaattaacatcttggctatattgactcatcaaatccattaatatgaattagtcttccatttatggttgtttgaaacatttttttccaataatgttttagggttttctctgtagtagagtttctaaatttttattggatgcattactagttatttgatgccatcgtaaatggtattattttaaatgtactacttttaaactacctattgttgtcatatggaaatacaattgaggaaggtagacatcaacaagacggtaaaagaaaaagccttgaatcctccttccccctctaaacactaaattaacaataatagatggatacatttcctttgtgacaaacttagatactagttgagagggtcctgcaccctgagtgagtgagaaaccatctacattgaagctggaagaaaaatttgacacactctttaaacataatctctactcctgccacggtgtcataaaaccaggattaaacgctccatctccaaggttctccattcagagggagaaaaaggaactacttggtcaatgtagcagttttttgatggtatgttcaaaggacatccttctctcttccc

SEQ ID NO: 85486 - DNA, 788 bp, Homo sapiens
gaagggaggcctccaggaggaggagcattggaagagattctggagagtgaggagcagaatttccactgaagtacctctggttgaaaaggagaacagagacttttttcacagccacaggacaaaatttgttcagaattaaatgctgaaaaaggaggctggagtgccgtggcacaattatggttcaccagcctcaacctcctgggatcaagcaatcgtctcacctcagcctcctgagtagctggactgcaggtgagtaccactatgcctggctaatttttgtatttgttgtagagatggggtcttgctatgttgctcaggcaggtcttgaattcttgggctcaagcgatcctccttcccaggcctctcgaagtgctaggataataagggtgagtcactacacctggccctttgctcagttttttttttttttttttttcttttggagacagagtctagctctgtcgcctaggctggagtgcagtggcgcgatctcggctcactgcaacctccgcctcccatgttcaagtgattcttctgcctcagcctcctgagtagctgggactacagtcacgtgccaccatgcccagctgtatttttattagaggcgggtttctccatgttggccaggctggtcttgaactcctgacctcaggtgatccgcctgcctcagccttccaaagtgctgcgattacagacatgagccaccgcacctggcccccttgcttattttctacgttgttgtttgtagtcctgttattgagaagtctgggattcttgtatattcttaa

SEQ ID NO: 85487 - DNA, 377 bp, Homo sapiens
gaccctgtttcaaaaagtaaaatataaagaatttcataataatcttacattagtgccaaaaaaggttttatattgcacaaaacaactggatttaatgggctcagcttatcagtcaaatgacatgcttgctcctgaaacattttttttgcatagttcctcttatccccagatcacccctgtccagggtggaagcactcatttctcagatctggaagtgttggcagccaactctcagctgtgtccgtctcttcaggactgtcctcagttgaagagagtcatctgaccagagtcacatccagcaattgctccatgtgagggtacaaaaccccagccctataggcccaatttgggacaactccacgggcccacagcagctc

SEQ ID NO: 85488 - DNA, 522 bp, Homo sapiens
aggtacagatctggaagtgatcagtacataggtggtgactgaagttgaagatgtggctcaaattgccagagggtgagatgagaacctttgtttaagaggcaaagtatgaaaccaatcaaaaaagtagagggagaataaaggttttgcaaaagtaaattaaagggctccatggagaggagctcagagagactaagattaagtattatttaaagaggtaggagaaaagcagtgtctgagaagtggtgtcagagaagccaggagaatagagtttcataaaagagcagtgccaaccaaagtcagtatggaaaagattcactgggaggcaggggaagaggaccacgggtgaacacggcgagggcatttcaaggaagaactgggagcaaaatcaaactacaccatccattgtggaattaatgagagatttaagaagtgaaaacaggccaggcgtggtggctcacgcctgtaatcccagcactttgggatgatgaggcgggcggatcacgaggtcaggaattcaagacc

SEQ ID NO: 85489 - DNA, 158 bp, Homo sapiens
actctagagatccccaaacaccgcaatctgtcccctcactcgctgtcgttctcttctctgggctggtctctgaaagctggccgggcagtgtcatgggcagggggctggttgatgttgggtgtcagagcaggaagatctcagtaaagaggcgatgtttg

SEQ ID NO: 85490 - DNA, 488 bp, Homo sapiens
gcggattgctggtcttgaactcctgacctcagttgatccgcctgcctcggcctcccaaagtacagggattacaggcatgagtcaccacacctggcctggtcatttacatttttgccagaatgaaagataagcaaaagttacacatgcacacatatacatacatgcgtgtgtagagattataggtatatgtgtatgggcatgtatgtatataccatttgtattgtcctccattttaactccttattttgcccatatttttgttgtctctcctaagttattttttggagacgggatcttgctctgtcacacaggctggtatacatgggtgagatcatagctcactgtagccttgaactcctgggctcaaaagatcctcccatcttagtttctctcaagtagctaggactacaggcacacagcatctcaagatcctggcctcaggtgaatcgcttgaccccaggaggtggaggttgcagtgagccgagatc

SEQ ID NO: 85491 - DNA, 422 bp, Homo sapiens
cattcagtatccaattaaaagacaaagattatcaaaccacagaaaaacaactacatgttgcttatgagactgacctaaaacatagggagctttaaaagtaaaaggatagaaaaaagacaccatgtaaacatcaagagaaaacgatgttaatgttaatcagttatccctatgtatttcatatgtattgctgtaatgcttgccaaatgccggttttctaattccactgttttttctacacttactggaattcccttatccatttatttctcctttattcacttatttatgtcagtataaactcatagattcctattttatttcatgggttataactcattattgctcaaaatatccatgttttagacttgttaattaacttccgtgtgtatgtgtgacaattccaatatttaatgccaattcag

SEQ ID NO: 85492 - DNA, 699 bp, Homo sapiens
cgcggggagtcgaggctttgcgcctgtgcttcggaccgtagcgccaggcctgagcctttgaagcaggaggaggggaggagagagtggggctcctctatcgggaccccctccccatgtggatctgcccaggcggcggcggcggcggcggcggcggcggcggcggcggcggcggcggcggcggcggcggcgaccgagaagatgcccgccctgcgccgctctgctgtgggcgctgctggcgctctggctgtgctgcgcgacccccgcgcatgcattgcagtgtcgagatggctatgaaccctgtgtaaatgaaggaatgtgtgttacctaccacaatggcacaggatactgcaaatgtccagaaggcttcttgggggaatattgtcaacatcgagacccctgtgagaagaaccgctgccagaatggtgggacttgtgtggcccaggccatgctggggaaagccacgtgccgatgtgcctcagggtttacaggagaggactgccagtactcgacatctcatccatgctttgtgtctcgaccttgcctgaatggcggcacatgccatatgctcagccgggatacctatgagtgcacctgtcaagtcgggtttacaggtaaggagtgccaatggaccgatgcctgcctgtctcatccctgtgcaaatggaagtacctgtaccactgtggccaaacagttctcctg

SEQ ID NO: 85493 - DNA, 865 bp, Homo sapiens
atatagtattatggtccaaataagaaaaatataatgtattactctagtgtgaacagtgcaattccagcaacgacatggtattaaactgaaattatctgcagttagtttctttgaagaacatagttggaagttgtaatttacaagttttgctacaaattggaatcacctgcagatttgtaatgtataatgaaactggcttctatctgctgacattctgattaaacttttgagttcgtaaatgtaaattgggctctatgggtttaaaagatcctcggttaattcttaagtgtagtagagtttaagaaatactagattaaaaatttgggaactgagtttactcggatacagataattctcaggaaactctgtataataccaaaagtgaaaggggctatgatgtgaaatggcatcatttataccattatagcattgttaccctccattaatattaaaaactgttataataacaaaaggtattttttgttgttgtgagttattgaatccctactatgtacattgtattgtgctaagtgttttacatgtaaaatttaactgactcttctaagtaattatacatattatctgcttttaatttttcttaaattgaaaaaatcagctaaaatgattatgatgggccccaccatcatggaatttttttgaaatcatttatttctattaatcccaaaatataatggtaacaaattttccccacacatcatttcaatttttatggactattgatttttctaaatgttaattaaaagctcaaaacttgactaaccccttggcacttccatttctcactcatttgcctgttgtgatcgtgttttggttttctattctcatcaacatcttttctactcca

SEQ ID NO: 85494 - DNA, 1072 bp, Homo sapiens
  misc_feature (75)..(75): n is a, c, g, or t
  misc_feature (220)..(220): n is a, c, g, or t
  misc_feature (239)..(239): n is a, c, g, or t
  misc_feature (371)..(371): n is a, c, g, or t
  misc_feature (494)..(494): n is a, c, g, or t
  misc_feature (687)..(687): n is a, c, g, or t
  misc_feature (777)..(777): n is a, c, g, or t
  misc_feature (881)..(882): n is a, c, g, or t
  misc_feature (885)..(885): n is a, c, g, or t
  misc_feature (899)..(899): n is a, c, g, or t
  misc_feature (934)..(934): n is a, c, g, or t
  misc_feature (957)..(957): n is a, c, g, or t
  misc_feature (979)..(979): n is a, c, g, or t
  misc_feature (995)..(995): n is a, c, g, or t
  misc_feature (999)..(999): n is a, c, g, or t
  misc_feature (1010)..(1010): n is a, c, g, or t
  misc_feature (1025)..(1025): n is a, c, g, or t
  misc_feature (1040)..(1040): n is a, c, g, or t
  misc_feature (1043)..(1043): n is a, c, g, or t
  misc_feature (1048)..(1048): n is a, c, g, or t
  misc_feature (1050)..(1050): n is a, c, g, or t
ctctctgtttaggactcaggaggagctttcaaaggaatgggctttgtctgtcagtcacatgccaagcgaccccgncctgtcagctgtcactctctaatttagaacactgtctatggccattggctgaggccccatctattgtccatcaccacaaaattccccaaatgaaatattcatcacagcagatccatcctgaaccagaaggaagagaacacaaagnagatattctaagcaccaangccttaccaatggatcgttgtcttgtagtggatacttttcttggtttgctttttgtggggatcaatcacattgctttaaaatagaactgatttatttaaacacaaaatatctttgttggaaaatgctcattntgctacacaacaatcttctgggttcactgaacgccctctaatttcctctactgtctggatttggaaaaaaactgaaaagcatgttatatgtttgtcctctttcctcacagaaagcaaagatgnactagaggacatgcaagcccactcctataggacaggtccgtcctgctcagcacccacactcagtggaggtctcagacgacctgggctattagctgacagagctaccaggtgaaatggcaagtaatgctaccctgggctatctcacgagaaacagctgctagacatggtccagacttggatagacccaggaggntttgctcatttctacagagtaagtaaagcagagatagcagccaggtgtgccatgaacaggcctggccctaaagtatgtatcctgggcagnaacaccaatgaaagcctgacccacagttcccatcccaccctgggttctgtgcccctgcacaagcatcctgcaaatgtgggcgggaacatcggtgcaaacatcanntantcagtgcacacccntgaaaacagctgcccctttggcccagtgtgcacantggcctagatatggagagaggancaggcaggcctgggcaggaggnttttggctgtttgggnaggnaacaaggggtnctgggagcccagagnagattacaagtgggnagntggantntgtgcatcatagcttttcactc

SEQ ID NO: 85495 - DNA, 498 bp, Homo sapiens
atgtaaagggttaactctgcagaagtaattgacattggccccatgccttagcagcagactgatcagctcatagttgcccatcctgagggctatctggaggcagttaaccgggtcttgattaggcagagctccagcactcagaagcagcttgactgaagagaggtcactgtttgatacagcaaaatacaaagctgacttcctgtggtcatcgtagtgtttgttaattctctgatccagcatgaagttcacatcaaatccagcctggatgaggagttccaggcactgaggatgtgctcctgctgctgcacagtgaactggactgatcccactctgcttaatggcagcaagatccgtaactggaatcagtatctttagagctctgagaaagaatttcaaaatgcatttcaacattgtttttaagatgtagcactaacttgtttattattgttttatagcaatactagatagtatcagtattcagggggcatttagaacccc

SEQ ID NO: 85496 - DNA, 305 bp, Homo sapiens
tgttttatcccagattcatctgctcttacctcgagtctgggatcttaactctgcttgcttcttagttcagccatagctaataaggcaacgcattgcttacagtagccccagcagcatgtctctctggctgctacttggcgtcctgctctcagtacccccagcagtgcaggggccacaggcgtggaagtctcagaacttctgcctacctcctcctagccttgcctcccctagtacagcacctgccaccaatttttattttatttttaacaacatcatctattttttgccacttgcaggaggtccca

SEQ ID NO: 85497 - DNA, 154 bp, Homo sapiens
acacagagtcaaaggggattattttaaagctttaagatttaatgactgccctgttgggtttcagggacctgtaacccctttcttttagccaattcctcccttctggaatgggaatgcttacccaaagcctgtaccctcactgtatcttggaagt

SEQ ID NO: 85498 - DNA, 609 bp, Homo sapiens
ttgaaatgtgtgttcctcagagcctctgggttctgcaggggactgcccagtgagtggaggcctggtagattgttctagacactgctttacttaggtcagcactgccttcaaccaccatgttcaacctgacatctaagaagatggcatttggggagagaggagagctgctgctttaaaaaagaagttcgaaaatcttgtgaatagagaatttatagtctattttaaagatcagctgaatggaccccatcatgcctggttaccttctcacagataaacaaatactggaccagggaaaggagctgggaaaaaaaaaactctttgaattcaacgatacagtaattgaaacattttcatcagtttcccttctacctccatttggatgatggatgaactttttaaattacagattgcggtgtttgcaaacaccgcaatctcaaacaccgcaatctcaaacaccgcaatctcaaacaccgcaatctcaaacaccgcaatctcaaacaccgcaatctcaaacaccgcaatctcaaacaccgcaatctcggctcactgcgacctcggcctcctggattcaagttcagcctcccaggtagctgagattataggggtgtg

SEQ ID NO: 85499 - DNA, 221 bp, Homo sapiens
taatatatctgaaaatctggaaaaagtctgtgatttttaataagttgacgacatcagaattaactggaggtgtaaaatcttaatagacctccctccagaataaacttatttaaaaaaataagactggccaggcatggtggctcacgcctgtaatctcagcatccacctgcctcagcctcccaaagtgctgggattacaggcatgagcgattgcacctggct

SEQ ID NO: 85500 - DNA, 448 bp, Homo sapiens
tacaggtgtgcccccctatgccaagttaatttttaaaaattattttgtagagacagggtctcattatgttgctcagggaggtcttgaactcccagtctcaggtgatcctcccaccttggcctcccaaagtgctaggattacagttgtgagccactgtgcccagaaagagttgctttttgaaagaaggagcccaaattccttcttaggcttctttgtgtttccattctagtagatagagctggccatctagtaatagctcagcaaatgtttattgagtaaattaatgaacactaatttaaagataattgaacaattagtaggtaatgaatgatctgtaaattagcaacttataataaattacaaattatttagctaatcagtaaataattaaacttcaatagagataatgataaaatattcagtaagtaaacacatggccagaataaaa

SEQ ID NO: 85501 - DNA, 1423 bp, Homo sapiens
gaattccgtccacaccagtgcacagagacgtgtcctccttttacttcttttaacagccgcttaatgttttatcctagcaggaaccctaccatgggccatttaaagtgtttcaaatcttagggggctgagcctggtggctcacacctgtaatctcagcactttgggaggctgaggcaggaggattgcttgaggttgggagttcaagaccagtctgggcaacatggcaaaaactcatttcttaaaaaaaaaaaaaattagaccgggcttggccggaactgaattggtagaggtaaaaggggaacggaggaccttaagctctggccacttcggcccagcgaacccactttatttttgtccaaggaaaagctgcaggggggaggattctttttaggaagtctactctgccggcccctgatttttgggttggatgcttgagagctttgtttcccttgttccgagagtggcccagctgggtctgaatcgactccctcccctttcgaccccccctcctcattttccagcccggagaaataggggagtgggggcccaagaacgagaagacgagaacgcgtcgccctgcgctatgtcagaatggggcgggtgtgaggggaacagctctcttgcgatcagctcaggagtatgagcctcccggaggacggcatgagttctggacacttcaggagtcctcagctagtgacatggtcgatatggataaactcataaacaacttggaggtccaacttaattcagaaggtggctcaatgcaggtattcaagcaggtcactgcttctgttcggaacagagatccccctgagatagaatacagaagtaatatgacttctccaacactcctggatgccaaccccatggagaacccagcactgtttaatgacatcaagattgagcccccagaagaacttttggctagtgatttcagcctgccccaagtggaaccagttgacctctcctttcacaagcccaaggctcctctccagcctgctagcatgctacaagctccaatacgtccccccaagccacagtcttctccccagacccttgtggtgtccacgtcaacatctgacatgagcacttcagcaaacattcctactgttctgaccccaggctctgtcctgacctcctctcagagcactggtagccagcagatcttacatgtcattcacactatcccctcagtcagtctgccaaataagatgggtggcctgaagaccatcccagtggtagtgcagtctctgcccatggtgtatactactttgcctgcagatgggggccctgcagccattacagtcccactcattggaggagatggtaaaaatgctggatcaggagcacaaaggccaaggtggatgttctcacatctggactaatcctagaatttgattttaggacagccaggagctattca

SEQ ID NO: 85502 - DNA, 524 bp, Homo sapiens
ccaaatacttgttccccaccttatcaccacccccaagtttcttctctatagaaattttgaaggtttcactggatctaggagactgttgaccacctgattgagtttttaggaattagaaacatcaggggttgataataaggaatatttgacagcttctcccaacataggtggaaaggaaggttgtatcaagcacctactaggtggtaggtatacgtttcatctcattgacttatttctgtttaggagcacaaaggccaaggtggatgttctcacatctggactaatcctagaatttgattttaggacagccaggagctattcagtgagttcaattcaacacacacacacacacacacacgttgaaactaacttttcagctgaccctgtcctggtagctggagatagaaagatgaatcatacccagaccacatcctagagacactctcatttgataccactcatagtggtatcagaactcttcatactactcttactttaaaggcatttctgttccctgctatgca

SEQ ID NO: 85503 - DNA, 461 bp, Homo sapiens
gtagaggtaaaaggggaacggaggaccttaagctctggccacttcggcccagcgaacccactttatttttgtccaaggaaaagctgcaggggggaggattctttttaggaagtctactctgccggcccctgatttttgggttggatgcttgagagctttgtttcccttgttccgagagtggcccagctgggtctgaatcgactccctcccctttcgaccccccctcctcattttccagcccggagaaataggggagtgggggcccaagaacgagaagacgagaacgcgtcgccctgcgctatgtcagaatggggcgggtgtgaggggaacagctctcttgcgatcagctcaggagtatgagcctcccggaggacggcatgagttctggacacttcaggagtcctcagctagtgacatggtcggtaagtgactctgggactaatacccacccactcccacct

SEQ ID NO: 85504 - DNA, 2468 bp, Homo sapiens
gaattccgtccacaccagtgcacagagacgtgtcctccttttacttcttttaacagccgcttaatgttttatcctagcaggaaccctaccatgggccatttaaagtgtttcaaatcttagggggctgagcctggtggctcacacctgtaatctcagcactttgggaggctgaggcaggaggattgcttgaggttgggagttcaagaccagtctgggcaacatggcaaaaactcatttcttaaaaaaaaaaaaaattagaccgggcttggccggaactgaattggtagaggtaaaaggggaacggaggaccttaagctctggccacttcggcccagcgaacccactttatttttgtccaaggaaaagctgcaggggggaggattctttttaggaagtctactctgccggcccctgatttttgggttggatgcttgagagctttgtttcccttgttccgagagtggcccagctgggtctgaatcgactccctcccctttcgaccccccctcctcattttccagcccggagaaataggggagtgggggcccaagaacgagaagacgagaacgcgtcgccctgcgctatgtcagaatggggcgggtgtgaggggaacagctctcttgcgatcagctcaggagtatgagcctcccggaggacggcatgagttctggacacttcaggagtcctcagctagtgacatggtcgatatggataaactcataaacaacttggaggtccaacttaattcagaaggtggctcaatgcaggtattcaagcaggtcactgcttctgttcggaacagagatccccctgagatagaatacagaagtaatatgacttctccaacactcctggatgccaaccccatggagaacccagcactgtttaatgacatcaagattgagcccccagaagaacttttggctagtgatttcagcctgccccaagtggaaccagttgacctctcctttcacaagcccaaggctcctctccagcctgctagcatgctacaagctccaatacgtccccccaagccacagtcttctccccagacccttgtggtgtccacgtcaacatctgacatgagcacttcagcaaacattcctactgttctgaccccaggctctgtcctgacctcctctcagagcactggtagccagcagatcttacatgtcattcacactatcccctcagtcagtctgccaaataagatgggtggcctgaagaccatcccagtggtagtgcagtctctgcccatggtgtatactactttgcctgcagatgggggccctgcagccattacagtcccactcattggaggagatggtaaaaatgctggatcagtgaaagttgaccccacctccatgtctccactggaaattccaagtgacagtgaggagagtacaattgagagtggatcctcagccttgcagagtctgcagggactacagcaagaaccagcagcaatggcccaaatgcagggaggagagtcgcttgacttgaagagaagacggattcaccaatgtgactttgcaggatgcagcaaagtgtacaccaaaagctctcacctgaaagctcaccgcagaatccatacaggagagaagccttataaatgcacctgggatggctgctcctggaaatttgctcgctcagatgagctcactcgccatttccgcaagcacacaggcatcaagccttttcggtgcacagactgcaaccgcagcttttctcgttctgaccacctgtccctgcatcgccgtcgccatgacaccatgtgagccgcacaggtcacactagagaagctgcgctggtatctttcctggtcgtgtgctgaggttgggacaattttttcctctttgacttcagcttgcatatggggttgaagcagcccactgagccaagttgaggagactggaggaaaagagagctggtctcccgtggggctcttcatattctaccttcacggaattccagtgtggcacccatggctgccttcccatccccccctgctctgaaataggacatttttcctacagtaacaaaacaggaatcaaactcaaggctgtgaacaaacatacgctgctttattctttccaatttttctcttgttttctagaactcttatccatatgtttttaaaataagtacctaaaagtggtttgatagtgtcctaaacgacttttttaacttcctaaatggaaagagcataacaagtagttgattggtaagatttacagggatttggtttctgagtttgaggcacattcccagtgaataagctgagtcccataccacactcaaaaggttttaataaatctaatcctatttcttcttaaagtttggttttcagacagtgctggtgcttctgcttcttaagttcatcaagggaatgaggagttcttgtccttctcctcctcttttttttcttttccactttctccttcaggattaaagattttgcggaattc

SEQ ID NO: 85505 - DNA, 796 bp, Homo sapiens
aaatttcagaaactaaacttggtccgaaagacacagtaacgcacattaataatactatctgtcatcctgttcttatcctgttacatttttcaggttacataagtttcattaactgaaactatactcagatcaactaaatttctttcttattatctctgtgttctgggccctcacacactattagtatgaattgaatactaaacacatttaacatttaattgaatcatctaaaatgtcatcataatatgagatctagctcaagtgactgggttaagcatctcatttccttatgtccttatgctgtcagatgaaaaaaaattcagctgcaggagagtgaagtgaaatgtgcaggatgaaaggcataaataaagatgaagatgactgccatgatatcctgctaacaccaagtactgtcctggaggcggaaaagcaggtatcagatggctctctagcatgcaatcttcacttatttctacattttattctctaaaagcattcatattgaggcccagtgctctagaaatgtacattgaattaacagaatgcctgtatgattttactttgtgcatgataatgtttttctacttaagtaaaaagtgtgatttgttttactgttttctcagagggaattaaactctcttttcttttctttttttttctttttttgttgttgagacagtcttgctgtcacccaggctgaggtacagtggtgtgatctcagctcactgccaccttcaccttcacctcccgggttcaaattattctcccaattagcttcaattgtaggcatgtgcta

SEQ ID NO: 85506 - DNA, 775 bp, Homo sapiens
ggacttattcctaggccaagaatcaggcagccatagggcaaagtaaaaagtatttttagccagagccacagaagggataaagggaaggaagactagagcttggccactctccggacaactccagctgccctcgatggagcggtcatccacaacgaagtattactgagaaagtagatgtggggtttttttgttttttgttttttgtttttttgattttgagacagaatcttgctctgttgctcaggctggatcactcaggcgatctcagctcactgcaacctctgcttcccagattcaagcaattctcctgcctcagcctcccgagtagctgggattacaggcgcccaccaccacgcctggctcatttttgtatttttagtagagacagggttttaccatgttggccaggccggtaataagatgaactttatactttttttttttttttttggagacagagtcccattctggtccacctaggtgcaggggcccgatgatgggctcactggcagcctggacctccggggctcaagtggatcctccacctcaagcctctcggggtatctggggattacgggtttgcaccaccacccttagctaatttggggattaaatggtaaagatggggtttcgccatgtggccccggcgggtcgggaactcctaggatcaagtgatctcccacctgtggagtccccaggtgcggggattacgggcatgagccactgcttggggccagaacttatactttattaaccagtatgctgatgataggga

SEQ ID NO: 85507 - DNA, 630 bp, Homo sapiens
gtacattcctgtggccaagagtcccttagttgcctaaaggcaggcaggcaaactttcaaagggccgagcttcttgagattagtctctttcactggaatatttttagttttgctaaaaatcacagtaacattgctcacttagtttatcaatttatcatttaatgtgagacgtacttttaacaagatatttaacttataagatttttctagttccttctttgcctaattctgaaaatgtatatgcttccattgctttggaattatgagaggtgtatatggctttgactgggaggtaagagcactgccttagcctttgctgccatggtgcagcatagaacacacacgactaggagtcaggagattgggtatgcacaccagctttgccacaaacccagctatggggaacttggataggacctagctttgctgaactatgaggtctttttctacaaaataggagaaactataataacattgtcacagattgttctgagtattaagagataacatgcaggaaagtgtttgtgacatgtacaggattatttagtaaatatgtatagatcattgttgatgtacctgcattactcaattgttacttcgctcaataaacttgcttattgttttcaatgtc

SEQ ID NO: 85508 - DNA, 420 bp, Homo sapiens
ctgagattgtgccactgaagtccaacctgggagacagagtgagactcagtctcaaaaaataaaaaataaaaaataattttgttaaaaagataaaatagaaatcgtagatgaattcttggaactgggattaatcaggctattatcgagtaagcgcgtggatggtgctaggatattcgcaatgaactgatcacgaatttggattgtggggtctggcctctgaagacaagatacttaatagagaggactgatagaatggagaggtaatggaggcattaaggaaggcttaagacaacacgcactgctttctgttgtcccttcagtcaggtcactgttcaaatagctctctagacaggctcttccttatcattctacttaaaatagcccccaatcactctgtgtccctttagcctgcttcctctt

SEQ ID NO: 85509 - DNA, 799 bp, Homo sapiens
aataggcgaggaaacaaaggttgaaggagattcagtgacttgctcaaagtcagaccgtgagtgtgttgagttgcgtggtcttgaacataggcctgcttgcctccagagcccatgtctcagcctccacttcagtgcctgcagaggcaggctgtgaaagtctggcttgctggctaagacgattgttccctctcttttaatgtttcaaggacaacatcccttgccgaatcctcttctttcaacctgcctcatggtgttacccaactttttgttaaattgggactagtgggtctgatgttgacaggttttctgagtcttggttctagggttcaccttcctttttatccagccaatcagtaatccagaagtcttcaaataaaatctttatgtgcccaaccacgtgtgaagagggagaagattcatctcgtttctcaaaagatccaggtttatttgtgagcccaggtagtgcctgcgaatcctttagtttggagaaacactttggggactggaacaggaacaatcacagctggctggaggaacgtggggtaatgggccttgagctgtccctttaaggatgagtaggagttgggaaggtggagggcataacatatgagcaaaattattgtctcacttaatggtgaatgggacatcttttgcctattctccccatcctccaagataattcctgggttagagttggctctcgggtaggagaggcagtatggggaattcattcatgcaaaatcaagattattgaaaactaattaattggatcccaaagacaagatgatgaaactactca

SEQ ID NO: 85510 - DNA, 419 bp, Homo sapiens
catacctgtaatcccagcactttgagaggctgaggcgagaagatcgcttgaatccaggagcttaagaccagcctgggcaacacagtgagaccccagctctacaaaaaataaataatgagctgcatgtggtggtgtgcacctgtgatcctagctccgtgggaggctgaggtgggaggattgcttgatcccaggaggttaaggctacagtgagctgtgattgtgccactgcactccagcccaggcgatagggggagaccctctctcaaaaagaagaaaagtctttcttgaattcactatacagcaagtttttttttctttaacatctactttatacagaaatttgtatttattcagggttagttccaaatcacttctaggtataatttcatttatccttatcctgcaataggggccaaaaa

SEQ ID NO: 85511 - DNA, 386 bp, Homo sapiens
tgaacggacaagccatgtagccaagccttagtgcgagccaagccgcagagctgtgcctgatctggggaaggacagaagctttgaaccgaaatgagattgctgtttggaaattttgaagttttgaaatgaagtttaagatgtgcttagctttaattgctgaaaataaaaattattcttgtaagacaacataatcagaaagcttaaagggtctgcccgagctgtcaccatgctagggagcaattcagaaggacatattcaaaaggcagtggtacaaggaggataaagccacgtctgacgtgcacccatggaacttatattcatgtccagtatacctgcttgtgtatttgcctctatgcataacgtttccttacatacccgcttatcgg

SEQ ID NO: 85512 - DNA, 499 bp, Homo sapiens
  misc_feature (454)..(454): n is a, c, g, or t
  misc_feature (466)..(466): n is a, c, g, or t
  misc_feature (487)..(487): n is a, c, g, or t
  misc_feature (492)..(492): n is a, c, g, or t
agcctgatctactgccttcacctgggcttctctcaccactggcttcatctcctcctctactcaccctgcccacccacacagctttgtccaaaggcatcagcacagtgtgacttttgctggaacaggttttgtttgggaagccagaaatagaggcaaaagccaggcaaagctcatggggctcaggccccttcagaagccactggctcccagtgctgtctctgctgctctccaactttgaggaattgggagtctctcgagagactgtggggttggcatgatggctcacacctgtaatcccagcacattgggaggccgagtcaggtggatcatgaggtcaggagatcgaggccatcctggactaacatggtgaaaccctgtctccactaaagatacaaaaaattagccgggtgtggtggcgggcgcctgtagtctcagctgcttgggaagctgaggncaggagaatggncgtgaacccaggaggcagagncttgncagtgag

SEQ ID NO: 85513 - DNA, 491 bp, Homo sapiens
agggagagaatgagggagggaggggaaggaaagggaaggaaagaaagaaagaaaaggaaaaactacgttaacatagacctaccaaataaaaagaaacaaatgcatactctgaaatttacaagatacttgtgtctccaataaaaatggctcagcatgagcttaaggagctagactaagaattccaggctcccagatgtttcaaacgtccaaagtagaaacattaaatattgtaacactttaaatggaagtgaagattttccatttaacattagaaattaagtagagtgataaaacaatttaaggaatctttttgttgctgttctccttctaacaaaactatatactccaatattgggcaatttggaacataaacctccaaagattaaggattcttctgccttacatatgcactgacactctcctggaaccatacaccagacagctaccaatcccaagaatgcaaagttcctcctcccattcttgaatgcact

SEQ ID NO: 85514 - DNA, 4752 bp, Homo sapiens
  misc_feature (1188)..(1188): n is a, c, g, or t
  misc_feature (1539)..(1539): n is a, c, g, or t
  misc_feature (3048)..(3048): n is a, c, g, or t
  misc_feature (3080)..(3080): n is a, c, g, or t
  misc_feature (3499)..(3499): n is a, c, g, or t
  misc_feature (3651)..(3651): n is a, c, g, or t
  misc_feature (4489)..(4489): n is a, c, g, or t
  misc_feature (4568)..(4568): n is a, c, g, or t
  misc_feature (4693)..(4693): n is a, c, g, or t
tcagcctcctgagtagctgggattgcaggtgtgtgccaccacatccggctaattttttgtatttttggtagagatggggttttcccatgttggccaggccggtctcgaactcctgacctcgtgatctgcccacgttggcctccaaagtgctaggattataagtgtgagccaccacaccaggcccgtttcatccctgcctcagcctgcatgccaagctccctgggtgcccgcccacaggtgtcaccctttaaggagaaagtggcctggggctggaaacaggactttgtagggaaggacagcgcgtgtgagaaaaggcctgttgatgggcacgccagggtttaatggacggctctttgaagtcatgggctgagccagaaggaattgtcatgatgtcagtctcatttccagatggggaaagggagacccaggctgcggtgacccactgaggcacaggatcagtgagaacccagccctggctttgcccagacctctcaagggcacttcgtgggaccattgccggccgttgtggcatctgtccctggccttgcccccatccgtctctgcacagcccaggtgggtccgagccagccccaggtctccagggtcccagcccagcctctagaagagccagcagcagggctggaagggagagcacatgctgggccttggggctgccttggacctcaggccgttgacaaggaaaagcggagagttgggaaaaaaggacaaatagctgagcgccagccgcagtccgggggacgggagcctcgtgcgactctcggagtgctggccagattggcagaggggaggagagaggaaaaactcaggctctgaggaaaaacctctccagcccagcgcgtggcctggcattaacccactgcagccccaggaagtggttccaccccaggcagccaacaaggcggtgcctgaactatgtctgtggatgacggagccacgacctgtccctcagggctcagcgctgcggctatgtccagggacccctggccgtgcccacgtcggggcttcccgttccttacctgccatgagaatgagatgtccagggacctccctgctccagctgggacctgtggggctttgtctgttgtcccgagcaccttggagatgtcatttctaacattttaacccaggaatccccccaccaagggacagagtgcaaggacatgatcnaacagaaaaagttctggtacaagatcaaccccgtggggtggtgagtgctgcagccccgggcctcacatcctgccgtccctgtgggagattggagcggtcccagtgcccaccgctgattctctggctccagcaacccctccaggtggatccgtcccacgcagcctggcctgaaacactgcccagccactgggtccagtaagacagagcctcgagtcattctgccgagaggatccagaaacacagactttttctggggtcctggaggcttctggcccatggggagcccctgggtcccagcgatccagccctgatgtgctgagggtgcagggcccagctgcagagcagaggagngtggcccccagggaccagcagcacgaaaggcacactgaggcacactggcaggcctgggctgcagagagcctgaaggtcatggggtagctgatggaagcaggaagaccccatacagcagcgaccactgaggctggtgctgcactttctcagggaattgagtgtgggctcccaccatcccggccactggcttcctccaaagcctcctcctcttacatcagcaaaccttctgttcggtgaccccctcagtgaccctctgtgcttgccttcgtggtcttcctcatggaggatttcgggtcagcgtgggggtcagaggtcatttcccataccccctcaaaggtacttcttgctgtggtccccacactctgacaccctcttctgaaatgaacacttttttgttgttgttgttgagacagagtcttgctctgtcgcccaggctggagtgcagtggcacaatcttagctcactgcaacctccacctcccaggttcaagcgattttcatgcctcagcttcccgagtagctgggattacaggcatgtgccaccaagcccagctaatttttgtatttttagtagagatgaggtttcaccatgttggccaggctggtctcgaacttctgacctcaagtgattcgcccgcctcggcctcccaaagtgctgggattacaagcatgagccactgcgcccggccacaaacactttttttttttaaacaagtgaaaacaagtttattaacaaagttaagaaataaagaatggctattccatagggagagcagcctgaataaacactttttttgttgttgttgaggcagagcctcactctgtcgcccaggcaggagtgcagtggtgcgacctcagctctcagctccctgcaccgtccacctcctgggttcaagcgcttcttccccaagtagctgggactataggcacacaccaccatgcccggctaatttttctctttttagtagagacaggatttcgccatgtgggtcgggctggtctcgaactcctggtctcaagtgatccgccctcctcggccttccaaaatgctaggattacaggcatgagccgccgtgcctggccacaaacatattttaaatttgaacaataaaggaactggaccaggaagtgtggagttggggagaccctgctctcgccaggtgccttcccggcaggttgtctctgcctccccttgcaccccttgaatggcgggctccctctcccatagcccctgccaggctggataaccaacttcattcttatacccgtccgaatctgccccctgttaatggcacccaccagtccttgtccaaacctcgaagctcaggacctcacagagcaccacgtcctcttctgtgtcatatgcagctggatctcagtaaatggcaatgtcttctctacccgggactgaacaaaacccattcctcctatgaaagccgataagacctgggggcagagcagcccgccttctgtccccgcggctttaggggacaccggccacccaccctcngcttcttcccccacttcttggagaatgtctgngatgtgggtgaagactggcagagaaaagctggtgtaaccttctgcaggggtttcgagcaattctgaatctcagctggtgaggaggccaaaacctgctctgcctagcagactggtcatgtctccctttcccttcccttccctttcccttcccttccctttccttgtccttcctttttccttcccttttcctttcctttctttttctttcagagtttcgctcttgttgcccatgctggagtgcagtggtgtgatcatagctcactgcagccttgaactcctaggctcatttctatttatttatttatttagagatggagtctcgctctgtcgcccaggctggagtgcagtggcacgatctctgctcattgcagcctctgcctcccgattcaagtgattctcctgtctcagcctcccgagtngctgggattacaggcgtctgccaccacgccgggctaaatttttgtatttttagtagagtcagggtttcaccatgttggccaggctggtctcgaactcctgacctcaggtgatccacccttcttggcctcccaaagtgctggaactacaggcntgagccactgcacccagccttctttttaaatatacattttttgagacagggccttgctctgtggcccagggctggggtgcagtggcatgatcatggctcactgtagtctccacctcccaggctcaagccatcctcctacctcaacctcctgagtagctgagaccacaggtgcctgccactatgcctggctaaatttatattttgtggagacagggtcttgctgtgttgcccaggcttgtctcaaactcctgggctcaagcaatccccctgccttgacctcccaaagtgctgggattacaggcctgagctgccgtgcctggcctggtcacatcttgaatggaatcgggctccgtattgtccagatacctcccatattaaaaaagaactggggccggcagcagtcacacttcccagcccttccctgagcttgggtctggtgggagtgtggagacagcaacagggtccctgtgtgtgcagtctggctgcaagactcaggggtgtgcgtgtgtgcacctgtgtgtgcacctgtgtgtgcacgggtgcaagggcatctgtgtgtcgttttcttacaggaaggcgtgggccaatgaccagctggaagtgcaggttcatgtgtcctcagacagtggctggtgcctcacgctggcttctggctgtgaccagggtagcagagagagcaaagaggtcctttcctcaggtgggtggagtggggcttgagcacagtccacatgcagagatgagtgtggactcggaagaccctgacccccttgtatcagtgtgtaggggaggtctcaaggtcattgccctacagaaaccaggctgggtgcggtggctcacncctgtcatcccagcactttgggaggctgaggcgggtggatcacctgcggtcaggagttcgagaccagcctggccaacanggtgaagaccccgtctctactaaaaatacaaaagtaagctgggtgtggtggcacatgcccgtaatcccagctactcaagaggctgaggcaggaaaatcgcttgaacccgagagttggaggttgcngtgagccgagattgcgccattgcactccagcctgggcgacagagtgagacgccatctgg

SEQ ID NO: 85515 - DNA, 2036 bp, Homo sapiens
  misc_feature (950)..(950): n is a, c, g, or t
  misc_feature (1301)..(1301): n is a, c, g, or t
cacacacacatcgggatatttttcttgtttccttcttccagagggtgtaggagttgtgttccaagtttgttcctgcaaaccctccgatgaggccagctgcattcatcggggcctggatggccgcacctctctctccccgccctgtctcctgcactcagtctcatttccagatggggaaagggagacccaggctgcggtgacccactgaggcacaggatcagtgagaacccagccctggctttgcccagacctctcaagggcacttcgtgggaccattgccggccgttgtggcatctgtccctggccttgcccccatccgtctctgcacagcccaggtgggtccgagccagccccaggtctccagggtcccagcccagcctctagaagagccagcagcagggctggaagggagagcacatgctgggccttggggctgccttggacctcaggccgttgacaaggaaaagcggagagttgggaaaaaaggacaaatagctgagcgccagccgcagtccgggggacgggagcctcgtgcgactctcggagtgctggccagattggcagaggggaggagagaggaaaaactcaggctctgaggaaaaacctctccagcccagcgcgtggcctggcattaacccactgcagccccaggaagtggttccaccccaggcagccaacaaggcggtgcctgaactatgtctgtggatgacggagccacgacctgtccctcagggctcagcgctgcggctatgtccagggacccctggccgtgcccacgtcggggcttcccgttccttacctgccatgagaatgagatgtccagggacctccctgctccagctgggacctgtggggctttgtctgttgtcccgagcaccttggagatgtcatttctaacattttaacccaggaatccccccaccaagggacagagtgcaaggacatgatcnaacagaaaaagttctggtacaagatcaaccccgtggggtggtgagtgctgcagccccgggcctcacatcctgccgtccctgtgggagattggagcggtcccagtgcccaccgctgattctctggctccagcaacccctccaggtggatccgtcccacgcagcctggcctgaaacactgcccagccactgggtccagtaagacagagcctcgagtcattctgccgagaggatccagaaacacagactttttctggggtcctggaggcttctggcccatggggagcccctgggtcccagcgatccagccctgatgtgctgagggtgcagggcccagctgcagagcagaggagngtggcccccagggaccagcagcacgaaaggcacactgaggcacactggcaggcctgggctgcagagagcctgaaggtcatggggtagctgatggaagcaggaagaccccatacagcagcgaccactgaggctggtgctgcactttctcagggaattgagtgtgggctcccaccatcccggccactggcttcctccaaagcctcctcctcttacatcagcaaaccttctgttcggtgaccccctcagtgaccctctgtgcttgccttcgtggtcttcctcatggaggatttcgggtcagcgtgggggtcagaggtcatttcccataccccctcaaaggtacttcttgctgtggtccccacactctgacaccctcttctgaaatgaacacttttttgttgttgttgttgagacagagtcttgctctgtcgcccaggctggagtgcagtggcacaatcttagctcactgcaacctccacctcccaggttcaagcgattttcatgcctcagcttcctgtttgaagtcaagtcagaggtaaaccggtcagttacagaagcaggatttctaggatttctaactccagctgttcccatactgtctagtttaaattatggctgttaaggccgggcgggtgactcgggcaggtaatcccagaactttgggaggcccagacagaaggatcgcttgaggtcaggaatttgagacctggccagcatggtgaaaaccctgtctctatt

SEQ ID NO: 85516 - DNA, 2600 bp, Homo sapiens
  misc_feature (950)..(950): n is a, c, g, or t
  misc_feature (1301)..(1301): n is a, c, g, or t
  misc_feature (2416)..(2416): n is a, c, g, or t
  misc_feature (2541)..(2541): n is a, c, g, or t
cacacacacatcgggatatttttcttgtttccttcttccagagggtgtaggagttgtgttccaagtttgttcctgcaaaccctccgatgaggccagctgcattcatcggggcctggatggccgcacctctctctccccgccctgtctcctgcactcagtctcatttccagatggggaaagggagacccaggctgcggtgacccactgaggcacaggatcagtgagaacccagccctggctttgcccagacctctcaagggcacttcgtgggaccattgccggccgttgtggcatctgtccctggccttgcccccatccgtctctgcacagcccaggtgggtccgagccagccccaggtctccagggtcccagcccagcctctagaagagccagcagcagggctggaagggagagcacatgctgggccttggggctgccttggacctcaggccgttgacaaggaaaagcggagagttgggaaaaaaggacaaatagctgagcgccagccgcagtccgggggacgggagcctcgtgcgactctcggagtgctggccagattggcagaggggaggagagaggaaaaactcaggctctgaggaaaaacctctccagcccagcgcgtggcctggcattaacccactgcagccccaggaagtggttccaccccaggcagccaacaaggcggtgcctgaactatgtctgtggatgacggagccacgacctgtccctcagggctcagcgctgcggctatgtccagggacccctggccgtgcccacgtcggggcttcccgttccttacctgccatgagaatgagatgtccagggacctccctgctccagctgggacctgtggggctttgtctgttgtcccgagcaccttggagatgtcatttctaacattttaacccaggaatccccccaccaagggacagagtgcaaggacatgatcnaacagaaaaagttctggtacaagatcaaccccgtggggtggtgagtgctgcagccccgggcctcacatcctgccgtccctgtgggagattggagcggtcccagtgcccaccgctgattctctggctccagcaacccctccaggtggatccgtcccacgcagcctggcctgaaacactgcccagccactgggtccagtaagacagagcctcgagtcattctgccgagaggatccagaaacacagactttttctggggtcctggaggcttctggcccatggggagcccctgggtcccagcgatccagccctgatgtgctgagggtgcagggcccagctgcagagcagaggagngtggcccccagggaccagcagcacgaaaggcacactgaggcacactggcaggcctgggctgcagagagcctgaaggtcatggggtagctgatggaagcaggaagaccccatacagcagcgaccactgaggctggtgctgcactttctcagggaattgagtgtgggctcccaccatcccggccactggcttcctccaaagcctcctcctcttacatcagcaaaccttctgttcggtgaccccctcagtgaccctctgtgcttgccttcgtggtcttcctcatggaggatttcgggtcagcgtgggggtcagaggtcatttcccataccccctcaaaggtacttcttgctgtggtccccacactctgacaccctcttctgaaatgaacacttttttgttgttgttgttgagacagagtcttgctctgtcgcccaggctggagtgcagtggcacaatcttagctcactgcaacctccacctcccaggttcaagcgattttcatgcctcagcttcccgagtagctgggattacaggcatgtgccaccaagcccagctaatttttgtatttttagtagagatgaggtttcaccatgttggccaggctggtctcgaacttctgacctcaagtgattcgcccgcctcggcctcccaaagtgctgggattacaagcatgagccactgcgcccggccacaaacactttttttttttaaacaagtgaaaacaagtttattaacaaagttaagaaataaagaatggctattccatagggagagcagcctgaataaacactttttttgttgttgttgaggcagagcctcactctgtcgcccaggcaggagtgcagtggtgcgacctcagctctcagctccctgcaccgtccacctcctgggttcaagcgcttcttccccaagtagctgggactataggcacacaccaccatgcccggctaatttttctctttttagtagagacaggatttcgccatgtgggtcgggctggtctcgaactcctggtctcaagtgatccgccctcctcggcctgtcatcccagcactttgggaggctgaggcgggtggatcacctgcggtcaggagttcgagaccagcctggccaacanggtgaagaccccgtctctactaaaaatacaaaagtaagctgggtgtggtggcacatgcccgtaatcccagctactcaagaggctgaggcaggaaaatcgcttgaacccgagagttggaggttgcngtgagccgagattgcgccattgcactccagcctgggcgacagagtgagacgccatctgg

SEQ ID NO: 85517 - DNA, 3014 bp, Homo sapiens
  misc_feature (2971)..(2971): n is a, c, g, or t
cgtttgcggagcccgcggcggcgtttcctggggcaacagcaatggcggcctcgctgtccgagcggctcttctcgctggagctgctggtggactgggtgcgtttggaagcccggctgctgccgtcccccgctgccgcagtggagcaggaggaggaagaggaggaaaaggagcagggggaggcctcgtcgccgcgcggtctgtgccccgccgtggccttccgcctgctggacttccccacgctgttggtttaccctcctgacggccccggcgctcccgccgccgaaccgtggcccggtgtcatccgcttcggtcgcggcaagtcctgcctcttccgcctgcagcctgctaccctgcactgccggctcctgcggaccccgcttgccaccttgctgctgcagctgccccctgggcgcccgacgcccaccccacagctcctgggggcctgcgacatttcgctggccaccgcagcgcacagggtcgtggggccggccgcctccggatgctcccaccgtcaccggggacgtttccccctgcataatcgagtgggcgagcggactggggacattgcactggcctaccgcctgactgacctgggaagccgcctgctgagccaacttgagcggcccctcaccttcacccgcacaggaggaggagcggaggtcagtccccaaacccagcaggaaagacagcagctgcagcagccagcctcacagccaagcccaaaagaggctgataagccgctgggggagttagaaatcccagaggcacagaaggatttgaaggaaatggttaaaagtaaggccgaatgtgataatgtgggttctgtggagaatggcaaaaccaattctgttgttacatgttcaggtgctggcaatgggagaaatgttagctccctaaatgaggaagtcacagaattggacatggagaccaatatattttgccctcctcctttgtattacactaacttgacccaagaaaaaccgccccctgcacaggctaaaatcaccattgagcctcaaatgaatgcacctgaggaaatggatgatgcttctcctgaaaaaaagcgtgtaaatcccccagcacacaggagttgtctaaagcatccaagttctgcagcacacgaacatcctccaatgcttgtaaatcctccacatattcagaatataggagcaactaatcaaacatgtcaaactgaacaaaatcgaattaatacaataaggcagttgcctttgttaaatgctttgttagttgagttgtccttgttatatgaccaacctgtgacaagtcctgctcatatacatcctcacctagcctggttatataggactgaggataagaagtcacccgaatcttctgccaaatccacatgccggtctgaagccaagaaggataagcgttctgtggggggatgtgaaaagtcagtgagtcttcagtataaaaagaaccaaattgaaaactataaggaagataaatattctgaaaagagcagtggtgccctccataaaagagttccaaaagggaggctactttatggcttaacaaatacactaagactacgtttaaagctgacaaatcctgatatgttggtggtacatgaaaaaagagaactatatagaaaaagacaatcacaaatgttgggtacaaaattcagaattccgtcatccaaagttaaactattaagctctgcagaacaaagtcagaagccacaactgcctgaagataagtatttagattcagatgcatctttcactgaaaatagtgatacctcaagacaaatcagtggagtttttgatgagcccagcacaagtaaagaaactaaactgaaatatgcaactgaaaaaaagacagttgattgtagtaaaaatagaatcaataatgtttcattggaagaagttgtgagtcctgcaaattccattattccagaaaggcttacccctacaaatattctgggaggaaatgtggaaatgaaaatccaaagtccatgtgttttccaacaggatgctgttgttgacagaattgtagataaggaaatagatattagacaggtcaaaaccacagataatgacattcttatggctgatataagtgacaagagaacaggtaaaaatagttgctatgaaaacatctcagaactgaagtattcagatgatttgtctagcccttgctattctgaagatttctgtaccagtgaggacaccagcagaagtttcaaagctcatgatagcagttcaaggacagaaaatccaaaacatagtcaatatacaagcaagtctagtgacacaggagtgtccaaaaagaaaaatagtagtgacaggagttctatccttagcccacctttttcagccgggtcacctgtacactcatacagaaaatttcatatttcaaagactcaggataaaagtttggaggaagcatctagtatctctgctagtgatttatcttcaacacattggactgaacaaaaagaaaaccagatagatcaaaatagtatgcacaattctgaaattacaaagagagctcaagacatctctgttaaaacaagaagtagttggaaatctttagaaaaaagccagtcaccacaaacatcccaggtgagttcttacctgccttcaaatgtgtccgaacttaatgtcctggatagcagtacatcagatcactttgaagaaggcaatgatgatgttggttcactaaatatttccaagcaatgcaaagatatttgtgaattagtaataaataaacttccaggatacacaatgtaaaaatacatgcttttaaaaaactttcaaggacctatgtgtactgttagtgaaaaaaattttaaagctgttttagttcatgaattatgtgaataattttttaaagaaatatgaattaacgttattcctttgatgtttaaatggtattttaccattaaatctgataatattggtgtgtggactcacatacccagatataaatcttcattgtttgntcgtaaggataagggtatgtttttctgggggaaagaaaaaaaa

SEQ ID NO: 85518 - DNA, 4938 bp, Homo sapiens
cgtttgcggagcccgcggcggcgtttcctggggcaacagcaatggcggcctcgctgtccgagcggctcttctcgctggagctgctggtggactgggtgcgtttggaagcccggctgctgccgtcccccgctgccgcagtggagcaggaggaggaagaggaggaaaaggagcagggggaggcctcgtcgccgcgcggtctgtgccccgccgtggccttccgcctgctggacttccccacgctgttggtttaccctcctgacggccccggcgctcccgccgccgaaccgtggcccggtgtcatccgcttcggtcgcggcaagtcctgcctcttccgcctgcagcctgctaccctgcactgccggctcctgcggaccccgcttgccaccttgctgctgcagctgccccctgggcgcccgacgcccaccccacagctcctgggggcctgcgacatttcgctggccaccgcagcgcacagggtcgtggggccggccgcctccggatgctcccaccgtcaccggggacgtttccccctgcataatcgagtgggcgagcggactggggacattgcactggcctaccgcctgactgacctgggaagccgcctgctgagccaacttgagcggcccctcaccttcacccgcacaggaggaggagcggaggtcagtccccaaacccagcaggaaagacagcagctgcagcagccagcctcacagccaagcccaaaagaggctgataagccgctgggggagttagaaatcccagaggcacagaaggatttgaaggaaatggttaaaagtaaggccgaatgtgataatgtgggttctgtggagaatggcaaaaccaattctgttgttacatgttcaggtgctggcaatgggagaaatgttagctccctaaatgaggaagtcacagaattggacatggagaccaatatattttgccctcctcctttgtattacactaacttgacccaagaaaaaccgccccctgcacaggctaaaatcaccattgagcctcaaatgaatgcacctgaggaaatggatgatgcttctcctgaaaaaaagcgtgtaaatcccccagcacacaggagttgtctaaagcatccaagttctgcagcacacgaacatcctccaatgcttgtaaatcctccacatattcagaatataggagcaactaatcaaacatgtcaaactgaacaaaatcgaattaatacaataaggcagttgcctttgttaaatgctttgttagttgagttgtccttgttatatgaccaacctgtgacaagtcctgctcatatacatcctcacctagcctggttatataggactgaggataagaagtcacccgaatcttctgccaaatccacatgccggtctgaagccaagaaggataagcgttctgtggggggatgtgaaaagtcagtgagtcttcagtataaaaagaaccaaattgaaaactataaggaagataaatattctgaaaagagcagtggtgccctccataaaagagttccaaaagggaggctactttatggcttaacaaatacactaagactacgtttaaagctgacaaatcctgatatgttggtggtacatgaaaaaagagaactatatagaaaaagacaatcacaaatgttgggtacaaaattcagaattccgtcatccaaagttaaactattaagctctgcagaacaaagtcagaagccacaactgcctgaagataagtatttagattcagatgcatctttcactgaaaatagtgatacctcaagacaaatcagtggagtttttgatgagcccagcacaagtaaagaaactaaactgaaatatgcaactgaaaaaaagacagttgattgtagtaaaaatagaatcaataatgtttcattggaagaagttgtgagtcctgcaaattccattattccagaaaggcttacccctacaaatattctgggaggaaatgtggaaatgaaaatccaaagtccatgtgttttccaacaggatgctgttgttgacagaattgtagataaggaaatagatattagacaggtcaaaaccacagataatgacattcttatggctgatataagtgacaagagaacaggtaaaaatagttgctatgaaaacatctcagaactgaagtattcagatgatttgtctagcccttgctattctgaagatttctgtaccagtgaggacaccagcagaagtttcaaagctcatgatagcagttcaaggacagaaaatccaaaacatagtcaatatacaagcaagtctagtgacacaggagtgtccaaaaagaaaaatagtagtgacaggagttctatccttagcccacctttttcagccgggtcacctgtacactcatacagaaaatttcatatttcaaagactcaggataaaagtttggaggaagcatctagtatctctgctagtgatttatcttcaacacattggactgaacaaaaagaaaaccagatagatcaaaatagtatgcacaattctgaaattacaaagagagctcaagacatctctgttaaaacaagaagtagttggaaatctttagaaaaaagccagtcaccacaaacatcccaggtgagttcttacctgccttcaaatgtgtccgaacttaatgtcctggatagcagtacatcagatcactttgaagaaggcaatgatgatgttggttcactaaatatttccaagcaatgcaaagatatttgtgaattagtaataaataaacttccaggatacacaatgtaaaaatacatgcttttaaaaaactttcaaggacctatgtgtactgttagtgaaaaaaattttaaagctgttttagttcatgaattatgtgaataattttttaaagaaatatgaattaacgttattcctttgatgtttaaatggtattttaccattaaatctgataatattgattattaaatcatataaacagatttctttttaaattgtttaatcataagaataaaagtgtgtctttctaaattgtctctcttaaagtgtctagtctacagtattgatcattctaaagctgacttcatgcacaccactgaaaaagaaggctagttagtaaggacagcctcaaattttaattggaacaaattatttaacaaatatagaagacttactgtgttagatgcagaaaggtgcagaatctatttatgatagagccctgctgttttaaaagcttacagttgtatgtagataagaagtcttccttgacatatacatatcccatatccccaataggtgaagttgcttttatatgctctcatagtgccctgcaccttttgtttataagccacaatttgtgtgattacttgattaaagtttatcttccactaggcttcagttgtgtgatgggatcatatttgttttacacatcagtgcatttttgtatttagcacaattcctggcatgtggctgcagtgcaataaaaacatttgttgaaaaaaacgaagcccaggcatttaaaatacctaatgggagggtttagaattaagcagcaaaaataagcagattccctaaaataaacctgcagaaaatccttattggaaatatatttgactgtaatatttctgttttgcttggtataaatagccttcaggtgttctctgaaatatttggaaagggaaacttaagaaggtatcttttatacagtttctgatataggagttcagtttcttgtcatttcagtttgttcaatggttatttttagtgtatggaactttgtttttatgaaatccagtgataatttataatttattccattggttttatatttagactttattctgtgttcaaatatttacatatattttcttctagctgtgttatactttaatttttagactttttaatatatctaacgtttttgaatgtatgaagtgaggttctaatttcctttctttaaaggtaattaattatataggtattctgaatgatcataatactagaatatagatagatggtaaaaagagagaagaggatgttacattttggggagcaatatgaataaaagagtgatgggaatgagcctgatatatttatgggacaatttaaaatattatcttgaatagaatgatccactcatgctacagagtggtagaaaggacatttgttgagtaaggaaaatgccagattacagagagcctcaaatgctaagtataataatagaattctaagcaataggaataacagattattttaggttataaatgagcactagtaagtagtcatgacattttgaatattttaaattattgaaaataataagcagagaaattatatcagttaaagttttgagatatgaaaggtttctgtggctagtggctatgatcttaatttttctaaaatataaagcatatagtataacatttcacaaaatcaaaatattgtaatgccaggtattgtaactagatgtttaatgatgtgaactgtgtaaattgtttaatagcaatttgtcattactatggaagagacaataaaaatataagcaatatcagaatcatcaaagaaataattccttataaaccaacgttttatttggtagagagtaagtcattgtctgtggtaagaataggtaaaatgattaatttagcaagtctaaggtacaacaagaccaaaaaactaatgcactttaaattacaaagctgagtagctgaatccgcttctctttgagttaatccatgaatacttatttctagaattgtgataattgtttcttctagtctaattctagtgaaaatatctgttttcatgtatttagtccttcctattacattctacaaattctactccatgttttaattctacaatctataagcttattttaaaagaattttgtaatagatactattcatggagccttatttatctccttagttgcttaaaattattgaaacatgaaatagtatttcaagtc

SEQ ID NO: 85519 - DNA, 415 bp, Homo sapiens
gtctctcaagattattttcttttcccccaaattctagagtgtgtccgcacactgttcctcatggtacccactgtatgtttccatgtctgtgggtccacaggatgctccgcggccaagcctccctgggctcctctgatctgtggccgtttctcatgcttccttgtttttggcgactttttgaggaccgttggggtcggttattttgtaggatgtgcctctgttggaatttgtctcctgactagactggggtcacaggttttggggagggaggacatggaggtgaagtccttctcatcacatcctgtccaggccagcactgtcaggaggactcagtgcttaatgctgatgcaggtcacctggctgaggtgtgctcttcagcattttccacagtcaagtgactctttcagctttcatc

SEQ ID NO: 85520 - DNA, 3361 bp, Homo sapiens
cacaccttcggcagcaggagggcggcagcttctcgcaggcggcagggcgggcggccaggatcatgtccaccaccacatgccaagtggtggcgttcctcctgtccatcctggggctggccggctgcatcgcggccaccgggatggacatgtggagcacccaggacctgtacgacaaccccgtcacctccgtgttccagtacgaagggctctggaggagctgcgtgaggcagagttcaggcttcaccgaatgcaggccctatttcaccatcctgggacttccagccatgctgcaggcagtgcgagccctgatgatcgtaggcatcgtcctgggtgccattggcctcctggtatccatctttgccctgaaatgcatccgcattggcagcatggaggactctgccaaagccaacatgacactgacctccgggatcatgttcattgtctcaggtctttgtgcaattgctggagtgtctgtgtttgccaacatgctggtgactaacttctggatgtccacagctaacatgtacaccggcatgggtgggatggtgcagactgttcagaccaggtacacatttggtgcggctctgttcgtgggctgggtcgctggaggcctcacactaattgggggtgtgatgatgtgcatcgcctgccggggcctggcaccagaagaaaccaactacaaagccgtttcttatcatgcctcaggccacagtgttgcctacaagcctggaggcttcaaggccagcactggctttgggtccaacaccaaaaacaagaagatatacgatggaggtgcccgcacagaggacgaggtacaatcttatccttccaagcacgactatgtgtaatgctctaagacctctcagcacgggcggaagaaactcccggagagctcacccaaaaaacaaggagatcccatctagatttcttcttgcttttgactcacagctggaagttagaaaagcctcgatttcatctttggagaggccaaatggtcttagcctcagtctctgtctctaaatattccaccataaaacagctgagttatttatgaattagaggctatagctcacattttcaatcctctatttctttttttaaatataactttctactctgatgagagaatgtggttttaatctctctctcacattttgatgatttagacagactccccctcttcctcctagtcaataaacccattgatgatctatttcccagcttatccccaagaaaacttttgaaaggaaagagtagacccaaagatgttattttctgctgtttgaattttgtctccccacccccaacttggctagtaataaacacttactgaagaagaagcaataagagaaagatatttgtaatctctccagcccatgatctcggttttcttacactgtgatcttaaaagttaccaaaccaaagtcattttcagtttgaggcaaccaaacctttctactgctgttgacatcttcttattacagcaacaccattctaggagtttcctgagctctccactggagtcctctttctgtcgcgggtcagaaattgtccctagatgaatgagaaaattatttttttaatttaagtcctaaatatagttaaaataaataatgttttagtaaaatgatacactatctctgtgaaatagcctcacccctacatgtggatagaaggaaatgaaaaaataattgctttgacattgtctatatggtactttgtaaagtcatgcttaagtacaaattccatgaaaagctcactgatcctaattctttccctttgaggtctctatggctctgattgtacatgatagtaagtgtaagccatgtaaaaagtaaataatgtctgggcacagtggctcacacctgtaatcctagcactttgggaggctgaggaggaaggatcacttgagcccagaagttcgagactagcctgggcaacatggagaagccctgtctctacaaaatacagagagaaaaaatcagccagtcatggtggcatacacctgtagtcccagcattccgggaggctgaggtgggaggatcacttgagcccagggaggttggggctgcagtgagccatgatcacaccactgcactccagccaggtgacatagcgagatcctgtctaaaaaaataaaaaataaataatggaacacagcaagtcctaggaagtaggttaaaactaattctttaaaaaaaaaaaaaagttgagcctgaattaaatgtaatgtttccaagtgacaggtatccacatttgcatggttacaagccactgccagttggcagtagcactttcctggcactgtggtcggttttgttttgttttgctttgtttagagacggggtctcactttccaggctggcctcaaactcctgcactcaagcaattcttctaccctggcctcccaagtagctggaattacaggtgtgcgccatcacaactagctggtggtcagttttgttactctgagagctgttcacttctctgaattcacctagagtggttggaccatcagatgtttgggcaaaactgaaagctctttgcaaccacacaccttccctgagcttacatcactgcccttttgagcagaaagtctaaattccttccaagacagtagaattccatcccagtaccaaagccagataggccccctaggaaactgaggtaagagcagtctctaaaaactacccacagcagcattggtgcaggggaacttggccattaggttattatttgagaggaaagtcctcacatcaatagtacatatgaaagtgacctccaaggggattggtgaatactcataaggatcttcaggctgaacagactatgtctggggaaagaacggattatgccccattaaataacaagttgtgttcaagagtcagagcagtgagctcagaggcccttctcactgagacagcaacatttaaaccaaaccagaggaagtatttgtggaactcactgcctcagtttgggtaaaggatgagcagacaagtcaactaaagaaaaaagaaaagcaaggaggagggttgagcaatctagagcatggagtttgttaagtgctctctggatttgagttgaagagcatccatttgagttgaaggccacagggcacaatgagctctcccttctaccaccagaaagtccctggtcaggtctcaggtagtgcggtgtggctcagctgggtttttaattagcgcattctctatccaacatttaattgtttgaaagcctccatatagttagattgtgctttgtaattttgttgttgttgctctatcttattgtatatgcattgagtattaacctgaatgttttgttacttaaatattaaaaacactgttatcctacagttgaa

SEQ ID NO: 85521 - DNA, 3276 bp, Homo sapiens
aaactctgctgtaacttcctaaattgaactggtgtggggacagctggattccagtgtggttctgctactgaccagccctgtgacctccagcaggttgtttgccctctctgtgcctctatcacctcatccatgaaatgagcagcttgaggcaatgggctgaacgtaggtaccctccagctcacaaattctatgatcctttgacgtaacaatgttcccctggacattgtttctggttcagctgtatttttattgattgaaagagggaactcattagttaccgaggatttggggatacctctctccaccatccaaaaatgtccatttggaatcacaattattttattctcaggagattttgttctcggctcagcaaagctctaaaacagtgcaagaacttctgttccactgcagaggcagtaaaaccagtgtaccaaaaactaaggttactaactatcctggtttgccccggactgatgggtttccagggacactggactttcagtgccaagactgagacagtttatggtaaataggaggttggtcctactaacaaagacatctacaatcatggaatgtttatttttctttcagctacaaagccgtttcttatcatgcctcaggccacagtgttgcctacaagcctggaggcttcaaggccagcactggctttgggtccaacaccaaaaacaagaagatatacgatggaggtgcccgcacagaggacgaggtacaatcttatccttccaagcacgactatgtgtaatgctctaagacctctcagcacgggcggaagaaactcccggagagctcacccaaaaaacaaggagatcccatctagatttcttcttgcttttgactcacagctggaagttagaaaagcctcgatttcatctttggagaggccaaatggtcttagcctcagtctctgtctctaaatattccaccataaaacagctgagttatttatgaattagaggctatagctcacattttcaatcctctatttctttttttaaatataactttctactctgatgagagaatgtggttttaatctctctctcacattttgatgatttagacagactccccctcttcctcctagtcaataaacccattgatgatctatttcccagcttatccccaagaaaacttttgaaaggaaagagtagacccaaagatgttattttctgctgtttgaattttgtctccccacccccaacttggctagtaataaacacttactgaagaagaagcaataagagaaagatatttgtaatctctccagcccatgatctcggttttcttacactgtgatcttaaaagttaccaaaccaaagtcattttcagtttgaggcaaccaaacctttctactgctgttgacatcttcttattacagcaacaccattctaggagtttcctgagctctccactggagtcctctttctgtcgcgggtcagaaattgtccctagatgaatgagaaaattatttttttaatttaagtcctaaatatagttaaaataaataatgttttagtaaaatgatacactatctctgtgaaatagcctcacccctacatgtggatagaaggaaatgaaaaaataattgctttgacattgtctatatggtactttgtaaagtcatgcttaagtacaaattccatgaaaagctcactgatcctaattctttccctttgaggtctctatggctctgattgtacatgatagtaagtgtaagccatgtaaaaagtaaataatgtctgggcacagtggctcacacctgtaatcctagcactttgggaggctgaggaggaaggatcacttgagcccagaagttcgagactagcctgggcaacatggagaagccctgtctctacaaaatacagagagaaaaaatcagccagtcatggtggcatacacctgtagtcccagcattccgggaggctgaggtgggaggatcacttgagcccagggaggttggggctgcagtgagccatgatcacaccactgcactccagccaggtgacatagcgagatcctgtctaaaaaaataaaaaataaataatggaacacagcaagtcctaggaagtaggttaaaactaattctttaaaaaaaaaaaaaagttgagcctgaattaaatgtaatgtttccaagtgacaggtatccacatttgcatggttacaagccactgccagttggcagtagcactttcctggcactgtggtcggttttgttttgttttgctttgtttagagacggggtctcactttccaggctggcctcaaactcctgcactcaagcaattcttctaccctggcctcccaagtagctggaattacaggtgtgcgccatcacaactagctggtggtcagttttgttactctgagagctgttcacttctctgaattcacctagagtggttggaccatcagatgtttgggcaaaactgaaagctctttgcaaccacacaccttccctgagcttacatcactgcccttttgagcagaaagtctaaattccttccaagacagtagaattccatcccagtaccaaagccagataggccccctaggaaactgaggtaagagcagtctctaaaaactacccacagcagcattggtgcaggggaacttggccattaggttattatttgagaggaaagtcctcacatcaatagtacatatgaaagtgacctccaaggggattggtgaatactcataaggatcttcaggctgaacagactatgtctggggaaagaacggattatgccccattaaataacaagttgtgttcaagagtcagagcagtgagctcagaggcccttctcactgagacagcaacatttaaaccaaaccagaggaagtatttgtggaactcactgcctcagtttgggtaaaggatgagcagacaagtcaactaaagaaaaaagaaaagcaaggaggagggttgagcaatctagagcatggagtttgttaagtgctctctggatttgagttgaagagcatccatttgagttgaaggccacagggcacaatgagctctcccttctaccaccagaaagtccctggtcaggtctcaggtagtgcggtgtggctcagctgggtttttaattagcgcattctctatccaacatttaattgtttgaaagcctccatatagttagattgtgctttgtaattttgttgttgttgctctatcttattgtatatgcattgagtattaacctgaatgttttgttacttaaatattaaaaacactgttatcctacagttgaa

SEQ ID NO: 85522 - DNA, 3308 bp, Homo sapiens
tgcgccaccatggccgtgactgcctgtcagggcttggggttcgtggtttcactgattgggattgcgggcatcattgctgccacctgcatggaccagtggagcacccaagacttgtacaacaaccccgtaacagctgttttcaactaccaggggctgtggcgctcctgtgtccgagagagctctggcttcaccgagtgccggggctacttcaccctgctggggctgccagccatgctgcaggcagtgcgagccctgatgatcgtaggcatcgtcctgggtgccattggcctcctggtatccatctttgccctgaaatgcatccgcattggcagcatggaggactctgccaaagccaacatgacactgacctccgggatcatgttcattgtctcaggtctttgtgcaattgctggagtgtctgtgtttgccaacatgctggtgactaacttctggatgtccacagctaacatgtacaccggcatgggtgggatggtgcagactgttcagaccaggtacacatttggtgcggctctgttcgtgggctgggtcgctggaggcctcacactaattgggggtgtgatgatgtgcatcgcctgccggggcctggcaccagaagaaaccaactacaaagccgtttcttatcatgcctcaggccacagtgttgcctacaagcctggaggcttcaaggccagcactggctttgggtccaacaccaaaaacaagaagatatacgatggaggtgcccgcacagaggacgaggtacaatcttatccttccaagcacgactatgtgtaatgctctaagacctctcagcacgggcggaagaaactcccggagagctcacccaaaaaacaaggagatcccatctagatttcttcttgcttttgactcacagctggaagttagaaaagcctcgatttcatctttggagaggccaaatggtcttagcctcagtctctgtctctaaatattccaccataaaacagctgagttatttatgaattagaggctatagctcacattttcaatcctctatttctttttttaaatataactttctactctgatgagagaatgtggttttaatctctctctcacattttgatgatttagacagactccccctcttcctcctagtcaataaacccattgatgatctatttcccagcttatccccaagaaaacttttgaaaggaaagagtagacccaaagatgttattttctgctgtttgaattttgtctccccacccccaacttggctagtaataaacacttactgaagaagaagcaataagagaaagatatttgtaatctctccagcccatgatctcggttttcttacactgtgatcttaaaagttaccaaaccaaagtcattttcagtttgaggcaaccaaacctttctactgctgttgacatcttcttattacagcaacaccattctaggagtttcctgagctctccactggagtcctctttctgtcgcgggtcagaaattgtccctagatgaatgagaaaattatttttttaatttaagtcctaaatatagttaaaataaataatgttttagtaaaatgatacactatctctgtgaaatagcctcacccctacatgtggatagaaggaaatgaaaaaataattgctttgacattgtctatatggtactttgtaaagtcatgcttaagtacaaattccatgaaaagctcactgatcctaattctttccctttgaggtctctatggctctgattgtacatgatagtaagtgtaagccatgtaaaaagtaaataatgtctgggcacagtggctcacacctgtaatcctagcactttgggaggctgaggaggaaggatcacttgagcccagaagttcgagactagcctgggcaacatggagaagccctgtctctacaaaatacagagagaaaaaatcagccagtcatggtggcatacacctgtagtcccagcattccgggaggctgaggtgggaggatcacttgagcccagggaggttggggctgcagtgagccatgatcacaccactgcactccagccaggtgacatagcgagatcctgtctaaaaaaataaaaaataaataatggaacacagcaagtcctaggaagtaggttaaaactaattctttaaaaaaaaaaaaaagttgagcctgaattaaatgtaatgtttccaagtgacaggtatccacatttgcatggttacaagccactgccagttggcagtagcactttcctggcactgtggtcggttttgttttgttttgctttgtttagagacggggtctcactttccaggctggcctcaaactcctgcactcaagcaattcttctaccctggcctcccaagtagctggaattacaggtgtgcgccatcacaactagctggtggtcagttttgttactctgagagctgttcacttctctgaattcacctagagtggttggaccatcagatgtttgggcaaaactgaaagctctttgcaaccacacaccttccctgagcttacatcactgcccttttgagcagaaagtctaaattccttccaagacagtagaattccatcccagtaccaaagccagataggccccctaggaaactgaggtaagagcagtctctaaaaactacccacagcagcattggtgcaggggaacttggccattaggttattatttgagaggaaagtcctcacatcaatagtacatatgaaagtgacctccaaggggattggtgaatactcataaggatcttcaggctgaacagactatgtctggggaaagaacggattatgccccattaaataacaagttgtgttcaagagtcagagcagtgagctcagaggcccttctcactgagacagcaacatttaaaccaaaccagaggaagtatttgtggaactcactgcctcagtttgggtaaaggatgagcagacaagtcaactaaagaaaaaagaaaagcaaggaggagggttgagcaatctagagcatggagtttgttaagtgctctctggatttgagttgaagagcatccatttgagttgaaggccacagggcacaatgagctctcccttctaccaccagaaagtccctggtcaggtctcaggtagtgcggtgtggctcagctgggtttttaattagcgcattctctatccaacatttaattgtttgaaagcctccatatagttagattgtgctttgtaattttgttgttgttgctctatcttattgtatatgcattgagtattaacctgaatgttttgttacttaaatattaaaaacactgttatcctacagttgaa

SEQ ID NO: 85523 - DNA, 399 bp, Homo sapiens
acccagaccttgattcagatcctagctcaggaactttccagctgtgtgacctagacagacctccacctctttgaaactcagtgttgataatgcccattttgaaagataatagttccagcactttgagaggctgaggcaagaagattgtttggccaggggttcaagaccaacctgggcaacagttgcactgccccccaccccttcacccctcccaacaaaacaaaaagttatctgggtagggtggcatctgtggtcctagcttcttgggagtctgagatgggaggatcacttgagcccaggagtttgaggttatagtgagctatgattgcaccattgcattccagcctgggcagcagagcaagaccctgtctctaaaaaacataataaacaaattttatt

SEQ ID NO: 85524 - DNA, 326 bp, Homo sapiens
caaataagaacccagagagagggagagattcacagacaatagcttaaaaagtctagaaattatagaccgattgaggtcagcaagaaacaaattattcaatatatcccctgagggctagagccagactttcccctatgattccaaaattacttcgcagtttcattagggtgaaaggcagtgcagtctcatgagttcagaaagtaaaggttgttccttaaaatttagatagacttgacaaccacttaggatggcattttggcattctgtccctgctcatcaaagaagttgctcaaatttgtgggatagaggaatgagagcaagaagta

SEQ ID NO: 85525 - DNA, 335 bp, Homo sapiens
aataagattccttttcagaagtggtggtccccacattggttactgctatgtttgtggaaggatacattttctctgtatctttaatgtcttctgaagtagtcggtatcttatgtgaggtgctgcccaagtttggaggtaaactggccacagatgccagcatatctgtggtcttcactaggccagaggtggggagtgaagtcagatgaacaggagaagacggcctactttctggtaatgtagtaggtacaggggacggtgaggttattgctggtaaagacagaagggaagaggaagagctggttttttccacagagggtgggcttgtccctgatatg

SEQ ID NO: 85526 - DNA, 375 bp, Homo sapiens
tggagccttcctgcgttccagttcctctaggagaggccaagggctgccctgctcccagcttcagggagcctctgcctacatgggatggcccactgtgtggcgtcaggtacctggcacccactgagcatccggggaattaggtccctcctgtgccccagagctgctaggcagactgctaggcggttgactcaaggtgttacctgctagtgcctggggtgaaggctgcatggagcccaaccttgctcctggccttcctgtgctcaggcctctccccttttcgccagggcttcctggtgcctctcccatgaagagggaacttcccctccactcccatggaagacccaggtttgggctgttgccagctttgaggcccct

SEQ ID NO: 85527 - DNA, 338 bp, Homo sapiens
tgctgggattacaggcgtgagccactgcgcctggccatgtcatcacttctttactgtgtttatcctaatttggacatcctctggtagatagatgccctcttgcagaaggtcaagaactctgctgatcctgaaatgtcagctttttccgccaacgagcacctgagtcttctttctccacccccttctgcatgccaaccaaccccatgttctgtctgcaaaagtagggcctagcatgccttcctctacccatctgcaacgggaagtagtgaaggaccgttgctttctaagcaggagcaccccacttgtttttgttgttgtttttggttttggtttttttt

SEQ ID NO: 85528 - DNA, 290 bp, Homo sapiens
ccttagagtacacacgtaggacatttttcttccacgcctcgagtgcgttgagagggtcagactctgctgtgttccacatgttaatgagaggtgctgtttgaatgtgaaaaaaatgccacttgactttcatcccagtgtctctcctctgtgccgtccaggagatgccagcagatgggtcttggaatttttttttttttgagatggagtctcgctctgtcgcccaggctggagtgcagtggcgcgaactcggctcactgcaaacgcgaactcagctcactgcaagctctgcc

SEQ ID NO: 85529 - DNA, 339 bp, Homo sapiens
ggcgacgttaactgctctgggcgccctcgaccacgcgtggctgagcctcccccaccacttggaagaagcggcggctacttctgcatttttcctccggctcctcgcccccgctgcccgcggatgcccggcgggctgatgaagtttgaccttttttttccatcaaagtatctcccccaccaccacggtgccccgcggcccctccctccctcctttcccagccttggggagtcttttgagctgtctcccgagccccgcgtgggccacgcagcgtgcagagcctgggagggagaatgggggtgttcctctagctgcggaactgtggggggcgtacgtccccgg

SEQ ID NO: 85530 - DNA, 253 bp, Homo sapiens
acgtttcaagagaatggtaccaaagggataggatcaaattgccaagtgttaatgttacaacaaatgaataccaatgctttcttcttgcagaaaagcccttttttaagcctaaaaatgactactttttaatgaaatcacgttattcctggagatacttagagaagagttgagttacagggtacctcattcctcttccaggtggtagcaaagcctcaatacttgggccagatgtttactctcctctttcctctgt

SEQ ID NO: 85531 - DNA, 222 bp, Homo sapiens
cacacagagactcttctagatttaattgggatttaggagattaaagcaatatgacaaataaatacaatcttgatccttgattggattctccatcagagaagggagctataaaggacatactggagataattgagacattttttaaatgaatggctgtgttaggtaagcttattgaatcaacgctgaattttttgtgtacgataccggcagatggctgtgtaa

SEQ ID NO: 85532 - DNA, 350 bp, Homo sapiens
ctgtgactgatggcctcaggagtccaggaataggccttctagcacagcagctagtagggctcccccaagccatccgctggcgtgtggaggtgcaggacctgggggaggcagtccccaacccagctaggccaaggggtagggtttttaggtctgtttttaacagagctcagagcaccaggtgaaggtggaaagttggcaggaaaacaaggtcagcatcttattttttctatactcagcagagtgtgccattcccagtttctgtcctgaggatttcaaagaccacaacagccacatttctttccatcttccctcagccagtagtcatttaaaattcttcagttgttctgaag

SEQ ID NO: 85533 - DNA, 497 bp, Homo sapiens
ggcgagacaccgcgccctgccgagcgggggaccccagtgcggcttttcaccgaggaggagctggcccgatatggcgggaaagagggattttatggacgaggagccccctacaatgccttgacggggaaggactccactagaggggtagccaagatgtccttggatcctgcagacctcacccatgacactacgggtctcacggccaaggaactggaggccctggatgaggtcttcaccaaagtgtacaaagccaaataccccatcgtcggctacactgcccggagaattctcaatgaggatggcagccctaacctggacttcaagcctgaagaccagccccattttgacatcaaggacgagttctgatgttccccctgcaggagcaggttcttgggagcgtgaggcaggaagacactaggtgctgaatctcctgcaaaactggctgcctggaggccctgagccacccagatctgaataaaacagatgcttaccctgga

SEQ ID NO: 85534 - DNA, 733 bp, Homo sapiens
ggcgagacaccgcgccctgccgagcgggggaccccagtgcggcttttcaccgaggaggagctggcccgatatggcgggaaagagggattttatggacgaggagccccctacaatgccttgacggggaaggactccactagaggggtagccaagatgtccttggatcctgcagacctcacccatgacactacgggtctcacggccaaggaactggaggccctggatgaggtcttcaccaaagtgtacaaagccaaataccccatcgtcggctacactgcccggagaattctcaatgaggatggcagccctaacctggacttcaagcctgaagaccagccccattttgacatcaaggacgagttctgatgttccccctgcaggagcaggttcttgggagcgtgaggcaggaagacactaggtgctgaatctcctgcaaaactggctgcctggaggccctgagccacccagatctgaataaaacagatgcttaccctggaagagcaaatgcctcctgttgtccttggtcaggggttctgtctacctggggacccctgtctgcacaccagggatcaataagagccaaagtgggacacctcctagatgtcagtatcagctggctgggcagtggaattttgagcgacctttactttatacttttctgtgcttgacagattttcagccatgaccatgttcactttataatcaaaacaaaaataaaggtcccatttttaca

SEQ ID NO: 85535 - DNA, 250 bp, Homo sapiens
aatagttcctaacctgaaatacgcctatttaaaactgcccctccacactcaattcccgtttttattatattcttctatgttttctttttgccatggcatttatcatccaatatttgtgatgtttattgtgtatcgcctgtctcctgctgctggaaagtaagctcctcaaatgtatgagctttatagtctccttgttcacacctatattccaattatctacaacagtacctggctcatagtaaatactcaa

SEQ ID NO: 85536 - DNA, 228 bp, Homo sapiens
actgcctagaaacaacactgtagtaaataatcttcggtgttttgttgggcttgctattctgtccctaggtgttttgtttaccattgtaatgaatttactgagcacaggtgatccatgtaactgcctagaaacaacactgtagtaaataatgctttgaaattgaacatttgtgccctacccaacgctccaaagtcctaattgcgttgactttcccacaccagatgctga

SEQ ID NO: 85537 - DNA, 348 bp, Homo sapiens
aattttttgtatttttagtagagacagggtttcaccgtgttagccaggatggtctcgatctcctgacctcgtgatccacccgcttcagcctcccaaagtgctgggattacaggcgtgagccaccgcgcccagtcttttccttatttctttaaagattcctcatttctgcccttccttaaattttttgatgtaactaagaaataagaattattcacttaaaacatttaagaatttatcacaatatgctagatgggactagaatatttacgttgaccacacagaatattcttttgttacggcaaaatctacacaaacaagcaaactggttcaagtatttgctgggtatga

SEQ ID NO: 85538 - DNA, 389 bp, Homo sapiens
tcagttgtggggaccaactctcagagactatttcctaaatgttgactctgcctcatgcagtggatgttttgagaatgcttctggcttcctcaatctctgtagctgatacatttcttgtagccacattgaggccctggcacaggaaagctactcagttcttctcaatctggcccagtcatcttatttctgccattgccctatacatttgaaatcttaaatgttctaaatatcttaaagcaatgaaatagattcaagtgtttctaacttagaaaaagtaaaagagagagcaaaataatacagcttttaaatcacctgtattctatacgaattattttaaaaagaaaatacttcacgtataatcccagcattttgggaggccaaggcgggcg

SEQ ID NO: 85539 - DNA, 270 bp, Homo sapiens
agactgtagagtggagcactatacactttacgatcacactgtgagacacaatgccaagaactctagcccaagaacgggatacaaccggctacttctaatatgagcacccaggaagctttagagctctggcggccagacttcgtatgcaacttttctgcgtggtagagagcctgcctagtgggtattccagtactgctggcatgcagtcacctgtgtggattaacattttgcaagggtgtatgggttggagtggagcaggagagcctgaag

SEQ ID NO: 85540 - DNA, 148 bp, Homo sapiens
gttgttgggaagattaaataagctgatctactgcaagctcttataagatatgtgcctggcatatagaaatgctcaacaagtgccagaggcagttatctggctaggtacttcatacatgtttttgaatgaataaatggattggtaatta

SEQ ID NO: 85541 - DNA, 418 bp, Homo sapiens
ttcacatattttgacaaaatgattgtgtataatcatggagacaaagcttattgttttaaatgattttgttaaatactagaaagtagttcactgagttaaaaggtttcatacaggtttcctaaaaaccatttggcttagatatatttaactatctgtgaaactacttgttattatcctctttactattgtatgggtttggttggattttgtctgttgaacacagatcctctgattttatttcgattttatttgaattgctttctgtaatattcaactacatggaaattgtgtttaatttgggcttatgtagagtggtccatagactttgagtgtgtgtttgggttgctgttctgaagaacagaagtagccaagaagtagtctgaaaaagtaggaccataaaaaattagactggtagaac

SEQ ID NO: 85542 - DNA, 102 bp, Homo sapiens
gatctttcatcaagattttacctgcatttatgtctaagggtccctgataaggcttgaggcatgtaacctatgtctaattaaaaatgatttgttgaatgaatg

SEQ ID NO: 85543 - DNA, 278 bp, Homo sapiens
cagatgttataatccccatttttcagagtggctcagagatgggagggaacttgttcaagttcatgaggcccataggggtcagacctgtgatttctagtgtgtactcaggaggcgggtacgaaaggagaagggggcaaggaacaaggtgttggagttaacaggagaagaaagggtggcatctggaaatagaatttcttcagctacccttggcacctggaaacccacaatccaaaggaggactggtttagagaaggtaccttttttttttttttgagatg

SEQ ID NO: 85544 - DNA, 126 bp, Homo sapiens
ggaaaagttactttgcccctctggggctgtttcgccttccatgaaatcgaaggttagattagttgcctataagggctctttccattctaaaatttaatggaagtgtgtatttacatatttgaactt

SEQ ID NO: 85545 - DNA, 356 bp, Homo sapiens
gagtactagtttgaaatgattacattcatcatttcaggttagtaaaaagcgtattataagacaccgtttataaaacattgcagcttagatatcacttcctctgggaacctcttcaactctctagctgttgttactcctctgtgttcccaaggcacctcttttcatacagtactacagatctttacctcaaattatatgggtctcgcttctatgagccatttaagttatttatattccttctgagacagggtctcactgtcacccatgctggagtgcaatggctcaatcacagctcactgcagcctcaatctcaagagctcaagcaatcctcccacttcatcagcctcttgagtggc

SEQ ID NO: 85546 - DNA, 359 bp, Homo sapiens
ttcaggattagattactgaagtatgatggcagtcattgagaaatcgtggagactagtatcccaaggacagaaaacgttcttattattggaagagaagaaaagtattttctataaagtataacccaatgaacttgatcgtgacccaccttgccctcccaaagtgctgggattacaggcatgagccaccacacctggccgctaggagattcttaaaaccaattcgtgccaaactgtcatgaatgctgctattcgagaagaaagagagaaggaacctaaagacactaaagaggccacaaaaggatttctctgataacttaacacatttacagtactggcatgaaagatagaaaagagggccg

SEQ ID NO: 85547 - DNA, 596 bp, Homo sapiens
agtaaagtaagcttatagtgcaggtattattgaagacatgtcgaaggtatagcgtaagcagcaaggagagaagtaaatctttctgggagttgggaactgctttgttgaagtggcaactgagtcttaaagaataattgagaatgtgactggtaaacaaggacagaaacatgttcatgaaagaaagcaagggacacattaaatccttccaggaaatagtttggtgtacatcccaaatcctagtatcattgaattatatacagggagtgaatgatgtgatcaaatgggcattttagaaagattatgctgacaactctggagggctgactagtcagtgtgaaggtcagaaaaacagcaagaaagcaaatgcaatagatctagtagaatgatgaagtgctaaactgacacactattttaagacttcaggaataccaggatgagtaaaactacatttaaaattttaatcatctgtggggtttagctatgaaaattttttgttttctaagctttctgcaatggatatgcactgctttcttaatagaaaaaatagtaaactttgttaagagagagagaactcagcaaaaggctcattacagggg

SEQ ID NO: 85548 - DNA, 5352 bp, Homo sapiens
gcgcactggagccctggccagcgcgcagccttcccggcgccggcgggctgggtcttgggaattctggtttgctttggctcactcgctttttacaaaccactggatcttacatgcctctgtaccccccacttccactccatgtccccatgctcctgcgccagcaacaggacatgttctctggatgtcagctgagtcattaaagtaactctgcatgtcagtagacagaccttggtagaaccacaaggctcccagagacacccatctctcctcatttttttggtgtgtgtgtcttcaccgaacattcaaaactgtttctccaaagcgttttgcaaaaactcagactgttttccaaagcagaagcactggagtccccagcagaagcgatgggcagtgtgcgaaccaaccgctacagcatcgtctcttcagaagaagacggtatgaagttggccaccatggcagttgcaaatggctttgggaacgggaagagtaaagtccacacccgacaacagtgcaggagccgctttgtgaagaaagatggccactgtaatgttcagttcatcaatgtgggtgagaaggggcaacggtacctcgcagacatcttcaccacgtgtgtggacattcgctggcggtggatgctggttatcttctgcctggctttcgtcctgtcatggctgttttttggctgtgtgttttggttgatagctctgctccatggggacctggatgcatccaaagagggcaaagcttgtgtgtccgaggtcaacagcttcacggctgccttcctcttctccattgagacccagacaaccataggctatggtttcagatgtgtcacggatgaatgcccaattgctgttttcatggtggtgttccagtcaatcgtgggctgcatcatcgatgctttcatcattggcgcagtcatggccaagatggcaaagccaaagaagagaaacgagactcttgtcttcagtcacaatgccgtgattgccatgagagacggcaagctgtgtttgatgtggcgagtgggcaatcttcggaaaagccacttggtggaagctcatgttcgagcacagctcctcaaatccagaattacttctgaaggggagtatatccctctggatcaaatagacatcaatgttgggtttgacagtggaatcgatcgtatatttctggtgtccccaatcactatagtccatgaaatagatgaagacagtcctttatatgatttgagtaaacaggacattgacaacgcagactttgaaatcgtggtcatactggaaggcatggtggaagccactgccatgacgacacagtgccgtagctcttatctagcaaatgaaatcctgtggggccaccgctatgagcctgtgctctttgaagagaagcactactacaaagtggactattccaggttccacaaaacttacgaagtccccaacactcccctttgtagtgccagagacttagcagaaaagaaatatatcctctcaaatgcaaattcattttgctatgaaaatgaagttgccctcacaagcaaagaggaagacgacagtgaaaatggagttccagaaagcactagtacggacacgccccctgacatagaccttcacaaccaggcaagtgtacctctagagcccaggcccttacggcgagagtcggagatatgactgactgattccttctctggaatagttactttacaacacggtctgttggtcagaggcccaaaacagttatacagatgacggtactggtcaagatgggtcaagcaagcggccacaagggactgaggcaagcacaatggtttcaaagaaagactgtaagctccatgattagcataaagcactaaccatgtctccatgtgacccgatggcacatagatgttgtagaataagttatgggtttttatgttttgttttgtgtttttccaaaacttgaacttgcaggcaagccttggttgggtatttgatttatccagaatgcttctctttagggaacaaggatgtttttaatggcataacaaaggcaagactctgccttaatttttgaaaagctgctaactacatgaacacaaatgtgtatttttgttgcagtgtagttttccttttgtgtaattttaaagtcagtgttgaattttattgaaagctcatgatgcgcttcaaagtggcaagtatttggctattaactgccaaaacaagagcctgattttttgaggccagtaattcgtttgctagaattgattttttttctctctctctttgttacataagggcattatgtaacactagccgaatggtagcctctgggttgttgtttttttcttttcctccatgatgttaatgggttatctcaaattttaagttaaactacctaaaataaataccaaagataatgcatatttttgcacagtggagcttacacttaaaagaaaacaaagccccatgggctgccttgaaatcaagagacaataactttgaacctcagcaagaccttgaaccgccggttcattttgcaccttattcagaaaatagagcatcatactcaccgagtctagtcagtgtagtgcttttaaaaattttgtcctttcatgtaacttttttattttaagaggaagaagaagaaaggggcacacacacacaataccgacgtctatcctttcctgctaggcagtgctggccaggctcatgtgtagtgtgcgagatggtgatgtactcttatatttttctgggcttttccttttgcacattccaaaattcatttcataagacaagatcttcataggacctccttggcatcctggcattctcaaaactgagccatccagcatgaaagataaatgggtttaaacccttgctgctgaatttattgcctggactgtcaggacatcaccagcccaccttcaccttagggaagatgccacacctggcctccacacttgctcttctgatcagtctgtctggattgagtcctacagtgtcagatagggcggcaaatgccaaagcagggaaacagggaggtgtggacaagccagtttgatgcagcacttcagatcaagtgcttaggaaggagaggaaacttgccttttttatggcagaggatagtaatgaaaatgtctcagtattttagggtcaatgagagccataaaaatataacataatcacaagtaaaggagataatggtctaaaacagctatttcccttttctgtgtgcatacttatgactgaatgtgagctaagcattttctcctgtggagccctagagcaggttactaaggaaggacacattgttttccagaagcctcccctgcctggctgactgccttgctagaaacataattttttttttctcactgaagctcaataatggaactctttttttttttttttttaatttaaagttccctatttgtgaattctgggattactgacttttctttttaattggagtctcaaaatcaactctcttatggtattatatctctgtatgccattaaaaaacagcttgttctagaatcatgtattttgtaaactgatgtttgtgatggtctctggttcttgaacagccatatctgaatgccgtgcctgcaaaactatgacaatttttgctgttttcagccttcagatttgatggcttgggaaactgaggtgttattttcaatgaaacaaagaaagagatgttaagcaagtggttgttttagatccaaatgtaaaggcaggtttgggaaggtgtttaaagagttggaggaattggggattgagttgtaaagaaaacttacagaagaggcaacaatttggttcttgacagtgagaggatattgagggcttcagctgctgctattatgatgttttgcaaaggaaaataatcaaaccaaagagtattcagtgatatgtaaattaaatgaagatacagtggagaatgggggtgaccacaaaagaggctccccctaaacacacagtgctgccacttaaaaagacttgagaaatttgaaagggggtgggtatggggggggcaagaaagagggagggaaatctttcaacttatttctgaaaaagagaaaaaaatataaaatttctggtgcacaggtttgttttttcaagaaaattttgcagaagctatgtttttaaagtgtacattttataaagtttatcagatattttcatatttaaagccaaatgtaaatagaggtctgtaaagaaaaataattgccatagaaagtataatttcagtgcagtaatttctgagagctagtacctatatgctaccggttagcatggttttagcaaatatataccagccttataaggttcgtattgctatgttcttctgttatttatttcagcatggactgttcatttgaaacctttttctagttattagcgttttaacagttacaagctttaaatggcaattttttttttttttttgtcaagagccaagacacaggtaatgcacgacattgattgctgcattttaccttcaaaatatttgtccttattgactgggtctccttaattaatgtacacatgtcattagaatgcagacggaggggactcaccatgaatatctggggttgattcccagatgtgtgttgcttctctattgcaagcagattccctgttggatttacttcggatttattcccttttaaagaatttttgcccatatctggaagggcactatatttttgggaggagccatagattcctggttatcctatttttaaacaaaatgtagacaaagtgaactctattttgattattgagaaaggagtagttttctatccctctaagagtatacttgaatcagacattttaaggatgtcactatggcactgttgtcatttccaaattcctagaaaagtttgttttactttgtttttattctgttaatgcattctttcttctctttacttcctttcttaccagtacactcctatctcaactctgtttatttgatgagttctgtcccgtaaatcatatttcccttacaattaataaatgtcacttcatattttataataaaccactcagtaaaagcaaaagcttgtcctgagaagtagagtgagttctttttcactctgtgtctaataatgttaaggtgggaaaaaaaaaagtgtggcatagctacctgcccatccccaaccctcagcaaagtagaatctcttttctggtaattttgggtttccgctctgggctctggcaagttgaacaatcctagccattgacaatcgtgatagttattattttcccatttgctgtctttttgtatctaaagtcttcctattgtactgcacaaaccatggattgtacatatttttatatattatgtcttattttattatttctaaataaa

SEQ ID NO: 85549 - DNA, 5370 bp, Homo sapiens
gcgcactggagccctggccagcgcgcagccttcccggcgccggcgggctgggtcttgggaattctggtttgctttggctcactcgctttttacaaaccactggatcttacatgcctctgtaccccccacttccactccatgtccccatgctcctgcgccagcaacaggacatgttctctggatgtcagctgagtcattaaagtaactctgcatgtcagtagacagaccttggtagaaccacaaggctcccagagacacccatctctcctcatttttttggtgtgtgtgtcttcaccgaacattcaaaactgtttctccaaagcgttttgcaaaaactcagactgttttccaaagcagaagcactggagtccccagcagaagcgatgggcagtgtgcgaaccaaccgctacagcatcgtctcttcagaagaagacggtatgaagttggccaccatggcagttgcaaatggctttgggaacgggaagagtaaagtccacacccgacaacagtgcaggagccgctttgtgaagaaagatggccactgtaatgttcagttcatcaatgtgggtgagaaggggcaacggtacctcgcagacatcttcaccacgtgtgtggacattcgctggcggtggatgctggttatcttctgcctggctttcgtcctgtcatggctgttttttggctgtgtgttttggttgatagctctgctccatggggacctggatgcatccaaagagggcaaagcttgtgtgtccgaggtcaacagcttcacggctgccttcctcttctccattgagacccagacaaccataggctatggtttcagatgtgtcacggatgaatgcccaattgctgttttcatggtggtgttccagtcaatcgtgggctgcatcatcgatgctttcatcattggcgcagtcatggccaagatggcaaagccaaagaagagaaacgagactcttgtcttcagtcacaatgccgtgattgccatgagagacggcaagctgtgtttgatgtggcgagtgggcaatcttcggaaaagccacttggtggaagctcatgttcgagcacagctcctcaaatccagaattacttctgaaggggagtatatccctctggatcaaatagacatcaatgttgggtttgacagtggaatcgatcgtatatttctggtgtccccaatcactatagtccatgaaatagatgaagacagtcctttatatgatttgagtaaacaggacattgacaacgcagactttgaaatcgtggtcatactggaaggcatggtggaagccactgccatgacgacacagtgccgtagctcttatctagcaaatgaaatcctgtggggccaccgctatgagcctgtgctctttgaagagaagcactactacaaagtggactattccaggttccacaaaacttacgaagtccccaacactcccctttgtagtgccagagacttagcagaaaagaaatatatcctctcaaatgcaaattcattttgctatgaaaatgaagttgccctcacaagcaaagaggaagacgacagtgaaaatggagttccagaaagcactagtacggacacgccccctgacatagaccttcacaaccaggcaagtgtacctctagagcccaggcccttacggcgagagtcggagatatgactgactgattccttctctggaatagttactttacaacacggtctgttggtcagaggcccaaaacagttatacagatgacggtactggtcaagatgggtcaagcaagcggccacaagggactgaggcaagcacaatggtttcaaagaaagactgtaagctccatgattagcataaagcactaaccatgtctccatgtgacccgatggcacatagatgttgtagaataagttatgggtttttatgttttgttttgtgtttttccaaaacttgaacttgcaggcaagccttggttgggtatttgatttatccagaatgcttctctttagggaacaaggatgtttttaatggcataacaaaggcaagactctgccttaatttttgaaaagctgctaactacatgaacacaaatgtgtatttttgttgcagtgtagttttccttttgtgtaattttaaagtcagtgttgaattttattgaaagctcatgatgcgcttcaaagtggcaagtatttggctattaactgccaaaacaagagcctgattttttgaggccagtaattcgtttgctagaattgattttttttctctctctctttgttacataagggcattatgtaacactagccgaatggtagcctctgggttgttgtttttttcttttcctccatgatgttaatgggttatctcaaattttaagttaaactacctaaaataaataccaaagataatgcatatttttgcacagtggagcttacacttaaaagaaaacaaagccccatgggctgccttgaaatcaagagacaataactttgaacctcagcaagaccttgaaccgccggttcattttgcaccttattcagaaaatagagcatcatactcaccgagtctagtcagtgtagtgcttttaaaaattttgtcctttcatgtaacttttttattttaagaggaagaagaagaaaggggcacacacacacaataccgacgtctatcctttcctgctaggcagtgctggccaggctcatgtgtagtgtgcgagatggtgatgtactcttatatttttctgggcttttccttttgcacattccaaaattcatttcataagacaagatcttcataggacctccttggcatcctggcattctcaaaactgagccatccagcatgaaagataaatgggtttaaacccttgctgctgaatttattgcctggactgtcaggacatcaccagcccaccttcaccttagggaagatgccacacctggcctccacacttgctcttctgatcagtctgtctggattgagtcctacagtgtcagatagggcggcaaatgccaaagcagggaaacagggaggtgtggacaagccagtttgatgcagcacttcagatcaagtgcttaggaaggagaggaaacttgccttttttatggcagaggatagtaatgaaaatgtctcagtattttagggtcaatgagagccataaaaatataacataatcacaagtaaaggagataatggtctaaaacagctatttcccttttctgtgtgcatacttatgactgaatgtgagctaagcattttctcctgtggagccctagagcaggttactaaggaaggacacattgttttccagaagcctcccctgcctggctgactgccttgctagaaacataattttttttttctcactgaagctcaataatggaactctttttttttttttttttaatttaaagttccctatttgtgaattctgggattactgacttttctttttaattggagtctcaaaatcaactctcttatggtattatatctctgtatgccattaaaaaacagcttgttctagaatcatgtattttgtaaactgatgtttgtgatggtctctggttcttgaacagccatatctgaatgccgtgcctgcaaaactatgacaatttttgctgttttcagccttcagatttgatggcttgggaaactgaggtgttattttcaatgaaacaaagaaagagatgttaagcaagtggttgttttagatccaaatgtaaaggcaggtttgggaaggtgtttaaagagttggaggaattggggattgagttgtaaagaaaacttacagaagaggcaacaatttggttcttgacagtgagaggatattgagggcttcagctgctgctattatgatgttttgcaaaggaaaataatcaaaccaaagagtattcagtgatatgtaaattaaatgaagatacagtggagaatgggggtgaccacaaaagaggctccccctaaacacacagtgctgccacttaaaaagacttgagaaatttgaaagggggtgggtatggggggggcaagaaagagggagggaaatctttcaacttatttctgaaaaagagaaaaaaatataaaatttctggtgcacaggtttgttttttcaagaaaattttgcagaagctatgtttttaaagtgtacattttataaagtttatcagatattttcatatttaaagccaaatgtaaatagaggtctgtaaagaaaaataattgccatagaaagtataatttcagtgcagtaatttctgagagctagtacctatatgctaccggttagcatggttttagcaaatatataccagccttataaggttcgtattgctatgttcttctgttatttatttcagcatggactgttcatttgaaacctttttctagttattagcgttttaacagttacaagctttaaatggcaattttttttttttttttttttttttttttttttttgtcaagagccaagacacaggtaatgcacgacattgattgctgcattttaccttcaaaatatttgtccttattgactgggtctccttaattaatgtacacatgtcattagaatgcagacggaggggactcaccatgaatatctggggttgattcccagatgtgtgttgcttctctattgcaagcagattccctgttggatttacttcggatttattcccttttaaagaatttttgcccatatctggaagggcactatatttttgggaggagccatagattcctggttatcctatttttaaacaaaatgtagacaaagtgaactctattttgattattgagaaaggagtagttttctatccctctaagagtatacttgaatcagacattttaaggatgtcactatggcactgttgtcatttccaaattcctagaaaagtttgttttactttgtttttattctgttaatgcattctttcttctctttacttcctttcttaccagtacactcctatctcaactctgtttatttgatgagttctgtcccgtaaatcatatttcccttacaattaataaatgtcacttcatattttataataaaccactcagtaaaagcaaaagcttgtcctgagaagtagagtgagttctttttcactctgtgtctaataatgttaaggtgggaaaaaaaaaagtgtggcatagctacctgcccatccccaaccctcagcaaagtagaatctcttttctggtaattttgggtttccgctctgggctctggcaagttgaacaatcctagccattgacaatcgtgatagttattattttcccatttgctgtctttttgtatctaaagtcttcctattgtactgcacaaaccatggattgtacatatttttatatattatgtcttattttattatttctaaataaa

SEQ ID NO: 85550 - DNA, 300 bp, Homo sapiens
actggagccctggccagcgcgcagccttcccggcgccggcgggctgggtcttgggaattctggtttgctttggctcactcgctttttacaaaccactggatcttacatgcctctgtaccccccacttccactccatgtccccatgctcctgcgccagcaacaggtaagggctgctgtgttttcttccttttcgctcgctgccggtgtgtcctggggaatggactctggccgccgtcccctaccctaccctgccccgctgctccagaggtgcccagctgtcacactgctgtagcgctcacc

SEQ ID NO: 85551 - DNA, 422 bp, Homo sapiens
caccatgtgcggcttttttgtatttttagtagatacagggtttcaccatgttggccaggctggtctcaaattcctaccctcaaatgatccacctgccttggcttcccaatgtgctgggattacaggtgtgagccatggtgcccagtcatatttctgtatatgtgacatttgcccttctagaactttgatccaactctagggaattggcttggcaaccctttttaatctaatctctttgtttacttaccttgaacttttggtcaaatgttcactacagataaacatgactaagtcaaaacagttggagaagtagaaataaattccaggttgatgtgttttaatgaatacagtttcttaatttccggagcttgcggaaaattccggagcttgcagaaactcataacattttgataagtagagat

SEQ ID NO: 85552 - DNA, 536 bp, Homo sapiens
agcaatattcccagcatcctctgctataatcctctagaataaataactgtttgggaacttcatacaaaaagctgactcccagtaggtattgagttcagtggcagtaattagcattcatgacacaacttgcctgaacatttgtaaaaacattatgtttatttacattctattcctgtttcagtgtgcatttgactttatgtcaaattgaaaagtggttgatttttagataccaacactgtaaagactgaacttttaaatttgaatgctaggaatattctttaaaaacttacttagattggcaaccaaatgaccatttgctttcactggagctcagcgatatttacacagcacttgagatattctctctacaattcaatttacaagctattagagaatctttgagataacaggattttttttttttttttttttgagactgagtctcgctctgtcacccaggctggagtgcagtggcacagtttcggctcactgcaagctccacctctcaggttcaagcgattctcctgcctcagcct

SEQ ID NO: 85553 - DNA, 125 bp, Homo sapiens
ctaacaaagccaaagaaaaggtggcacactggccttcaattcaaagcccagggtggcaagaaaagggtcactagttccctgaaaataactggcatgcaaaattcaaacaggtaattggggtggag

SEQ ID NO: 85554 - DNA, 454 bp, Homo sapiens
  misc_feature (325)..(325): n is a, c, g, or t
catgctgcacaggccagcaagagatcccaggcacgcaaccggccacagcctagtggaccatgtgcaggagctgcagtgtttgctgtggctgcccactgaccaagaatgaggttgccctgcttgaaagtcagctttagctaccaggggtttagtaagatgggcacatggggcagggcctagtgaaagcagagagacgcaggaagcagctactgccgtagtccaggtcagagaggactggtgggttcctgagtctcctgtggctttgccagagctagagaaaagatccgtggtctagatgtgtgtgatggcttcataatggattggntgggggaggagcaaagtagaagggaatgttcagagagtgagcctcagcttgagtatttagttgaaggatgttcccatttgctgagatgagaaaaactatagtgagagcaggtctggaagaaagcttgag

SEQ ID NO: 85555 - DNA, 763 bp, Homo sapiens
ccccactagattagctagacacagagtactgattggtgcatttacaaacctctagctagacacagagtgctgattggtggattcacaaacctttagctagacacagagtgctgattggtgcattcacaatcctccaggtagacagaaaagttctccaagtccctacccgtcccagaagcccagccggcttcacctctcactggcactcgcctgtggcgcctagcccgggcactccggcagcccagttggagctcctcccgcaatcaagcccagcagctgctggccagccacgcccagtgtggggccgccaagcccccgcccacccggaactcttgaaggcctgtgagcgccaccagaagccccggctcccgcaggcgcctctcgctccacacctccacgcaagcagagggagtcggctccagcctcggccagccccagagaggggcccccacagtgcagtggcggccagagcggatgccgaggcccaggagaggccgagagtgagcgagggctgctagcacgttgtcacctctcactaacaccagaagaggtggagatggtccatatttacaacatttgttgcagacaatgagacaaatttagtccatactccacaaattgccagaagtaatgttatttgacccaacaggagggagaaagcggaatttgtgtggagagtaagatgctgatgtttggatgtgcagagaagagtttccatatagcaggaaaagccctttttcctttctctccagcttgtaaggaa

SEQ ID NO: 85556 - DNA, 333 bp, Homo sapiens
attcgtaaactttttaaaaactatgggtttttttgctattttttttctagatcatcagctatcattttagtgtattttatgtgtggcccaagacagttcttcttccagtgtggctcaaggaagccaaaagattggatacccctgtaaacagagggtaatttaatgattaggttaccactgtgggcaactagagctcattcctgctgggaccctcagagggacactgacacatttgctggactattgttccatcaggggccaagaaagctggggtatgtatccacctacagatgttcctcattggttgtggagcctccacctccagagagtccc

SEQ ID NO: 85557 - DNA, 462 bp, Homo sapiens
attataaattacagattaaaccaaagcttccctcctttatgggtgcaaaattgatggtataagtaactgttctctcaaatggctaattatatttctagttgcctacttgaaggtctaattagccaattgcatatgcttttgtgggggcaaggagataattggcatcctcaagcaggtaattagaaaagcaattattagtgcccacggctaattacaagaatgaaaattgtccccaccaaaatggtaccagtgtctactgggcagaaaaccagtccctggaaagtgacaggaaacttaatccatttggcagtgttagaatggcaggcagtaaaacaaatcatcaactagacctacataatctataagcaacctcctgtgagagggctgtcagaagcctttctaactgtggcaaagggctgcagttggggcagttgccctattgccaataataacctgcacatg

SEQ ID NO: 85558 - DNA, 230 bp, Homo sapiens
agtagagatggggtttcaccatgttggccagactggtctcaaactcctcaccttgtgatccgccctcctcagcctcccaaagtgctaggattacaaaagtgagccaccaggcctggccagcttcctgatgattctaatgggaagtcaggcttgagaaccatggaatagatcattgcctatgtttctccctggtttcaaaatttatgattttaacttatctgatatgtttg

SEQ ID NO: 85559 - DNA, 1192 bp, Homo sapiens
ctttggggttgcattctcactccaagatcccaaatccaaagcccaagtgctcccctatgcaaatattcccaactcctttgttctacagcttatctgttgcccgctcctaaatccacagccctggggcacccctcctgaggtaccacagatttagtcgggaggtaccctctctgttcagcttccctggggtccccctcctcctcctttgctggttgtgtccaaagctaggtggggttcacggagaggatgtagttgggaggtgaaatgaggtgattttataaccagccaaagtccacccctttttttcaggcagtataaaggcaaaccaccccacccatcaccatctgtcatctcactaccaccatgctggcctcagggctgcttctggtggccttgctggccagcctgactgtgatggtcttgatgtcagtctggcagcagaggaagagcagggggaagctgcctttgggacccaccccattgctctttattggaaactacctgcagctgaacacagagcacatatgtgactccatcatgaagatcagtgagcgctatggccctgtgttcaccattcacttggggccccggcgggtcgtggtgctgtgcggacatgatgccgtcaaggaggctctggtggaccaggctgaggagttcagcgggcgaggcgagcaggccaccttcgactggctcttcaaaggctatggagtgacctgccgcacctgggagcgcaccaagccgctcaggcgcttctccatcgccaccctgcgggacttcggggtgggcaagcgcggcatcaaggaggtatccaggagaaggcgggcttcctcatcaaggccgtctagggcacgcgcggctccagcatctatcccaccttcttcctaagccgtaccacctccaatgtcatcagctccattgtctttggggaccgttttgactatgaggacaaaagttcctgtcactgctgtgcatgatgctggaaagcttccagttcacggcaccctccacgggggagctctatgagatgttctcttcggtgatgaaacacctgccaggaccacagcaacaggcctttaaggagctgcaagggctggaggacttcattgccaagaaagtggagcacaaccagtgcacgctggatcccaattccccacgggacttcattgactcgtttctcatccgcatgcaaggg

SEQ ID NO: 85560 - DNA, 659 bp, Homo sapiens
acgcaaagtgaccaagcattctcttttccaagtgaaatacgttattttaattgattagttgctttaatttgccttaagcgttttagcagagatttgcttttattgttgtgtttgccctgtaacactgattttatcagaggtttcttttatttaaattatcccaaatttgagttgaaaagttgcctagaatttttaaagtaacaaactggccagttcgtttcttaaacatctattttaaaaggactgggtgttgatacagtttttccagggttagatgtttatgactttatggatttgtcgaccgggtattactctaaactttaaacattaaaagctattataattgaggacaccaactgtttgcatagtgggatagagatagaaaaaaaaaagccatgacagtataatgactacaagattaactactgaactaaatggactttaaaagtggggagaaagtgattataaatcaaatactgtataacaaagaccaggacaccaagaatctgattggtgaaacctgcggttcctggcagatgctggtagttgcagtcaactttgagcacaatataattccaatttaaggagttgagaatcttagaacccactgtagtgagatttgtaatatgactgaataaattcttcctctcgtttgtgag

SEQ ID NO: 85561 - DNA, 374 bp, Homo sapiens
ctgaagatgcacttaataatgaagtcaggtagtgaaagtctgataccttgtttggtgacttcctgcaactcaccatggggaaggttcccccactcaggacttcaggtgcaacctgtggtgtgctaggaatcatctgcgctgagtgtatttagcaggatgagcaccagggttccagcaggctcacatttcactatgtaagcaccaagtgaatggggggatccttgaggggccacactttgccaggaaggttctttccagatttatcttccactttaactgtcttcaggggatttttcatcaatatctggtagcccctcagcgactctagtttggaacacatctcaaggtagattcaacatattacatgaacttgt

SEQ ID NO: 85562 - DNA, 462 bp, Homo sapiens
accataatgtcacaaggctgaaaagttagccccttttttagttttcattatgtactgcagtatgtagcaaaagactccctcgggcaaaggaaatgtactctttggggatttacttcataacaataaatggataaacagaacaccaaggataactgtttatatttaaccatgaacatgtatgtatacaatacatgcatatgcgtagaaagtataaaataaataaatccatcaaagcattaagtgttgtctcagtatggtggatctagggagtgctttgtagaccgccctctttgcctatcctttctaatttcacaacggtaaatacgtatacttttgcaatataaaatttcaaaaaatgttaactcaaattaagctgcatgtattccttcagtctgtcctatatttgtatgatgctccagaatgctcaaataacacttcattaaaaaaatttatttcttcaaa

SEQ ID NO: 85563 - DNA, 661 bp, Homo sapiens
ccctgaccaacatggtgaaaccctgtctctattaaaaatacaacattagccaggcgtggtgacacatgcctgtagtcccagctacttgggaggctgagtgagtagaattgcttgaacccgggaggcggaggttgcagtgagccgagatcacaccattgcaccccagcctgggcaacaagagcaaaactccatctaaaaaaaaaaaaaaaagtgaagaaactagatctgaagccttaattttctcccctataaacaggacttaacgatactgtcagctatcttattaccgcaaagatttaaagagagactattgatacacgtgctttgtgcttttaccttaaagcactacacaaatagaaggagtttcaggactgtcccttaagggtttactctattaaccattttcaagtccttaaattccctaggagaagcaattaagaaccaggcatcagtagagtatgttgaattaaaaggttctacagctgtattttgaggcctggaagagacacaaacaggactttctatggctaggcagagcagaagtcaccagttaggaaaaatccccagggtcagaaaccacctcccaaaatccgtgggattccaggcgtcagccactgctctcggccctctttacaccattttgtttgattgtctagtccct

SEQ ID NO: 85564 - DNA, 487 bp, Homo sapiens
ctgggggtagcagttgggatttacccagcacgctactttgttggcccctggggaggtggtgcagccaggcgggtaaggaggactcgcgccatcagcggggtctgagacatggtgtgcccagtgggcagagaataggcctgtggtttttaagaacctcactgatatcgaatgtgtcttggagtgagaaagtttttaatggaaaaggagcaagagagagtaatgaaataatttgctaagtgcctactatgttccaggcattttacatccacagtctctttcaatcaacacgtccatgcggaggagagcttcttgtcgcccattataaaggctggggagagaccgggaagagcgagaagctacacgctgggctgcagattgggccctagcgggcttggagcgtggatatgctggctggcccccctccccgggagtcacagctctcgccggtctcgccactcaggctctgccgggtacccaggaggcttgc

SEQ ID NO: 85565 - DNA, 623 bp, Homo sapiens
gccccagcgtctctgcagaccagtcccctccagggtccggcggggcccgcgcggtgggaggagtcgggcactggccggcgactaacgggtccgactgctgaccaagctaggagagacccggaccacggagacagagaccccggcatcgcgaccccgaggacctcctctcctcgccctgtggcacccactagtcctgggcactcagtcgcggagagcccccgaccccagcgcgccagccccgggggagccacctccatccccgcgtgccgcccgggccatgctcccccggggcagcggctgagccccagccgggacgggatcggagcccggcggagcatggatccgggctgggggcagcgggacgtgggctggggcggccttgcttgatcctcttcgccgcccttcgctgctcacggtgttcgcctggctgctgcaattatgcccggggccttgtgtgctggcgctgtggcacgcgggggaccggggcccggggaccccgccttagccggggaaacccggggggttcacatgggggagctggggccgtgtggcgctcgttgttgcggttgcgggcgactcgggggctggcgaccgccgaaggagccaggagtccgggggcctcc

SEQ ID NO: 85566 - DNA, 214 bp, Homo sapiens
aagatggcgccattgcactccagtctgggtggcagagcaagactctgtctccggcggttggtggggagtaaagttttctgtatccatactgtcctctaggttacaaaagactagagcaggccgggagtggtggctcatgcctgtaatcccagaactttcggaggctgaggcaggaggaatgcttgaacccaggactttgagaccagcccgagca

SEQ ID NO: 85567 - DNA, 798 bp, Homo sapiens
agcaattctctttcctcagcctcctgagtagctgggattacaggcatgcaccaccatgcctggctaattttgtatttttagtaggtatggggtttctccatgttgatcaagctggttttgaactcctgacctcaggtgatccacccacatcggcatcccaaagtgctaggattagaggcatgagccactgcgcctggcctgaaaaaaaattttaacgtttgagaaaatacaaaattttcatagtctccaagtatttctcctaagatctttccccctatgagggggaaaagatagtaactttacaatggagaaacccagcagaaacctgaaccaaatgaacaagttcaacatcatcagtaagaagaactatcaatgccataactctgatggaatgcactgggaaggattccacatcatttttgtgctgtaattgccaaaagttcgtaacttcagtccaatcatggaaatacatcagacaatcccaaatcgaggaacatttcataaatactgatcagtactggttcaagatgtcacggttatgaaagataaggaaagattgaggaactgttattgcagtcctacaaaacggcgagagactaagaaataactaaatgcagcgtgatcctgggtggaatttgggaacagaaaaaggacattagtggaaaaagtggtgaaactccaataaggtcttttgtttagcgaatatgttcattttaaatcagttaaattatttaaatatatttaaacattagttaaatgtatttaattaaattaataaaattggttattttgtgaaat

SEQ ID NO: 85568 - DNA, 294 bp, Homo sapiens
ctgggtgatagagtgaggctcggtctaaaaaaaaaaaacaaggtgcagcctgtgtgtgattcttaggttggtgatcttaggcaagatttaacctctctatggttcagtttcctaatctgcaaaatggacgctatctcatagggttactatggagatcaaatgaggaattcacataaagcactacagaaaatatttagcatggaataagcactcaataatgttttccattattatttccaatttttctctcagcatgtgtttcacaatcctttgttcatggcaaggtatgttgtc

SEQ ID NO: 85569 - DNA, 350 bp, Homo sapiens
aaaactttgtaaaatacaaatagacactttctcaaaattattgaaaaaattagttttaatagttaatgtcataactattattattcctttcaaaatcagggacaatattgagttgactgctctccctttttgttgtgtagtattatggtatttagtagtgttagtgcaatcagacaaaaacaccccaaacaggttagaaagaagcaaaacttattattttcaggtggtattatctttttgaaaaatccaagattctaatttgagaactattataaccaaaaagggtcaaaataaacagttccaaactacaggaaaaaagtgaaatatttcaacaataatttattggatat

SEQ ID NO: 85570 - DNA, 449 bp, Homo sapiens
aagccagaattaccctgataccaaaagcaaagatagtacaaaaaaagaaaatgaccaatatccctcatcaatatggatgcaaaatatataaagagacagatacaaagacatataaagagaattatataccatgatcaaatggtgtttattccactaatccaaggctggttgaataatcaaaactcaatcaatacaatccacgacattagcattaaatcgtctaccacgacattagcattaaatcatctacattaaagaataaaaatcggccgggggtggtggctcatgtctgtaatcccagaactttgggagggtgaggtgggcagatcacctgaggtcgggagttctagaccagcctagccaacatggtgaaacccccacctctactaaaagtagaaaaattagctgggcgtggtggtgcacactggtagccccctgctacttgggag

SEQ ID NO: 85571 - DNA, 443 bp, Homo sapiens
agccacaacaagggaactttccttgactaattaaggcaataatctcgtgccagaagggcctggacaagggttatttctttccgggttgtcttctggttcaatggcataatagattacaacaattgactgatctatctcattgatacttattgtctgaataatcatggccttgttacctatagcttcaacaatagcaataataagacaaacaaaatacacaaatacattctgtctctcacacacacacacacacacacacacacacgcacacgcacaatccagccttggaaatttaagaacttgtccagtcgggcaaggcaggacctggaaaaacagaaccaaatagatgtgttcaggaggaagtccagtgaaacaggcaagtggataagaggcaaagacatagacagcgtacagttcaggcaggtaataagcatgaagaagga

SEQ ID NO: 85572 - DNA, 307 bp, Homo sapiens
acatgtttttgtaaaaaagcaaattactgaccaaatatgtgattagcatagataaaacaattaatatgtttttcaaatccaacaatgtataaaaaggataataaagcatgaccaagtggagtgtatggaatgccagtttggtttaacagtcataactttatgttggctgggcatggtggctgaggcctgtaatctcagcactttgggaggcctaggtggggggatcacttgagcccaggagttcgagaccagcctgggcaacatagcaggacctcacctcttttgttatctctcacttctttttatt

SEQ ID NO: 85573 - DNA, 438 bp, Homo sapiens
cattttatcctactatgaagtaaagttacacatttttctgatgaagaaagtgaagtttagaattttactaagattatacaggtgttaaggatggtattttgtcccagtatgacatctatgcgttatgaatatatatgcctaaggtgtattttagacaaattgcatttatatttgtatttagacttctgtagtctcaattttttactcacgtattcatgaaattattcccatattttaaaacttagtaacatgtttataatggctgtatagtttttagaatatgtatacataatgtgtaattaattgatgtacttttgctagatattttgcaattttcaatatttggcattttatatttaatactcccacaaatattcatttatatgatttatattattttttgtccaatgctctaattaaaagagaattactaattta

SEQ ID NO: 85574 - DNA, 314 bp, Homo sapiens
agagaaatcacaaacacgcaatctattaaagagtaataaggttattactaaaaaaaaaatgacaataaagtttacaacttagatgaaatataaattcctagaaaataagcataccaaaattgacaaagaaaaataaaaatctgaacattcttaagtttttaaataaaatgtaatctataattttaaaacttacccttaaaactaaaaaaagaaacaaacaaaaatgctaccaacccaaatagttttgctaatgaattgtatcaagtagaactaacactaatctcatgtaaaatgttcctgagattgcgtgtttg

SEQ ID NO: 85575 - DNA, 418 bp, Homo sapiens
aaaaaaaaaaaaaagaaagattcaggttccagcaggatgtttccaattaagagtcacttccatgtctgctccttgtcacaggctgatgtatatttctgcacaatctgaatccgacttctattctgaagttttaagatttgagtcagagggctgggcgtggtggctcacacttgtaatcccagcacttttgagaggccgaggcgggcagatcacctgaggtcagaaattcgagattaatctggccaacatgttgaaacctcgtctcgactaaaaatacaaaaattagctgagcgtggtggaacacacctgtaattccaggtactcaggaggctgagggaggagaattgcttgaactcgggaggcggaggttgcagtgagctgagatcattccactgcactacagcctgggcaacaagag

SEQ ID NO: 85576 - DNA, 470 bp, Homo sapiens
aatacgtattctgaagccactatatctgcatatgtatcccagatttgaacaattaagtaaaaagatggtgaatgatgaaagccagttttctgtctgtagaagtgagaggtgacagataaccaaaggaagaaggctagaatggatagaggacagtgcttaagtgtagttcctgttgcctttagtcttatagacttcatttccaaagtttcttagcaccccccttccccctttggtgaggttgtttcacatattttctagacaattagattcttttgtcaaagtctgtgttccatccggagagcctctgatctcttaaatgattttttaaatttacatacattaaggttcactctgctgtaaaggtctgtgggttttaatcctgtctcacagtttttgcatatgttggccttctgcctgggaatactctcccagatattccccatgactggccccttatcttcaatcagatc

SEQ ID NO: 85577 - DNA, 671 bp, Homo sapiens
agttttttctctgccagaatttgttcctagcatttatttccaattgccttaacgaaaataaaatcatcccatgtatagaagtacttgcttagaaatcatggtgaattagtacgtaggctatgctgagaataataattggaaactgaaaaacaaagattgactatagtaattaaatggaaactttaaaaaccatcatttaaaatgtaaatctcttctccaataagtgtattcggtcctttgaaagaaactcctttgcaatcactctctgaaaaatatagattgtaaagaatcctggctgtgagaaaggaagctgaaaagggtttgtttttccctctgacactttccagcagagacatctcagaattgcctaagtgtgaatatctaaaattacaaactagtgttctctagaaatcttaggatacatgtgtgatgataaagagagctacagctgtactcattaccagtgaaataactcatgaaaaagttttgggccaactttcgatagcatgttgaaagccactgcgttttctttgtctctacttgcttattgttcatttttgcttcattacctatggtggcttctctgtatcccatagtgagagtagggcctggacaaggtttgtaatcctatcacacttccaaaattattgaataaaataatagatgccttc

SEQ ID NO: 85578 - DNA, 798 bp, Homo sapiens
gtagtaaagatgtgtgtgaatatttaattgtgagcatactagatgcagtattgttgattataaaagctgtgtattaatgcctttaagccccacggtaatcatatgaagtgggtagtactatttctgcttttcagaagaaaaaacaggcatagagaaatgaggttgcttgctcaaggtacctgagttagttaagtgttagggccaggacttgaatccaaccagtgtgactctagagccagtactattgatcattatatggtaaaattgtaaacaacctaaatgtttcacagtgattgttagggtccatccctacagtggggtactgccttctcagccatgaaaatgatgatagaataatataaagacatgaaaggatgtcttggtatatgtaagtgagaaaaaataaatttaaaaacatgattccattttggtaaaaaaacccaaaaatatattatgtctggaaggatatgtgccaaattgttaaatggttatttctgagtgtagttttacaggtgattgttttctttttgcttatccaaattttctaacttctacaatgaatataaattatctatcatgttgtaattaagatattaagatgtaacttttcaataaaaaattaaatgtgttagcataagctgagaaatttgggttttatactctgcattttaagcaagtttgtagaaattgtacatgagaatttgtaaatgcatgtagtgttttgtaattttttgtttgattccttattctagaagtaatatcaattgagtagagaaatatatcactcctaccacccta

SEQ ID NO: 85579 - DNA, 642 bp, Homo sapiens
gtagtaaagatgtgtgtgaatatttaattgtgagcatactagatgcagtattgttgattataaaagctgtgtattaatgcctttaagccccacggtaatcatatgaagtgggtagtactatttctgcttttcagaagaaaaaacaggcatagagaaatgaggttgcttgctcaaggtacctgagttagttaagtgttagggccaggacttgaatccaaccagtgtgactctagagccagtactattgatcattatatggtaaaattgtaaacaacctaaatgtttcacagtgattgttagggtccatccctacagtggggtactgccttctcagccatgaaaatgatgatagaataatataaagacatgaaaggatgtcttggtatatgtaagtgagaaaaaataaatttaaaaacatgattccattttggtaaaaaaacccaaaaatatattatgtctggaaggatatgtgccaaattgttaaatggttatttctgagtgtagttttacaggtgattgttttctttttgcttatccaaattttctaacttctacaatgaatataaattatctatcatgttgtaattaagatattaagatgtaacttttcaataaaaaattaaatgtgttagcataagctga

SEQ ID NO: 85580 - DNA, 1909 bp, Homo sapiens
gctggtggtggcgcgcggcgcggcgcggcgatggcggcgggtggcagcgatccgcgggctggcgacgtagaggaggacgcctcacagctcatctttcctaaagagtttgaaacagctgagacacttctaaattcagaagttcatatgcttctggaacatcgaaagcagcagaatgagagtgcagaggacgaacaggagctctcagaagtcttcatgaaaacattaaactacacagcccgtttcagtcgtttcaaaaacagagagaccattgccagtgttcgtagcttgctactccagaaaaagcttcataagtttgagttggcctgtttggccaacctttgcccagagactgctgaggagtccaaggctctaatcccaagcttggagggacggtttgaagatgaggagctgcagcagattcttgatgatatccagacaaagcgcagctttcagtattaatctccaaacatcactgctgctcggagaaaccacatccccaggcataacaccaccttcccactgtctggggctgacttgcacagaaattctgttgaagacagttgagaattcctttggagaaaacagcccagcttggcgtggggttaggttgctgtttcaaataactcacaggcccaggtgacatggaatcttggagcagccttgtgcagtggcagccagtggcttcctgaacgtgcctctgcgaagtgtgagatgaggggtcacataaccacactgttgactacctcattcctggtttttggcctccacatcatcttttttcttaatatttcatgttttaatttcagggtgtttatactttttgaaactagaccagaagatagtagactttatagagaaagaccagttttacctagatactaaaggaagaattaaaccgctgttagtttgaaatgctttttttttttttttttaaatggagatagggtcttaactcttgtccaggctggaggagtgcagtcgtacagtcatggctcactgaagtcttgaccccgctgcctcagcctcccaaataactggggccacaggtgtgcaccacaactctcagctaatttttaaaattttttatagaggtggggttttactatgctgtccagactggtcttaaactcctgggctcaagtgatccccctgccttggcctcccaaactggtgagattacaggcatgagccaccacaactggcctgaaattcttaaaggatgggagtgtcgatgacagcaccttggcatcgttgtgcctaacctgggagacggaagaagcacgccatgggaagtgtttacacttgggggacaagtgctaagtattgtggagcccatagccccttgagatagatggctactttgcctttcttcttgaactgtcttgcagaatgtggatttggggtaagtggtcttgaaggattcatttagtcaccctcaaattaagatttttacttcatctttcttgggcctgcacctccaagataacaaagaagaagcaatggtcgtgccaaagaggtccacaaccaggtgtgcactgttcactgcagcccatttgctgtatgaactgtggttgttgtgtgcccaatgacaaggctactaagaaattcatcatttgaaacgtagaggccgcagcagtcagcgatgtttctgaaatgagcatccttgacgcctgtgtacttcccaggctggatgtgaagctacattaccatgtgagttgtgccattcacagcacagtggtgaggaattgagctcatgaagcaggcaaggaccgaacacctccaccccaacgtagacctgcaggtgctgccccatgacctccaccaaagcccatataaggagcggagttgttaaggactgaagaaaaacttctctggagaaaaataaaattgcaattctacttaaaaaaaa

SEQ ID NO: 85581 - DNA, 359 bp, Homo sapiens
gactgttctcaaattcctggcctcaagtgatcctcctgctttggcctaccaaagtgctgggattacaggtgtgagccactgcatccagccaggacttttatatctatattctgaggtataattgagttgtcttggtctttgaggtcttacttgttttgtataaaggttgtgctagcttcatagaatgaattgagaaactctgtgtttttgcaattttcaggaatagtttaaattttctgtcccatgaagggtttgatagaacctaccgtaaaactttggggcctaattcatttttacagggaagaagaacaagaactatagatcttgtctgcctttttcatttatatgacatttattag

SEQ ID NO: 85582 - DNA, 409 bp, Homo sapiens
gaactgaattgggtcccctaaaacgctatgttggaatcttaatccccaggacctcagaatgtgaccttaataaaaacagggtctttacacaggtgatgcagttacaacaaggtcattagggtgggccctaatccactatgactgatgtccttaaaagggggactttggagagatgacgtgaaggccatgtggagacaatggggtgatgtgcctataggccaaaaaacgtcaaggaccgcaggccaccacctaaagctggaagaggagagggaagatcttcccctaagaccttcagagggaacatggccctgctgacaccttgatctcagacttcccctctaggaactgtgaagaatcaacatttttcgtttaagccggccattttgtggtacgttattgtggtagcctg

SEQ ID NO: 85583 - DNA, 242 bp, Homo sapiens
gtgaaggaagtatgaaaactgagactaatattatgaagtctttttttaattctttatcttattgcccatttttaaccccttggtgtttgaaatggaaaataaatattctcttcgcgatagataatatgtcaataaccaaaaggtggccttaaccaataattggcccaactttaaattattaccctaaagatatataaattaactaatctaaaattaaatgcaattttgctatgacttaaagt

SEQ ID NO: 85584 - DNA, 469 bp, Homo sapiens
gagtactgtttttgaatctcttccagtgaaaactaatatgataaaattcaaatgacatcaatatggcctattcgaatgaataacttaaatttttgtaaagctcctacattccaaacttgtaacactaatattaatatttttagtttttattcagtgaccctgtaaccccggtagagagaacaaagcttcttttagcaaatggattttgggcagtatataaaattacagcttgcattttcacagaggcctacacatctatcacaacaggttgaaataaaattcagactgtctcatcaggattataccaactatgaaacgcttgccatgtgtcttaagtattcctttaattattagaatttaaagcattctaacctgattggaaatttaaatgttgattcattattcttcatatttataagaccaattttaaaagctattaatttattccttctgcagttacctttcttca

SEQ ID NO: 85585 - DNA, 1866 bp, Homo sapiens
  misc_feature (3)..(3): n is a, c, g, or t
  misc_feature (83)..(83): n is a, c, g, or t
  misc_feature (137)..(137): n is a, c, g, or t
  misc_feature (486)..(486): n is a, c, g, or t
  misc_feature (896)..(896): n is a, c, g, or t
aanagagaatgagaatgtagagccatttgctggctcagcttaaggccacagctttcttagcaatgcagcttgtacagttgtcngagctttctggtagaaccctagtctgggtgcaacagtcacagagacaaatatgnaaataggaacatgtatgaaaacttaaacccttaaaaagaaagacgcttagcctctatttatttccaaataattgctgttcaaggcattgctctttatctcttgggccccatgacagagtggcttaaaataaatcatcaagtcttcagggcaagtgtgatttattttttggtcatatactgctgctttgtcattctatgtaattattatattcagccagtctgcttatcattggttacagcttcataatgtcacaaataatcctgcttatgtttatctgtctaggtgtcagccatccatgccataaatcctataacaacctaataatattctcttcatgtgttttgtgcngaagctacattgcaataagtatggctttcacataaatagagagttttggagtacaggagtgactcggggaaaagtgtgattccacagatggtgctactcagacaaatcaaagggctgaatgtagtatctggcaaatccatctttaatgcagccattcctctacatggctttggtttagagtatacattaatgcattaactctaggctagtacagagcttaatgatgcatccctgcttaatttctaccaatttcacagaggatatttttgtctcctgcaagtaggaatcaagaaagtttactagatgtgctcatagtgtagtgagccttatgtgggaaaaggaaaaccaacacctttgaattctttcattctgtgtggagttgccctaaattaagctgatgcttcagtgtnttcatcccttacacaatcagttgcatcactcctccaccacagagccataaaactcactggtctagtcagtgctttagatgtttcaggtgcctaataacttttggcaactttttttttttttttttttttttttgctattggcctataggtcatctcagcattatcaaaactaagtttgataacttacattctatttgcatacggcttttaacttgttaggaatggaaatccacctttttgaagttccactgtgttacagagtctttacaagttccaatcttgtaaactaggtatgattatccctttttatggataaggaaactcatgttcagaaacttaagtaatcttctcaatgatatatatctagcaactggtcgaaccaggattcaaattttatgtctaataattgtgaacaaaatccatcaaataaccatccaaaacccagcctgtgaacgcatttaaagaaattttgctctagaatcagcactgattttcaactctgctgtcttctgtgaacattgcataataaactaacactaagtcaaacacagaccatgttcccacccaagtcagccttggttcccaagcacaagtcgctttcagaatagcttgttgttgaagcaggaaaaaaaaaattgtgcttgatttggccttgagtagcaatgtgaattataaaggaagttaagcatggcttgctagaagagtcccagcggtgctggtgcttctatagaattaattggagagtctttttttttttgaagtcccaggcagccaatgagtgaaaatgcataatttatgcaagtgttggggaaaaggcacacctgtgccaagataagattttcctatcttggatgagtgggaagtttaatttttctgcaaaaataaattggaagcctaaatattagaacttatggggaagagttatgccttctaatgtatttaaataaacgtgaggttcttttgttccttt

SEQ ID NO: 85586 - DNA, 1256 bp, Homo sapiens
gcacactgtacctaccatctgcattgagcagaaagacttttgttttactgaagacaaaagatgtttttattttagacccagaagagaggagtttgctctgaatttgtaaataagtcttccccattcctcatactcgagcctctcctctctggttgcctcctgccaccagcatccatggctcatttgacacctttttaaatatcaggacaagtctgaaacaaagtagtaaaatgtatataactcttacctgttgtcattctttttcttttaaatttgttgctaatctctgataatgaagattcttactctgattctcagctgagctgtgagggcttccagggaaaatggaacaaaatggtgttcttaggtaatgggttgtagatactgagtcttcctttccttttctgacccttctcgaggacatttgctttcctcacacttttgtagtctctctttacatattactatatggaaatgaattgctctgtgctgaaatttgaagaccagataatgaaactgaaaagcaaacaattttactgaatctgtctacccttcattcatgagaactccagaatgagtgttgaccactgaagcatcttttaagtctgtgttccattgtgccattcaggtttgctgtcacatatgcatcatctgaaatcatttgaaatttttgtacaataaaatatcctggatttgatcctgaaggaaactagtaagatcagatttttgggtcatgtctgttgtattttcagtaatgtgatttcagatggtcatctggattctcccacttctctactccattatttctctacttttccttccagcaaacctgaaacgtgagggagatggattaatgtgagtaacaggaatgtgtctttaaaaagctagagtggttacatttaatcaggcagtaagataatttgggttcttgagttgttttggagtaatatcccacaactggggtaggaagctcaggacttttttctttaaagctagtcatttcaaaagcatattgtatttttttgaatgactacagtatggacaatttcaaaaaccaaaacccactttggattggtggaagtaaaaactggtaactcactcaagtgaatgaatggtcttgcattttaaaagcttatgggaaactcaatttgaaatgattagaaaatgtcaagtattataagctggtatttaagatgcttgtaaatactatttatgtttttaattttgtaaaataaagatttctttttaaccactgg

SEQ ID NO: 85587 - DNA, 1264 bp, Homo sapiens
gcacactgtacctaccatctgcattgagcagaaagacttttgttttactgaagacaaaagatgtttttattttagacccagaagagaggagtttgctctgaatttgtaaataagtcttccccattcctcatactcgagcctctcctctctggttgcctcctgccaccagcatccatggctcatttgacacctttttaaatatcaggacaagtctgaaacaaagtagtaaaatgtatataactcttacctgttgtcattctttttcttttaaatttgttgctaatctctgataatgaagattcttactctgattctcagctgagctgtgagggcttccagggaaaatggaacaaaatggtgttcttaggtaatgggttgtagatactgagtcttcctttccttttctgacccttctcgaggacatttgctttcctcacacttttgtagtctctctttacatattactatatggaaatgaattgctctgtgctgaaatttgaagaccagataatgaaactgaaaagcaaacaattttactgaatctgtctacccttcattcatgagaactccagaatgagtgttgaccactgaagcatcttttaagtctgtgttccattgtgccattcaggtttgctgtcacatatgcatcatctgaaatcatttgaaatttttgtacaataaaatatcctggatttgatcctgaaggaaactagtaagatcagatttttgggtcatgtctgttgtattttcagtaatgtgatttcagatggtcatctggattctcccacttctctactccattatttctctacttttccttccagcaaacctgaaacgtgagggagatggattaatgtgagtaacaggaatgtgtctttaaaaagctagagtggttacatttaatcaggcagtaagataatttgggttcttgagttgttttggagtaatatcccacaactggggtaggaagctcaggacttttttctttaaagctagtcatttcaaaagcatattgtatttttttgaatgactacagtatggacaatttcaaaaaccaaaacccactttggattggtggaagtaaaaactggtaactcactcaagtgaatgaatggtcttgcattttaaaagcttatgggaaactcaatttgaaatgattagaaaatgtcaagtattataagctggtatttaagatgcttgtaaatactatttatgttttcacttgtaataggttcttacccttccccgcttcggtcttctgcta

SEQ ID NO: 85588 - DNA, 741 bp, Homo sapiens
gcacactgtacctaccatctgcattgagcagaaagacttttgttttactgaagacaaaagatgtttttattttagacccagaagagaggagtttgctctgaatttgtaaataagtcttccccattcctcatactcgagcctctcctctctggttgcctcctgccaccagcatccatggctcatttgacacctttttaaatatcaggacaagtctgaaacaaagtagtaaaatgtatataactcttacctgttgtcattctttttcttttaaatttgttgctaatctctgataatgaagattcttactctgattctcagctgagctgtgagggcttccagggaaaatggaacaaaatggtgttcttaggtaatgggttgtagatactgagtcttcctttccttttctgacccttctcgaggacatttgctttcctcacacttttgtagtctctctttacatattactatatggaaatgaattgctctgtgctgaaatttgaagaccagataatgaaactgaaaagcaaacaattttactgaatctgtctacccttcattcatgagaactccagaatgagtgttgaccactgaagcatcttttaagtctgtgttccattgtgccattcaggtttgctgtcacatatgcatcatctgaaatcatttgaaatttttgtatgtttcactagtcacgacggtgacaacgacgtgcctagcgcatagcgatgcatagcggcacgcggt

SEQ ID NO: 85589 - DNA, 281 bp, Homo sapiens
ccaaaacccacttggattggttttgaaattgtccatactgtagtcattcaaaaaaatacagtatggacaatttcaaaaaccaaaacccactttggattggtggaagtaaaaactggtaactcactcaagtgaatgaatggtcttgcattttaaaagcttatgggaaactcaatttgaaatgattagaaaatgtcaagtattataagctggtatttaagatgcttgtaaatactatttatgtttttaattttgtaaaataaagatttctttttaaccactgg

SEQ ID NO: 85590 - DNA, 1987 bp, Homo sapiens
gcacactgtacctaccatctgcattgagcagaaagacttttgttttactgaagacaaaagatgtttttattttagacccagaagagaggagtttgctctgaatttgtaaataagtcttccccattcctcatactcgagcctctcctctctggttgcctcctgccaccagcatccatggctcatttgacacctttttaaatatcaggacaagtctgaaacaaagtagtaaaatgtatataactcttacctgttgtcattctttttcttttaaatttgttgctaatctctgataatgaagattcttactctgattctcagctgagctgtgagggcttccagggaaaatggaacaaaatggtgttcttaggtaatgggttgtagatactgagtcttcctttccttttctgacccttctcgaggacatttgctttcctcacacttttgtagtctctctttacatattactatatggaaatgaattgctctgtgctgaaatttgaagaccagataatgaaactgaaaagcaaacaattttactgaatctgtctacccttcattcatgagaactccagaatgagtgttgaccactgaagcatcttttaagtctgtgttccattgtgccattcaggtttgctgtcacatatgcatcatctgaaatcatttgaaatttttgtacaataaaatatcctggatttgatcctgaaggaaactagtaagatcagatttttgggtcatgtctgttgtattttcagtaatgtgatttcagatggtcatctggattctcccacttctctactccattatttctctacttttccttccagcaaacctgaaacgtgagggagatggattaatgtgagtaacaggaatgtgtctttaaaaagctagagtggttacatttaatcaggcagtaagataatttgggttcttgagttgttttggagtaatatcccacaactggggtaggaagctcaggacttttttctttaaagctagtcatttcaaaagcatattgtatttttttgaatgactacagtatggacaatttcaaaaaccaaaacccactttggattggtggaagtaaaaactggtaactcactcaagtgaatgaatggtcttgcattttaaaagcttatgggaaactcaatttgaaatgattagaaaatgtcaagtattataagctggtatttaagatgcttgtaaatactatttatgtttttaattttgtaaaataaagatttctttttaaccactggtcataggagaatagaaataaaagaaaactagataaaagtaaaatatacataccttcattctcttacaatatcaatcatcatgtaactttagaaaattgtgccatattgtgtgagaatgtgagtgaaaagggatatgtcctaatatatgtaaatggttgaaacagtgtcaggtacacccaggagttcctgaccacacttttgagaattacactgaattacggtgattgtccatgccagtaaaagaacataatgagtttcgattcgtcgaatcaataaactatatgcccatttaaaaatgcaagatgccttaggccatccccttagagatcccacattcaataaggtccgtggcgtcaagaaatctgcatcttaactaagcaccacaaattaattggaataactggtctggacaattccgaacgagaaaaaccccgttcacagagatccccgaagaggttcggccattataacgtccaatagagggggtgcgcaactacagcagctaccaccaaagttttccaaacgccggactggagtttaatctgtggcagacccttaccacaagccagtgcagacccatagagatcacggggcgcctgcgacgcatgtcatccaccaatccctcgacgacctccccgaaccacgtatatcatccactgagctcacaaacacggcaccacagcaatacgaattccatcagtctactaatcattgaacttgcaactctacaa

SEQ ID NO: 85591 - DNA, 349 bp, Homo sapiens
cccacaaactagactaagcccatttaagggaaaacaattcaagaccaattcagctgccctcccttcccactgcaacttacatatgacaagagataaaacattgtgggaaaggggcaggcagaaaagtcttaatggttatactcagttagcagaggcaccctgaaatgatttctaatcactacaacagtacacagatattctctaaactatattcagaggatctgaatcttcagtgaaatcattgcaggacggagtatcaactggactatacgtctggatctgcagctacattcaagaaaagtcaactgctttgaaacgttgccacaattacattcttaaaggaaatcag

SEQ ID NO: 85592 - DNA, 429 bp, Homo sapiens
atttagaacaaaacagatcagtcggttggggggattcagtaacactctacacttgtatccagtcaattgttgatggtaatccaatcttggatgtggtgaaaagagggtgggcttagggtctaagtgaaattgactgccagtgtgtgactctgaatcatttatttatatctctgaggttttcgttcccttttttataaaaattttattaaataagttttcatttttccgtaaaactaagactgaaggaaagtctgcctttcttaaagtcagcaaggtctactgataaagaagataccttgtaatctctactttcatgacagaaatccaggcctaatcaatacttttttctattatcactgtaattaaggcataaggctttccctgatatacaaatgattaaacctctcaataaacaacttcacataggtc

SEQ ID NO: 85593 - DNA, 565 bp, Homo sapiens
tcgatgcagctgtagtgacaatctcagagcagcttctacaccacagccatttccagcatgaagatcactgggggtctccttctgctctgtacagtggtctatttctgtagcagctcagaagctgctagtctgtctccaaaaaaagtggactgcagcatttacaagaagtatccagtggtggccatcccctgccccatcacatacctaccagtttgtggttctgactacatcacctatgggaatgaatgtcacttgtgtaccgagagcttgaaaagtaatggaagagttcagtttcttcacgatggaagttgctaaattctccatggacatagagagaaaggaatgatattctcatcatcatcatcttcatcatcccaggctctgactgagtttctttcagttttactgatgttctgggtgggggacagagccagattcagagtaatcttgactgaatggagaaagtttctgtgctacccctacaaacccatgcctcactgccagaccagcattttttttttaacacgtcaataaaaaaataatctcccagaaagtttatctttgc

SEQ ID NO: 85594 - DNA, 447 bp, Homo sapiens
aggacatttgcttgtatatgacacaggtggactgcagcatttacaagaagtatccagtggtggccatcccctgccccatcacatacctaccagtttgtggttctgactacatcacctatgggaatgaatgtcacttgtgtaccgagagcttgaaaagtaatggaagagttcagtttcttcacgatggaagttgctaaattctccatggacatagagagaaaggaatgatattctcatcatcatcatcttcatcatcccaggctctgactgagtttctttcagttttactgatgttctgggtgggggacagagccagattcagagtaatcttgactgaatggagaaagtttctgtgctacccctacaaacccatgcctcactgccagaccagcattttttttttaacacgtcaataaaaaaataatctcccagaaagtttatctttgc

SEQ ID NO: 85595 - DNA, 785 bp, Homo sapiens
acttttatttcttctccgtttttcctcattcttttcctcttatttctttgacttttctgatttctttttttttcttattttcctttttttttcatattccttttaattttttcttacttcttttacttttcttatttgccctcttgtggaaatgaggcacagcctcccttatggttgagccgtagttctagctgagcacggatggtttgatcctcctgtgttggggcactgtatggtgtgagggcacaaaaccttgacccacatgggtctggtcaccttctcacagaggtcacctttacagccccccaactctttgaaggatgtgtcccaaggtgtctcaagtctgatgcaatgaaagctgccccccattgaccacaggactgagtccagaatgtcctgcgtgtttcccagagtgtctgtcctaacaccgcttaaagattagccactgctagacagtgatcctcaggtatatggtctcaggattggccccaagcacacggtgtgtgtgtgtgtataaatatatcttcacaaagcataggtacccattaaagccatattgctttgctgaatggttctaatagctacagatgatttctagcctgaaagaaaagcaccacgaattgtttgaagttgacttgtcagatgtggcatgcttggtctaagttttgacaggaagggtatgtgggtaggggtgtacggagcatctcatgagaccagttctcctcctgagaggtccgtgatgttgggaactgttgccccagatggactttgcccttgtgagactt

SEQ ID NO: 85596 - DNA, 996 bp, Homo sapiens
aacatgtatgcatccaaaaacagcccccaaaaaatacatgaagcaaaaactaacagattggaagagagcagtagttcaaaaacaacagctggagaccttaacatactacttttaataatggataaaactaagcagaagatcaacagggaaacagaagacttaaataacactgtataccaacaaggactaacagagaactgtagaaccctccacccaactactacagaatgcacgttcttctcaagtgcacatgaacattctccaggacagaccatatgctaggctgttaaaaaaaagttcagcaaatttaaaaggattaaaactgtacaaaagtatgtcctcaaatcccagtggggtgagttagaaataaataacaaacttgggaaattaataaatacatgcaaattaagcagtatacttctaaataaccagtgggtcaaacaggagatcacaaacaaaattaggaagtgtcttgaggccgggcgcggtggctcacacctgtagtcccagccctttgggaggccgaggaggcgggtcgcttaaggtcaggaggtccaggcaggaaaattgcttgaacccccgaggcagaggttgcagtgagccgagatcacactacagcctgggtgacagagtgagattccatcaaaaaaaaaaaaggaaatattttgagacaaatgaaaatgatactatatatcaaacttatgggatgcagctaaagcgtgcttagagggaactttagagctataaatgcctacatttttaaataaatctaaattgcctaaacgtctaccttaagtcattggaaaaagaacaaacatctcaaaaggaaaaggaagtaataggattagagtgaaaactggtgagatagagaatagaaaaacagtagagaaaatctgtaaaaccaaaggtgatttttttaaaggtaatctttaaaaagatcaacaaagttgacaaacttttagccacactgaccaaaaaagaaaggctcaaattact

SEQ ID NO: 85597 - DNA, 378 bp, Homo sapiens
ctgggattaatcagaagtcaacatggtggattagcatgtaagatggagttgctttaacctgcacatctttgctattacaaatagtgctattatatatatataaaatatgatttatatatgatatatatataaaagtgtgaataatcttgctgttttcttttatgatttaatttttcagtctataagattgaacatatgtcattttgtttatacatgtgttatagattgagtatttgtgttcccccatcaaatacgctgaagccttaactcccagtatgactctattgggagatagggcccgtgaggaggtaataaaggttaaatgagggcataatggtgaggccctgacccattaggcctggtacccttataagaaaa

SEQ ID NO: 85598 - DNA, 769 bp, Homo sapiens
tgtacttacaggccacccctgaaaaggcatatcagattcctaaagtgcttcgtaatgccccttcaaagagtcttaagtcagatatggcttccccaaaccaattttgcagtcagacatgtaaaaatcagaaaatcaattcctagaactcgctcaatgtttcatttcatcccataccaggcaccatgatgtgtcaatcttagttcaaagcactacaaaccaaaccaggtgatgacaagtaccaggaaagaaaatagaaacttttagcagggcacagtggctcatgcctataatcccagctactcagaaggctgaggcaggagaattgcttgaacctgggaggtggaggctgtggtgagccaagatggtgccactgcactccatcctgggcaacagaacaagtctcaaaaaaaaaacaaacaaaaaaaaaaacaaaaaaaaaacaacacctctgccaatctccgttgcaaactggctccccatttaaatggactgacaaggcagttatacaaatttaagtggtgtgcacttaagttcaatctaactttgaagtgactcatgccccagtaaaaggactatgctttctatagtcaaaaattctttaatgctctgacaaggaggcccaggagtttgagaccagcctgagcaatatagtgagaccctatcttcacacacaaacaaaattaagctgggcccagtggctcacatctataatcctagcactctgggaggctgaggcaggaggatcacttgactcaggagttcaagacca

SEQ ID NO: 85599 - DNA, 653 bp, Homo sapiens
ctctgcttcctctttaaacataagttttaatttcaaaccatctctttgtgaatgcatatggccgtatgctgttaagagcacccaggtcacatcttaaatgctttgctgcttagaaatttcttctgccagataccttaaatcatctcaagttcaaagtttcacagatctctaaggcaggggaaaaatgctgttagtctgtttgctaaagcacagcaagagtgaccttagctccagttcccaataagttcatctccatctgagagcatctcaacctggacttcattgccccatcactatcagcattttggtcaaaactattcaacacatttctaggaagttccaaagtttcccacctcttcctgtcttcttctgagctctccaaactgtaccaacctctgcccattacccagtttcaaagttgcttccacattttcaggtatctttacagcagtgacccaaactcctggtaccaattttctttattagttcatatatacattataatgaactacgtgagactgggtaattgataaagaaaagaggtttaattgactcacagtttcacaaggcttaggaggcctcaggaaacttacaatcatggtggaaggccaaggggaagcaaggcacgtcttacatggtggaaggggtggggg

SEQ ID NO: 85600 - DNA, 460 bp, Homo sapiens
  misc_feature (3)..(5): n is a, c, g, or t
  misc_feature (314)..(314): n is a, c, g, or t
  misc_feature (321)..(321): n is a, c, g, or t
  misc_feature (343)..(343): n is a, c, g, or t
  misc_feature (355)..(355): n is a, c, g, or t
  misc_feature (457)..(457): n is a, c, g, or t
atnnnaagttccagggtacatatgcaggatgtgcaggctggttacagaggtcaacatgtgccatggtgatttgctgcacagatcttcccatcacctaggtattaagccccgcattagctgttcttcctgatgcgcgcccttcccagcccccccgacaggccccagtgtgtgttgttcccctccctgggtcaatgtgttctcattgttcaactcccactcataagtgaaaacatgccatgtttggttttttgttcctgcattagtttgctgaggataatggctttgaaatctaaagtatgctctctgatcacggngaaattnaatcataaatcaacaaaatagnaaaaaattcccncattgtagtaagtcaactaatacttccatgcaactcatggatcaaaggagaaattaaatgataaattagatttacaaataaataaaatgctgtacttatgtngct

SEQ ID NO: 85601 - DNA, 994 bp, Homo sapiens
ttcacctcccaggttcaagtgatcttcacacagcctcccaggtagctgggatcacaggtgaggtctgtctctgtcacccaatacagtggcgtgatctcagctcactacaacttctgtctcctgggcccaagtgatcctcctgcctcagactcccaagtaactgggactacaggtgaacaccaccacacctggctaaatttttattcttagtagagatggggccttgccactttgcccagactggtcctgaactcttggggtcaagcaatactcccaccttggccacttgtgatcttctggggttacaagagtgagccaccacacctggccaacatgtatttcttgataatgtaaaaattagtaaagaattgacttttacagtggtctttaatttgtattagcatataaattaaagttttagaattttaaaaacaaatacaacaagcaaaacaaaacaacaacacaaaacagcaaccaccaaacaaagtaagagaaacagaaaagcacaagaaagagaagagcagaacaagacacaagaagagcacaagggggggggggcgggcatggagacagccccccgagggggcacaagaaatgtagaaacgacaaacaccgaatatgtgatatagaagacgggagcggcgctcgccatgagatgggcatcgacgacaataaaaagagaaacgagagagagcgcgcacatgaagatgagaaggcatcaggcgatgacgacgagagacagcagagctgggcgagagtctcagcggacgcgagacaaacagaaaatgaaggaagagacgaacaaaagccaaaggccacgacgaccaaccacaaccagaagaaaagagaagcagccgaagaggagagagcaaaagacaacacatgaaaacagcgtccgaaacagtggtaaaagaaaagaacagagacacagcgggggcgcacgactagcagcgaccccaccagcgaagacgcagcaggagaaccaataaaagag

SEQ ID NO: 85602 - DNA, 443 bp, Homo sapiens
cgctatgggtgaactatgtagaaacggccattattttgcctgcaaatgttaacagaagggtattaaaaccacagctaagtagctctattataatacttatccagtgacgttcctcatccactgggagatcttttggggactgggtcatctaacgaatcaagtgtcccaggaggaagcctgttcagaggacattaggccaactaaatgaatgagagagagtaaaggcagagtcaggactagaactgagttctagattataatctggtttgctcttggcacccaacttgccactcaacccctcaggtactttcctaattgatgacatacttagttgtaaaaagtcacaagaatagccacttgaaaatcattcctttttaaatcttcctattctacagcagttaagaaaataaattttgaaaccagaccaagattcaaagcctggt

SEQ ID NO: 85603 - DNA, 456 bp, Homo sapiens
aacaaaaaaaaaaaacaaaaaaaaatgaataactttttagttaagcatgtcctgtgtaatattatactaaaaaaaaattcattgtttatcggaaattcaaatgtaactggacatcctttcttttatctggcaaccccctgcctgctgtattccttctctttttgtttggagacagtcttactgtgtcacccaggctagagagcagtggtgtgatctcaactcactgcagcctcaacctcctaggctcaagggatcctcccacctcagcctcccagatagctgggattacaggcacataccaccatgctcagctaatttttgcatttttagtagagatggggtttcgccatatagcccagggtggtcttgaactcctggcctcaagtgatccacccgcctcatcctcccagagtgctgggattacaggcgtgagtcgctgcacccaaccttgtattc

SEQ ID NO: 85604 - DNA, 139 bp, Homo sapiens
ctgtgggtcatcattttttccatctgtaaatttgatcagctacttactaaggtttcttcactgagtataagtctcccttgattaaattaaagcattgtctgagtgagtagacaaagtaaaaatgtatttgggggaataa

SEQ ID NO: 85605 - DNA, 397 bp, Homo sapiens
tatggagagtaatttttattttagacacattgtaaatgtttcttacaatgattatttttaaagcaagctctagagtttccaaaactgggcattgagtagaatccagcatcgtaataattcagatttggttcctgtttgcccttgtactgtgctggagctcactgtcctggagctcaagggaacccactggcactagaggtgtattgagttgagtcaatggaacacctgtcagcttccatctcgataccatagggagcatgaatgttcaagctcttgctgctagaagtgatgaaagtggctgccgttatggtttttattaatagctttttttttttgtaaaatgtccttttaaatgaagacaagtttactttatgaaaaataatcaagtttatgcttt

SEQ ID NO: 85606 - DNA, 480 bp, Homo sapiens
tagctgggcaacaggcatgcaccactgtgctggctaaaaaccactattattaatcctgtcgagcacatattccattttggcaaatgttaactgatgagattaaaattacccttcacattaataaagttctatttctataatattttcagcaagcaagtggattctatgaggacaggaaatgattcttctagcctaactttttaaagctgaagtttagaacttattttgggtttttctttgatgcatgaaaggatctggttgtagtttcccaccacacccagctaattttgtatttttagtagagatggggttttaccatattggccagactggtatcgaactcctgaccttgtgatccaccctccttgttctcccaaagtctgggattacaggcatgagccaccacaccccgcctgtagtttcttaaaatgactcatctctattcaaccagtcattgttgaaactcaggaaagagccaca

SEQ ID NO: 85607 - DNA, 180 bp, Homo sapiens
ctgttttttttttttctattaatctggtcctttttctatagcaaatttaatttattgaactattatataccctatatttctcaaatttttctttaaagatgaaataattccatatcaaatctttgtttatatgcagctacattatgcctatattttttccttgaaagggcagtcaagcta

SEQ ID NO: 85608 - DNA, 632 bp, Homo sapiens
tttcaatttgagagtagattaacagcatttctgtagttaggagagcagccagttacatattcttttcttgggagtttagacttgcaggtccctctgaatgaggtaaagccaggtcctcctaccccaactaaagtttaaagatgcaggggagatgtcaaaagatgtgatctgagatttctgcaatcacttggaaactgtactggctaattaagatcataatagattatttattctttcattcactcatgtttatgcgtgtgttctttcactctttaaccattcagcaggtatttactgagcaactgaaacttcattcatattatatgagttattacatgataatatcaataagaaaaattatgtgaaagtttattaatattggctatgagggggatgaaagcagcaagccaaaaaaaaaaaaatgctgtattttaaagaaagtcaaaggtagcttcatccatgataaaaaggtgagaaaactgagatccagtggagttaatcaacttgtctatgatcacatacctagtttatggtggagaaaagactgaggtttagagactgattcataaaaccgagctctttctatgatattggaatatcagataaatcaataaactcccaactagatgaaa

SEQ ID NO: 85609 - DNA, 336 bp, Homo sapiens
aacaggttgatacattagcagctaaatattaggcaaggaaggagttatgtaaaatagtaatgtcatcttatacttgtgggaggggttttgtatttctgcaaagcattttcacagctcttatctactctgctcaacaaatataaagagtaaatttcctttattctcattttttcagtgagaaaactgagatccagtggagttaatcaacttgtctatgatcacatacctagtttatggtggagaaaagactgaggtttagagactgattcataaaaccgagctctttctatgatattggaatatcagataaatcaataaactcccaactagatgaaa

SEQ ID NO: 85610 - DNA, 556 bp, Homo sapiens
caggcataatactctcaagccttggcttctggaaagactacactgagtgtcgcacaaaatattcatttgtattgctttggtaaaactagaaaacactatgggcatgtaagatcttattaatattataatcagatatcctttaactattaaccagcagtcctagaaactggaagtatgtcatagtaagccttagtttcccaaatgaagactttaagccatagattacctttatttgtaagatccttaaaatttaccccagaaaaaatagctagaacatcctcctccatgtgagccacatatgtcgtctgtgaatcactttcatctccaaattagtacgatccaaattagcagggctttcctacagtgaaacctgtttaagcaaacatctgctggttcactgaaaagtaatttttttctacaggtggcctttgaatttgtggcccaaaaatccatggaaagaaaatgtagcctttgagatggaagcccttcaaagagaggtggtgtccttgagaggctgggtctgctctcgctggggagaagcgtgcgaaaaggaact

SEQ ID NO: 85611 - DNA, 348 bp, Homo sapiens
agctgctgctcagggggctgaggcaagaggattgtttgagcccaggagtttgaggtcacagtgagctgtagtcatgccactgcactccagcctaggcaacagaatgagaccttgtgtcttaaaaaaaaaaagtttcctttgttgggttattttaatttggacctggttatcatttttcagccatatttaactttgtacatatcagaatgttctgataaaacttaacttttattaaagtgtttgtgatataatctgctagttttggtacacattatcttttgcaatgccagttattttcttttccagtgtgggtttgcataggaaaagaattgctgtcactttctattt

SEQ ID NO: 85612 - DNA, 366 bp, Homo sapiens
caccatgcccggataattttggtatttttaatagagatgggttttcaccatgttcgccaggctggtcttgaactcctaccttcaggtgatccacccgccttggcctcccaaagtgctgggattacaggagtgagccaccaagcccagcctaaatttttgtatttttagtagagatggggtttcactatgttgcccaagctgttcttgaactcctatactcaagcaatatacctgccttggcctcccaaaatgctggaattgcaggtgtaagccaccacgcctggcttaagtatacatttcaaaattacttaatgagtacaattagattatttgaaacacaaaggctaaatgtttgaaggaatgtta

SEQ ID NO: 85613 - DNA, 833 bp, Homo sapiens
tgctgggcatgagttgtttgtgacaaatattcatatacatattcttgtgtggacatatgttttcgcttctcttgggtatatatctaggagtaggattgctgggtcatatggtaagtctctatttaatggtttagactcagtactttgttttctgcctttccacagctcagtttcataaagaggcaggagccttttgttcagggctccttggcagtaaggtaatttcttcttctgcattgtatccagctgacccttgctcagtgctgttctttgggggaaagatggaatgctgggaagccagcacctcttattccttctagctaacacttttacagtgacggatataatgatatcttcaactagtattgttgaattatctccctgatgctgtccaattttgcttcatatattttggggctctgttattaggtatgcatatatagtcattattgttatatctttgtggtggtgtggcctttttattattttagcacttttatatctttacctctaataacgtttttaaaaattgaacgttgattttgtctgatgttagtacaaccacttcagcttctttgtagttgctgtttgcatgacatatctttctccattcttttactttcaatctatttgcatctctgggtctaaaatgtgtagatagcacatagttgaatcttttaaaaaatacattttacaatctctgatttttattggaatgtttaatccatccacatttaatgttacgattgatggagctggacttatttctgccataaaaatatctcatgacatttttattcctgtatttctattgtacttttttgcattaagaa

SEQ ID NO: 85614 - DNA, 365 bp, Homo sapiens
ttcggcgtggtggcacacacctatagtcccagctactagggaggctgaggcaggagaatcacttgaaccccggaggcaaaggttgcagcgagctgagatcataccactgccctccagcctgggtgacagaatgaaactctatctcaaaaaaaaaaaacctaacattataaaaccatttgaaaaataaaattagggtgaaaatgatctttccatcaaagcaagaaaacaagtaacttcaaaattaggtatcaattagaaaccttaaaagtgatagctaatattaatcatatcaagatgacaaaattaatgagaaatgaatttagaatcaattatttgaaactgtgttaacaggttccaaatggtta

SEQ ID NO: 85615 - DNA, 508 bp, Homo sapiens
gccaccatgcctagccaagcctgtggttttctttctggaagtgacgcagtgcactgagaagaatccgtcccacgccacagcccttacagtcatcgttattgacatcacagtcaagtacagcagccacttgggctcccgggacatgcgctggagttggtactttataaagacaagctgtaggcaacagtctgattaactcgatgccacagcacatcacagattaccgacgtccagttcccattaccttggagctcagacaaagctcaaacccaagggcatggacaaaccagtccccaaatgctatccttgtggatctatctccaggcacccctcttgtaataatgctacatcgatcgggatccactcacaaggcggaaaccacagagtcatttaaacagggaagttttaacagaacaatgaactatttacaggggattgtgactaagtgtgaatcaaagagaactctaaaaaacacccatggggccgggcgtggtggctcacgcctgta

SEQ ID NO: 85616 - DNA, 668 bp, Homo sapiens
atgttaagtaaacaatacaaaaacttaataattatgaaatacagcaaacaaggagtgaattggataacaagcccatgatgaactgttgagtcagttgtataattacagatattataagttcagaggaaggcagtatcctaaagattagacatggctcaataatttatgtattcccaaataggaacacttctaaattgaataattaaagaagagtttgttttaacaggagaaatagctggtctgtatagagttagtctcctgaaggagaaaagaatcacatgatagctaagtaaaacaaaaactaggatgtaatagattttaagtaacaaacagaaaatatagacaatgagggcagagtcaaagttaggaccaaaatgagtttacttttagttaaaagtaataaggaagcaagaactataatcaagcaaaagctatatagggtgaaatgtaagaattagtgaattggaggtgggaagcccaggtaggcagatctgtagaaggaatctatagagtagaaatgcatccgttagtaatgatggtcattcctcatgtttctgattctcaaatgcatacatactctctcagttccagaactatccttcagttcctaattgggaggccaagcttatgatgtgtcttgattgcagacttgtatgtgatacccttat

SEQ ID NO: 85617 - DNA, 552 bp, Homo sapiens
tggagtctttttagtaaggatccaccctcggcctcccaaggtgctgggattacaggtatgagccaccgtgcctggccatccgttgttttttgtttgtttgttttattatattgagaagtccacagcaaagaatcacagtgatgaaccagttgctgtgttgagtcaacaacttaagagcagctaaggccaagcagcagctgcttgctgcagcactccatcatatgctaaattggaattgagcaaagtgtctgggaagagacagtaaagagaggattcatgttgaaaagagaaataaatatttatttattgcatgggatgcagccagatgatttaggtcattaatgagttgaggaagtaactttaaactatcaaacataagaataatacaatgaagactctattaagagattattaatctggctaagaattgtatatagaaaaaaatgaagagcgaagatgagctaggatagatactaggatagatactttggaacaatctcaagatgaggtgattcaaagcttggaatgggaagaaaggaaaaatttccaaag

SEQ ID NO: 85618 - DNA, 224 bp, Homo sapiens
ttgccttcaccaatctctctacatgtggcactggtttcatatccatgtccctcctttctctgcaggccaggggttatcaccatgcaagctttgtcggaagaggaccggaggctctggatggaagccatggatggccgggaacctgtaagtaacaattcagggaagtagagcaagaatgaaggccctgagttgtttgttgcttccctagtgcagtgatttttgct

SEQ ID NO: 85619 - DNA, 789 bp, Homo sapiens
cccaaagtgctgggattacaggagtgagccaccgtgcccagccccatttagggatgtttttagagctgtcagttctatccatctctcactatgtctgatacaagcacatatatgctatatactcacactcatacacacacacactcctagatacacacacaccctctttaatggttagagactataaaataaatattgttgctacccttatctcttcaccacccctctccccaaattcttcagctaagcttttattatgaactccattccaaaagctagatgggagagaaaattttctgctgttaaatggaatcattgtctcctatttccaagcaaaggtagaggaggaaataaatgcagtctgtttttttaagtcatttttttctgacagtctctgaaacttattgataagaacactgtgtcttgagggctgtattttttgcatctgttctttccatagtttctataagagacacaatatttctatatatttccaccttaattaaaacggggccttaaaaatgagagaggggtaaggaaaaagtaaaagtaaaaattaattttaataagagaataaataaaaagagagagaaaaataaattgacttggccagagaagcaaaaatcagaacacatggtgattggggaagccaaaaagaaataaaatatgaaggtttgcaagctttggccaaaagctacaagacaagtctaaatgatacaggttttttggttttcaaggctcctacattcactcagaagcttctgtatcctttttttattctcctaaagg

SEQ ID NO: 85620 - DNA, 627 bp, Homo sapiens
gcggctgtgaaggaagcacgaggacagaacgggcccagatgccctgaagagcaccgaggacagagctctggtgggtcagggctgcgcacaggtgggtgaggggccacgcagggctccctacagtcctcccagagcagtgggtccatgggatgcggcccccaaagatgggtccacatgctgaccctggaacctgtgaatgaggccttatttggaaaaaggtttttacagaggtaactcgttaaggatctcaagatgagagcatcctggatcacccaatgactggtccttataagagactcatagaggagacacttggagggagccaggccagtcgaccactgaggcagagtcagagggacgcagcccccagaggaggaagaggcaggaaggggccgcacagggccttcggcccagagacgccttgattttgaacatctggtccccagatgacgagagggtgaatctctgctggagtgagcccccggctttggggaggggtcatggcagcaccaggtgctcaggtccctggttcacggcacagccgcggtgcatgggcagccctgccgacctgctcccaaagacttccagaactgccatctgataaaggtgagccacccttgccaagca

SEQ ID NO: 85621 - DNA, 801 bp, Homo sapiens
gcacagtgttctttttggaggctctggaagagagtccatttccttgccttttgcagcttctagaggccacctccattcttccatcttcaaagccagaaacagcatctctctgagcccgattcctcacatctctttctctggctctgggcttccgcctttcttttccacttttaaggacccttctgatgacattgggcccacccagacagtccaggatcatctccctctctgctgatcagcaaccttaattctacctgcagtcttaatcccctttgccatgttacataacatagtcatagcttctggggacatggtcatcgtggggcggggggattattttgcctaccacggctgctttaaattccttgtcaaataattccaacaactgtgtcatctctgttggtgtctgttgatcatcttttctcattcgaattgagaattacctagttcttggtgtaacaactgattttttattgtatcttagacattttgggtagtctgtatgagactctggatcttacttaaatcttctactttagcaggcctcccctgttactgtgccagcaggggaaggagggacgtcaccatgttactgccaggtgggggtggaagtccgggtatcccacttggcttgcagtaataccaagttcaagaccagcctggccaacatggctggtggggccaggggtgcctcgttactcttcctatgtggcttccacattgcagaggaggcaagggggctccttaccactgggaaagataaagtcccagctccctgcccggccttctctgacgctaccc

SEQ ID NO: 85622 - DNA, 654 bp, Homo sapiens
ttcgagctagaataccctgatgtattgataccaattttataattttgcttaaaagataaaaagttggttttatgtctcattttcatttaattgtgtcattatcaaacccaatgcatgccatactattcttccacaattacataactgaataactctccaaatcaggtaaacctatctgagacacaagagtcacgtaagattaatacagaggccattcaatatggatgatatcttacttatattctcaatgattgagattccttctgtaaattaatgaagtttcttttcatgtccacacgtaagaacaagaaaccatcatcctttcttctctccctctagtatagctggtccccttcaacttcgctctgcttttcaactatattttatttgccttccaaatgctactctgcttcagtgcccacactgacaaacacttatgttggcaagctgccattcaaaagaaggcctttccattttgtgaggactggtcaatcaaacctgcctggcctccaggctgtcgggagcactgcctcagtcccggccagtttgtcaagacccagaggtttctggtttctcttacggcaattattaatttgactcaacttctttgaagaaagaaacaagacttttaagtaagataatattctaaatgtt

SEQ ID NO: 85623 - DNA, 696 bp, Homo sapiens
tagacagagtctcgctctgtcaaccgggctagagtgcagtggtgtgatcttagctcactgcaccctccacctcccgggttcaagcaattctcctgcctcagcctcccaagtagctgggactacaggtgtgcaccaccacacctagctaatttttgtatttttagtagagatggggtttcaccatgttggccaagctggtctagaactcctgacctcagagatccacctgccttggccacccaaagtgctgggattacaggcacccagcctggtttttcttaaatgagataatttcttccttttttcctaaatcatgtgtcaggaataataaaattattatttatagtaattccattactcacagtaataattgtgataataatgtaaacaatttgtatttatatagcattctattattcacaaagcattttgacatatattgtccaatttcattcctacaaaaatccttgtgaggtagatagaaaaagtattattttcctattttacaaatagaaaatagaggctcagagaagttaatcgaatttcttaatagcatatatttaggacgtgatggtggagattgaatttcatcctaaatctaactctaaaacctgtcctatgacaccctccatatactacataatagccaaagacatattaagcctatctgctgttcaacaaattacatgcacccag

SEQ ID NO: 85624 - DNA, 359 bp, Homo sapiens
acatattgaaaatagcttatagtggagaatcatataaaagaattgaatggagcagccatccaagtataatgaagattcatctggagggcagacttcaattaaacccccacaacggatactcagccaaggaaatggagaaaatatatagatattttgtatccagatttaaattatatctgctaatcacaaggtagtggcacaaagatcagggccaaaagtgttttgctcaggtagctaggacatatagaacagcctgagaagtatggataacttctcagacttcatgagttaactgtgcaagctggtaacgtatctgtccgccagtgatacccattggactgagggagttacattagctg

SEQ ID NO: 85625 - DNA, 757 bp, Homo sapiens
caggggctgggggactcctctgctcaccttagtccttgatttcgaaggccccaattaactatctgttgtgtcagaatcggcgagtgcaaagtagctgcgccccgctgacgcgctctctcctgggtccgggtatcccagggcatccggagctggggagggttgtgcggactacccaaggcacgcgcagataccgggcagggaagaagggctccgtgttccaaggatggtcgtttacctctcctgagatcagccctaatcccttggtaacttaagcgcctctgaactcggggagcgcttggtggggcgcctccctgcatccacccctacccctggctccttcccaggcccagcatctttcccaccattctcacccccaccacccccacggccccgcccgtttagaggcgtgcggtgggcacttggtttacagaaccggcgtttcagatgtttatttgcaactaatttcttgtgctggaaaatgcttgttacccgggcggagcgcttccgctctgcgcggtccggcccggcgggcggtagctcgctgatccctccggcgaagcctccaaggagcgggcggctgggagaggttgtgccacccgggaccaagccatcggcgctgctccggactcccggtagggggagccgccgcgggcgccaggccggattgtgttctggcctcggggcggccctgctgccagcggccgggactctcagcacagagctcgggaggactccacctgctctccagataaggcgc

SEQ ID NO: 85626 - DNA, 372 bp, Homo sapiens
caagagagacatagcaggcattgaaacaatggaaatgcccacatagcagaagggagtgaggggatccaaactacaagagcgacaaaatcaactgtggatccagagacgaaaaaatgttctgtagtgcaaaggtaatctggtgagaatgatgaaaaaaaaagaaccatttttagaaaaaaggaatattagaaatattgaagtaaatatcataagtcattctattacaaaggcattaactccttcctatcaatagaatgtaccagtttaaaaatttttagtaggaatatatcttttattttataacagaaatcaagggacaaagagaatttgatcatccatacttcctactcttattggttgtcaaaatgtagc

SEQ ID NO: 85627 - DNA, 768 bp, Homo sapiens
ctcagctcacctgctttgtcctagagccagcagagtccaggctgctgttaacaacttcatgtccccgtgggtagcaggcaggtgcttctgtctgatctggctctccttgaccactgtactcatcaaatagaccaagatccccagagtccaagatccttacaagggggccagaaagggatgagctttctgaagaagcactgatgtaaaataccaggaattttgacatcgaagaagatttttgtgatggcagctgggatttggccataatctagaagacacatggtgaatacagttgcaagtcatttagtcatatttcttgctaaattgctgtgtcttcaatggtgagtctgttcaactttacttttgttatgcttccctcaatcacgaaaaggacaaacttctcaacagactggtcctgagtaaaagtgacctgaattctctgataaagaagagggaaagattcggctgggtaatgccaggtttgtctcacttgacagtacaatgtaactagttttgccataatgttgtgagaggagatatgtgtgggcccaagaccagaatggtggaactatgcaatcaatcgtagatttatagcattgcatgcaacaaaatgcccaggtttggtgtcaggaagcccaggttcaggctttgcaaatcctacgattgggaatcagttccttaacctctctgacttttggctaacttgattataaaaccacgtaaagaaaggcttttcatatggttgttctagggaaaaaaatgagataa

SEQ ID NO: 85628 - DNA, 290 bp, Homo sapiens
ccacctctgatctgacaagaggcagagctcaggtggtaattcttactcgcctgccactcaccttgtgctgtgcggcctggttcctaacaggccatggactactgctggtccgtggcctgggggttggggacccctgtcatacagtacttgaaaccacctggcacatagtaaatgcttaatgaaagttagctattcttatttaacccttaaaaccactatattaagtactattagtaagtattgttaagtatattaagtattatatctccttttataggtaaattaactga

SEQ ID NO: 85629 - DNA, 393 bp, Homo sapiens
ccatgtaagctaggatggtcttgatctcctgacctccacacatgcattcttttttggttttttggttttggtttttggagacagactctgcactccagcctggaagcctggataacaagagctacactcagtctcaaaaaaaaaaaacaaaaaaacacctgacttaacttcctgctcatgctggacaccagaataaattcctaaggcgggcggtgtaaaccggggacccccagctcctgggattcacctactttctccccctccaattcagggtgtggatttcaatgtatgcagccttctgggacctcagcagggcagaggatcatgggacacagagtctcttggggatacgtggaatcccctaacccagggaggtctcgcccgggttatcct

SEQ ID NO: 85630 - DNA, 689 bp, Homo sapiens
tgctggaactcaccatatagatgcctcactgcttttcatttctaagtttctcctccatgtctttttcctcttgccagtgtttagataaaattatttctatttgatacatttttcttcactcttgtccttaatgggtcaagtctcatgtggcttcatagccctgacagacagtagtattgctattttggagtcaaggtctcgttctgtcggccaagctggagtgcagtggcaccatcagggctcactgcagccttgacctccgaggctcaaggaatcctcccacctcagcctcagccttccggatagttggtactacagatgatccagctctgtcggaggcacgtaggcacagccaaatctcatgctgtacattgatcacctgtccaacctttgcctagagtgggagcccccagttccttcgagatccaacattacctgtctgtaaagaagaagaggaggagggagacagcggggaggatccggtggcagtttaacaccagagcaggtccaatgtttacttttacccttttggaggtgggtaacggcaaatgctgggtgctgggtttcagagagactctgcataatgagcttggatttgggggctcacatgtactttacattttgctagagtgtaggagttgctatttttgtatttaattcacagccagactgttccatgattcccacca

SEQ ID NO: 85631 - DNA, 1065 bp, Homo sapiens
tctgtaaactccccctgaaagacattcctattaatacagtaaatgtgaacactgacttgtttttataagcacatctgaaagggcatatttgagtctcatcccaactttggtccttgctatctgtgcaggcttgggcaggtcatctccctgctggtctcaatatcctcacctgtaaaatgattgtaaatgatccccctaccttcaagattctctgattgatagaattttttctttaattaaaaaattttaaatattccttgagttggagcactgatcaataagtggattgcttagggaggttggaacgaatagattcagtcccaacttcctcttttaaattccctcttcctcactcttcctgcaacacttatttttacagttgagttttaaaaataagtaatatataaaataatttctgtagtgtggtttcagatttaaaaattcctgcagacaggctgggcttgcaaccccatcagtcgatggtcagagccctttgctttttgagaccatttttaggtgagcttggcttgcctggatacagtgtgcagtgcattcttcctgaattttgcaattctggtatctgggtgtattttctaggtgtgtcagggtgagtgtaatccacctagggtgtggaaaaagccaagaaagggaaattaaaagaggttcctatccagtcatgttaatgatcttccacttgtactatcctgtgcttcgttgttaacctcgaaaacatactttgttggctgcaaaaataaacaaagggaaactcagaagtgtgtgagcatgcgtgtgtgtatttagagatagttctctggtgaagaaatggaatcctgctgatttaaatggcacaagattgtcttcgtgataatgagtcatcatataatcataatagatggttgtgtaatggggtgacccagccagtttttccagtgcaaagactcaaggtaattaacctgctattatcaactgcttttgattaagttactttcaagaggaaatacttagatttgaaacataaactctgaatttcatcaataaaagtaaattgccaagtgagactttgaa

SEQ ID NO: 85632 - DNA, 1436 bp, Homo sapiens
atgcattttgcatactaaaatgatgaaacattcttaatgaatttaaatagctactttatcagaaacaggagtcataggttgaatttttatgtgggtagtagagctaagaatatttgtaaaacagctctccatgatgggctccaacaggatgaagtaagaccacctaccaaggaagtaagatcagtcccaaaatgaactgtacatgaaattctgctctaagatctttttgctttttaacatgatttcagaaaaggctaatttttgtaatggactacaatacttgttttgctacataagctttcaggattttttttcttttatttttattttaaaattaatttttgagcagcattcttgactgcaagaaagcttctgtcagtttcccaaattactcaaataacatgtattttacactgaaaatcatgagctccttaactcaaagcttttccttgttgtttttgtaactatttaccatacaattacttgtaaatgaaatgtataacataaatatgcgctaacataaaggaagatgtttaaatattttttagacttctgaaaaaagataaaactctcggtttttaagaacattgtatctttcattttatctttctttctcctccaaatatattaataactatccttctatttgttacgttcttttacttaaagggactaaagtataaatcaggtaattaatacacaaaactttattctgtcccttgcttgtagcactacttcattccagtttcctcagagtttattatataaatcagacagatttgtaaataagtattttacagtctacatttatttgattatgaaaatggaaacagaataaaatgtgaacagataacaaactttacttgtgtgtttctccatcttttcaagttgatcaggtatatggatggcattttaaataatgtattaaatttagagaatgcattaaatagaaaagaaaattgtgggaaataggaaagcctttccattaagggtttagatataaaatgttctattcagttacaaactaaacctaaaatgagagggtttttttgtttaactgaaagagctagagagtaattaaaggtaattggcatgttattattcttaaaaggttcgcttttctgttctaagaataccagggaacaattgaatagataaaaagcaaactataaattgccaaatagatcttttgtataataatacatctcccaagacaaaagatatttcagacccataaaaaataagggaagtgtatttgcctgactggtcttgcatcttgcctgaccacaatgaatttgcatcagattttaaactcacagagttataaaatatcttaatgtgttaagagggaatcaaaagtgaatgtgattaacttgaaggaactagttggcagactttaacattaggctagtagaaactatttaataaataaaact

SEQ ID NO: 85633 - DNA, 466 bp, Homo sapiens
  misc_feature (2)..(2): n is a, c, g, or t
tntgtgatgctcagcatgagatgcaatctcaaaggaggggtgcacaccgtaggcaggtgccacacatgatctttcctaagttcgtaaaaggaaccaacacaggagcagctggcattctgcggggttcctctgggaagcatgagatgatcacctggtctctactgtggctcctggaaacgcactttgcttccctattcatataacaggcagacatttgcatggacagggcattcagccttggacttgtcttagtttaaatagtgagaatttgtcctgggctccccacaaaactctgaatcagtgtctggtgccagggccattgtaacagctcaggaacagctgccccagggagcccaaactcacagaacagtctttgtcccttggtgacttgcctatttcaagaccacaggcaggagtccatgttgatattcttctccctctgagacaacagcgcagccagccttgg

SEQ ID NO: 85634 - DNA, 1069 bp, Homo sapiens
agaggaggcttagaggatttctagttgattgttaaacctattcatcaacctactcataagaaatgaaaagcctcccttctccacaagaaaagacctcatcaactggagctgacatggctcaaaggctctagagatgtcagaggccgtgtctggctggggaagggacacgggatcctctgcactccacagcagctcaggcacaaactcccccgcttccgaggtgtaaaaagacagcagagtctccagctctctacccaaggcgcttgacgggcactgtctaggtggcactggcttcacatgcatcccccttccctctacagtgggcagcagtgttatctccggatgaaagcaaaggctctgagggcagaaggagtcgggctcacagctgtgcagtgccagcgacctaacctcactatgcttcagtttcctgaatcagcccatctataaaatgggataattcttagcacagagtgagcacacagtaagagttgatgctgctgtccttgcaaccatttctgttatggccccaggataaagtccttatagtcccttatagatttacaccaaaggatgtcgagcccttggtttgtgaagtgggactggtaactagattcaatgagatccatgccctgggcttggtgacagaatcaatgatggagttaaaatcctcacttccccccttccaaccgcatggcctcaggaagacaacatcccaaactcatctgtcacaggaagacagtaccagcatcttcatgatcagggtgactaaatggaggctaggcattgtgccaggctctcaacatacctcaagccccacaggatggtatcaccaggtgatggcaacaccagctccatgtcacaagtaaaaagactgaggctcggagacattaagtgatctgctccaaggtcaccaaagtagaagcagctgagaaggacctgaagccttccagctaaggtccagaagctgtgctaagggtagtgtctggcccggcgcacggtctcacacctgtaattccagcactctgggaggccgaagcaggcagatcgcttgagctcaggaatttgagac

SEQ ID NO: 85635 - DNA, 1193 bp, Homo sapiens
attacaggtgcccgccaccacgcctgactaattttttgtatttttagtacagacaggatttcactatgttggccaggctgttctcaaactcctggccttgtgatctaccctcctcaatctcccaaagtgctgagattacaagcatgatccactgcacccggccagttgttttttttggtttttttgtttttttaggttttttttacgaaaatgtttgggaacagaaatgttgtggatttgagattttgttggattttggaatatttgtattatacctactgtttgaacatcccaagtttgaaaatctgaaaccttaagtgttaacatgagcaccttaataaagtttggacagtatttcttttataaacaatattattgatattgctaactattaacattagaaatgaaagtcgagaaagataattacctggaacgttagtacccagaaatacccaattgtgttggtatttgttttaagttttcatttttatgcatctccacctcagaaccataatctaaatttacagttgaattcatttcaatacctcagtggtgtaccattgagtcctaaaattctagaatgttaatcccagtcatgtgtgtacactaacatgccttttttgaagtcttttgaaacctatcagatacagtgtggagtccattttgctgaagagtatctagaatatctgctaccctaagaagcagtcatagtcccttccatagtagtttaagttttaaattgtccactgttctgagtaacgtgatgaaattttgcaccaccctgtcctggatatgaatcaacataaccacgctgtacgtgctcccattggtcagtcattgacatcatcggcttttgacatccatctgtggacatcagcatgactcagtgattcaggatcaccctaagatgatcccccttcttaggtatagtcagaaggttgatattagctacatcagaattcctaagtcattcactttatcttatcttataagcgttttatcatctcacttcaacacaagaagggtgagcacggtactatgagatattttgagaatgagcgagaccatgttcacataacttttgtatggtatattgttccgttttcttattggttattgctgttcatttgttactgtgccagatttataaattaaacttgattataggtatatacctataggaaaaaactgtg

SEQ ID NO: 85636 - DNA, 214 bp, Homo sapiens
aagctccctgctgccagctctcttgtccactaggctctgagcagccttggtgctggcaccaagaagaaccaggggcacagggacccctgccaggaggctcccgccagcatcctcagggccgtaagctccaactcaggtttttactgaaacctcagtgtgcttctcagtcctccggggtcagccttgctggagccaccttgttgtgtgggactga

SEQ ID NO: 85637 - DNA, 4824 bp, Homo sapiens
  misc_feature (197)..(197): n is a, c, g, or t
  misc_feature (303)..(303): n is a, c, g, or t
  misc_feature (516)..(516): n is a, c, g, or t
tgaaacagggtctcgctctgtcacccaggctaaagtgtagtgccgcgatctcagctcattacaacctctgcctcccaggttcaagggatcctcccacctcagcctcccaagcagttgggaccacaggcatgtgccaccatatccggctaatttttgcttttttcatagagacagggtttcaccatgttgcacaagtnggtcttgaactcctgagctcaagtgagctacctgctttggcctcccaaagtgctgggattacacatgtgaaccaccgtacccggccccaaaaatgctttcttaagngtaactacgtaatgctagttgtagtttagattcctggatgttaacttaaaatagtcccataggaacccagtgtggtggctcacgcctgtaatcccagcctgaggcaggtggatcatctgaggtcaggagttcgagaccagctgggccaacatggtgaaaccctgtctctactaaaaacacaaaaaaattagctgggcatagtggcaggcaccngtaatttcagcttctcgggacgctgaggcagaagaattgcttgaacccaggaggcagtggttgcagtgagcccagatcgtgccattgcactccagcctgggcaacaagagcaaaactctgtctcaaaaaaatcaattaatttaggctgggcgcagtggctcatgcctgtaaatcccagcactttgagaggctgaagcgggtggatcatgaggtcaagagatcgagaccatcctggctaacacggtgaaaccccatttctactaaaaatacaaaaaaaaaaccccaaaaaacaaaaaaacaaaaacaaacaaacaaaccaaaaaaacacaacaactagccaggcgtagtggcaggcgcttgtaatcccagctagtcgggaggctgaggcaggaggagaatggagtgaacccaggaggcagagcttgcagtgagctgagatcgcgccacagcactccagcctgggcaacagagcgagactccatctcaggaaaaaaaaaattaattaattaaaaaaacagtaagataaataacacttctcccatttcagtaaaaggatgaagccagtttctcaatgaataaaaacaagagactgttgaatgtcaagttttatagacagtccagacaacacagggagacaccatctctacacacacacacacacacacacacacacacacacacacacacacacacaaaatagctgcgtatggtggcatgggcctgtagtcccagctattggggcagggccagggggtgggaggctgaggggagaggatgccttaacagggaggttgaggctgcagagagccatgatcacgtcactgtactccagcctgggtgatacagcaagactctgtctcagaaaaaaaaaaaagaaaaaagtcaagaatgcattcttgaggaattccaccaacaaaatgcaccaaatatagccaaagagttttctgctatatgccaagtggaaagctatgaagaaagagaagaacagaagcaggaggacattggttttcatctcctattctttcaagaagtaagatccattatcttttaaaaagtctaaacactggtaaggcaagacacaactcccacccataacactgcatctctgtcctcaggcaacaaatcaaatgtcagataaaagcacaatatctaccactcaacccccaggcttcagcacagaactcacaaacattctgctggctaaggcaaaaaggtgtactgtatttccagagagcttgcagagttctgagcactaatcccataatcctcatatctcaatctacacaaagcaccatcaggctaagaaacagattatatagcaggcacaacactcttgggtatgcaaacatgttaaggatcaaagtaagaaaagagtaactataggggccatactatatttgccaaaaagtgacttgtttaaaaattaaaaagaagccgggtgcagtggctcacacctgtaatcccagcactttgagaggctggggtgggtggatcacctgaggtcagtagttcaaaaccagcctggccaacatagtgaaaccccatctctactaaaaatacaaaattaggcgtggtggcaggcgcctgtaatcccagctactagggatgctgaggcaggagaatcgcttgaacccggaaggcagaggttgcagtgagccaaaatcgcaccactgcactccagcctgggcaacaagagcaaaactctgtctcaaaaaaaaaaaaataaaaataaaaacaaaaaagaaatccagtttacctccttgtgcaattcctaataaattgctgagaagtgatcttacataggaatcttgtataatttattctgatgcgttcgaggtggccgttagttgactccgcggagttcatctccctggttttcccgtcctaacgtcgctcgcctttcagtcaggatgtctgcccgtggcccggctatcggcatcgacctgggcaccacctattcgtgcgtcggggtcttccaacatggcaaggtggagatcatcgccaacgaccagggcaatcgcaccacccccagctacgtggccttcacggacaccgagcgcctcatcggcgacgccgccaagaaccaggtggccatgaaccccaccaacaccatcttcgacgccaagaggctgattggacggaaattcgaggatgccacagtgcagtcggatatgaaacactggccgttccgggtggtgagcgagggaggcaagcccaaagtgcaagtagagtacaagggggagaccaagaccttcttcccagaggagatatcctccatggtcctcacgaagatgaaggagatcgcggaagcctacctggggggcaaggtgcacagcgcggtcataacggtcccggcctatttcaacgactcgcagcgccaggccaccaaggacgcaggcaccatcacggggctcaatgtgctgcgcatcatcaacgagcccacggcggcggccatcgcctacggcctggacaagaagggctgcgcgggcggcgagaagaacgtgctcatctttgacctgggcggtggcactttcgacgtgtccatcctgaccatcgaggatggcatcttcgaggtgaagtccacggccggcgacacccacctgggcggtgaggacttcgacaaccgcatggtgagccacctggcggaggagttcaagcgcaagcacaagaaggacattgggcccaacaagcgcgccgtgaggcggtcgcgcaccgcttgcgagcgcgccaagcgcaccctgagctcgtccacgcaggcgagcatcgagatcgactcgctctacgagggcgtggacttctatacgtccatcacgcgcgcccgcttcgaggagctcaatgccgacctctttcgcgggaccctggagccggtggagaaggcgctgcgcgacgccaagctggacaagggccagatccaggagatcgtgctggtgggcggctccactcgtatccccaagatccagaagctgctgcaggatttcttcaacggcaaggagctgaacaagagcatcaaccccgacgaggcggtggcctatggcgccgcggtgcaggcggccatcctcatcggcgacaaatcagagaatgtgcaggacctgctgctactcgacgtgaccccgttgtcgctgggcatcgagacagctggcggtgtcatgaccccactcatcaagaggaacaccacgatccccaccaagcagacgcagaccttcaccacctactcggacaaccagagcagcgtactggtgcaggtatacgagggcgaacgggccatgaccaaggacaataacctgctgggcaagttcgacctgaccgggattccccctgcgcctcgcggggtcccccaaatcgaggttaccttcgacattgacgccaatggcatccttaacgttaccgccgccgacaagagcaccggtaaggaaaacaaaatcaccatcaccaatgacaaaggtcgtctgagcaaggacgacattgaccggatggtgcaggaggcggagcggtacaaatcggaagatgaggcgaatcgcgaccgagtcgcggccaaaaacgccctggagtcctatacctacaacatcaagcagacggtggaagacgagaaactgaggggcaagattagcgagcaggacaaaaacaagatcctcgacaagtgtcaggaggtgatcaactggctcgaccgaaaccagatggcagagaaagatgagtatgaacacaagcagaaagagctcgaaagagtttgcaaccccatcatcagcaaactttaccaaggtggtcctggcggcggcagcggcggcggcggttcaggagcctccgggggacccaccatcgaagaagtggactaagcttgcactcaagtcagcgtaaacctctttgcctttctctctctctctttttttttgtttgtttctttgaaatgtccttgtgccaagtacgagatctattgttggaagtctttggtatatgcaaatgaaaggagaggtgcaacaacttagtttaattataaaagttccaaagtttgttttttaaaaacattattcgaggtttctctttaatgcattttgcgtgtttgctgacttgagcatttttgattagttcgtgcatggagatttgtttgagatgagaaaccttaagtttgcacacctgttctgtagaagcttggaaacagtaaaatatataggagcttaaattgtttatttttatgtactactttaaaactaaactgaacattgcagtaatgttaaggacaggtatactttttgcaaacaaatgcataaaatgcaaatgtaaagtaaagctgaaattgatctcaaaaaaaaaaaa

SEQ ID NO: 85638 - DNA, 144 bp, Homo sapiens
gatctggtggagaaaagaagcaaaactttgttttaatttactgtttttttaaaatctttttggatattgttttgcatcccatacatttgcaactggcaatgaaatgtaagctttggttctgaaaaaaaataaatgtagctattc

SEQ ID NO: 85639 - DNA, 553 bp, Homo sapiens
gggagcggctagagaaggaacattcaaatcttcccacgtgggcaagttccaagcaaatgtttatttttttacctcctctttggtttttgtctcacttgaagcactttgtgtttatgggaaaataccaaaaattaccaaaatttaaaaacccagggctttgctggaagtgagggtatcttcttggcttttcccttttcctccccaccactatacgcacatgcacacacagctctattttttggtgcttttcgttcattattcactccatttcattttagctcttgaagtcaaaatgggattccaaagagcaaaatagaagtttggagagtttgaaatctctcctcgtggctggacgccgtggctcacacctgtgatcccagcactttgggaggccaaggcaggcatactgcttgaactcaggagttcaagaccagcctggggaacatggtaaaaccctgtctctacaaaaaatagaaaaattagctgggcatggtggctgtagtcccagctatttgggaggctgaggtgggaggatcacttgagcctggggagg

SEQ ID NO: 85640 - DNA, 320 bp, Homo sapiens
tcacaatatatctaggtagttacctagtgataccaggtaactacctaaaagtagacctaaaaattagaatccaggttttgaataatctctccatttcctctgtaagctattacacggaccatggccccttgaatgttgacgttctagagttgtatccctaggcatcttctcttctcaaatatactactcctcctaggtaactttactcatatcaaaggattcagcctactcaccaaaactacattcccaacaaatctctaaaatcccaactagaatttccaactacctattttacactgtcatttggatattcccatttg

SEQ ID NO: 85641 - DNA, 658 bp, Homo sapiens
gtggaagctttgttctttcgatgtttgcaataaatctttccactgttcactctttgagtccacactgcctttatgagctgtaacactcaccgcgaaggtctgcagcttcactcctgaagccagcgacacccacgagcccaccgggaagcccaaacaactccagacgcgccgccttaagagctgtaacactcatggcgaaggtctgcagcttcactcctgagccagcgagaccacgaacccatcagaaggaagaaactgtgaacacatctgaacatcagaaggaacaaattctggacacgctgcctttaagaactgtaacactcaccgcgagggtccgtggcttcattcttgaagtcagtgagaccaagaacccaccaattccagacgcagttgcattttatagaacagaatgctttaagaacgtgaactctaaaatcagtatgccggggctgatgagctcagctcccctcatcctagctctgtggttttgggcaaacgatttaacctctctaatctcagtttcctagttggtaaatgggaataattatagtactcatgtaaaggaatttttgtgaggattaaatcagataatccatgtaaagtacttagcatagtgcctgggatggtatatgagtttgatggatgttgatttttatgg

SEQ ID NO: 85642 - DNA, 2290 bp, Homo sapiens
gagagacttagagccgagtgggacaaagcctggggctgggcgggggccatggcgctgccatcccgaatcctgctttggaaacttgtgcttctgcagagctctgctgttctcctgcactcagggtcctcggtacccgccgctgctggcagctccgtggtgtccgagtccgcggtgagctgggaggcgggcgcccgggcggtgctgcgctgccagagcccgcgcatggtgtggacccaggaccggctgcacgaccgccagcgcgtgctccactgggacctgcgcggccccgggggtggccccgcgcggcgcctgctggacttgtactcggcgggcgagcagcgcgtgtacgaggcgcgggaccgcggccgcctggagctctcggcctcggccttcgacgacggcaacttctcgctgctcatccgcgcggtggaggagacggacgcggggctgtacacctgcaacctgcaccatcactactgccacctctacgagagcctggccgtccgcctggaggtcaccgacggccccccggccacccccgcctactgggacggcgagaaggaggtgctggcggtggcgcgcggcgcacccgcgcttctgacctgcgtgaaccgcgggcacgtgtggaccgaccggcacgtggaggaggctcaacaggtggtgcactgggaccggcagccgcccggggtcccgcacgaccgcgcggaccgcctgctggacctctacgcgtcgggcgagcgccgcgcctacgggcccctttttctgcgcgaccgcgtggctgtgggcgcggatgcctttgagcgcggtgacttctcactgcgtatcgagccgctggaggtcgccgacgagggcacctactcctgccacctgcaccaccattactgtggcctgcacgaacgccgcgtcttccacctgacggtcgccgaaccccacgcggagccgcccccccggggctctccgggcaacggctccagccacagcggcgccccaggcccagaccccacactggcgcgcggccacaacgtcatcaatgtcatcgtccccgagagccgagcccacttcttccagcagctgggctacgtgctggccacgctgctgctcttcatcctgctactggtcactgtcctcctggccgcccgcaggcgccgcggaggctacgaatactcggaccagaagtcgggaaagtcaaaggggaaggatgttaacttggcggagttcgctgtggctgcaggggaccagatgctttacaggagtgaggacatccagctagattacaaaaacaacatcctgaaggagagggcggagctggcccacagccccctgcctgccaagtacatcgacctagacaaagggttccggaaggagaactgcaaatagggaggccctgggctcctggctgggccagcagctgcacctctcctgtctgtgctcctcggggcatctcctgatgctccggggctcaccccccttccagcggctggtcccgctttcctggaatttggcctgggcgtatgcagaggccgcctccacacccctcccccaggggcttggtggcagcatagcccccacccctgcggcctttgctcacgggtggccctgcccacccctggcacaaccaaaatcccactgatgcccatcatgccctcagacccttctgggctctgcccgctgggggcctgaagacattcctggaggacactcccatcagaacctggcagccccaaaactggggtcagcctcagggcaggagtcccactcctccagggctctgctcgtccggggctgggagatgttcctggaggaggacactcccatcagaacttggcagccttgaagttggggtcagcctcggcaggagtcccactcctcctggggtgctgcctgccaccaagagctcccccacctgtaccaccatgtgggactccaggcaccatctgttctccccagggacctgctgacttgaatgccagcccttgctcctctgtgttgctttgggccacctggggctgcaccccctgccctttctctgccccatccctaccctagccttgctctcagccaccttgatagtcactgggctccctgtgacttctgaccctgacacccctcccttggactctgcctgggctggagtctagggctggggctacatttggcttctgtactggctgaggacaggggagggagtgaagttggtttggggtggcctgtgttgccactctcagcaccccacatttgcatctgctggtggacctgccaccatcacaataaagtccccatctgattttta

SEQ ID NO: 85643 - DNA, 403 bp, Homo sapiens
tcaagcttctaacgatgtacggggacatgtgggactccaggcaccatctgttctccccagggacctgctgacttgaatgccagcccttgctcctctgtgttgctttgggccacctggggctgcaccccctgccctttctctgccccatccctaccctagccttgctctcagccaccttgatagtcactgggctccctgtgacttctgaccctgacacccctcccttggactctgcctgggctggagtctagggctggggctacatttggcttctgtactggctgaggacaggggagggagtgaagttggtttggggtggcctgtgttgccactctcagcaccccacatttgcatctgctggtggacctgccaccatcacaataaagtccccatctgattttta

SEQ ID NO: 85644 - DNA, 2411 bp, Homo sapiens
gagagacttagagccgagtgggacaaagcctggggctgggcgggggccatggcgctgccatcccgaatcctgctttggaaacttgtgcttctgcagagctctgctgttctcctgcactcagggtcctcggtacccgccgctgctggcagctccgtggtgtccgagtccgcggtgagctgggaggcgggcgcccgggcggtgctgcgctgccagagcccgcgcatggtgtggacccaggaccggctgcacgaccgccagcgcgtgctccactgggacctgcgcggccccgggggtggccccgcgcggcgcctgctggacttgtactcggcgggcgagcagcgcgtgtacgaggcgcgggaccgcggccgcctggagctctcggcctcggccttcgacgacggcaacttctcgctgctcatccgcgcggtggaggagacggacgcggggctgtacacctgcaacctgcaccatcactactgccacctctacgagagcctggccgtccgcctggaggtcaccgacggccccccggccacccccgcctactgggacggcgagaaggaggtgctggcggtggcgcgcggcgcacccgcgcttctgacctgcgtgaaccgcgggcacgtgtggaccgaccggcacgtggaggaggctcaacaggtggtgcactgggaccggcagccgcccggggtcccgcacgaccgcgcggaccgcctgctggacctctacgcgtcgggcgagcgccgcgcctacgggcccctttttctgcgcgaccgcgtggctgtgggcgcggatgcctttgagcgcggtgacttctcactgcgtatcgagccgctggaggtcgccgacgagggcacctactcctgccacctgcaccaccattactgtggcctgcacgaacgccgcgtcttccacctgacggtcgccgaaccccacgcggagccgcccccccggggctctccgggcaacggctccagccacagcggcgccccaggcccagaccccacactggcgcgcggccacaacgtcatcaatgtcatcgtccccgagagccgagcccacttcttccagcagctgggctacgtgctggccacgctgctgctcttcatcctgctactggtcactgtcctcctggccgcccgcaggcgccgcggaggtgaggctgccccggcaaagccagcggccccaggagactgaggtgggcgggagggtggtcctctgggctgggggacctgcggaaggggcggcactgcccccaatgtgagtctccttcccaggctacgaatactcggaccagaagtcgggaaagtcaaaggggaaggatgttaacttggcggagttcgctgtggctgcaggggaccagatgctttacaggagtgaggacatccagctagattacaaaaacaacatcctgaaggagagggcggagctggcccacagccccctgcctgccaagtacatcgacctagacaaagggttccggaaggagaactgcaaatagggaggccctgggctcctggctgggccagcagctgcacctctcctgtctgtgctcctcggggcatctcctgatgctccggggctcaccccccttccagcggctggtcccgctttcctggaatttggcctgggcgtatgcagaggccgcctccacacccctcccccaggggcttggtggcagcatagcccccacccctgcggcctttgctcacgggtggccctgcccacccctggcacaaccaaaatcccactgatgcccatcatgccctcagacccttctgggctctgcccgctgggggcctgaagacattcctggaggacactcccatcagaacctggcagccccaaaactggggtcagcctcagggcaggagtcccactcctccagggctctgctcgtccggggctgggagatgttcctggaggaggacactcccatcagaacttggcagccttgaagttggggtcagcctcggcaggagtcccactcctcctggggtgctgcctgccaccaagagctcccccacctgtaccaccatgtgggactccaggcaccatctgttctccccagggacctgctgacttgaatgccagcccttgctcctctgtgttgctttgggccacctggggctgcaccccctgccctttctctgccccatccctaccctagccttgctctcagccaccttgatagtcactgggctccctgtgacttctgaccctgacacccctcccttggactctgcctgggctggagtctagggctggggctacatttggcttctgtactggctgaggacaggggagggagtgaagttggtttggggtggcctgtgttgccactctcagcaccccacatttgcatctgctggtggacctgccaccatcacaataaagtccccatctgattttta

SEQ ID NO: 85645 - DNA, 2565 bp, Homo sapiens
gagagacttagagccgagtgggacaaagcctggggctgggcgggggccatggcgctgccatcccgaatcctgctttggaaacttgtgcttctgcagagctctgctgttctcctgcactcagggtcctcggtacccgccgctgctggcagctccgtggtgtccgagtccgcggtgagctgggaggcgggcgcccgggcggtgctgcgctgccagagcccgcgcatggtgtggacccaggaccggctgcacgaccgccagcgcgtgctccactgggacctgcgcggccccgggggtggccccgcgcggcgcctgctggacttgtactcggcgggcgagcagcgcgtgtacgaggcgcgggaccgcggccgcctggagctctcggcctcggccttcgacgacggcaacttctcgctgctcatccgcgcggtggaggagacggacgcggggctgtacacctgcaacctgcaccatcactactgccacctctacgagagcctggccgtccgcctggaggtcaccgacggccccccggccacccccgcctactgggacggcgagaaggaggtgctggcggtggcgcgcggcgcacccgcgcttctgacctgcgtgaaccgcgggcacgtgtggaccgaccggcacgtggaggaggctcaacaggtggtgcactgggaccggcagccgcccggggtcccgcacgaccgcgcggaccgcctgctggacctctacgcgtcgggcgagcgccgcgcctacgggcccctttttctgcgcgaccgcgtggctgtgggcgcggatgcctttgagcgcggtgacttctcactgcgtatcgagccgctggaggtcgccgacgagggcacctactcctgccacctgcaccaccattactgtggcctgcacgaacgccgcgtcttccacctgacggtcgccgaaccccacgcggagccgcccccccggggctctccgggcaacggctccagccacagcggcgccccaggcccagaccccacactggcgcgcggccacaacgtcatcaatgtcatcgtccccgagagccgagcccacttcttccagcagctgggctacgtgctggccacgctgctgctcttcatcctgctactggtcactgtcctcctggccgcccgcaggcgccgcggaggctacgaatactcggaccagaagtcgggaaagtcaaaggggaaggatgttaacttggcggagttcgctgtggctgcaggggaccagatgctttacaggagtgaggacatccagctagattacaaaaacaacatcctgaaggagagggcggagctggcccacagccccctgcctgccaagtacatcgacctagacaaagggttccggaaggagaactgcaaatagggaggccctgggctcctggctgggccagcagctgcacctctcctgtctgtgctcctcggggcatctcctgatgctccggggctcaccccccttccagcggctggtcccgctttcctggaatttggcctgggcgtatgcagaggccgcctccacacccctcccccaggggcttggtggcagcatagcccccacccctgcggcctttgctcacgggtggccctgcccacccctggcacaaccaaaatcccactgatgcccatcatgccctcagacccttctgggctctgcccgctgggggcctgaagacattcctggaggacactcccatcagaacctggcagccccaaaactggggtcagcctcagggcaggagtcccactcctccagggctctgctcgtccggggctgggagatgttcctggaggaggacactcccatcagaacttggcagccttgaagttggggtcagcctcggcaggagtcccactcctcctggggtgctgcctgccaccaagagctcccccacctgtaccaccatgtgggactccaggcaccatctgttctccccagggacctgctgacttgaatgccagcccttgctcctctgtgttgctttgggccacctggggctgcaccccctgccctttctctgccccatccctaccctagccttgctctcagccaccttgatagtcactgggctccctgtgacttctgaccctgacacccctcccttggactctgcctgggctggagtctagggctggggctacatttggcttctgtactggctgaggacaggggagggagtgaagttggtttggggtggcctgtgttgccactctcagcaccccacatttgcatctgctggtggacctgccaccatcacaataaagtccccatctgatttttaaagacccacaccagaagacgaccagaccagagcagagccaaacaacaccaggaggggcgcccaaaaaacactcgcggggccccactcagctcacccatgtgagagggccccccctaggcgcaactagccacaggcccgcacaacaccagcgcggagagaccacctgctattcggcaccaccgtgggggaagacaccccaccagcagagaacgaggttgatacctcgcgcgtgccagaaccgagcatagacagccagaggcgcgacgggatacctc

SEQ ID NO: 85646 - DNA, 2508 bp, Homo sapiens
gagagacttagagccgagtgggacaaagcctggggctgggcgggggccatggcgctgccatcccgaatcctgctttggaaacttgtgcttctgcagagctctgctgttctcctgcactcagggtcctcggtacccgccgctgctggcagctccgtggtgtccgagtccgcggtgagctgggaggcgggcgcccgggcggtgctgcgctgccagagcccgcgcatggtgtggacccaggaccggctgcacgaccgccagcgcgtgctccactgggacctgcgcggccccgggggtggccccgcgcggcgcctgctggacttgtactcggcgggcgagcagcgcgtgtacgaggcgcgggaccgcggccgcctggagctctcggcctcggccttcgacgacggcaacttctcgctgctcatccgcgcggtggaggagacggacgcggggctgtacacctgcaacctgcaccatcactactgccacctctacgagagcctggccgtccgcctggaggtcaccgacggccccccggccacccccgcctactgggacggcgagaaggaggtgctggcggtggcgcgcggcgcacccgcgcttctgacctgcgtgaaccgcgggcacgtgtggaccgaccggcacgtggaggaggctcaacaggtggtgcactgggaccggcagccgcccggggtcccgcacgaccgcgcggaccgcctgctggacctctacgcgtcgggcgagcgccgcgcctacgggcccctttttctgcgcgaccgcgtggctgtgggcgcggatgcctttgagcgcggtgacttctcactgcgtatcgagccgctggaggtcgccgacgagggcacctactcctgccacctgcaccaccattactgtggcctgcacgaacgccgcgtcttccacctgacggtcgccgaaccccacgcggagccgcccccccggggctctccgggcaacggctccagccacagcggcgccccaggcccagaccccacactggcgcgcggccacaacgtcatcaatgtcatcgtccccgagagccgagcccacttcttccagcagctgggctacgtgctggccacgctgctgctcttcatcctgctactggtcactgtcctcctggccgcccgcaggcgccgcggaggctacgaatactcggaccagaagtcgggaaagtcaaaggggaaggatgttaacttggcggagttcgctgtggctgcaggggaccagatgctttacaggagtgaggacatccagctagattacaaaaacaacatcctgaaggagagggcggagctggcccacagccccctgcctgccaagtacatcgacctagacaaaggtgagcggcgggggcgacctcagcccatctcagagccctgcctgtccccattccacctcacctgggaccaacgatggcaggcaccagccaggcccggggcccctgccacctcaggctcagaaatccctggggagtcctgcgggggggtctgccctgtgtctcccactgtgatgagggtggaggacagccgccaacccgttggcgcccttggcttccagggttccggaaggagaactgcaaatagggaggccctgggctcctggctgggccagcagctgcacctctcctgtctgtgctcctcggggcatctcctgatgctccggggctcaccccccttccagcggctggtcccgctttcctggaatttggcctgggcgtatgcagaggccgcctccacacccctcccccaggggcttggtggcagcatagcccccacccctgcggcctttgctcacgggtggccctgcccacccctggcacaaccaaaatcccactgatgcccatcatgccctcagacccttctgggctctgcccgctgggggcctgaagacattcctggaggacactcccatcagaacctggcagccccaaaactggggtcagcctcagggcaggagtcccactcctccagggctctgctcgtccggggctgggagatgttcctggaggaggacactcccatcagaacttggcagccttgaagttggggtcagcctcggcaggagtcccactcctcctggggtgctgcctgccaccaagagctcccccacctgtaccaccatgtgggactccaggcaccatctgttctccccagggacctgctgacttgaatgccagcccttgctcctctgtgttgctttgggccacctggggctgcaccccctgccctttctctgccccatccctaccctagccttgctctcagccaccttgatagtcactgggctccctgtgacttctgaccctgacacccctcccttggactctgcctgggctggagtctagggctggggctacatttggcttctgtactggctgaggacaggggagggagtgaagttggtttggggtggcctgtgttgccactctcagcaccccacatttgcatctgctggtggacctgccaccatcacaataaagtccccatctgattttta

SEQ ID NO: 85647 - DNA, 2312 bp, Homo sapiens
gagagacttagagccgagtgggacaaagcctggggctgggcgggggccatggcgctgccatcccgaatcctgctttggaaacttgtgcttctgcagagctctgctgttctcctgcactcagggtcctcggtacccgccgctgctggcagctccgtggtgtccgagtccgcggtgagctgggaggcgggcgcccgggcggtgctgcgctgccagagcccgcgcatggtgtggacccaggaccggctgcacgaccgccagcgcgtgctccactgggacctgcgcggccccgggggtggccccgcgcggcgcctgctggacttgtactcggcgggcgagcagcgcgtgtacgaggcgcgggaccgcggccgcctggagctctcggcctcggccttcgacgacggcaacttctcgctgctcatccgcgcggtggaggagacggacgcggggctgtacacctgcaacctgcaccatcactactgccacctctacgagagcctggccgtccgcctggaggtcaccgacggccccccggccacccccgcctactgggacggcgagaaggaggtgctggcggtggcgcgcggcgcacccgcgcttctgacctgcgtgaaccgcgggcacgtgtggaccgaccggcacgtggaggaggctcaacaggtggtgcactgggaccggcagccgcccggggtcccgcacgaccgcgcggaccgcctgctggacctctacgcgtcgggcgagcgccgcgcctacgggcccctttttctgcgcgaccgcgtggctgtgggcgcggatgcctttgagcgcggtgacttctcactgcgtatcgagccgctggaggtcgccgacgagggcacctactcctgccacctgcaccaccattactgtggcctgcacgaacgccgcgtcttccacctgacggtcgccgaaccccacgcggagccgcccccccggggctctccgggcaacggctccagccacagcggcgccccaggcccagaccccacactggcgcgcggccacaacgtcatcaatgtcatcgtccccgagagccgagcccacttcttccagcagctgggctacgtgctggccacgctgctgctcttcatcctgctactggtcactgtcctcctggccgcccgcaggcgccgcggaggctacgaatactcggaccagaagtcgggaaagtcaaaggggaaggatgttaacttggcggagttcgctgtggctgcaggggaccagatgctttacaggagtgaggacatccagctagattacaaaaacaacatcctgaaggagagggcggagctggcccacagccccctgcctgccaagtacatcgacctagacaaagggttccggaaggagaactgcaaatagggaggccctgggctcctggctgggccagcagctgcacctctcctgtctgtgctcctcggggcatctcctgatgctccggggctcaccccccttccagcggctggtcccgctttcctggaatttggcctgggcgtatgcagaggccgcctccacacccctcccccaggggcttggtggcagcatagcccccacccctgcggcctttgctcacgggtggccctgcccacccctggcacaaccaaaatcccactgatgcccatcatgccctcagacccttctgggctctgcccgctgggggcctgaagacattcctggaggacactcccatcagaacctggcagccccaaaactggggtcagcctcagggcaggagtcccactcctccagggctctgctcgtccggggctgggagatgttcctggaggaggacactcccatcagaacttggcagccttgaagttggggtcagcctcggcaggagtcccactcctcctggggtgctgcctgccaccaagagctcccccacctgtaccaccatgtgggactccaggcaccatctgttctccccagggacctgctgacttgaatgccagcccttgctcctctgtgttgctttgggccacctggggctgcaccccctgccctttctctgccccatccctaccctagccttgctctcagccaccttgatagtcactgggctccctgtgacttctgaccctgacacccctcccttggactctgcctgggctggagtctagggctggggctacatttggcttctgtactggctgaggacaggggagggagtgaagttggtttggggtggcctgtgttgccactctcagcaccccacatttgcatctgctggtggacctgccaccatcacaataaagtccccatctgatttttaaaaaacaacaacaacccaaaca

SEQ ID NO: 85648 - DNA, 2515 bp, Homo sapiens
gagagacttagagccgagtgggacaaagcctggggctgggcgggggccatggcgctgccatcccgaatcctgctttggaaacttgtgcttctgcagagctctgctgttctcctgcactcagggtcctcggtacccgccgctgctggcagctccgtggtgtccgagtccgcggtgagctgggaggcgggcgcccgggcggtgctgcgctgccagagcccgcgcatggtgtggacccaggaccggctgcacgaccgccagcgcgtgctccactgggacctgcgcggccccgggggtggccccgcgcggcgcctgctggacttgtactcggcgggcgagcagcgcgtgtacgaggcgcgggaccgcggccgcctggagctctcggcctcggccttcgacgacggcaacttctcgctgctcatccgcggtgcggggaccggggaccggggccgcggggtcggggcaggggtccggggccgcggggtcgggggcaccgcaaggctcacgcgcggcttcctcctgggtgcgcagcggtggaggagacggacgcggggctgtacacctgcaacctgcaccatcactactgccacctctacgagagcctggccgtccgcctggaggtcaccgacggccccccggccacccccgcctactgggacggcgagaaggaggtgctggcggtggcgcgcggcgcacccgcgcttctgacctgcgtgaaccgcgggcacgtgtggaccgaccggcacgtggaggaggctcaacaggtggtgcactgggaccggcagccgcccggggtcccgcacgaccgcgcggaccgcctgctggacctctacgcgtcgggcgagcgccgcgcctacgggcccctttttctgcgcgaccgcgtggctgtgggcgcggatgcctttgagcgcggtgacttctcactgcgtatcgagccgctggaggtcgccgacgagggcacctactcctgccacctgcaccaccattactgtggcctgcacgaacgccgcgtcttccacctgacggtcgccgaaccccacgcggagccgcccccccggggctctccgggcaacggctccagccacagcggcgccccaggcccagaccccacactggcgcgcggccacaacgtcatcaatgtcatcgtccccgagagccgagcccacttcttccagcagctgggctacgtgctggccacgctgctgctcttcatcctgctactggtcactgtcctcctggccgcccgcaggcgccgcggaggtgaggctgccccggcaaagccagcggccccaggagactgaggtgggcgggagggtggtcctctgggctgggggacctgcggaaggggcggcactgcccccaatgtgagtctccttcccaggctacgaatactcggaccagaagtcgggaaagtcaaaggggaaggatgttaacttggcggagttcgctgtggctgcaggggaccagatgctttacaggagtgaggacatccagctagattacaaaaacaacatcctgaaggagagggcggagctggcccacagccccctgcctgccaagtacatcgacctagacaaagggttccggaaggagaactgcaaatagggaggccctgggctcctggctgggccagcagctgcacctctcctgtctgtgctcctcggggcatctcctgatgctccggggctcaccccccttccagcggctggtcccgctttcctggaatttggcctgggcgtatgcagaggccgcctccacacccctcccccaggggcttggtggcagcatagcccccacccctgcggcctttgctcacgggtggccctgcccacccctggcacaaccaaaatcccactgatgcccatcatgccctcagacccttctgggctctgcccgctgggggcctgaagacattcctggaggacactcccatcagaacctggcagccccaaaactggggtcagcctcagggcaggagtcccactcctccagggctctgctcgtccggggctgggagatgttcctggaggaggacactcccatcagaacttggcagccttgaagttggggtcagcctcggcaggagtcccactcctcctggggtgctgcctgccaccaagagctcccccacctgtaccaccatgtgggactccaggcaccatctgttctccccagggacctgctgacttgaatgccagcccttgctcctctgtgttgctttgggccacctggggctgcaccccctgccctttctctgccccatccctaccctagccttgctctcagccaccttgatagtcactgggctccctgtgacttctgaccctgacacccctcccttggactctgcctgggctggagtctagggctggggctacatttggcttctgtactggctgaggacaggggagggagtgaagttggtttggggtggcctgtgttgccactctcagcaccccacatttgcatctgctggtggacctgccaccatcacaataaagtccccatctgattttta

SEQ ID NO: 85649 - DNA, 2502 bp, Homo sapiens
gagagacttagagccgagtgggacaaagcctggggctgggcgggggccatggcgctgccatcccgaatcctgctttggaaacttgtgcttctgcagagctctgctgttctcctgcactcagggtcctcggtacccgccgctgctggcagctccgtggtgtccgagtccgcggtgagctgggaggcgggcgcccgggcggtgctgcgctgccagagcccgcgcatggtgtggacccaggaccggctgcacgaccgccagcgcgtgctccactgggacctgcgcggccccgggggtggccccgcgcggcgcctgctggacttgtactcggcgggcgagcagcgcgtgtacgaggcgcgggaccgcggccgcctggagctctcggcctcggccttcgacgacggcaacttctcgctgctcatccgcgcggtggaggagacggacgcggggctgtacacctgcaacctgcaccatcactactgccacctctacgagagcctggccgtccgcctggaggtcaccgacggccgtgagtgcttcccccccgccccccagctcccgcccctcgaccctcgaccgccgccccggcccgcgcgccgctgaccgcgccccctccgcagccccggccacccccgcctactgggacggcgagaaggaggtgctggcggtggcgcgcggcgcacccgcgcttctgacctgcgtgaaccgcgggcacgtgtggaccgaccggcacgtggaggaggctcaacaggtggtgcactgggaccggcagccgcccggggtcccgcacgaccgcgcggaccgcctgctggacctctacgcgtcgggcgagcgccgcgcctacgggcccctttttctgcgcgaccgcgtggctgtgggcgcggatgcctttgagcgcggtgacttctcactgcgtatcgagccgctggaggtcgccgacgagggcacctactcctgccacctgcaccaccattactgtggcctgcacgaacgccgcgtcttccacctgacggtcgccgaaccccacgcggagccgcccccccggggctctccgggcaacggctccagccacagcggcgccccaggcccagaccccacactggcgcgcggccacaacgtcatcaatgtcatcgtccccgagagccgagcccacttcttccagcagctgggctacgtgctggccacgctgctgctcttcatcctgctactggtcactgtcctcctggccgcccgcaggcgccgcggaggtgaggctgccccggcaaagccagcggccccaggagactgaggtgggcgggagggtggtcctctgggctgggggacctgcggaaggggcggcactgcccccaatgtgagtctccttcccaggctacgaatactcggaccagaagtcgggaaagtcaaaggggaaggatgttaacttggcggagttcgctgtggctgcaggggaccagatgctttacaggagtgaggacatccagctagattacaaaaacaacatcctgaaggagagggcggagctggcccacagccccctgcctgccaagtacatcgacctagacaaagggttccggaaggagaactgcaaatagggaggccctgggctcctggctgggccagcagctgcacctctcctgtctgtgctcctcggggcatctcctgatgctccggggctcaccccccttccagcggctggtcccgctttcctggaatttggcctgggcgtatgcagaggccgcctccacacccctcccccaggggcttggtggcagcatagcccccacccctgcggcctttgctcacgggtggccctgcccacccctggcacaaccaaaatcccactgatgcccatcatgccctcagacccttctgggctctgcccgctgggggcctgaagacattcctggaggacactcccatcagaacctggcagccccaaaactggggtcagcctcagggcaggagtcccactcctccagggctctgctcgtccggggctgggagatgttcctggaggaggacactcccatcagaacttggcagccttgaagttggggtcagcctcggcaggagtcccactcctcctggggtgctgcctgccaccaagagctcccccacctgtaccaccatgtgggactccaggcaccatctgttctccccagggacctgctgacttgaatgccagcccttgctcctctgtgttgctttgggccacctggggctgcaccccctgccctttctctgccccatccctaccctagccttgctctcagccaccttgatagtcactgggctccctgtgacttctgaccctgacacccctcccttggactctgcctgggctggagtctagggctggggctacatttggcttctgtactggctgaggacaggggagggagtgaagttggtttggggtggcctgtgttgccactctcagcaccccacatttgcatctgctggtggacctgccaccatcacaataaagtccccatctgattttta

SEQ ID NO: 85650 - DNA, 2404 bp, Homo sapiens
gagagacttagagccgagtgggacaaagcctggggctgggcgggggccatggcgctgccatcccgaatcctgctttggaaacttgtgcttctgcagagctctgctgttctcctgcactcagggtcctcggtacccgccgctgctggcagctccgtggtgtccgagtccgcggtgagctgggaggcgggcgcccgggcggtgctgcgctgccagagcccgcgcatggtgtggacccaggaccggctgcacgaccgccagcgcgtgctccactgggacctgcgcggccccgggggtggccccgcgcggcgcctgctggacttgtactcggcgggcgagcagcgcgtgtacgaggcgcgggaccgcggccgcctggagctctcggcctcggccttcgacgacggcaacttctcgctgctcatccgcggtgcggggaccggggaccggggccgcggggtcggggcaggggtccggggccgcggggtcgggggcaccgcaaggctcacgcgcggcttcctcctgggtgcgcagcggtggaggagacggacgcggggctgtacacctgcaacctgcaccatcactactgccacctctacgagagcctggccgtccgcctggaggtcaccgacggccccccggccacccccgcctactgggacggcgagaaggaggtgctggcggtggcgcgcggcgcacccgcgcttctgacctgcgtgaaccgcgggcacgtgtggaccgaccggcacgtggaggaggctcaacaggtggtgcactgggaccggcagccgcccggggtcccgcacgaccgcgcggaccgcctgctggacctctacgcgtcgggcgagcgccgcgcctacgggcccctttttctgcgcgaccgcgtggctgtgggcgcggatgcctttgagcgcggtgacttctcactgcgtatcgagccgctggaggtcgccgacgagggcacctactcctgccacctgcaccaccattactgtgaccccacactggcgcgcggccacaacgtcatcaatgtcatcgtccccgagagccgagcccacttcttccagcagctgggctacgtgctggccacgctgctgctcttcatcctgctactggtcactgtcctcctggccgcccgcaggcgccgcggaggtgaggctgccccggcaaagccagcggccccaggagactgaggtgggcgggagggtggtcctctgggctgggggacctgcggaaggggcggcactgcccccaatgtgagtctccttcccaggctacgaatactcggaccagaagtcgggaaagtcaaaggggaaggatgttaacttggcggagttcgctgtggctgcaggggaccagatgctttacaggagtgaggacatccagctagattacaaaaacaacatcctgaaggagagggcggagctggcccacagccccctgcctgccaagtacatcgacctagacaaagggttccggaaggagaactgcaaatagggaggccctgggctcctggctgggccagcagctgcacctctcctgtctgtgctcctcggggcatctcctgatgctccggggctcaccccccttccagcggctggtcccgctttcctggaatttggcctgggcgtatgcagaggccgcctccacacccctcccccaggggcttggtggcagcatagcccccacccctgcggcctttgctcacgggtggccctgcccacccctggcacaaccaaaatcccactgatgcccatcatgccctcagacccttctgggctctgcccgctgggggcctgaagacattcctggaggacactcccatcagaacctggcagccccaaaactggggtcagcctcagggcaggagtcccactcctccagggctctgctcgtccggggctgggagatgttcctggaggaggacactcccatcagaacttggcagccttgaagttggggtcagcctcggcaggagtcccactcctcctggggtgctgcctgccaccaagagctcccccacctgtaccaccatgtgggactccaggcaccatctgttctccccagggacctgctgacttgaatgccagcccttgctcctctgtgttgctttgggccacctggggctgcaccccctgccctttctctgccccatccctaccctagccttgctctcagccaccttgatagtcactgggctccctgtgacttctgaccctgacacccctcccttggactctgcctgggctggagtctagggctggggctacatttggcttctgtactggctgaggacaggggagggagtgaagttggtttggggtggcctgtgttgccactctcagcaccccacatttgcatctgctggtggacctgccaccatcacaataaagtccccatctgattttta

SEQ ID NO: 85651 - DNA, 1545 bp, Homo sapiens
gagagacttagagccgagtgggacaaagcctggggctgggcgggggccatggcgctgccatcccgaatcctgctttggaaacttgtgcttctgcagagctctgctgttctcctgcactcagggtcctcggtacccgccgctgctggcagctccgtggtgtccgagtccgcggtgagctgggaggcgggcgcccgggcggtgctgcgctgccagagcccgcgcatggtgtggacccaggaccggctgcacgaccgccagcgcgtgctccactgggacctgcgcggccccgggggtggccccgcgcggcgcctgctggacttgtactcggcgggcgagcagcgcgtgtacgaggcgcgggaccgcggccgcctggagctctcggcctcggccttcgacgacggcaacttctcgctgctcatccgcgcggtggaggagacggacgcggggctgtacacctgcaacctgcaccatcactactgccacctctacgagagcctggccgtccgcctggaggtcaccgacggccccccggccacccccgcctactgggacggcgagaaggaggtgctggcggtggcgcgcggcgcacccgcgcttctgacctgcgtgaaccgcgggcacgtgtggaccgaccggcacgtggaggaggctcaacaggtggtgcactgggaccggcagccgcccggggtcccgcacgaccgcgcggaccgcctgctggacctctacgcgtcgggcgagcgccgcgcctacgggcccctttttctgcgcgaccgcgtggctgtgggcgcggatgcctttgagcgcggtgacttctcactgcgtatcgagccgctggaggtcgccgacgagggcacctactcctgccacctgcaccaccattactgtggcctgcacgaacgccgcgtcttccacctgacggtcgccgaaccccacgcggagccgcccccccggggctctccgggcaacggctccagccacagcggcgccccaggcccagaccccacactggcgcgcggccacaacgtcatcaatgtcatcgtccccgagagccgagcccacttcttccagcagctgggctacgtgctggccacgctgctgctcttcatcctgctactggtcactgtcctcctggccgcccgcaggcgccgcggaggctacgaatactcggaccagaagtcgggaaagtcaaaggggaaggatgttaacttggcggagttcgctgtggctgcaggggaccagatgctttacaggagtgaggacatccagctagattacaaaaacaacatcctgaaggagagggcggagctggcccacagccccctgcctgccaagtacatcgacctagacaaagggttccggaaggagaactgcaaatagggaggccctgggctcctggctgggccagcagctgcacctctcctgtctgtgctcctcggggcatctctggttgctcgggttttcaccctttttacagggggtcccccttttcttaaaattggccccggggggttaaaagacccctcccaccccctcctcccccccggg

SEQ ID NO: 85652 - DNA, 1837 bp, Homo sapiens
gagagacttagagccgagtgggacaaagcctggggctgggcgggggccatggcgctgccatcccgaatcctgctttggaaacttgtgcttctgcagagctctgctgttctcctgcactcagggtcctcggtacccgccgctgctggcagctccgtggtgtccgagtccgcggtgagctgggaggcgggcgcccgggcggtgctgcgctgccagagcccgcgcatggtgtggacccaggaccggctgcacgaccgccagcgcgtgctccactgggacctgcgcggccccgggggtggccccgcgcggcgcctgctggacttgtactcggcgggcgagcagcgcgtgtacgaggcgcgggaccgcggccgcctggagctctcggcctcggccttcgacgacggcaacttctcgctgctcatccgcggtgcggggaccggggaccgggttcgctgtggctgcaggggaccagatgctttacaggagtgaggacatccagctaggtgaggcagtgctgggacacgagggcacaggcgcggctccgtcccgggctgggaagtgcatcctgggagcggggacctcagcctcctctcctcccacagattacaaaaacaacatcctgaaggagagggcggagctggcccacagccccctgcctgccaagtacatcgacctagacaaaggtgagcggcgggggcgacctcagcccatctcagagccctgcctgtccccattccacctcacctgggaccaacgatggcaggcaccagccaggcccggggcccctgccacctcaggctcagaaatccctggggagtcctgcgggggggtctgccctgtgtctcccactgtgatgagggtggaggacagccgccaacccgttggcgcccttggcttccagggttccggaaggagaactgcaaatagggaggccctgggctcctggctgggccagcagctgcacctctcctgtctgtgctcctcggggcatctcctgatgctccggggctcaccccccttccagcggctggtcccgctttcctggaatttggcctgggcgtatgcagaggccgcctccacacccctcccccaggggcttggtggcagcatagcccccacccctgcggcctttgctcacgggtggccctgcccacccctggcacaaccaaaatcccactgatgcccatcatgccctcagacccttctgggctctgcccgctgggggcctgaagacattcctggaggacactcccatcagaacctggcagccccaaaactggggtcagcctcagggcaggagtcccactcctccagggctctgctcgtccggggctgggagatgttcctggaggaggacactcccatcagaacttggcagccttgaagttggggtcagcctcggcaggagtcccactcctcctggggtgctgcctgccaccaagagctcccccacctgtaccaccatgtgggactccaggcaccatctgttctccccagggacctgctgacttgaatgccagcccttgctcctctgtgttgctttgggccacctggggctgcaccccctgccctttctctgccccatccctaccctagccttgctctcagccaccttgatagtcactgggctccctgtgacttctgaccctgacacccctcccttggactctgcctgggctggagtctagggctggggctacatttggcttctgtactggctgaggacaggggagggagtgaagttggtttggggtggcctgtgttgccactctcagcaccccacatttgcatctgctggtggacctgccaccatcacaataaagtccccatctgattttta

SEQ ID NO: 85653 - DNA, 302 bp, Homo sapiens
gcaacacaggccaccccaaaccaacttcactcctttctctgccccatccctaccctagccttgctctcagccaccttgatagtcactgggctccctgtgacttctgaccctgacacccctcccttggactctgcctgggctggagtctagggctggggctacatttggcttctgtactggctgaggacaggggagggagtgaagttggtttggggtggcctgtgttgccactctcagcaccccacatttgcatctgctggtggacctgccaccatcacaataaagtccccatctgattttta

SEQ ID NO: 85654 - DNA, 2011 bp, Homo sapiens
gagagacttagagccgagtgggacaaagcctggggctgggcgggggccatggcgctgccatcccgaatcctgctttggaaacttgtgcttctgcagagctctgctgttctcctgcactcagggtcctcggtacccgccgctgctggcagctccgtggtgtccgagtccgcggtgagctgggaggcgggcgcccgggcggtgctgcgctgccagagcccgcgcatggtgtggacccaggaccggctgcacgaccgccagcgcgtgctccactgggacctgcgcggccccgggggtggccccgcgcggcgcctgctggacttgtactcggcgggcgagcagcgcgtgtacgaggcgcgggaccgcggccgcctggagctctcggcctcggccttcgacgacggcaacttctcgctgctcatccgcgcggtggaggagacggacgcggggctgtacacctgcaacctgcaccatcactactgccacctctacgagagcctggccgtccgcctggaggtcaccgacggccccccggccacccccgcctactgggacggcgagaaggaggtgctggcggtggcgcgcggcgcacccgcgcttctgacctgcgtgaaccgcgggcacgtgtggaccgaccggcacgtggaggaggctcaacaggtggtgcactgggaccggcagccgcccggggtcccgcacgaccgcgcggaccgcctgctggacctctacgcgtcgggcgagcgccgcgcctacgggcccctttttctgcgcgaccgcgtggctgtgggcgcggatgcctttgagcgcggtgacttctcactgcgtatcgagccgctggaggtcgccgacgagggcacctactcctgccacctgcaccaccattactgtggcctgcacgaacgccgcgtcttccacctgacggtcgccgaaccccacgcggagccgcccccccggggctctccgggcaacggctccagccacagcggcgccccaggcccagaccccacactggcgcgcggccacaacgtcatcaatgtcatcgtccccgagagccgagcccacttcttccagcagctgggctacgtgctggccacgctgctgctcttcatcctgctactggtcactgtcctcctggccgcccgcaggcgccgcggaggctacgaatactcggaccagaagtcgggaaagtcaaaggggaaggatgttaacttggcggagttcgctgtggctgcaggggaccagatgctttacaggagtgaggacatccagctagcctcctctcctcccacagattacaaaaacaacatcctgaaggagagggcggagctggcccacagccccctgcctgccaagtacatcgacctagacaaagacccttctgggctctgcccgctgggggcctgaagacattcctggaggacactcccatcagaacctggcagccccaaaactggggtcagcctcagggcaggagtcccactcctccagggctctgctcgtccggggctgggagatgttcctggaggaggacactcccatcagaacttggcagccttgaagttggggtcagcctcggcaggagtcccactcctcctggggtgctgcctgccaccaagagctcccccacctgtaccaccatgtgggactccaggcaccatctgttctccccagggacctgctgacttgaatgccagcccttgctcctctgtgttgctttgggccacctggggctgcaccccctgccctttctctgccccatccctaccctagccttgctctcagccaccttgatagtcactgggctccctgtgacttctgaccctgacacccctcccttggactctgcctgggctggagtctagggctggggctacatttggcttctgtactggctgaggacaggggagggagtgaagttggtttggggtggcctgtgttgccactctcagcaccccacatttgcatctgctggtggacctgccaccatcacaataaagtccccatctgattttta

SEQ ID NO: 85655 - DNA, 2605 bp, Homo sapiens
gcgtcctcaggcctcgcctggcatttgctgtcacagaggttgcttccttgggtccgtccgtcctcgcccctccagcctgggcgccccccgacccctgtctcattccctccaccacatgcagcacagtccaggaggctggggtccaagagggccatggctggcacccggcttagtgctgagtccccagtgcccagcaagcctggcacccaggaggtggtcagcaaacgcttctgaacgacaggaagtgggactcttcagccatcgatgatccgctgtgcggccacaggtccgtgtctcttgttctcctgcactcagggtcctcggtacccgccgctgctggcagctccgtggtgtccgagtccgcggtgagctgggaggcgggcgcccgggcggtgctgcgctgccagagcccgcgcatggtgtggacccaggaccggctgcacgaccgccagcgcgtgctccactgggacctgcgcggccccgggggtggccccgcgcggcgcctgctggacttgtactcggcgggcgagcagcgcgtgtacgaggcgcgggaccgcggccgcctggagctctcggcctcggccttcgacgacggcaacttctcgctgctcatccgcgcggtggaggagacggacgcggggctgtacacctgcaacctgcaccatcactactgccacctctacgagagcctggccgtccgcctggaggtcaccgacggccccccggccacccccgcctactgggacggcgagaaggaggtgctggcggtggcgcgcggcgcacccgcgcttctgacctgcgtgaaccgcgggcacgtgtggaccgaccggcacgtggaggaggctcaacaggtggtgcactgggaccggcagccgcccggggtcccgcacgaccgcgcggaccgcctgctggacctctacgcgtcgggcgagcgccgcgcctacgggcccctttttctgcgcgaccgcgtggctgtgggcgcggatgcctttgagcgcggtgacttctcactgcgtatcgagccgctggaggtcgccgacgagggcacctactcctgccacctgcaccaccattactgtggcctgcacgaacgccgcgtcttccacctgacggtcgccgaaccccacgcggagccgcccccccggggctctccgggcaacggctccagccacagcggcgccccaggcccagaccccacactggcgcgcggccacaacgtcatcaatgtcatcgtccccgagagccgagcccacttcttccagcagctgggctacgtgctggccacgctgctgctcttcatcctgctactggtcactgtcctcctggccgcccgcaggcgccgcggaggtgaggctgccccggcaaagccagcggccccaggagactgaggtgggcgggagggtggtcctctgggctgggggacctgcggaaggggcggcactgcccccaatgtgagtctccttcccaggctacgaatactcggaccagaagtcgggaaagtcaaaggggaaggatgttaacttggcggagttcgctgtggctgcaggggaccagatgctttacaggagtgaggacatccagctagattacaaaaacaacatcctgaaggagagggcggagctggcccacagccccctgcctgccaagtacatcgacctagacaaagggttccggaaggagaactgcaaatagggaggccctgggctcctggctgggccagcagctgcacctctcctgtctgtgctcctcggggcatctcctgatgctccggggctcaccccccttccagcggctggtcccgctttcctggaatttggcctgggcgtatgcagaggccgcctccacacccctcccccaggggcttggtggcagcatagcccccacccctgcggcctttgctcacgggtggccctgcccacccctggcacaaccaaaatcccactgatgcccatcatgccctcagacccttctgggctctgcccgctgggggcctgaagacattcctggaggacactcccatcagaacctggcagccccaaaactggggtcagcctcagggcaggagtcccactcctccagggctctgctcgtccggggctgggagatgttcctggaggaggacactcccatcagaacttggcagccttgaagttggggtcagcctcggcaggagtcccactcctcctggggtgctgcctgccaccaagagctcccccacctgtaccaccatgtgggactccaggcaccatctgttctccccagggacctgctgacttgaatgccagcccttgctcctctgtgttgctttgggccacctggggctgcaccccctgccctttctctgccccatccctaccctagccttgctctcagccaccttgatagtcactgggctccctgtgacttctgaccctgacacccctcccttggactctgcctgggctggagtctagggctggggctacatttggcttctgtactggctgaggacaggggagggagtgaagttggtttggggtggcctgtgttgccactctcagcaccccacatttgcatctgctggtggacctgccaccatcacaataaagtccccatctgattttta

SEQ ID NO: 85656 - DNA, 2300 bp, Homo sapiens
gagagacttagagccgagtgggacaaagcctggggctgggcgggggccatggcgctgccatcccgaatcctgctttggaaacttgtgcttctgcagagctctgctgttctcctgcactcagggtcctcggtacccgccgctgctggcagctccgtggtgtccgagtccgcggtgagctgggaggcgggcgcccgggcggtgctgcgctgccagagcccgcgcatggtgtggacccaggaccggctgcacgaccgccagcgcgtgctccactgggacctgcgcggccccgggggtggccccgcgcggcgcctgctggacttgtactcggcgggcgagcagcgcgtgtacgaggcgcgggaccgcggccgcctggagctctcggcctcggccttcgacgacggcaacttctcgctgctcatccgcgcggtggaggagacggacgcggggctgtacacctgcaacctgcaccatcactactgccacctctacgagagcctggccgtccgcctggaggtcaccgacggccccccggccacccccgcctactgggacggcgagaaggaggtgctggcggtggcgcgcggcgcacccgcgcttctgacctgcgtgaaccgcgggcacgtgtggaccgaccggcacgtggaggaggctcaacaggtggtgcactgggaccggcagccgcccggggtcccgcacgaccgcgcggaccgcctgctggacctctacgcgtcgggcgagcgccgcgcctacgggcccctttttctgcgcgaccgcgtggctgtgggcgcggatgcctttgagcgcggtgacttctcactgcgtatcgagccgctggaggtcgccgacgagggcacctactcctgccacctgcaccaccattactgtgaccccacactggcgcgcggccacaacgtcatcaatgtcatcgtccccgagagccgagcccacttcttccagcagctgggctacgtgctggccacgctgctgctcttcatcctgctactggtcactgtcctcctggccgcccgcaggcgccgcggaggtgaggctgccccggcaaagccagcggccccaggagactgaggtgggcgggagggtggtcctctgggctgggggacctgcggaaggggcggcactgcccccaatgtgagtctccttcccaggctacgaatactcggaccagaagtcgggaaagtcaaaggggaaggatgttaacttggcggagttcgctgtggctgcaggggaccagatgctttacaggagtgaggacatccagctagattacaaaaacaacatcctgaaggagagggcggagctggcccacagccccctgcctgccaagtacatcgacctagacaaagggttccggaaggagaactgcaaatagggaggccctgggctcctggctgggccagcagctgcacctctcctgtctgtgctcctcggggcatctcctgatgctccggggctcaccccccttccagcggctggtcccgctttcctggaatttggcctgggcgtatgcagaggccgcctccacacccctcccccaggggcttggtggcagcatagcccccacccctgcggcctttgctcacgggtggccctgcccacccctggcacaaccaaaatcccactgatgcccatcatgccctcagacccttctgggctctgcccgctgggggcctgaagacattcctggaggacactcccatcagaacctggcagccccaaaactggggtcagcctcagggcaggagtcccactcctccagggctctgctcgtccggggctgggagatgttcctggaggaggacactcccatcagaacttggcagccttgaagttggggtcagcctcggcaggagtcccactcctcctggggtgctgcctgccaccaagagctcccccacctgtaccaccatgtgggactccaggcaccatctgttctccccagggacctgctgacttgaatgccagcccttgctcctctgtgttgctttgggccacctggggctgcaccccctgccctttctctgccccatccctaccctagccttgctctcagccaccttgatagtcactgggctccctgtgacttctgaccctgacacccctcccttggactctgcctgggctggagtctagggctggggctacatttggcttctgtactggctgaggacaggggagggagtgaagttggtttggggtggcctgtgttgccactctcagcaccccacatttgcatctgctggtggacctgccaccatcacaataaagtccccatctgattttta

SEQ ID NO: 85657 - DNA, 2224 bp, Homo sapiens
gagagacttagagccgagtgggacaaagcctggggctgggcgggggccatggcgctgccatcccgaatcctgctttggaaacttgtgcttctgcagagctctgctgttctcctgcactcagggtcctcggtacccgccgctgctggcagctccgtggtgtccgagtccgcggtgagctgggaggcgggcgcccgggcggtgctgcgctgccagagcccgcgcatggtgtggacccaggaccggctgcacgaccgccagcgcgtgctccactgggacctgcgcggccccgggggtggccccgcgcggcgcctgctggacttgtactcggcgggcgagcagcgcgtgtacgaggcgcgggaccgcggccgcctggagctctcggcctcggccttcgacgacggcaacttctcgctgctcatccgcgcggtggaggagacggacgcggggctgtacacctgcaacctgcaccatcactactgccacctctacgagagcctggccgtccgcctggaggtcaccgacggccccccggccacccccgcctactgggacggcgagaaggaggtgctggcggtggcgcgcggcgcacccgcgcttctgacctgcgtgaaccgcgggcacgtgtggaccgaccggcacgtggaggaggctcaacaggtggtgcactgggaccggcagccgcccggggtcccgcacgaccgcgcggaccgcctgctggacctctacgcgtcgggcgagcgccgcgcctacgggcccctttttctgcgcgaccgcgtggctgtgggcgcggatgcctttgagcgcggtgacttctcactgcgtatcgagccgctggaggtcgccgacgagggcacctactcctgccacctgcaccaccattactgtggcctgcacgaacgccgcgtcttccacctgacggtcgccgaaccccacgcggagccgcccccccggggctctccgggcaacggctccagccacagcggcgccccaggcccagaccccacactggcgcgcggccacaacgtcatcaatgtcatcgtccccgagagccgagcccacttcttccagcagctgggctacgtgctggccacgctgctgctcttcatcctgctactggtcactgtcctcctggccgcccgcaggcgccgcggaggctacgaatactcggaccagaagtcgggaaagtcaaaggggaaggatgttaacttggcggagttcgctgtggctgcaggggaccagatgctttacaggagtgaggacatccagctagattacaaaaacaacatcctgaaggagagggcggagctggcccacagccccctgcctgccaagtacatcgacctagacaaagggttccggaaggagaactgcaaatagggaggccctgggctcctggctgggccagcagctgcacctctcctgtctgtgctcctcggggcatctcctgatgctccggggctcaccccccttccagcggctggtcccgctttcctggaatttggcctgggcgtatgcagaggccgcctccacacccctcccccaggggcttggtggcagcatagcccccacccctgcggcctttgctcacgggtggccctgcccacccctggcacaaccaaaatcccactgatgcccatcatgccctcagacccttctgggctctgcccgctgggggcctgaagacattcctggaggacactcccatcagaacctggcagccccaaaactggggtcagcctcagggcaggagtcccactcctccagggctctgctcgtccggggctgggagatgttcctggaggaggacactcccatcagaacttggcagccttgaagttggggtcagcctcggcaggagtcccactcctcctggggtgctgcctgccaccaagagctcccccacctgtaccaccatgtgggactccaggcaccatctgttctccccagggacctgctgacttgaatgccagcccttgctcctctgtctctcagccaccttgatagtcactgggctccctgtgacttctgaccctgacacccctcccttggactctgcctgggctggagtctagggctggggctacatttggcttctgtactggctgaggacaggggagggagtgaagttggtttggggtggcctgtgttgccactctcagcaccccacatttgcatctgctggtggacctgccaccatcacaataaagtccccatctgattttta

SEQ ID NO: 85658 - DNA, 1881 bp, Homo sapiens
gagagacttagagccgagtgggacaaagcctggggctgggcgggggccatggcgctgccatcccgaatcctgctttggaaacttgtgcttctgcagagctctgctgttctcctgcactcagggtcctcggtacccgccgctgctggcagctccgtggtgtccgagtccgcggtgagctgggaggcgggcgcccgggcggtgctgcgctgccagagcccgcgcatggtgtggacccaggaccggctgcacgaccgccagcgcgtgctccactgggacctgcgcggccccgggggtggccccgcgcggcgcctgctggacttgtactcggcgggcgagcagcgcgtgtacgaggcgcgggaccgcggccgcctggagctctcggcctcggccttcgacgacggcaacttctcgctgctcatccgcgcggtggaggagacggacgcggggctgtacacctgcaacctgcaccatcactactgccacctctacgagagcctggccgtccgcctggaggtcaccgacggccccccggccacccccgcctactgggacggcgagaaggaggtgctggcggtggcgcgcggcgcacccgcgcttctgacctgcgtgaaccgcgggcacgtgtggaccgaccggcacgtggaggaggctcaacaggtggtgcactgggaccggcagccgcccggggtcccgcacgaccgcgcggaccgcctgctggacctctacgcgtcgggcgagcgccgcgcctacgggcccctttttctgcgcgaccgcgtggctgtgggcgcggatgcctttgagcgcggtgacttctcactgcgtatcgagccgctggaggtcgccgacgagggcacctactcctgccacctgcaccaccattactgtggcctgcacgaacgccgcgtcttccacctgacggtcgccgaaccccacgcggagccgcccccccggggctctccgggcaacggctccagccacagcggcgccccaggcccagaccccacactggcgcgcggccacaacgtcatcaatgtcatcgtccccgagagccgagcccacttcttccagcagctgggctacgtgctggccacgctgctgctcttcatcctgctactggtcactgtcctcctggccgcccgcaggcgccgcggaggctacgaatactcggaccagaagtcgggaaagtcaaaggggaaggatgttaacttggcggagttcgctgtggctgcaggggaccagatgctttacaggagtgaggacatccagctaggtgaggcagtgctgggacacgagggcacaggcgcggctccgtcccgggctgggaagtgcatcctgggagcggggacctcagcctcctctcctcccacagattacaaaaacaacatcctgaaggagagggcggagctggcccacagccccctgcctgccaagtacatcgacctagacaaaggtgagcggcgggggcgacctcagcccatctcagagccctgcctgtccccattccacctcacctgggaccaacgatggcaggcaccagccaggcccggggcccctgccacctcaggctcagaaatccgttgctttgggccacctggggctgcaccccctgccctttctctgccccatccctaccctagccttgctctcagccaccttgatagtcactgggctccctgtgacttctgaccctgacacccctcccttggactctgcctgggctggagtctagggctggggctacatttggcttctgtactggctgaggacaggggagggagtgaagttggtttggggtggcctgtgttgccactctcagcaccccacatttgcatctgctggtggacctgccaccatcacaataaagtccccatctgattttta

SEQ ID NO: 85659 - DNA, 1517 bp, Homo sapiens
gggcggtaccggcccggaatgtaagggatcgaaccccacgcggagccgcccccccggggctctccgggcaacggctccagccacagcggcgccccaggcccagaccccacactggcgcgcggccacaacgtcatcaatgtcatcgtccccgagagccgagcccacttcttccagcagctgggctacgtgctggccacgctgctgctcttcatcctgctactggtcactgtcctcctggccgcccgcaggcgccgcggaggtgaggctgccccggcaaagccagcggccccaggagactgaggtgggcgggagggtggtcctctgggctgggggacctgcggaaggggcggcactgcccccaatgtgagtctccttcccaggctacgaatactcggaccagaagtcgggaaagtcaaaggggaaggatgttaacttggcggagttcgctgtggctgcaggggaccagatgctttacaggagtgaggacatccagctagattacaaaaacaacatcctgaaggagagggcggagctggcccacagccccctgcctgccaagtacatcgacctagacaaagggttccggaaggagaactgcaaatagggaggccctgggctcctggctgggccagcagctgcacctctcctgtctgtgctcctcggggcatctcctgatgctccggggctcaccccccttccagcggctggtcccgctttcctggaatttggcctgggcgtatgcagaggccgcctccacacccctcccccaggggcttggtggcagcatagcccccacccctgcggcctttgctcacgggtggccctgcccacccctggcacaaccaaaatcccactgatgcccatcatgccctcagacccttctgggctctgcccgctgggggcctgaagacattcctggaggacactcccatcagaacctggcagccccaaaactggggtcagcctcagggcaggagtcccactcctccagggctctgctcgtccggggctgggagatgttcctggaggaggacactcccatcagaacttggcagccttgaagttggggtcagcctcggcaggagtcccactcctcctggggtgctgcctgccaccaagagctcccccacctgtaccaccatgtgggactccaggcaccatctgttctccccagggacctgctgacttgaatgccagcccttgctcctctgtgttgctttgggccacctggggctgcaccccctgccctttctctgccccatccctaccctagccttgctctcagccaccttgatagtcactgggctccctgtgacttctgaccctgacacccctcccttggactctgcctgggctggagtctagggctggggctacatttggcttctgtactggctgaggacaggggagggagtgaagttggtttggggtggcctgtgttgccactctcagcaccccacatttgcatctgctggtggacctgccaccatcacaataaagtccccatctgattttta

SEQ ID NO: 85660 - DNA, 899 bp, Homo sapiens
gagagacttagagccgagtgggacaaagcctggggctgggcgggggccatggcgctgccatcccgaatcctgctttggaaacttgtgcttctgcagagctctgctgttctcctgcactcagggtcctcggtacccgccgctgctggcagctccgtggtgtccgagtccgcggtgagctgggaggcgggcgcccgggcggtgctgcgctgccagagcccgcgcatggtgtggacccaggaccggctgcacgaccgccagcgcgtgctccactgggacctgcgcggccccgggggtggccccgcgcggcgcctgctggacttgtactcggcgggcgagcagcgcgtgtacgaggcgcgggaccgcggccgcctggagctctcggcctcggccttcgacgacggcaacttctcgctgctcatccgcgcggtggaggagacggacgcggggctgtacacctgcaacctgcaccatcactactgccacctctacgagagcctggccgtccgcctggaggtcaccgacggccccccggccacccccgcctactgggacggcgagaaggaggtgctggcggtggcgcgcggcgcacccgcgcttctgacctgcgcctgcacgaacgccgcgtcttccacctgacggtcgccgaaccccacgcggagccgcccccccggggctctccgggcaacggctccagccacagcggcgccccaggcccagacaaaaaaatagtcaatagtgctcagactggtagcttcaaacagctcacagttaaggaagctgtgctgaatggtttggtggccactgaggtgttgatgtggttttatgtcggagagattataggcaagcggggcatcattggctatgatgtttgaagaccaatctttaacatctgattatat

SEQ ID NO: 85661 - DNA, 989 bp, Homo sapiens
gcgagtcctggaaagcgttgttggcccggttgctctggagccgggtctcgggtctggtggctgccggccctgcggcatctcgccatggggagcacggagagcagcgagggccgcagggtgtccttcggagtggacgaggaggagcgggtccgggtgctgcagggtgtccggctgtctgaaaacgtggtgaaccgcatgaaggagcccagctctccaccccctgctcccacatcttctacctttggccttcaagatggcaacttgagagcccctcacaaagaatccacactgcccaggtcggggagcagtggtggccagcagccctcagggatgaaggagggtgtcaagaggtatgaacaggagcatgctgctatccaggataagctcttccaggtggcaaagagggaaagagaggctgccaccaagcactccaaggcatccctgcccacgggcgaaggcagcatcagccatgaggagcagaagtcagtccggctggccagggagctggagagcagagaggcagagctaagacgccgtgacaccttctacaaggagcagctggagcgtattgagaggaagaatgctgagatgtataaactgtcttcagagcaattccatgaggcagcctcaaagatggagagcacaataaagccccgcagggtggagcccgtctgctcagggttgcaggcccagattctccactgctaccgagatcgcccgcatgaggtgctgctgtgctcggacctggtcaaggcataccagcgctgcgtgagcgccgcccacaagggctgaggagcagacatcattccctgccctggcagtgacttggagccctgaagaagggaccaatcatgggaccacagccactgtgccctgccgtttcctgctgggcccctgcatatgcccctgagcctggggctgccacgtgtttaggaaacaaagtatgcgctactgtctgaaaacaaataaagcagatgcctttgttttca

SEQ ID NO: 85662 - DNA, 407 bp, Homo sapiens
  misc_feature (40)..(41): n is a, c, g, or t
  misc_feature (43)..(44): n is a, c, g, or t
cgcgggcggcgccgcccgggacagtaagtttgtatttggnngnngtttcgaggctccgcagctggttagccccgcagggtggagcccgtctgctcagggttgcaggcccagattctccactgctaccgagatcgcccgcatgaggtgctgctgtgctcggacctggtcaaggcataccagcgctgcgtgagcgccgcccacaagggctgaggagcagacatcattccctgccctggcagtgacttggagccctgaagaagggaccaatcatgggaccacagccactgtgccctgccgtttcctgctgggcccctgcatatgcccctgagcctggggctgccacgtgtttaggaaacaaagtatgcgctactgtctgaaaacaaataaagcagatgcctttgttttca

SEQ ID NO: 85663 - DNA, 375 bp, Homo sapiens
ctacggctcctccccttttccattatgtgggttaaggccccgcagggtggagcccgtctgctcagggttgcaggcccagattctccactgctaccgagatcgcccgcatgaggtgctgctgtgctcggacctggtcaaggcataccagcgctgcgtgagcgccgcccacaagggctgaggagcagacatcattccctgccctggcagtgacttggagccctgaagaagggaccaatcatgggaccacagccactgtgccctgccgtttcctgctgggcccctgcatatgcccctgagcctggggctgccacgtgtttaggaaacaaagtatgcgctactgtctgaaaacaaataaagcagatgcctttgttttca

SEQ ID NO: 85664 - DNA, 681 bp, Homo sapiens
ggctgtctcaggcataaagggatggctatcctgggcacagcggggcgggttgtcctggaggcgggctgcaccatcctcatgggggccctccagtggggctttcctgtctcctgagtgtacacaggccccagtgaaggagcccggtgtggagccccataccacagcatgtttcagtgtctgctatattgtgagcctaagccacccaccacagggcttgaccctgcgaccgtcctctcatttctagaacgggaaagcacagtgcttctccttgagggttaaaaggatgctgctgggtgtcagggacttagcctagcgcctgggaggccccgcagggtggagcccgtctgctcagggttgcaggcccagattctccactgctaccgagatcgcccgcatgaggtgctgctgtgctcggacctggtcaaggcataccagcgctgcgtgagcgccgcccacaagggctgaggagcagacatcattccctgccctggcagtgacttggagccctgaagaagggaccaatcatgggaccacagccactgtgccctgccgtttcctgctgggcccctgcatatgcccctgagcctggggctgccacgtgtttaggaaacaaagtatgcgctactgtctgaaaacaaataaagcagatgcctttgttttcagtcgttgactcactggcaa

SEQ ID NO: 85665 - DNA, 783 bp, Homo sapiens
gggattaccgggattgtatccaaggggctgggtggaatctgcttgccgtccaccgtggaagctggtcagcgctccaccttctacctgttgagactggcagaatgctgagatgtataaactgtcttcagagcaattccatgaggcagcctcaaagatggagagcacaataaagcacaaacaggcaacacttcataacccagtggcggccctggacccaggaggtttgtgcagtcatggacagctacacaggcgcctgccatggacggaagggaaggctgcacagacacctgccatggacggaaaaagggaaggctgcaccaacaggtctgccgtggacggaagggaaggctgcacggactcctgctgtggacgaaagggaaggctgcccagaggtctgccgtggacggaagggaaggctgctgcgtggactgccgccgtggacggaagggaaggctgctgcccggactgccgccgtggacggaagggaaggctgctgcccggactgccgccgtggacggaagggaaggctgctgcgcggactgccgccgtggacggaagggaaggctgtacagagccttatcaccaatgggaaggaaaggctgcacggaggcttgcttggatagaagggaagggtgcagattgtcttggacatgaagggaaggctacacacagaattatcatggatggaaggaaagctgcacagaggaatgttaatgacgagaagggaagaatgcagagccttgccatagatgagaaggaaggatgcacagaagcttttttgat

SEQ ID NO: 85666 - DNA, 1008 bp, Homo sapiens
gcgagtcctggaaagcgttgttggcccggttgctctggagccgggtctcgggtctggtggctgccggccctgcggcatctcgccatggggagcacggagagcagcgagggccgcagggtgtccttcggagtggacgaggaggagcgggtccgggtgctgcagggtgtccggctgtctgaaaacgtggtgaaccgcatgaaggagcccagctctccaccccctgctcccacatcttctacctttggccttcaagatggcaacttgagagcccctcacaaagaatccacactgcccaggtcggggagcagtggtggccagcagccctcagggatgaaggagggtgtcaagaggtatgaacaggagcatgctgctatccaggataagctcttccaggtggcaaagagggaaagagaggctgccaccaagcactccaaggcatccctgcccacgggcgaaggcagcatcagccatgaggagcagaagtcagtccggctggccagggagctggagagcagagaggcagagctaagacgccgtgacaccttctacaaggagcagctggagcgtattgagaggaagaatgctgagatgtataaactgtcttcagagcaattccatgaggcagcctcaaagatggagagcacaataaagccccgcagggtggagcccgtctgctcagggttgcaggcccagattctccactgctaccgagatcgcccgcatgaggtgctgctgtgctcggacctggtcaaggcataccagcgctgcgtgagcgccgcccacaagggctgaggagcagacatcattccctgccctggcagtgacttggagccctgaagaagggaccaatcatgggaccacagccactgtgccctgccgtttcctgctgggcccctgcatatgcccctgagcctggggctgccacgtgtttaggaaacaaagtatgcgctactgtctgaaaacaaataaagcagatgcctttgttttcagtcgttgactcactggcaa

SEQ ID NO: 85667 - DNA, 1045 bp, Homo sapiens
gcgagtcctggaaagcgttgttggcccggttgctctggagccgggtctcgggtctggtggctgccggccctgcggcatctcgccatggggagcacggagagcagcgagggccgcagggtgtccttcggagtggacgaggaggagcgggtccgggtgctgcagggtgtccggctgtctgaaaacgtggtgaaccgcatgaaggagcccagctctccaccccctgctcccacatcttctacctttggccttcaagatggcaacttgagagcccctcacaaagaatccacactgcccaggtcggggagcagtggtggccagcagccctcagggatgaaggagggtgtcaagaggtatgaacaggagcatgctgctatccaggataagctcttccaggtggcaaagagggaaagagaggctgccaccaagcactccaaggcatccctgcccacgggcgaaggcagcatcagccatgaggagcagaagtcagtccggctggccagggagctggagagcagagaggcagagctaagacgccgtgacaccttctacaaggagcagctggagcgtattgagaggaagaatgctgagatgtataaactgtcttcagagcaattccatgaggcagcctcaaagatggagagcacaataaagccccgcagggtggagcccgtctgctcagggttgcaggcccagattctccactgctaccgagatcgcccgcatgaggtgctgctgtgctcggacctggtcaaggcataccagcgctgcgtgagcgccgcccacaagggctgaggagcagacatcattccctgccctggcagtgacttggagccctgaagaagggaccaatcatgggaccacagccactgtgccctgccgtttcctgctgggcccctgcatatgcccctgagcctggggctgccacgtgtttaggaaacaaagtatgcgctactgtctgaaaacaaataaagcagatgcctttgttttcaaaaaaaaaaagaatgggcttcgctgggcctcgccgggggaagctctacggggcgcg

SEQ ID NO: 85668 - DNA, 1141 bp, Homo sapiens
gcgagtcctggaaagcgttgttggcccggttgctctggagccgggtctcgggtctggtggctgccggccctgcggcatctcgccatggggagcacggagagcagcgagggccgcagggtgtccttcggagtggacgaggaggagcgggtccgggtgctgcagggtgtccggctgtctgaaaacgtggtgaaccgcatgaaggagcccagctctccaccccctgctcccacatcttctacctttggccttcaagatggcaacttgagagcccctcacaaagaatccacactgcccaggtcggggagcagtggtggccagcagccctcagggatgaaggagggtgtcaagaggtatgaacaggagcatgctgctatccaggataagctcttccaggtggcaaagagggaaagagaggctgccaccaagcactccaaggcatccctgcccacgggcgaaggcagcatcagccatgaggagcagaagtcagtccggctggccagggagctggagagcagagaggcagagctaagacgccgtgacaccttctacaaggagcagctggagcgtattgagaggaagaatgctgagatgtataaactgtcttcagagcaattccatgaggcagcctcaaagatggagagcacaataaaggtccaatacttatgaactcaaggaataccaaatggaggaagaaataccccatgacagatgggtttacttgtgagcacgaatcacctgctgtctccggccacctgggatgctcagccagtgcctttggaaacatttctgccttgaatgtcaggccccgcagggtggagcccgtctgctcagggttgcaggcccagattctccactgctaccgagatcgcccgcatgaggtgctgctgtgctcggacctggtcaaggcataccagcgctgcgtgagcgccgcccacaagggctgaggagcagacatcattccctgccctggcagtgacttggagccctgaagaagggaccaatcatgggaccacagccactgtgccctgccgtttcctgctgggcccctgcatatgcccctgagcctggggctgccacgtgtttaggaaacaaagtatgcgctactgtctgaaaacaaataaagcagatgcctttgttttca

SEQ ID NO: 85669 - DNA, 755 bp, Homo sapiens
gcgagtcctggaaagcgttgttggcccggttgctctggagccgggtctcgggtctggtggctgccggccctgcggcatctcgccatggggagcacggagagcagcgagggccgcagggtgtccttcggagtggacgaggaggagcgggtccgggtgctgcagggtgtccggctgtctgaaaacgtggtgaaccgcatgaaggagcccagctctccaccccctgctcccacatcttctacctttggccttcaagatggcaacttgagagcccctcacaaagaatccacactgcccaggtcggggagcagtggtggccagcagccctcagggatgaaggagggtgtcaagaggtatgaacaggagcatgctgctatccaggataagctcttccaggtggcaaagagggaaagagaggctgccaccaagcactccaaggcatccctgcccacgggcgaaggcagcatcagccatgaggagcagaagtcagtccggctggccagggagctggagagcagagaggcagagctaagacgccgtgacaccttctacaaggagcagctggagcgtattgagaggaagaatgctgagatgtataaactgtcttcagagcaattccatgaggcagcctcaaagatggagagcacaataaatgctgggcccctgcatatgcccctgagcctggggctgccacgtgtttaggaaacaaagtatgcgctactgtctgaaaacaaataaagcagatgcctttgttttca

SEQ ID NO: 85670 - DNA, 662 bp, Homo sapiens
ggctgtctcaggcataaagggatggctatcctgggcacagcggggcgggttgtcctggaggcgggctgcaccatcctcatgggggccctccagtggggctttcctgtctcctgagtgtacacaggccccagtgaaggagcccggtgtggagccccataccacagcatgtttcagtgtctgctatattgtgagcctaagccacccaccacagggcttgaccctgcgaccgtcctctcatttctagaacgggaaagcacagtgcttctccttgagggttaaaaggatgctgctgggtgtcagggacttagcctagcgcctgggaggccccgcagggtggagcccgtctgctcagggttgcaggcccagattctccactgctaccgagatcgcccgcatgaggtgctgctgtgctcggacctggtcaaggcataccagcgctgcgtgagcgccgcccacaagggctgaggagcagacatcattccctgccctggcagtgacttggagccctgaagaagggaccaatcatgggaccacagccactgtgccctgccgtttcctgctgggcccctgcatatgcccctgagcctggggctgccacgtgtttaggaaacaaagtatgcgctactgtctgaaaacaaataaagcagatgcctttgttttca

SEQ ID NO: 85671 - DNA, 1002 bp, Homo sapiens
gggtgtcaagaggaagaatgctgagatgtataaactgtcttcagagcaattccatgaggcagcctccttcatccctgagggctgctggccaccactgctccccgacctgggcagtgtggattctttgtgaggggctctcaaggatgaaggagggtgtcaagaggtatgaacaggagcatgctgctatccaggataagctcttccaggtggcaaagagggaaagagaggctgccaccaagcactccaaggcatccctgcccacgggcgaaggcagcatcagccatgaggagcagaagtcagtccggctggccagggagctggagagcagagaggcagagctaagacgccgtgacaccttctacaaggagcagctggagcgtattgagaggaagaatgctgagatgtataaactgtcttcagagcaattccatgaggcagcctcaaagatggagagcacaataaagccccgcagggtggagcccgtctgctcagggttgcaggcccagattctccactgctaccgagatcgcccgcatgaggtgctgctgtgctcggacctggtcaaggcataccagcgctgcgtgagcgccgcccacaagggctgaggagcagacatcattccctgccctggcagtgacttggagccctgaagaagggaccaatcatgggaccacagccactgtgccctgccgtttcctgctgggcccctgcatatgcccctgagcctggggctgccacgtgtttaggaaacaaagtatgcgctactgtctgaaaacaaataaagcagatgcctttgttttcaaacaacacaaaatcaaacacaacaaaagagggggggcagattcccgggggcagtagcgccccgtttggaaaggccacaggaggggtaaaacagcggcggtaaacggaggacagtcggtgggcaccctcggggactggcacaccaaccgagaactgtcacgcgcggggtgcacacaaacaccaaagagagcacaaccagaa

SEQ ID NO: 85672 - DNA, 1189 bp, Homo sapiens
gcgagtcctggaaagcgttgttggcccggttgctctggagccgggtctcgggtctggtggctgccggccctgcggcatctcgccatggggagcacggagagcagcgagggccgcagggtgtccttcggagtggacgaggaggagcgggtccgggtgctgcagggtgtccggctgtctgaaaacgtggtgaaccgcatgaaggagcccagctctccaccccctgctcccacatcttctacctttggccttcaagatggcaacttgagagcccctcacaaagaatccacactgcccaggtcggggagcagtggtggccagcagccctcagggatgaaggagggtgtcaagaggtatgaacaggagcatgctgctatccaggataagctcttccaggtggcaaagagggaaagagaggctgccaccaagcactccaaggcatccctgcccacgggcgaaggcagcatcagccatgaggagcagaagtcagtccggctggccagggagctggagagcagagaggcagagctaagacgccgtgacaccttctacaaggagcagctggagcgtattgagaggaagaatgctgagatgtataaactgtcttcagagcaattccatgaggcagcctcaaagatggagagcacaataaagccccgcagggtggagcccgtctgctcagggttgcaggcccagattctccactgctaccgagatcgcccgcatgaggtgctgctgtgctcggacctggtcaaggcataccagcgctgcgtgagcgccgcccacaagggctgaggagcagacatcattccctgccctggcagtgacttggagccctgaagaagggaccaatcatgggaccacagccactgtgccctgccgtttcctgctgggcccctgcatatgcccctgagcctggggctgccacgtgtttaggaaacaaagtatgcgctactgtctgaaaacaaataaagcagatgcctttgttttcaaacaacacaaaatcaaacacaacaaaagagggggggcagattcccgggggcagtagcgccccgtttggaaaggccacaggaggggtaaaacagcggcggtaaacggaggacagtcggtgggcaccctcggggactggcacaccaaccgagaactgtcacgcgcggggtgcacacaaacaccaaagagagcacaaccagaa

SEQ ID NO: 85673 - DNA, 1301 bp, Homo sapiens
gcgagtcctggaaagcgttgttggcccggttgctctggagccgggtctcgggtctggtggctgccggccctgcggcatctcgccatggggagcacggagagcagcgagggccgcagggtgtccttcggagtggacgaggaggagcgggtccgggtgctgcagggtgtccggctgtctgaaaacgtggtgaaccgcatgaaggagcccagctctccaccccctgctcccacatcttctacctttggccttcaagatggcaacttgagagcccctcacaaagaatccacactgcccaggtcggggagcagtggtggccagcagccctcagggatgaaggagggtgtcaagaggtatgaacaggagcatgctgctatccaggataagctcttccaggtggcaaagagggaaagagaggctgccaccaagcactccaaggcatccctgcccacgggcgaaggcagcatcagccatgaggagcagaagtcagtccggctggccagggagctggagagcagagaggcagagctaagacgccgtgacaccttctacaaggagcagctggagcgtattgagaggaagaatgctgagatgtataaactgtcttcagagcaattccatgaggcagcctcaaagatggagagcacaataaaggtccaatacttatgaactcaaggaataccaaatggaggaagaaataccccatgacagatgggtttacttgtgagcacgaatcacctgctgtctccggccacctgggatgctcagccagtgcctttggaaacatttctgccttgaatgtcagggccacactgcgttactgagcatgttctgaccgggccgtcttgggcatcacctgccattctcctgccatcctctcaacagctctgtggggtggggtcctcccccatacctgatgcaccgaccacacagtggaaagtgacaaagccagcgccttgccccaggccccgcagggtggagcccgtctgctcagggttgcaggcccagattctccactgctaccgagatcgcccgcatgaggtgctgctgtgctcggacctggtcaaggcataccagcgctgcgtgagcgccgcccacaagggctgaggagcagacatcattccctgccctggcagtgacttggagccctgaagaagggaccaatcatgggaccacagccactgtgccctgccgtttcctgctgggcccctgcatatgcccctgagcctggggctgccacgtgtttaggaaacaaagtatgcgctactgtctgaaaacaaataaagcagatgcctttgttttca

SEQ ID NO: 85674 - DNA, 895 bp, Homo sapiens
gcgagtcctggaaagcgttgttggcccggttgctctggagccgggtctcgggtctggtggctgccggccctgcggcatctcgccatggggagcacggagagcagcgagggccgcagggtgtccttcggagtggacgaggaggagcgggtccgggtgctgcagggtgtccggctgtctgaaaacgtggtgaaccgcatgaaggagcccagctctccaccccctgctcccacatcttctacctttggccttcaagatggcaacttgagagcccctcacaaagaatccacactgcccaggtcggggagcagtggtggccagcagccctcagggatgaaggagggtgtcaagaggtatgaacaggagcatgctgctatccaggataagctcttccaggtggcaaagagggaaagagaggctgccaccaagcactccaaggcatccctgcccacgggcgaaggcagcatcagccatgaggagcagaagtcagtccggctggccagggagctggagagcagagaggcagagctaagacgccgtgacaccttctacaaggagcagctggagcgtattgagaggaagaatgctgagatgtataaactgtcttcagagcaattccatgaggcagccgagatcgcccgcatgaggtgctgctgtgctcggacctggtcaaggcataccagcgctgcgtgagcgccgcccacaagggctgaggagcagacatcattccctgccctggcagtgacttggagccctgaagaagggaccaatcatgggaccacagccactgtgccctgccgtttccgcatatgcccctgagcctggggctgccacgtgtttaggaaacaaagtatgcgctactgtctgaaaacaaataaagcagatgcctttgttttca

SEQ ID NO: 85675 - DNA, 1262 bp, Homo sapiens
gcgagtcctggaaagcgttgttggcccggttgctctggagccgggtctcgggtctggtggctgccggccctgcggcatctcgccatggggagcacggagagcagcgagggccgcagggtgtccttcggagtggacgaggaggagcgggtccgggtgctgcagggtgtccggctgtctgaaaacgtggtgaaccgcatgaaggagcccagctctccaccccctgctcccacatcttctacctttggccttcaagatggcaacttgagagcccctcacaaagaatccacactgcccaggtcggggagcagtggtggccagcagccctcagggatgaaggagggtgtcaagaggtatgaacaggagcatgctgctatccaggataagctcttccaggtggcaaagagggaaagagaggctgccaccaagcactccaaggcatccctgcccacgggcgaaggcagcatcagccatgaggagcagaagtcagtccggctggccagggagctggagagcagagaggcagagctaagacgccgtgacaccttctacaaggagcagctggagcgtattgagaggaagaatgctgagatgtataaactgtcttcagagcaattccatgaggcagcctcaaagatggagagcacaataaagcacaaacaggcaacacttcataacccagtggcggccctggacccaggaggtttgtgcagtcatggacagctacacaggcgcctgccatggacggaagggaaggctgcacagacacctgccatggacggaaaaagggaaggctgcaccaacaggtctgccgtggacggaagggaaggctgcacggactcctgctgtggacgaaagggaaggctgcccagaggtctgccgtggacggaagggaaggctgctgcgtggactgccgccgtggacggaagggaaggctgctgcccggactgccgccgtggacggaagggaaggctgctgcccggactgccgccgtggacggaagggaaggctgctgcgcggactgccgccgtggacggaagggaaggctgtacagagccttatcaccaatgggaaggaaaggctgcacggaggcttgcttggatagaagggaagggtgcagattgtcttggacatgaagggaaggctacacacagaattatcatggatggaaggaaagctgcacagaggaatgttaatgacgagaagggaagaatgcagagccttgccatagatgagaaggaaggatgcacagaagcttttttgat

SEQ ID NO: 85676 - DNA, 756 bp, Homo sapiens
acacagcagattacactgtataacctatatcacaacactcttaaagaaatctggataaaacataactctcccctaaaatcttagtacatagaagagcattgagagagagagaaagaaattaccaagtaagtgggaaaagaagactaaaatcaaagcctataccacaggagcccatggcaatatcagacctggatataagccctaggatctgggtgtttaatgccttcagagggataggacatgctgctttgaattcacacagtatggggaactggaactaagagctctgcataaagctggatatctaagggctacccaatatataaaaagggggacaaaagaaactctactagtccaggaggcatgctgtttctcatgcctctgggcagaaaaaaaaaaaggccttctgcaagaaacaaaaaccccaagcctgttctattagtgtatgtaaagtcatggtatttgaactccaagctgaaaaattgcataaaactggtattagatctatgaaactcctaattttcaaaaatagtgatccttccagaacccaagacctgtgacacacctcttaacaaatataaactcacagttaaaaaaacaaaataaaaattataaaccacacaaggaaacaaatcactatgaaaagagtcagctaatcaagtagaactgaatgttattttttaaatctgaaacaagttaaaaaggcataggaaccattaggaaataagacacaatgggggaaacatttttaaaaag

SEQ ID NO: 85677 - DNA, 388 bp, Homo sapiens
atgttttatttttgagcattttaaaattcagattcccttaaaatttcttaaaaacactaatttcatattatacggcttcccagtcctgaattacacattttactactatgtgaagctggatgcccttcagagaaattggcaaaggataatggcatgtaaaatactgttcatttctcatttcccaaccatgaatagtaatatccacattataaacataaaatatactcctcagacttcacatccacagaactggcttatctgcacagaaaatttcatgtttaatcaagaaggtctttaagctgaaaggagaccatgacatgctttaaaagactaaagaattttctggttctatcttcctacctttctttgcaaaaataattgggttctg

SEQ ID NO: 85678 - DNA, 189 bp, Homo sapiens
tgaccgaatgaagacatgaaggcccacacagcccctgtacaaccatcttctctggaggcgctgcgtctgggcacttttcctctatgtagctccctccccaaccattttcctctgtcatcagactaatcactttgaacaccagtgttccctcccctacaacacagtgtatttctggaaaagcatctttca

SEQ ID NO: 85679 - DNA, 455 bp, Homo sapiens
ctttatactttgtgtggtttgtttttagggaaaagtaattgatgtcgagagggttttccaaaacagaattttgtccctaataagcatttgattcttaagattctctgtattttgttacatttctggaatcttatacatatgagctattgacataaaatgagcacaattgtgtaactctttatgggagcaacagttataatgttttggcacatctcaaagatgtctagattatgtgactacatacagaagattaaatcaatgccaatcatttcctaaagtaaggcatttaacagtaagagaaatatttgtattgatttttttaggaataccatatttataataagttatacaaatttgattgtatgaatagctcaaattagagtaaaaattagccttgtagcctcactgcatttgaacttttaaatgcacttatgggaaggaggcaagatgaccaa

SEQ ID NO: 85680 - DNA, 647 bp, Homo sapiens
agttggaatcataccctatgtagcctttttaaattggcttccttcacttagtaatatgctttaaaggttcctccatgtcttttcatgcttgatagctcatatggactcattttaatactcatcataaacactgccaacattgcttcctggaatggaggctggagagaacttgggttctaaaattatcctgggtggcaatgcagcccatagtttcccgagcaagctatagacaagactgtgctgactattagaggggaatctgtggtcatgctggctccattcaaaacaatgattgtagaaaagggtcccctcaccctttctggatagatgccaggataatgcttcaggaagtgaaggccccaggctgagtatggtagctcacgcctgtaatcccagcacttcgggaggtcaacgcaggaggattgcttgagtccaggagtattttgaaaccagcctggacaccatagcaagaccccgtctctacaaaaaattaaaaaattagatgagcatggtggcacatgcctgtgttcccaactacttgggaggttaaggtgggaagatcacttgagcctgggaggttgaggctgcagtgagctgtgaccatgccaccacactcactctgggcaacagagggagactctgactca

SEQ ID NO: 85681 - DNA, 380 bp, Homo sapiens
tgagattacaggtataaaccactgcagtcagccacagcattattaaagtgtcagttctcccccaaattgatcaacgtgatttcaataaaaagccagcaggtttatttgtataaatacacaagctgatactagaattcatatgaaaggtaaagaacctacagtatccaagataattttgaagaaaaagaacaaagttggataattatactacctcatttcaagaattactataaagccattgttttgtctcgtatatgtttatagttttgcattttatagtaataaaacaatgtggtattggagtaggtatagattaactgaacataatagtgagtctagaagaaggcctacatatataaagttgattgattcttgatagt

SEQ ID NO: 85682 - DNA, 547 bp, Homo sapiens
tataaatggagatactaatggcacctaccctgtagaattcatgtgaggatggaaacatataatctatgcactatgcttagcagagtgtctgtacagaacacacactgttaaatggtaactgttattaccatgattagtttgcaaagcactttcacgtatagttgctgcaaactaatgtgcactattttgttgtcatttgccagatagatcattaacacattattgtttcacctcaatccctccttatatgttaaatctaaatgttattcaactacaaaattttaaaaatatctgagatctgacaagacaatgttgaggttcggtatgctcctataggcagaaaagtaagccacttcagtgtttttattcgtagctggcagcaccacttgaggagcccagactcatagttaagactcttctgatcctaggcaaagtctccactgagaaactactgatgatgtagcattggactaggccttcaaaaagaaagctgggggaagggaaataggggagtggatgaggtgaagtaggacactgcaaaaaaaaa

SEQ ID NO: 85683 - DNA, 295 bp, Homo sapiens
ttcgtgttagaaaataatctaaagccagggaaagaatcatccaaaaaggattaaagagagtagtacccagcactcatgtaaggccaggaacattgcttgttcccaccagccagactggaaaacctcaaaattcacatggcattggtaagaacactcagaagggtcttgcctcagaagtggagaataatttggcatagacaatgcaacactctggtcccacctaacaaactttaaaagcaaaacccaaaggattaaacagtttccaagtaacataactgcatccaaaaacaaagct

SEQ ID NO: 85684 - DNA, 878 bp, Homo sapiens
gcgccctttgccgctctggatccagctagaggcttgtcattgttcccacatggctaagtgctcgggttcgtcctaattgagctgaacactagtcactgggttccacagttctcttccatgacccacggcttctaatagagctatagcactcaccacagggcccaaggttccattccttggaatccgtgaggccaagaaccccaggtcagagaacaaaagtcttgccgccatcttgggagcagcccaccccatcttgggagtggcctgccaccatcttgggagctctaagaacaaagacctgctggtaacagctggataagcccaactgctttgtagctgcctgtgtgtggcaaacaactaacactccttaggcctcaattttttaatttataaaatgaaagcagtaaatatcacatcatataagttgttgagtatttatgagaattaaaaggaataatcgccataaaaggcctgatactggcaataatatatttgacaaatatgagtttctctttttccctttattctactttacggcaactcctacctcctattctctttcttttgctactaagcagacatctgggtttgtttgtttgtttcatcagggagaggttctaaacgttgtatcctttaaccctcaaagcatcatctattctcttagagggtaaagggcagagatgttatccctgttggtttctaaccttggagaaggtcagaaatgtcacgagctctctatagatcctcttatcagcttctcttacacaatcctttggttctgtgtgtggtgaaaactggattgggggaaaatcagatcagtagaaaccaaatgttgaagcaactggtgaatagagaaatacagattgcgtatccctaca

SEQ ID NO: 85685 - DNA, 499 bp, Homo sapiens
aataatcatgaactcagagcttacctgagctggtaaatacaggcaccatccatatcacaacgctgcctaaaaattgtatttatattgcatgcaaatatttgacaactccatcacaaacaataaaagatcggggagagaaaagccatttagcctgataaagtacatctcaatttagctagcagatcagtacccacaggaataatctggaaggcatgttccctaccccctccaccttctgttatttgcatttctagcagtgatcactgaagcatcaggatttgtggggattcacaagtaacatcatgatgggaggaggcagccctgcctccgatgatgagctgaaaatagctgaagatggtaaaaccaagagcaaagcaacccggctcatagccgaaatttcatctcctcctcagcctctcacagagaagccaggaagagtctgattggcttgcaatcgggtaaacaaaaataaacacataaatgaataaagtcactgatc

SEQ ID NO: 85686 - DNA, 1977 bp, Homo sapiens
  misc_feature (18)..(18): n is a, c, g, or t
  misc_feature (73)..(73): n is a, c, g, or t
  misc_feature (298)..(298): n is a, c, g, or t
taacatttgaggaaaaanctaaaggaagagtaggagcaagccatgcagctatctagggaaagagcgtaccagnaaagaacgtctaagggtgaagagccagagggaggcatacacttaacatctgaagaacagagcagaaaggccagcatggatgaagtgagtgagcaggggaagagtaagagatgaagtctgaggtttgatctaaggagctgagatctggaaagtcattgtaatgacactgagttttactttgcatgaggtaggaagctattagaaggtttggagcagaagagtgctncataatgtgaatcagtctggccgcgatgttgaaactaacatcacagttgttagttggggaggggaggttgtaggcaaaggcagaagcaggaagctctgttagaaaactgtggcaataatcttctaggtaaaaggtagtggtgattcaaagcaagatggtagcattggagaggatgagatatggtcagatgaggatatattttaaaagttgagctaacaggatttgctgaggaatcagaagtgaaccaaagactacaaagtttttgatctgaacaattcaaagcatgaagtttttatttactgtaatgaaagtgaaccagaccataggagaggctattgaagtgtgtggagggcggagagggggttcagatagagaggggataacaagaaatgtttgagatgcctgttaggcaccagaatagacataaaaagggagccggcaatacaacctggagttgagatgagagttttggagtcatcagcatataggtgggatttaaagtcatgagaaaggctgagaggtgagatctcaataggagcacaagtagatgaaaaagagaagctgtccaagaattggaccttgggtaccccactgttgagacgctggagtgctagcgaagaaccagcagaggaagttgaggaggcagccaacagaataggaaggtagctaagaaagggtgttgtcccagaagtcaagggaagtgttttaagagaagtgtgtcttcatctgtgtcaaatgctgttgataggttaaattagctcaagacagagaactggctactggtgggcttgacaagaggcctgaaatgctttggtttgcattcctttatctttcatacacaacttacctaaagtaggaatacgcttcaaatgtatatatttgggaataagttcctcactcctcaagtctacggtagggtttgatgtcatcagggcaaaacaaaaatgcaattagagtatttttagtgtgctatatgaaaggccaaattggcagcctctcttttctcaaggtcagtatcaacatgcataaatcatgttgacagtatgtctatgtgcccttgacatgatgtgatgaaaatggcacgttaccaaaacctattacctcaatctaatcatgagaaagacatcagaaagattccaatagagatacattctgtgaaatacctgatcagtactcatccaaactgtcaaagccatcaaaaacaaggaaagtctgaaaaactatcacagccaacaggagcctaggagacatgatgactaaaatgtactttgacctcctggatggggtcctggaacaaaaataacattaggtaaaaaccaagaggccctgaatgaactatagattttagttaaaataatgtgttaatattggttcattcattgtaacaaatgtatcatactaatgtaagatgttaataatagggaaactgggtacaaattatatgtgaactctgtactatcttctcaatttttctgtgaatccaaaactattctaaaaataaagtctattaataaaagtattaggcaaagtatttcagagaacatttatccaatgaaaatatacaggtggctaattcatattaagcatgaaaaatgctcaaattcatttgttattagggaaatgcaaattaaaaccacaatgagacatcagtctgtgcccagcaggattgctgtaacaat

SEQ ID NO: 85687 - DNA, 709 bp, Homo sapiens
tctccagcaagatctttgagctgtggtttctccacctgtggaatataaatgttaacaacataaccttctttctaaggataacttgagaattaacagtgcaagtaaatggaaagtatagtacctgtcaccagatatttaatagtagttattacgaaattgtaactcactacctgtgttagttgaggtttatcttcagccatgcaaatcaaaatcagattattttcacatcagcagataaggtttgtctgagaatcttatttttaatttgatactcttatttttaacttgatgccattgtgtgaaatcaccattacttagtaaacgtttgctattttcactttaaataactaaataatatttcattttatgggtgtattataatttattcagttctctattgttcaatatttacattgtttccagtttttttctgttacaaacactatttaatttttgtagtgataaatttgcatatgccatgattattttgtcctggaagtggaataacttgattaaaatgttaccaaagtccttagacttctgcattattatcaaatggctctccaaaaaacattctaatttatattcccattcacatcactggatagtttttctattgaagcttttatattcagatttgaaaaacactgattgaggctattttagaaattatcttaaagagcattcttttcaaagtaccaaagaattt

SEQ ID NO: 85688 - DNA, 484 bp, Homo sapiens
ggctgcagtgggtttgtctcgtgtacctctacatccaatgcccacggcaagaacaaccagaaaagctggacacactttttgaaggttttctggaggtgacaaggcaatctagcctcaaagggccaatgtcctgggcagatgtggcgttcacaggccactggaaacttgacacctttctacccctcagggcactgctggtggccgatgagcagagagctcatcttggagcttggaggctgagagcttctgaaaacacacagggtggggagataaaatctggaattcaaggaccactgggaggaagggcctgggaaactcccagacattcagtggggacctgaaaagggagcatggactttgccaggagtgggacaaacggaagctggatcagctgcccaaaggtctgaggcggacttcatgcagtccctccccggagtgcgttcagatgaaccacccctgctcttcccacaaaaataaatcctct

SEQ ID NO: 85689 - DNA, 1569 bp, Homo sapiens
aggtaggagaggaagacagctgcatcccattctgccccattccaccctgcgtggactttgagatccaggtgggcgccatgggaaaggtagcagggtgggtcagtgctgtctggaaagattagataaggaggaggaagggagctagatagaagtggggcaggtgactatcaaggagcctgactcaaaacctaccaccttggccaccatcagagcaccatgggagggggaatgacagactgggggaatgacagactggggaaatccccgagggaccctgaacaaccctccccccgcccccattcagctgtggatgagaaaactgtccctggggcatggaggagaaactgacccgcccaggtcacacaagttaatggaacagcaagttccagatcccaggtcttctggctcccagccccagacactggctgtgggtggaggattacccaggtgccaaggcaagagactgaaggcacaaactgtttcagtataataaaaaaaatagaataagaatagtcataatacaaattagatatagagatgatcatggacaattagcaatcactattaatctttagcttttaatattactctttgttgcattactaatataacctaggaataaccggtgggtatagggtcaggtgctgaagggacattgtgagaagtgacctggaaggcaagaggtgagccctctgtcacgcccacataagggccgcttgagggctccttggtcaagtggtaacgccagtgtctgggaatgcacccgttaattagcagaccgcgaaagggagtctcctttccttggaagagttggggaacactctgctccaccagcttcttgtggaaggctggatattatccaggcctgcgcgcagtcatccggaggcttaaacccttccctgtggtgctgtgcttcaatggtcccactccttgtccactttcatgctcctcccgtactcctggttcctctttgaagagcgcagtagatagcggtagaagaaatagtgaaagtcttaaagtcttcgatctttcttacaagtgcagagaagaaaacgctgacatatgctgccttccctctctgcttcggctacctaaaagggaagggccgcctatcctgtaatcacatgacttgcttcaccttgtcaatcacttagaagattcaccctccttaccctgcccccttgtcttgtatgcaataaatatcagtgaccccagccgttcagggccactactggtctccgcgtcttgatggtagtggtcaccccggcccaggtgttttttctttatctctttgtcttgtgcttttatttattacaatctctcatctccgcacatggggagaacacccactaagccccgtagggctagaccctacaactggccaccactccacagatgcaggccagccccaaggaggccactccaacagcaggcactgtcagaacactgggatgggctggtggtgggtgggaagcctggggggccctttctccagatagccaaagtcacacctactaggcggaatgttaagagagaaacccagattcactggttggggctcctggctca

SEQ ID NO: 85690 - DNA, 107 bp, Homo sapiens
caagtaaaacttagcctctagctcgcgtgagactgattggaattgcttcagtggacagtactaaaggtgttgcagaatctctaaagttagcatcgcggccagcatgc

SEQ ID NO: 85691 - DNA, 609 bp, Homo sapiens
cagggaggagacagtcatctacaggccaaggagaaaggcctggaacagagccccttacagccttcaagaggaaccgaccctgctgatgcagacttccagcctccagaactgtgagacaatgaatttctgttgtttaaaccacccagtgtgccatacttcgtcatggcagtcctagcaaactgatagagtgcactcaaaagcacagattcttttcatggactttccaaagcccagggacttctgtttcttctagctgtgttttgaaattgcgacatggcatgggtcatcaggatacgagttgttatctccttcccgtaagagcaattaaggtcaaagactgaagccagagctcttgggtttaagtcccattagctgtgtgacctctggccctaatggtgtctcttgtaaaatagaataataatacctgcttcttagattacttggaggaccaagtgaattaataacatgtaaaactcttggtgctcggcacataataagtgctcgacaatgaaacgttcattgccattgttggggggccagaaagcaaccactgcctgagagcaccccagacccatgaatcacacagcaagaaagaaagcccgcatggtc

SEQ ID NO: 85692 - DNA, 276 bp, Homo sapiens
  misc_feature (45)..(45): n is a, c, g, or t
  misc_feature (53)..(53): n is a, c, g, or t
  misc_feature (55)..(55): n is a, c, g, or t
ccgcacccactgacctgcgcccactgtctggcactccctagtganatgaaccngntacctcagatggaaatgcagaaatcacccgtcttctgcgtcgctcacggtgggagctgtagactggagctgttcctattcggccatcttggctcctccgcatttgtttttatggtggttttgtattgtttttatagagctgccctcacatgcttagcaacattagatgtctggagactggaaagtccaagatcatgtgcctgaggattcagtgtctggtaa

SEQ ID NO: 85693 - DNA, 273 bp, Homo sapiens
ttatattttatttttattccccagaaaacagtttccaatgttgaagaacaataattttatcaatataaataacctacctgcaggtgttttatatcatattcaatgacaaactatgaaatgtaacatttttgctttgacagcccatgaaatccatcatctattttcatagatccttcattcagaaaaagatttgattttcaggatttatggtccgatcagaaatatttgaattatagatttgcagcttttgaaatcaacatcaggatttactag

SEQ ID NO: 85694 - DNA, 364 bp, Homo sapiens
gtaatcaagaggaaagatattgtgaatctcttaaaaactcaaagcttactggattgatgttgatgtactcttactaaaatcttaactaagtctaggcaaggtggctcatgcctgtaattccagcactttgggaggctgaggcgggcagatcacttgagcccaggggttcaagaccatgggcagtgtggcgaaaccctgcctctacaaaaatgttttaaaaattagccaggcatgagagtatatgcctgtagtcttagccatgtgggaggctgaggtgagaggatcacttgagcctgggaggtccaggcagcagtaagccatgatcgtgccactgaactccagcctggacaacaacagagtgaga

SEQ ID NO: 85695 - DNA, 463 bp, Homo sapiens
acaagtatcaaagcttaaaattacactaagacttttggaattcttgtatttttataaagtgccctcttctcttttaaagtagttcttagcagggctgttatctacgttgatcacctaaaattattttccctacatgtggtaaaggaagaatatgatcagtgttaatttacatgtaacagattagaaggaattggaccctaatagtagcaggtgattaaacattttattatcccacctgttagcctggctacaggtattatatttcatgtcctgctgtttacaaaaaagaacttccataaaccttagaaatcttacttcctcaaaaattattgtttatggagtttagagcttggagatttaagtatttattgcagttttattttcaaatgataaatgctatctataatttatgtggtttttatttctcatgtttacattaaaataaaacctgataaactgtttt

SEQ ID NO: 85696 - DNA, 315 bp, Homo sapiens
ttcaacccttccttttctttttcctctttcatcacacctagtttatcttccatcttagcctaccttcatcttcttctgttacagagctcatgactcactcacttccacttaagatacccaacaatttcctagaactttttcctggcttccgcaaaaaatcatttggacctatgcaaaacttctgaacctctattatacttttttctttcacttgttttatagttttgttttgtttttttaataggtcccatgctgatttttttttctccgtgctcaattttgaacagggtgatagctattcagattcagtgtttg

SEQ ID NO: 85697 - DNA, 327 bp, Homo sapiens
ccagaaaaatattcctccatttgaactctaaactaaatacacattttattagcttccagcaaaagactatttagccaacaactgcaaaatatgagggagacaaaaaatgggaatcaaactcatgtttctatcttttatatctgccaaatacaattaaggtttgtcctgtggcttactgaggggaacaataaaatatcccttttgttgtatgtttagggacgtagtttaaaatagactaatatgagcaacagaaaaattcctatgtgttttcctccttttttcaaaacactgggctgccagaaaaataatccgtgttttgggcccaag

SEQ ID NO: 85698 - DNA, 240 bp, Homo sapiens
gatagaatagccagccttccacttgaatgcactgccatattgtcaagctgcattccttaagcatcacttcttagaggcctcaagcttctcgggaatgtttgatgacttaaaggggaaatgaacaggttgcaattatgcttgtcaaggttcttcttgtgaacctttatttggacaattcacacaaaaaaagaaagcagctcattttctaattcaggatattatttctttttaaaactggta

SEQ ID NO: 85699 - DNA, 730 bp, Homo sapiens
gtagaaggaggcagttatgtttatattgaaggtgaaatttttctttcatttagaatggaaaacatccccaaatgtatcattataaactagtcagccttgactacacaaaattgacctttaagttgcttgagaaaaacacaatgcaaatcgttcagaagggtcaacatcctttggtgctaaaatcttgtgtatgttttcagaatggctttttctgtatgttatagaataatcactaaaggaaaggtagttgaatttaaagtcatgaagcaagactctttaattcagttattttaaacaagaattaaaaccccaaacatccttggcaggctttgaagcacacagaattttctagtatttcttattaaatacaccaataataaacatatacttagtttacctgatgagtttagacataattctatataatgttcgcttatattcatttattaactagcaacacttgtgcaagaacaaggtattctgcttgaaaacactgatttttaagttcctgttgcccgattgtaaagaaaatcatctgacacagaagcctggattttgctctcctaacactggtgttttccttgagcctctaattcaaataaaacaaactgatacaccttacagccttattcatctgtgtctggataactcacttttcatctattgaataagaaaaagtgtttaaacttaataaaataaaaaattgtgcaccaattactacagatccttg

SEQ ID NO: 85700 - DNA, 853 bp, Homo sapiens
gagtctgcagacggccgtggctcctctgttcttcccgaggctacagcaacagccagaggtgttcctggggagatggcggaacagcacggagcacccgaacaggctgcagctggcaagagccatggagaccttgggggcagctacaaggtgatcttgtacgaactagagaacttccaaggcaaacgctgcgagctctcggccgagtgccccagcctgaccgacagcctgctggagaaggtgggctccatccaagtggagtccgggccgtggctggcatttgagtccagggccttccgcggggagcagtttgttctggagaagggggattatcctcgctgggatgcctggtccaacagccgtgatagtgacagccttctgtccctccggcctctgaatattgatagtccagatcacaagctgcatctgtttgagaacccagctttcagtggccgcaagatggagatagtggatgatgacgtgcccagcctgtgggctcatggcttccaggaccgtgtggcgagtgtccgtgccatcaacgggacgtgggttggctatgagttccccggctaccgtgggcgccagtacgtgtttgagcggggcgagtaccgccactggaatgagtgggacgccagccagccgcagctgcagtctgtgcgccgcatccgtgaccagaagtggcacaagcggggccgcttccccagcagctgaaaggcacccagacttcaaggacccagacccaccctggggggctgcaagggcaagaagaggaggctccagggttggggcgagggccgacctgtccacccttccctggaatctgctcaataaagcctggggttggtcccccacccgc

SEQ ID NO: 85701 - DNA, 1282 bp, Homo sapiens
gagtctgcagacggccgtggctcctctgttcttcccgaggctacagcaacagccagaggtgttcctggggagatggcggaacagcacggagcacccgaacaggctgcagctggcaagagccatggagaccttgggggcagctacaaggtgatcttgtacgaactagagaacttccaaggcaaacgctgcgagctctcggccgagtgccccagcctgaccgacagcctgctggagaaggtgggctccatccaagtggagtccgggccgtggctggcatttgagtccagggccttccgcggggagcagtttgttctggagaagggggattatcctcgctgggatgcctggtccaacagccgtgatagtgacagccttctgtccctccggcctctgaatattgatagtccagatcacaagctgcatctgtttgagaacccagctttcagtggccgcaagatggagatagtggatgatgacgtgcccagcctgtgggctcatggcttccaggaccgtgtggcgagtgtccgtgccatcaacgggacgtgggttggctatgagttccccggctaccgtgggcgccagtacgtgtttgagcggggcgagtaccgccactggaatgagtgggacgccagccagccgcagctgcagtctgtgcgccgcatccgtgaccagaagtggcacaagcggggccgcttccccagcagctgaaaggcacccagacttcaaggacccagacccaccctggggggctgcaagggcaagaagaggaggctccagggttggggcgagggccgacctgtccacccttccctggaatctgctcaataaagcctggggttggtcccccacccgcaaaaaaaaaaaaaaaaaaaaaaaaaaaaaaggggggggggcttaaaattttccctggggggccccagttttgggtttacccggtttttttgtacaagggtgggcccccatatatagggggcggcgagtattatattaagcgataggagcatggggccggtcggttttaacaaaccggttggtagctgtggagaaaacctgtgttaatgtgggggagacttttgggacaagagacccttaatttcgtgggggtgggcgtctatattggggacaaatttcccttacaggaaggtttaaacggcttaagggggaacttttaacattttcaaagggtggtttactgggtggtaaaaataggggggatatggtggcgcgtagaagttgggcgaagggggtattgctttgggaaattttttcccgggcggtttga

SEQ ID NO: 85702 - DNA, 413 bp, Homo sapiens
tggatgagtcaaatctaaggtcttcgaaccttatgttaggggttggaggtcttggtgtgaggaaggaagactttaaaattaaagactgttaagtccgtgtggctttttcttactttggattcatttatcctgtactccatgtagctcgcatggttagagagatctgaggcctactcctatttgagaggatgttatcccccatagccagaaaccagggtggcttccaaaagaaaagggtagcattcggtgactctgctttaggccttgaggatgaatcttttctttgtttttgtcttcctgtgtccttttgcatcatcagagatctggagactaagctttgagcatgggcttggggaagaggggccaaagaggcagcttggctggcattaagtgttgaaggccgtagaccagac

SEQ ID NO: 85703 - DNA, 693 bp, Homo sapiens
gctattatgataggcacaattttagtgaaagatgaagactagaaaccctggcagctacatgtaggggtaaaatgtatcagccctctagaagttaagtagaagacattttatagaaaatcatatcttttgaaatttgtttttccatagtaatgtataatcttattctaccattggcccaaaaaataagcaaataataataataatccaacataagaaaataagggatagttggatttggggataggatatcaaaagaccttgatttcctggattaaaatatgaatttttctttctatattccaagtgtagagaagaagaaaggcaaacaaattcccagacagagattgatatggtttgactgtgttcccacccaaagtctgatcttgaattgtagtaattcccatgtgtcaaggacaggaccaggtggagtaattgaataataggggcaatttcccctatactgttctcataatagtgagtgagttctcataagatctgttgattttctaatggactttctcctttgcttggctctcattctctttcttgccaccaagtaaagaaggacatgtttgcttcccattctaccatgattgtaagtttcctgaagcctgccaagcattgctgaactgtgaaacctctttcctttataaattacccagtttggggtatgtctttatgagcagtatgaga

SEQ ID NO: 85704 - DNA, 327 bp, Homo sapiens
tctactagagaatagaaccaacacagagggaaacacagctgagtggggaaagagaggcggataacatcgtttgaatttctagatcccacaatgcctcaagtctatccctgtacctttacctttcagtgatattagccaataaattccacttattaagccagtttgagttatgcagattacagtccttctacagcatttcactgcccttaaaaccacacagaactaagctcacttaaaaaaaaatctaaagtgcaaaaaattgacttttttcactttcagtatattctttttactaactaaagtatttattacaaatttctttgggtt

SEQ ID NO: 85705 - DNA, 375 bp, Homo sapiens
gtatattttatagagatggggcttcgccatgttgcccaggctggtctcaaactcctggactcaaacgattagcccgtcttcacctcccagagtgctgggattacaggcatgagccaccatgcccagcccaggagcacatctaaaaatgctctgtgctctggctcaggaaggaatgcatgtagccaagtgggggccaaagggtgggggcaaagctgcccattaagtaccttggaggtgaaggccaggtcagcagtggggatgtgggtaccctaattgtggacattagccacagatgctcctgtcatctgtgcagtggctaagatcttacgcagagtgcaccctaggagctgtgctggggatgccatcacccccctg

SEQ ID NO: 85706 - DNA, 392 bp, Homo sapiens
tgataaggttctggttcctctgagacctggatggactctttgcaaagagtgctgggagattcttctgggggcagtggttctcaaatacaaacgtgcagaagcaacatccaggcagcttgtttctgtgttgacacctcagattcccctctgaagaatctgttgagaaggtgtgggcatggcacaagaatggggatgtttaacaggcaccccagtgatcatgatggaagtctgtgggttatattctgagaaacagtatcctccatttctttgtttgtttttaacttcagcccctttgagtgggtgtctggttcttagaatcaaaaagtattaatcaaggcagtgcatattaccaaggtttgggaagtaaaggcaagccattagacaaagtgata

SEQ ID NO: 85707 - DNA, 545 bp, Homo sapiens
cttgcctagagtgtgtaaattaactttatcactatgctccttataaattgattttttttcccttcaaaaattgttttgttcccaattctgcacaaacccctgggattgttcagtgttgcagacacacctttgacagtctttgaagtttgacttttaaaattcttaggaacagcatagtaagttacttttaatattgatccttttaaggtagtagaaacttaaatgcaaatttggtaaaaattgcttttccagaaccaaattctgcatttcttctttccagtttaaagattaaacatgcaaagcgttttgaccagccaggaagcactgctgttgtcttttgttttgccaagtttgatccttagtaagctgggtagcttcaggtgtgggtgtccactgccaaattcaaacttccagacacctctttgagaacactatggaccttagggccaacttgaaacaagacagatgccttgagactgaaataggttctatagattctcattcctgtatagttactaaggtgagcccactaagggaagggcaat

SEQ ID NO: 85708 - DNA, 662 bp, Homo sapiens
ttgtgccaaatatttttcccacattgaggcaaaaggttcttccatatctcttgtcagttagttaggcatagctacttgtggtaatggacgggagtacataatctctcaggtgagggaactctcaagtggctaaaggcaattctttagagaagacagcagctggccaggtgcagtggctcacgcctgtagttccagcactttgggaggccaaggagagtggatcacttgaggtcaggagtttgaggccagcctgcccaacatggtgaaactctatctctactgaaaaaatacaaaaattagccagtcatggtggcaggcacctgtaatcccagctactcaggaggctgaggcagaattgcttgaacccaggaggcggaggttgcaaggagccatgatcacaccactggactccagcctgggctacagagactccatctcaaaaaacaaaaaacaaaaacaaaaacaaaaacaaacaaaaaaaaacagaagaccgcagctatgggtggtttgcagccaatacttataggaggaactaggggttgggtgcactggcccagtaaaggagatctgggcagggcacaaacagcatctgctactgtgatattttcttaatactaatctacaggtttgtattcctgtatatagactcttcttaggagaaa

SEQ ID NO: 85709 - DNA, 453 bp, Homo sapiens
tttggtcagctcacctcccctgatcctagatgcagataccgctcagtttcaaagcacttttccccctacacgagttctgggggaagatcattttaagtgaccagctcctctcaccttctcagctcacatggtcaggcagtagagatatcatttcaaccaccagatttgttaggtttttgttagacgtcagttggcagagctgaactaaatactttttctactttcctcccacttttcctttcctgtcttgtgacttgccttgccacagtggattagaaattctcttcgtggaatacagcttggcaggcgattgctggaaaagcagatagagaagaccactggtttcggcccccgctcgctgcccagagtgcagctgacctgatgggggggctaggcaggggcaggttttataaatgcacttctgggaggcgatggccagatgggaggcgggct

SEQ ID NO: 85710 - DNA, 389 bp, Homo sapiens
caatgagatcacttcaaaattccaggcctcaagcagtcctcctgccttggactcccaaataagcaaatactttctaatgactttgatagaacaacattaaattaagaaaaagttaactaaaatattaagtatcaccagaaatggtaactaggtaggtaaatatataagaatttttaacattaaagtcagtgaaatagaaaacagaaaaaatagaatcaataaaaccaaaagctggttctttgagatgataaaaaaaatggataacttctagaaaagcttatcagaaaaaaaagatagaagaaatgaaggcccaatatcaagaaggagagaggtgacattactacaaatgctacaaatgttaaaagcaaaacaggagaatactatgaata

SEQ ID NO: 85711 - DNA, 692 bp, Homo sapiens
ttgtatctggtgaatcagtattactacctgaacaaagagcatgctggctcttaaaaaaaaaaaaaaacaaactcatgatacctaacgtattaagcaagtactttatctttatctgccagattctggcatgcacacacatctgcaacccctgcataacactgatcttaaacttgaaaaaacccagggctcagtttaatacactaaggcacaggaacatcaaactagttttagtataccgtatataatactttgggaaagaggaggaaagctaaaggggacaatcctactcaactccagaagattaacttccttgacagttgcaagcactgtgttgtcagatcttccacattttcaagaggactctgaaacccagatttttatttggaattgcatgactcttcagtgctgcctcaattaaaaatgaaacagctggctgatagattccacagttggctgctagattcctccgtgaaagtataatcacgtgtgaatgttttgtattaatattatacacaaactaatagcaaaatgagttttgaggtaaaggtacagattcccaggatacaggaagtaaacaaggatataaaaagagtaacaggtcgggcatggtggttcacacttgtaatcccagcattttgggattataggcatgagccgacgtgcccggccttaaaaaatcacttaaaatcttt

SEQ ID NO: 85712 - DNA, 692 bp, Homo sapiens
ctgaggctctgaccccttgtagccgctggccctcccttgacccctttggatgagtgagggggctcagctggaccctatgaccttgcttcacattgggtaagccttctgacctgaggccttcctgtggtttcagctgagagaggctagtgacatagagagccgaggcaaatcctggatctgtgcctgcctcaagagctccctcctttgtgggagttgcatttgggggagcagcatagttctcaggggctccacctaggcaggcgctagactgatggaggaggcagttgaaggaggaggtagttttcttgtggtccctttgtctatttagccaatgatacgataggagagggtcaggtggggagctgagacattccgaagtgaaaagtcaggattggctttttcttctagagcatggagttttccaaggatctgtcactagtgtgccgtctgaacagacatcgctgctgacacctaaaacctcttctaagaaacactccaattattcagataattgcttgtgcctaagactgtataacctaagagtcgggtgcaggcttgataaagaattggaagccctctgcaaaactgctacaggtgttctgtgttccgacgccctccatcaccttggacaggggttcttcttccggcccagtctctcccatttcctcttttctccctccatctcctcccat

SEQ ID NO: 85713 - DNA, 294 bp, Homo sapiens
acaaaatttttttttttaaattcactgggcatggtcatgcacctctgtagtcccagctattctggaagctgagaggattgcttgagcccaggaggtggaaaccgtagtgggccatgatagcgccactgtactctagcctggcaaaacagcaagactgtctcaaaaaatagtaataataatgcagagggatcctttgtacccttgacctagtttcctccagtggtaacatcttgctaaagtacaatatcataattttgacattgatataagccatctatcttgttcagacctccc

SEQ ID NO: 85714 - DNA, 1102 bp, Homo sapiens
tttaaatacctatcttatatcaatgcaatatttacaattagcaagcaaaaaatttatctagaatgaaaagataaatatggtagcaaaggacttaagttagtactttaactggtgtgccacaagtaaatgattacattctgagaagcttgctcatttttaactacttgtacatcagtagaaaataaggattaagtcaaaaagaggataggaagtaatactagaatacctgatattataaattattaagagttctgactattagaaggtattactgccatgtactaccatttaaagtgaagagattttggaagaaaaacaaaaactataatcaacagaaaaactctgaaagaaattttaagatgaacaaccttcaagaagttaaaggcggctgcagtggaccgtgggcagccagggtcggtgaagaatcccaacatggctgggcgaaaacttgctctaaaaaccactgactgagtagcttttgcagagatcataccccagaaccaaaaggccattgctagtttcctgaaatcctggaatgagaccctcacctccaggttggctgctttacctgagaatccaccggttatcgactgggcttactacaaggccaacgtggccaaggccggtttggtggatgactttaagaagtttaatgccctgaaggttcccgtgccagaggataaatatactgcgcaggtggatgccgaagaaaaagatgtgaaatcttgtgctgagtgggtgtctctctcaaaggccaggattgtagaatatgagaaacagatggagaagatgaagaacttaattccatttgatcagatgaccactgaggacttgaacgaagctttcccagaaaccaaattagacgagaaaaagtatccttattggcctcaccaactaatcgagaatttataaaattgagtccaggaggaagttctggcccttgtattacacattctggacattaaaaataataattatacagtagaccaatagcaccataattttaggcacagtaaattagccaatatctctcattgctaactcagtttcatttaacttcttgtgttgcctttaacaactttttttttaatatcattctcgc

SEQ ID NO: 85715 - DNA, 469 bp, Homo sapiens
ttaacagaatgttttgaagatttgtccttattgtagtacttttcaagatttccttatttttaaggctgaatgctatcccagtgattgtacgtgccttgtttgctgaatctactcatccttaagggtacatttgcttccaggtaacatgtttgtgagtaatactacaatgtgcatatatctattccatgttctgctttgtctgtttgggatatttttcatacactgattcagtaccatgtgtattcccttgcttttgttgtctcatccgttgatgctacgtcccccaaattattgccacgaccagttgtaatgaagcttcacccttctgtattgtgctaggaattttacagttataggttttacattatagtcttcattcattttttaaaattgacacatgtaattgtgcatattttggggaaacaattatatatatgttttgtataacaataaaaatcagtacttctat

SEQ ID NO: 85716 - DNA, 525 bp, Homo sapiens
agtctcacacctcactcttcaagctgggaaaatgatgctgttaccttgggaggtgagaccctccagatgggaacctcgacgctgggagctggtgtgttcccggaattcgggggaatatttcattccctgcgtatggtgtctggactttcagatccctcctcccaggcacccaggcatcatttcacaaccccatgctcagcaagccccagagaaaactcctcaataaactacgagtgttaatacccgatgcaataagatgtgattaaattttacacaagggaggggtgcaggtacttcagaatcataaaaacagcttttccacaaaactgtcagcattagacacaaatatgagagcaaaggggcgctcgggcttactcacattgctcagtttgtttacactaagtccgcacaacatgaaaacacctgctccactttcacaatcagtcttctccattgtgcacaggaaagttatagtttggagaaggtttttgtatttcaataatgccacccattttgtggtgttta

SEQ ID NO: 85717 - DNA, 197 bp, Homo sapiens
atttccatgaagctctcctgattcattgtacttatgccaacaatttttctggaccaaaatagtagagacctatagagtccagtggctgcgaacaggtaaacactcgggactcttaccaatgttcctcacaaagtttcaacttaaaactaaatgattcccctctacctcagtcattactgtacatgttattgataaca

SEQ ID NO: 85718 - DNA, 331 bp, Homo sapiens
gggaatctcagcccctgcacatccttctgtcattctttgctcctgctatttcttctcccttactaaactcacttgtctcagactgctaatggacaaatgccatagccagttgatcactctggccaccagcctccattgtactgacccagttttcacctctgactttcttgggtatctgttgccatccagccccatctagagttccatactttcatttccttctggtcacctactctcaatgctgctagtcctttgtttagccaaccataatgatgtagtctaccacctctttgagagtgtagtatgcatcaagcactgtgctaagtgtttt

SEQ ID NO: 85719 - DNA, 407 bp, Homo sapiens
agctgaaaagaatcttaatgcaaaagaattcttaactggaaaactggaaacaagcaatagtaaggaactggtgaattatgccacatccaagaagcataacatatactcatttaaaaagatagaaaacctaggccgggcacagtggctcacacctgtaatcccaacactttgggagacccaggagggtggaacacttgaggtcaggagttcgagaccagcctggccaacatggtgaaaccctgtctctactaaaaatacaaaagttagccatggtggtgcgcacctgtagtcccagctactcaggaggctgaggcagaaaaatggcatgaacccgggaggcggagcttgcagtgagccaagatcacgccactgcactccagcagaacgagactccatctcaaaaaaaa

SEQ ID NO: 85720 - DNA, 403 bp, Homo sapiens
ttccttgacattattccttaaacaatacagtataaaagtatatacatattaagtaacctagaaatggtttaaagtatacaagagaatgtgtgtaggttatatgcaaatactatgccattttatatgagggacttgagcatctgtgacttttggtgtccacaggtgagcctggagccaatccctcacagatactgagagacaactataatcataaaactgtaattttaaaaggtagtacaacactcgaggttaaaagcctaaatctaagccagactgaatttcaggctcctcatcccctcacatattagctatgtagccttgtgcaaattatttaatttttaatgccttagtttcctcatctatgtaacagaaccaataatcatttctacctcatagggtaact

SEQ ID NO: 85721 - DNA, 410 bp, Homo sapiens
aagaaagagaccagaaagaggtgtctcaccttttttattcctctacaaagtatgtctggatgtggcatctgaaacttctctaattagtaccttatgatcatgagaacagccagcctgagggcaaagccctcattgaggctggaagagcacagagattatggtaggcagaattatagcccccactagagatatccatgtcctaggctctgtaatctgaagatgtgttactttacgtggccagagactttgcagatgtgctaaggaagggtatggccttgagatggagagagagttttggattctctgatgggcccagtgtaaccaccagagttcttaaatgtggaagagggagcaagagagtcagtgttagagtgatgtgatgtgagagactcgagcagtcattgctggct

SEQ ID NO: 85722 - DNA, 359 bp, Homo sapiens
ttggcattaataatatgaccaggaataaatttatttaagaaatgtagatgaagtatcgatattatcatgttatagggatcaggtaagagttatcaccaaattctgcccctgtcatttgacccttttgtttaagaattcctgagggcactgtacacactacagatgttatcagaaaaagttacgttttaatgggtgacttcagtagcacaataacaatagcaggtatttcaaaaagtctgacatgcatcatgcagtttaggtttgccatattatccagcctcagatacttcctctacattttggcataggcctatctgaatgatgttcaggctactattcagagaaagagtggcctaggc

SEQ ID NO: 85723 - DNA, 689 bp, Homo sapiens
tgactgtttgcatccttgacatctctggccttggtcccacacgcagcctgaggctgtggcgagacactaggccaggactcagaagttcttggggctggtcccagtttcacaaattttgtcagatcacaccccctgtctgggcctgatttccttgatttgcaaatgggtgcctccgtgtctgtgctgctcagctctcattttgctgtgatgctcaaagaccatgcagcttggtgcttagcacagtgacccagaggctctaggaggcccgggctccagtcccagccctgccacttcctagctgggggaccttgggcaagctgcttaacttctctgggccttggtttccccatccatacagagggtgacaggagtacctgggatgaccttaatgcataatgatgcttttaaccccgagactggtagtatgtacttgatgaagtggcagcttttactatttgccactagaaatgaatgggggctgagcacaatggctcaggcctgcaatctcagcactttgggaggctgaggcaggaggattgcttgagcccaggagttcaagaccagcctaggcaatatggtgaaacctcatctcaaaaaaaaagaaaaaaagaaaaataaaaagaaaagaagcaataggaaagtcttttgtaaactgaaaaatgtcacaaatataattggtgctgcttcta

SEQ ID NO: 85724 - DNA, 846 bp, Homo sapiens
gctggggaccaggcggagatccgtactgtggtggcactcatgcacctgttgttggtagtgaacttctggctgccattcagtcagcagctgttaactactaaggtgccaggacaaaatgaaatgcaaccaagaagtcatgccccatcacaaagtgcaatttgaggaaaacaagaaggcagatgttttgccattgagccagaattaagttttcttctaggactatcaaggactatgtggatctgacaggcacttctgctcagctctcctctagagactcctagaacatcatcgtttcctgatttctttgctggctgcttttataaccaaactccaaacatcaaaattatcatcttagtcctgggtgttctgtcctaatgtgttaactgcaaaaatgacctcaattcttaggaacttctgccatcagtagctggagtctattgggtttcaagtctgggcctcaagaggcattgcaaactttcatcctctcttttgagatttcagcaccatcaccaaatgaacaagtcccaggtagcctgctggaggatgtacaaccatgtggaacgccgatgagccatcacagctgagttgttttggacctgctagctctaaaccaatgtcgcagctgtctgtagaagcacgaatgagatatggccaagctccattgagcctggcccagataagcagaactgtttcacggagcccaggacaaattgccaaaccccagtattgtgtattcaataatttctagttgttctaagccactaagtttcagggtgacttgttaagtggttataactacctaataagtacattttgtatttcctttttattatcatctaccatagc

SEQ ID NO: 85725 - DNA, 680 bp, Homo sapiens
ctcaggcttccggtctgtttggtgccctggtcgcgtgtcttccgaactctgctgcttcgccccggcaagagcacttccttccgcggctgctaaaactggtgcgcgggttcccaacttcgcagaagcagcttcatcggccccccgctagagacctcagaccgcagccatcgacgcctcgcctcggggatctgtccccaccctcggggccagctcaccatgagtcaggccctgtgctaggtgctgggatgaagcagtgactgacacaggcctggacctgtccttgtgaagagtgcgtctgtgacacagatactgtgccatgtggcaaaacttgaatggagacatcagctctttgtgggtctcaagtctactggctttcaatcagctcttctgcttgacagctgcaggtcttgggactgcccagcccccataaccctgtgagtgcattcctgataataaccctctttctcttgtcctcccccaccccacatcattggttctgtttctctggagaaccataatacatcatttactaatcaggaaatagattcagagacattaataactcatccaacctcacagttaactgtagagttgggcttgaaattccaaggtcgattttcttagccaatacaccatgctacatatatgtatgtaaaaataaaaacgcttgtgaactgaaa

SEQ ID NO: 85726 - DNA, 1529 bp, Homo sapiens
ctcaggcttccggtctgtttggtgccctggtcgcgtgtcttccgaactctgctgcttcgccccggcaagagcacttccttccgcggctgctaaaactggtgcgcgggttcccaacttcgcagaagcagcttcatcggccccccgctagagacctcagaccgcagccatcgacgcctcgcctcggggatctgtccccaccctcggggccaggtcagggaccagagacctgcgacgctctccttaggggtttagttcccaggctttctgaccccagtaattccaaacgcttccctttgtttccacagccctagcgtagcgaggtgctccctgcagtttttgcttctgagatagagttctcttttcagctccttcggtagtcacttcgtacatagtgattcatgatgcgaaatcctctctgttgaaataactgacgaggcctctgtcttctgactggaccctgacttccatgccctttccactctcactccagtacatgcccaaaccccaatctttgttgctccaggcattgcctctgtggcgctgtgtcccctcctttgaactctgatccttctgctcaggccctttctcccagtctgaagtaaggagtgaaaaaatgtgaattgttctactcatctggaaaagagaaccctgaggcaggaacaagtcgttaattgcatgtgcgtttgtccacagctcaccatgagtcaggccctgtgctaggtgctgggatgaagcagtgactgacacaggcctggacctgtccttgtgaagagtgcgtctgtgacacagatactgtgccatgtggcaaagtaagcgcgtgggacagcagagccttgtttgccattaaagtaatatcacaagtctgttaaggttggagaatcaagtgaacatgctgaaaagttatggggaatgtagtctcatagctgggggagctgggggccttgtcaattggttcccccagtctggagagcaatctgagagtaagtagtgacactgtgtgtgctgagtgtgtctgtgggggtgtttttggataaaattaacatttgaatttgtgaactgagtgaagcagagtgcccttcataatgtgggtgggcctcattcaattagttcaaggcccgcataggaaccacctcctgcctgactgaaccgggacctacgtcttttcttgccttcagacttgaatggagacatcagctctttgtgggtctcaagtctactggctttcaatcagctcttctgcttgacagctgcaggtcttgggactgcccagcccccataaccctgtgagtgcattcctgataataaccctctttctcttgtcctcccccaccccacatcattggttctgtttctctggagaaccataatacatcatttactaatcaggaaatagattcagagacattaataactcatccaacctcacagttaactgtagagttgggcttgaaattccaaggtcgattttcttagccaatacaccatgctacatatatgtatgtaaaaataaaaacgcttgtgaactgaaa

SEQ ID NO: 85727 - DNA, 1374 bp, Homo sapiens
ctcaggcttccggtctgtttggtgccctggtcgcgtgtcttccgaactctgctgcttcgccccggcaagagcacttccttccgcggctgctaaaactggtgcgcgggttcccaacttcgcagaagcagcttcatcggccccccgctagagacctcagaccgcagccatcgacgcctcgcctcggggatctgtccccaccctcggggccagctccttcggtagtcacttcgtacatagtgattcatgatgcgaaatcctctctgttgaaataactgacgaggcctctgtcttctgactggaccctgacttccatgccctttccactctcactccagtacatgcccaaaccccaatctttgttgctccaggcattgcctctgtggcgctgtgtcccctcctttgaactctgatccttctgctcaggccctttctcccagtctgaagtaaggagtgaaaaaatgtgaattgttctactcatctggaaaagagaaccctgaggcaggaacaagtcgttaattgcatgtgcgtttgtccacagctcaccatgagtcaggccctgtgctaggtgctgggatgaagcagtgactgacacaggcctggacctgtccttgtgaagagtgcgtctgtgacacagatactgtgccatgtggcaaagtaagcgcgtgggacagcagagccttgtttgccattaaagtaatatcacaagtctgttaaggttggagaatcaagtgaacatgctgaaaagttatggggaatgtagtctcatagctgggggagctgggggccttgtcaattggttcccccagtctggagagcaatctgagagtaagtagtgacactgtgtgtgctgagtgtgtctgtgggggtgtttttggataaaattaacatttgaatttgtgaactgagtgaagcagagtgcccttcataatgtgggtgggcctcattcaattagttcaaggcccgcataggaaccacctcctgcctgactgaaccgggacctacgtcttttcttgccttcagacttgaatggagacatcagctctttgtgggtctcaagtctactggctttcaatcagctcttctgcttgacagctgcaggtcttgggactgcccagcccccataaccctgtgagtgcattcctgataataaccctctttctcttgtcctcccccaccccacatcattggttctgtttctctggagaaccataatacatcatttactaatcaggaaatagattcagagacattaataactcatccaacctcacagttaactgtagagttgggcttgaaattccaaggtcgattttcttagccaatacaccatgctacatatatgtatgtaaaaataaaaacgcttgtgaactgaaa

SEQ ID NO: 85728 - DNA, 1046 bp, Homo sapiens
ctcaggcttccggtctgtttggtgccctggtcgcgtgtcttccgaactctgctgcttcgccccggcaagagcacttccttccgcggctgctaaaactggtgcgcgggttcccaacttcgcagaagcagcttcatcggccccccgctagagacctcagaccgcagccatcgacgcctcgcctcggggatctgtccccaccctcggggccagctcaccatgagtcaggccctgtgctaggtgctgggatgaagcagtgactgacacaggcctggacctgtccttgtgaagagtgcgtctgtgacacagatactgtgccatgtggcaaagtaagcgcgtgggacagcagagccttgtttgccattaaagtaatatcacaagtctgttaaggttggagaatcaagtgaacatgctgaaaagttatggggaatgtagtctcatagctgggggagctgggggccttgtcaattggttcccccagtctggagagcaatctgagagtaagtagtgacactgtgtgtgctgagtgtgtctgtgggggtgtttttggataaaattaacatttgaatttgtgaactgagtgaagcagagtgcccttcataatgtgggtgggcctcattcaattagttcaaggcccgcataggaaccacctcctgcctgactgaaccgggacctacgtcttttcttgccttcagacttgaatggagacatcagctctttgtgggtctcaagtctactggctttcaatcagctcttctgcttgacagctgcaggtcttgggactgcccagcccccataaccctgtgagtgcattcctgataataaccctctttctcttgtcctcccccaccccacatcattggttctgtttctctggagaaccataatacatcatttactaatcaggaaatagattcagagacattaataactcatccaacctcacagttaactgtagagttgggcttgaaattccaaggtcgattttcttagccaatacaccatgctacatatatgtatgtaaaaataaaaacgcttgtgaactgaaa

SEQ ID NO: 85729 - DNA, 1434 bp, Homo sapiens
ctcaggcttccggtctgtttggtgccctggtcgcgtgtcttccgaactctgctgcttcgccccggcaagagcacttccttccgcggctgctaaaactggtgcgcgggttcccaacttcgcagaagcagcttcatcggccccccgctagagacctcagaccgcagccatcgacgcctcgcctcggggatctgtccccaccctcggggccaggtcagggaccagagacctgcgacgctctccttaggggtttagttcccaggctttctgaccccagtaattccaaacgcttccctttgtttccacagccctagcgtagcgaggtgctccctgcagtttttgcttctgagatagagttctcttttcagctccttcggtagtcacttcgtacatagtgattcatgatgcgaaatcctctctgttgaaataactgacgaggcctctgtcttctgactggaccctgacttccatgccctttccactctcactccagtacatgcccaaaccccaatctttgttgctccaggcattgcctctgtggcgctgtgtcccctcctttgaactctgatccttctgctcaggccctttctcccagtctgaactcaccatgagtcaggccctgtgctaggtgctgggatgaagcagtgactgacacaggcctggacctgtccttgtgaagagtgcgtctgtgacacagatactgtgccatgtggcaaagtaagcgcgtgggacagcagagccttgtttgccattaaagtaatatcacaagtctgttaaggttggagaatcaagtgaacatgctgaaaagttatggggaatgtagtctcatagctgggggagctgggggccttgtcaattggttcccccagtctggagagcaatctgagagtaagtagtgacactgtgtgtgctgagtgtgtctgtgggggtgtttttggataaaattaacatttgaatttgtgaactgagtgaagcagagtgcccttcataatgtgggtgggcctcattcaattagttcaaggcccgcataggaaccacctcctgcctgactgaaccgggacctacgtcttttcttgccttcagacttgaatggagacatcagctctttgtgggtctcaagtctactggctttcaatcagctcttctgcttgacagctgcaggtcttgggactgcccagcccccataaccctgtgagtgcattcctgataataaccctctttctcttgtcctcccccaccccacatcattggttctgtttctctggagaaccataatacatcatttactaatcaggaaatagattcagagacattaataactcatccaacctcacagttaactgtagagttgggcttgaaattccaaggtcgattttcttagccaatacaccatgctacatatatgtatgtaaaaataaaaacgcttgtgaactgaaa

SEQ ID NO: 85730 - DNA, 394 bp, Homo sapiens
tgggcttctgtgtaacacatcttgtcccagaaccttggtgatgtgtgtgaacttacagtatctctgtcctaaataaccccagcaagggagatccaacttcaactcttaaactttgtggtgatggctaagtctttaaatcatgttaattattgtttcagaggtttttggttatcaggaacagaaaactctcatgaaggaagaaaaggtttgtaggaggaacactggggagtgcacatagctgaccacccaggcctcaggaaggaagggagcagggcagtgctagagattctggtgagaaacccctgcctctccagggctctgccaccagataaactagcttcagggcactgccaccagatgagccatggtcagctttttcctggctttgttgtgt

SEQ ID NO: 85731 - DNA, 839 bp, Homo sapiens
cttgccgtcagccttttctttgacctcttctttctgttcatgtgtatttgctgtctcttagcccagacttcccgtgtcctttccaccgggcctttgagaggtcacagggtcttgatgctgtggtcttcatctgcaggtgtctgacttccagcaactgctggcctgtgccagggtgcaagctgagcactggagtggagttttcctgtggagaggagccatgcctagagtgggatgggccattgttcatcttctggcccctgttgtctgcatgtaacttaataccacaaccaggcataggggaaagattggaggaaagatgagtgagagcatcaacttctctcacaacctaggccagtgtgtggtgatgccaggcatgcccttccccagcatcaggtctccagagctgcagaagacgacggccgacttggatcacactcttgtgagtgtccccagtgttgcagaggcagggccatcaggcaccaaagggattctgccagcatagtgctcctggaccagtgatacacccggcaccctgtcctggacacgctgttggcctggatctgagccctggtggaggtcaaagccacctttggttctgccattgctgctgtgtggaagttcactcctgccttttcctttccctagagcctccaccaccccgagatcacatttctcactgccttttgtctgcccagtttcaccagaagtaggcctcttcctgacaggcagctgcaccactgcctggcgctgtgcccttcctttgctctgcccgctggagacggtgtttgtcatgggcctggtctgcagggatcctgctacaaaggtgaaacccaggagag

SEQ ID NO: 85732 - DNA, 451 bp, Homo sapiens
tgaggtttcactgatgagaaactaaagtgtagttagcataactacaaaaaattattggatgccacagatgtcaaagaacttggagatcaattagtctggtggttcctttcctttctgaatataagtatcaatttttaatttataaacaaaacagaattatacacaaacacagagctatgtggaccccacatattagtaattgttcttttttgcatctgttgactaagacaatgcctataaactactttgaattcactacgcttttaaatacatgtctattacagtaatctcaataacatctaaattaatttgtctcacagtgacaaatgtgtggcattggctgacgtatggatttgtgtattggacaataattccaagggcctttaaaaggcaataaaggcaaaaatctcacccatctccttcatgtcctcattgcagcacaaatgagggc

SEQ ID NO: 85733 - DNA, 742 bp, Homo sapiens
cgtggtggtgtgtgcgtgtagtcctagctactcaggaggctgaggcaggaggatcgcttgaacccaggaggcagaggttgcagtgagcagagatcgtgccactgcactccgcctaggcaacagagtgagactccatctcaaaaaaaaaaaaaattgtaatcacaaatgtcacacagacttataccctgctgtagtcacctaatcttacgagaagtcttttcccatgttgtatggtctatgttagttattctcataactgttcaacagtccccacagtgggtatgtggtcaggtaattagcccctgtgttattgaacaccagaggatttcaaggctttcactattactaataaagctatggtaaacatctctgtatgtatagcattattgtcattcaagcttctttctttagactagattctcctaaagcacagggatacgaggtgcatagctcttggtgtgtattgctgaagataatgataaaaatgtagtgtcattggctgtgtaggaaaaagccaatgtctttgcatttgcccacattgttagttttaaaaaatttttggactaatataagaagtagaaaaaatggttagtcattattttaatatattttttaactagttgggttaagtaaacgttttctcatagatttgtttattatttgcattttgtcttctgggaatcatttcttcacgtatctaaaaatatttttcttggcaattagtatgattacattagattaa

SEQ ID NO: 85734 - DNA, 476 bp, Homo sapiens
aattcggcactagggaagagagaatctgagaaaagcacagtgtttcccataaactgaagagaaagacatcaaagttctaggtagctgaaatttgcagggcaataccataagagggagctatttgtagaatagttctcaaattttgtgtaagcatcccctcatgtctttggctgactattaagttgcttatgcatagggtgaactccacaaggtctgacacaaacaactgccaggaaaagaacagctaattaggatgtaaaagggaaacaagtatgggagtatgtgcagggtaaggagacatttgcattttgaccagttggagaggagaggtcttgttgagcttgttaaacaaattcatgaagattccagtaaagataatttatatccagaagaaaagttgatcaatagaaacagaccccaaaatagagttaacagaaaaagacatttaaacagtgattataaatatgttcacgtat

SEQ ID NO: 85735 - DNA, 311 bp, Homo sapiens
ttttttttttaaagactcaaggtaatgaaaactatgagtagaatagtaaggtgtgacaggggacaaataagtagatataaaactatgctgcaatattctagttattaaagctgggaaatatgcaaatgtaagtagtgcttggaaccagagaaggttctatatttagctgttcttctgtagctaaatctgacaaattgaaaaatatcatattctctgctctaggtacattttatgtatattttgacagcatatcaaatatatgaaacattaggttaaataaattaaaatccagtggaataaactatatggga

SEQ ID NO: 85736 - DNA, 421 bp, Homo sapiens
gcatcccagcctctggctgctgtcactgcaagtgctctcatcccctgacccagcagggctttgggctgttgttactttgtcatggtcgttctagcagctttggaaacctcttcaggttaagagtcttgcataagtgagagtgggagcatggccctcagatatttggccacatccttactggtgtgttacagagacccaggaagaatgtagttgaacgaggacacatgcaggtgtcccgggccctgaacagcttctattcagagtttggcctttcgaaggctgtgccatctcaggtgtgcctgcagtgtgcagcaggtgtatgcagcttcctctttgcaggtttcttggtatttaatctcatcctttaatatcttctattaactcaaaggaaattctgttcttagtttgaagtctgagagag

SEQ ID NO: 85737 - DNA, 367 bp, Homo sapiens
tattattcataaccttattgataactggccataaatggcccataaatgtttgcttatactgtttaatatattatcctaaaaaaaatcactcaatttttaatagtttttttaatgtgttggctgacagtctatacattattttggattaaatgaagagaattaacctaaagaaatcaaaatctcaacagcaatgactgatttacctattataaaagttatccatgctttttgttgttttattcttaaatattctattaacttgctcattgtattatttgtactttatattgatgaggatcaataaatgttacttgacagtactgatgtacaatttaataaaattgatttatatattttcatctgcttt

SEQ ID NO: 85738 - DNA, 345 bp, Homo sapiens
acattttttctaggctcctttattttcatgccaattgtctggatactggaatttaaaaaaaacctcaatagatttccagcatctggttattgggcctcccctttcttaagctctaggattaaaatgttcttcacttgctattactaaaaattaattctcttaagttattttaaaaatgtttgaaggaaaatatagccctgcccttttaaggattaaaagccatttgtttcagcagaaaaaaaggttgtaaaaatcccatatgacaaaacctgtagtaaaaaagtgatcctacataagtctttgcaaaataaattctacccaacagagtagtttagaggacgaaat

SEQ ID NO: 85739 - DNA, 356 bp, Homo sapiens
caatcatttaaccctaagaaatagaagtattaggaagagaaaacatagtccttattttgagcagtgtgattgtagagacaaacatccaagagaaacagttgaaaaactattagaaatgacaaaaggtagttttgtttaatagttcaccatgaaaatctgtactatatagaaaatctgtatatagaatatagcattggccaattggaaatgtaatttgaaaatcccatttgcagcaaaacttggaactgtatactgtctaagaataaacaatgggaaaaatgcaaaatccttatgaggaaaatgatacattttaatggaggaaataaaatgcctgaataaacactgtgttcctgtct

SEQ ID NO: 85740 - DNA, 2231 bp, Homo sapiens
  misc_feature (114)..(114): n is a, c, g, or t
  misc_feature (258)..(258): n is a, c, g, or t
  misc_feature (276)..(276): n is a, c, g, or t
  misc_feature (694)..(694): n is a, c, g, or t
  misc_feature (707)..(707): n is a, c, g, or t
  misc_feature (1103)..(1103): n is a, c, g, or t
  misc_feature (1158)..(1158): n is a, c, g, or t
  misc_feature (1378)..(1378): n is a, c, g, or t
  misc_feature (2056)..(2056): n is a, c, g, or t
  misc_feature (2206)..(2206): n is a, c, g, or t
cgagctcgcgcgcccgcgggtggacacttgtgtatccaaagatttcggcacgaggagagagagagagagagagagagagagagagagagagagagagagagagagagagagagngataaattctgccaaattttcaaataattatccttaagctttcacaaagattttttaaaaaaataaagggcaggggatacttcctaacaccttctataagaccaatattaccctaatactaacaccagacaaagacaacagggnaaagaaaataacagaccnatatccattgtgaatatggatgtacaaatcttcaacaaaatactaacaaattgacttcagtagcatatgaaaatgattatctgagggatcttcaaaagttcatggaaaacacatatgagaagagaatgcatggatttcaattttttgcactaaaatgaacttgtactaacttataacatgtctgaacaagatctagattgaggcactaagaaagataaggcatcagtttgaaaacagcccatatcagagcgacatgaattttgttaaaattgaagcaagaacaaacatcacatttgtagtgaagcttgagttggagaatggtgaaatcactggtgctttacaaaaagtttatggggacaacgccccaaagaaatcagcaatggataactcattttaagaaaggatgagatgatattgnatatgaagcctanggtggcagaccatccacatccatttatgaggaaaaaattaatcttgtttgtgacctaattgaagaggatcaacgattaacagcagaaacaatagtcaatgccataaacatctcagttggttcagcttacccagttctgaccgaaaaattaaagttgtgcaaactttccacttgatgggtgccaaaaccattgtgcccagatcagctgcacaaaagagcagagctttcaaaggaaattttaaacaagcagagtcaagatcctgaagcatttctttaaaggattataacaggagatgacatatagttttaccagtatgatcctaaagacaaggcacaatcaaagcaatggataccaagaggtaaaaagtggtccatgccaggtgcagtggctcacgcntgtaatcccagcactttgggaggccgaggtgggtgggtcgcttgaggccaggagnttgagaccagtctgggcaacatggggaaaccccatctctactgaaaacacaaaaattagccaggtgtggtggcacatgcctgtagttccagctgctcaggaggctgaggcaggagaatctcttgaacccaggaggtggaggttgcagtgagccgagattgtgccactgcacaccagcctgggcaacagagtgtggctctgtctcaaaagacaaacaaacnaacaaacaaacaaaaaaagtggtccagtcaaagcaaaagtgaactggtcaagagcaaaggtcacagcaacagttttttgggatggtcaaagcatttacttgtttactttctggagggccaaagaatgatagcatctgcttattatgagagtgttttaagagagttagacaaagctttagcagaaaaataccaggaaagcttcaccagagagtctttctccaccatgacaatgctcctgcttattcctctcatcaaacaaggtcaattttgtgaaagttctgaagggaaatcattaggcatccatcttacagtcctgatttggctccttctgacttcttcctatatcttaatctttaaaaaatctgtaaaaggcaccaatttttcttcagttaataatgtaaaaaaatggcattgacgtcagatttccaggaccctcagttctctagggatgaactaagtggctagtatcatcacttacaaaagtgtcttgaattgatggagcttaatgttgagaaattagtttatattttatattttttaactccattttcacaaacatttgaagtctccttgtacatcactaccaagtggagtttattccagaaatgaaagattgatttgatatataaaaattaatcaatataatattaataggataaagggaaaaaaatcatcatntcaatagatacagaaaaagcatttgacaaaatccagtaccctttcatgatttaaaaacacaccagaccagaaaaagaaaggaaattcttcaatctcataaaggtcatctttgaaaaacccactgctaacattatacttaatggtgaaagnttgaaaatttctccctagtatcatg

SEQ ID NO: 85741 - DNA, 321 bp, Homo sapiens
gagcccacagatccaactccctaggccaaggctgcagcctggggcagagatgcagaggcctggaggagcctagggcacgcggcctgcgggctggctggggttcagagttcgtatgtgtgtggagtgactgggcaggtgttcagaaatgaaggctggcactgccaggtaaggcccttccctccctgatgtgagagccctggagccaccgcagaggcccagtcagatctctgttctaattctggcctggtgtggaggatgaggagagacggcccagaaaggaaggcagactgtgcagaccccatgtcttctggcccgcgaggc

SEQ ID NO: 85742 - DNA, 756 bp, Homo sapiens
atttttattatgacatttatttgtattacaaggaaccaatgttctaagggacaatctctgataaatgctgctgtgtggcaaataaatgctgcagttctgaaggtagaaagttgagcagtaactgtaacccgttttaagtgtacccaaggaaatgaataagagacacatctcaaaggttctttttgtttctttatagaatgaatattaagtacttttcatgagtttacccaagagtaataataattctagattttagccctgtgaggccaattaaagataattttgattattaatgtttccttctcattttttttttaaataacaaagcatcataaagaaatcccagtcaaaaaaaaatgctgctgcctggaaaacatagtgaaaccctgtctccatcaaaaaatattttaaaattagctaggtgtgggggcatgtgcctgtagtctcagctactcaggaggctgaggtggcaggatcacttgagcccaggaggcagaggttgcagtgagctgagatggtgccactgcattctagcctgaacaagagtgagaccctgtctcaaaacaaaaacgaaaaaaacaaaacaaaaaaccatgcttatacagaaatgggaaaatgctacaaagatattgccatagtactgaaagcacacagcataacaatcattaatgctttgaagcattttaaaaacagtaaggggaatgtcaacataaaaaagaacaactacgaaaaggtgagaaacgatcaagttatctc

SEQ ID NO: 85743 - DNA, 462 bp, Homo sapiens
gtgcactgtgagtacagcgtgtatgtgaacatgtgtgaatattgtgtatgtgtgagtacatgggtgtgtgagcatgtctgtgattacgtgtgagcacatgggtgtacgcgagcatgtgtgtatgtgattacatgtgtgacacatgggtgtgtgtgaacacacgtgtgtgattgtgtgtgtgagcacatggttgtgtatgcattcttcctccaaggtcatctccaagcctcacctctctgctcccactcccatcactcactctggcactctgatcagcatccagtggtaaaggtctaccctaaatagttatggatatggggtccttagtagtccaagttccagagaaaggaaagtgacagctgaggtgtcagggtaaaaagaaggaaaaaaaaatgccgggcatgtaactcacattttattctctctctctctttaagaatctggcagagagctcatcttcct

SEQ ID NO: 85744 - DNA, 693 bp, Homo sapiens
agaggctctgactccccacacagcaaaatctctgtatataacttttgactcctccaaaacttaactacgaatagccttttgttgaccagaagtcttactgataacataaacaattaatacatatttttcatgttatatgttttatatgctgtattcttacaataaaataagctagacaagtgcaaacattaagagaatcattgggaaagaaaatatatttactaagtgtaagtggattctcataaagatcttcatcattgtcttcatgctgaggaagaggagaggttggtgtggctgtctcgcagaggtggaaggggcagaagaggtggggagatagaatgggaggcaggataggcaggtacacttggtgtagcttttattgggggaaaaaaacacatgtgagtggacccatgcagttcaaacttgtgttgttcaagggtcaactgcagcttttcttgattctaaatttagatataatttaccaattcattcatttaacatttattgactgtctacaaagctccagagactcaggtaggctttagagataatagtggggagcaagaaacacataagctcttggggcttattttaaaaaagaataaagtaggtaaagagtgactgtgatgaataattcaaaactctaaagtttctttagttgatatgactgaatttaattttagacaatcacat

SEQ ID NO: 85745 - DNA, 330 bp, Homo sapiens
cctgggcaacaagaatgaaactctgtctcaaaaacaaacaacaacgacaaaaaacacaaagatgacaacaggctgaaactggagggaagagtgacgtggaggagactgttgggtgtgttccttaaaatgcccaacacagtgctcatgtttataatcccagcactctgggaggctgaggtgggaaaattgctcaaagccaggagttctaggccagcctctatgggcaacatagggagaccccatttctacaaaaataaataaataaataaataaaaattaaaaattaaccaggtatggtagtagtagttctagctacttgggaggctgagg

SEQ ID NO: 85746 - DNA, 697 bp, Homo sapiens
gagccactatgcctgccccagaacttcttttttattaaaaaaaaaaaaaaagttatattggcatattttgcacattatttaattcacctttttaaagtgtacaattctatatatttttaaaattttttgtccagatgggattttgccatgttgcccaggctggtcttgaactcctgggctgaagcaatcctcctgcctcggcctcccagacggttgggattacagatgtgagccactgtacccagtctggttcttttttatagtttctgattctctaccaaggtatcctatctttcattcattgtgacagtatcttcttttacattgagcgttgttatattagttgcttacgaatcttgcattctggttgggtgcagtaactcaggcctgtaatcctagcactttgggaggccgaagtgggaagatgtcttgagcccaggagtttgagaccagcctgggcagtctagagagaagaccccacctccacaaaaaataaaaaattaactgggtttggtggtgcatgcctgtggtcccagctactcaggacgctgaggtgggagaattgcttcaacctgggaggcagagattgcggtgacccaagatcgcgccattgcacttacagccggggcaacaaagagtgaaacctctgtctaaaaagaaagaaggaagagaaaaagaatgctgaaaacatcatgta

SEQ ID NO: 85747 - DNA, 119 bp, Homo sapiens
gcaatttcctgccatctctgactactcctcagtgcacctctcagaacctcatctcccccagatcacaagcactgacatacatttcagtcttctgtcacagcatcactcacatccagcag

SEQ ID NO: 85748 - DNA, 509 bp, Homo sapiens
aataatgagtatttcagtatcagtaaaaggtcctaaggaagaaaatgtagaagatatggctagaaaaataatgttctagtaaaataacatagtatttctatgtaaagaacatagtatttcaggcttagaaatttcaatttaatatggtagataggaggcaactataaaatcttctaaagcagagaagtaatataaccagctccaattcatattcatggaaaagtataaattcatcaggatgtacacagatttagctacaagaatattcattaagtaattgtgtacataccaatatcagaagcagtttatatgtttgacaaaagggaactggttaagtatgtagctttttaaaaaatgtatgctatttaataatgaaataacctaatgaaagtttaaaaaatggattataggccgggcgcagtggctcacccctgtaatcccagcactttgggaggccgaggtgggcggatcacgaggtcagaagatcaagaccatcctggctaacatag

SEQ ID NO: 85749 - DNA, 238 bp, Homo sapiens
tcttccatcatcatcatcatcgtgaaaatcccccagctaccccaccctctactcggctgccctctctccttccagtcttctggaacttactgcttaaatagtcagtttctgtcctgaccctcctaacccattgctggctgccttctgcttcttccaagccactggaagaaaatctcagtcatggttgaaccctcagtgtctagcgtagagcctggcccaaagcaggctgagtcagcac

SEQ ID NO: 85750 - DNA, 341 bp, Homo sapiens
gaaaaaaaacaacacacacacacacacgcaatagaaaacttgaaggcatcttccttttccaatcccagtaaacacacactactcacagcattggtgatttcaggtctttgtagattctctccccactttcccacctaggagggaaccacccacacttatggtagtctcctcatgccctgggaaggacctgaagaagcacttacttccctttccaaccactttctcatttttgcccagggaaagagcagtagcccatctggcccattggtccctgttttctggtgggtggtggtatcacctgttccacttccacatcttcttggagcacctgcatttggggg

SEQ ID NO: 85751 - DNA, 504 bp, Homo sapiens
tctataggctggaagactgcatcagggggaaagagtgaggaagacccaccccaccacctctgggagagctccagggctattcactaagcgaaaaagcaaacggcagaacaagacaccctagacaatcccatttacatgaacatacataaaaccaaactactaatgtttatgtgtacacaaacattttgtaaatggtgggcaagaaaggtctggcagaagcaaactcatcctgaaacagtgggtacctctggggaggaatcagaattgggatgtggggatggtggggaagtaaccaagaagcctgttactgcttatctctagcaaggatggctaagaacacagattctggaatgtgggttcaaatcccagcaccagccacgcgcggtggctcatgcctgtaatcccagcactctgggaggccgaggcaggtggattacttgaggtcaggagttagagaccagcctggccaacgtggtgaaaccccatctctactaaaaatacaaa

SEQ ID NO: 85752 - DNA, 111 bp, Homo sapiens
gatccatactttttgggctcaactcagggttaccaaaatagagtcaaactcaactcaggattacctaaatggagtcaaattttgtgtgtggttttgtaacatgattctttc

SEQ ID NO: 85753 - DNA, 516 bp, Homo sapiens
aaacacccatagcttccctgtctgtccatttcgtgagctcctcattaccttccatgactcacttttccatgtgacacggagcctccctggcttccactgctgatactgaccattcctttctttgttctctatgctgccgtggacacagagccaccatcgctgttaactgtactagagtctttactttttttttcttttgtgagcctaagccttcctcaagacaagaatctttgttttgtttaaaaaaagaatagccttaatgtttttttttctgattttaaagtgaacaccctattgtagaacatccatgtaagcaaaaagaaaaaaaataaaaatgatttgtaatttctccaagaaatgacctgtgttgacatttcagtgattatacttccaagtcttttactaaatgtgtacgtaaatagctttatttttgtgtgtgtaaaaatctgtagcctctgtaaacaagccaaatgtcatatacaccccacacaaaacaataaaagcaaaaatcaccag

SEQ ID NO: 85754 - DNA, 453 bp, Homo sapiens
ctccctgaagacaagaactacatttcatttatgactgggtctttaacacataccagaagtcccgaaatacatgattggcactatgtaaccatgggttaggcggggcacagtggctcatgcctgtaatcccaggactttgggagactaaggtgggcggattgcttgagttgagtttgagaccagcccgggcaacatggtgaaacctcatctctccaaaaattacaaaaattagccaggcatggtggtgtacatctgtagtcccagctactctcagaaggctgaggagggtggatcacttgaaccccggaggtagaggctgcagtaagccaagatcacaccactgcactcctgcctgggtgacagagtaagaccgtctcaaaagacaaaaacaaaaacaaaaaaaacaatgggttaaaccaacgaattaacctagtgccaggcgaaccaagctga

SEQ ID NO: 85755 - DNA, 847 bp, Homo sapiens
gaccatgtggtcgctctgaactctcttcatttcagccatctcacaggccattttcactacccttgaaacttcactttccacatatccagcttgaagagaaaagatttctaaaaggattccatgtgtatttaggccttctccaaccatctgccttatgaggttcacccatttccaaacaaaggttttaaatacggtgactgttcttggatttgcaagaatgtacaaccagcaggtccccttttgcagtaaagggcattatacttgaaggggcatactcattttttcctcaggtcagaggcagagggaagagttaacagtgatcaaatagagaccttcatgtgtctgttttttgtttttgtttttaagttcatttaagggtgatgacggagaaagaagggagtaaaaatgatgcgcgcacaaagaaatttttcccattgcttgccagattcattctttttaggctacccttactccagtccttacctacaccctaaagaactgtatttagctagcaagagaggcattctcaggatacgtgagcttccaggcatggactaacatgtggtttcaaatcaatagtgtattctaacagaaaagcgttacttaatcttaattctccattatgtgataaaataatctatagaaataggtatcactttggccagttctgtgcatgtagctgaaaaaaaaatgtgacacatttctgttgtatgatttgctatgattttggtttcctgagacatttgttccctacagtcttgaatatgaaattctgtgtaaataatatgactatgcatttttgctgaaaaacaaatgtatgaaataagaataaattatttgtaagcac

SEQ ID NO: 85756 - DNA, 359 bp, Homo sapiens
gttaaggatttaatgagatagtatacacaaaaaaacaacaaaaacatagaacataaaagtgatgctgttggtagcactgctgttatccatattggtgccttctaacagtctcagtaatcatggaaaaacacaatgagtttcaatgtaatggctttgtagatatgtctaaagtttttatattgagcatatttaaattatgatgattatataaccttatacattaattttatatatttataaaatattgctcaattaaattcatgcttagaagtatcttatttttttcttttaatatttagctttgcatgtatatgtaattcatttaattatagaaagcattatcctgtggcatcatatag

SEQ ID NO: 85757 - DNA, 2573 bp, Homo sapiens
tgaaggccttagaatccagaggggccgattaggcaacaccaggggataaacaattgaggtcacactgctcggcatgggcagaagcagctcttcaggagctgtccacacttcaggggtgctcagactgactgctcctaagaattctgctgcatatatttttagccccatctcctgccactgctgacagatattgtgacagtaagtagcagacaggactgtggcttcacctcctccgggcacctggctacagtgatgagtcagttcacctgatgacaaaccagggtctggccttgccaaagcacttaagttctcatgacctggaccgcactggaggccctggctaagtcaggatgtcgtagcctcttcttggttttgccccttggccttgaaattcttttttcttgaataactttaaaaaaatagagataaagtcttgctatgttgcccaggctggtcttgaatgcctgggctccagcaatctttttgcctcaacttcccaaagtattgagattacaggtgtgagctaccatgcccggccttgaaattctttcttcgctatgtctgcatgttttttgtgttctgtatttatttcttctccaaggaaacagcctacattttccatgtgtccatgtttctgaggccgtgggtgacagtgggaattgcactaatgggggcccagcaggcctgggggctggtcttagcgctagaccttgaacaaggcacttcacctgctggtctccaattttctcctctgtaaaatgaaagagttgaactaagtgatctcaaaagtttcaaccagcccgataattccttaattctttaaaaatttaactttatatatctttattattctttaacctcatctttgttacactaatattagtcactaatatttattgagtgtttactacctgacaggcacagtgccagtttacattttaattttcacatcatttctatgatgtgggtactcatttttttaaagctttatgaaggtataatttacgtactataaaattcacctgttttaagtgttcagttgaatgatttttaatttacatagtggtgcaaccatcaatgatgtgggtattcttaccccaatttaaaagataagaaggggcagtgttaagtaattgacccatgattccacagctagtaagagcgacagccaagactccaaacctggttgatgctcttaaccactgtgctatgccgcaggtaggcagacttcattactgccttatcctgaaaccctttgcacagtttctattactgatttctatgtagatttgaatataacaaatttaaatcatgtccttggtaacagaactgatcacagccaaaaaaaaattcaccaaatgggtttattctgtactccaatataggtgtcttcccaggtttatatccttggcttgagaaaagggttgtacaaatagatgattgcagagtttccacatccttccagatacctctgcctctaacagtcacactcttagtaagggaagttgtttgatttacttcttcccttaggttgattacaagtgaagtgcgccgtcttattcctttttcattgctggagcacaaattgaattgtgcccagaccgtatctttctcacatgaaacctggatctcacctatcccttccatgcctgattcccgtgtttgcatattttatttccacatttacctcttgtcagccctgacagagaatttggcaccccttcaagcttctcctaaacaatctatccacacaaacacccctgagcaatatggacttcactgaagatagtgtgtaagcaaaggagaagagttcacattgtgcatcctattagacattttgttctcagaagtaccttactggccaaaccaatgaaggttttcctcttgtcctcccctctcaaggctcagtcacctcaacttctttttgcctactagatatccaatccatcacctcgcctcccctggccctagctcaattaccctcttaaacccattcctgctcagcaaaacttcctctagttcaccattcattcatttgaacattaggaggcaatttagtgacctgttgtacctgaccatgttcttaagggggaggtctcacgtctcattcccagaaaagtctaccatatatagatacatattccccgccccgccccagatttctggtgaatgaaatcacttgtatcttattaggtacatatacgcaaatccttaacctcaattctctgtcctcttcatgtcttacccagatatctcaggaagatttctcttttccttctgtttgcctccctcttcgacttacttgggagtcagcatctgaccacagtcgtgactggtaatgatgatttgtgcaaatactatcaaggaaaggacatgaattgtcttaattttagacccattaaaaaaccgcacaggcctcaatcttaaaagtcctatctaaatacccagaaatacccttcagaatttttgaagctatgcccatgtacaaaattttcttccttccctaattttaatggtatactaacaccttaggtaaataaaatatttctttactattttattgataaaaaaaa

SEQ ID NO: 85758 - DNA, 644 bp, Homo sapiens
tgaaggccttagaatccagaggggccgattaggcaacaccaggggataaacaattgaggtcacactgctcggcatgggcagaagcagctcttcaggagctgtccacacttcaggggtgctcagactgactgctcctaagaattctgctgcatatatttttagccccatctcctgccactgctgacagatattgtgacagtaagtagcagacaggactgtggcttcacctcctccgggcacctggctacagtgatgagtcagttcacctgatgacaaaccagggtctggccttgccaaagcacttaagttctcatgacctggaccgcactggaggccctggctaagtcaggatgtcgtagcctcttcttggttttgccccttggccttgaaattcttttttcttgaataactttaaaaaaatagagataaagtcttgctatgttgcccaggctggtcttgaatgcctgggctccagcaatctttttgcctcaacttcccaaagtattgagattacaggtgtgagctaccatgcccggccttgaaattctttcttcgctatgtctgcatgttttttgtgttctgtatttatttcttctccaaggaaacagcctacattttccatggggaagaaataaaaaaaaaaa

SEQ ID NO: 85759 - DNA, 373 bp, Homo sapiens
gctctattaaacaataaaggtgagtgtttatgcttagatgttatgacaaacttcttatttgcagacctaagttttccaaattctgaaacataataaaagtttgttgtcacttgaaaacagacagtaggatttaagttttatctttctcccggatcacctgagatcaggagtttgagaccagcctggccaacatggcaaaaccccatctctactaaaaatacaaaaaatcagccgggtgtggtggcaggtgcccgtaatcccagccactcgggaggctgaggcaggagaattgcttaaacccgggaggaggaggttgcagcgacccgagatcgcaccactgcactccagcctggagaagagagagagactccat

SEQ ID NO: 85760 - DNA, 360 bp, Homo sapiens
  misc_feature (87)..(87): n is a, c, g, or t
  misc_feature (182)..(182): n is a, c, g, or t
atggcaggcctgatgaccatagtaaccagccttctgttccttggtgtctgtgcccaccacatcatccctacgggctctgtggtcatnccctctccctgctgcatgttctttgtttccaagagaattcctgagaaccgagtggtcagctaccagctgtccagcaggagcacatgcctcaaggnaggagtgatcttcaccaccaagaagggccagcagttctgtggcgaccccaagcaggagtgggtccagaggtacatgaagaacctggacgccaagcagaagaaggcttcccctagggccagggcagtggctgtcaagggccctgtccagagatatcctggcaaccaaaccacctgctaa

SEQ ID NO: 85761 - DNA, 420 bp, Homo sapiens
tagtagagatggggtttcaccatgttgaccaggctggtcccgaactcctgaccttgtgatccacctgccttggcctcccaaagtgctaggattacaggcatgagctaccatgccgggccagatcactttctttttatagtgaattcaaaacaatgaacactatagaaagtcatccttttcagataaagccaatgaagttttagaaattttcattaaaaatcattctacattgactgcatttttgatgtttgacttgtgaattgtttgaaaagcattgatatttataaaaagtcttaggaaaagtaaggcctgaagaccttccatagaatgagacgtagttgcatattttatgattaaactagcaataatgatgactaatcttcaaaccctgctatttgccattttatagatttgaaaact

SEQ ID NO: 85762 - DNA, 420 bp, Homo sapiens
gagcccctgccctccagaagctcacatcctcctactcatggcagacaaataaacgtgaattacactgcagggaggtaagtgtggcagcagatgtagtatgcagtgcagaggtggccatggttgcgagggcaaggagggcttcctagcatgggcgttatttgaccagaggtctggcggtggcttttgctagcagtgtgattgtgatctgagccagggacagatacctctgtgagccttggtttcctcatctgtaaagtggttaaagactgaataaagcaaaatatgtgcaaacagtctgtgaatggggaagtaacagatgttgctttctattatgttctctcctagccatgaatatcaattattacagaaatgaaaagggatcctgcacccaaattcaaatcaagcaagttcacctagagg

SEQ ID NO: 85763 - DNA, 369 bp, Homo sapiens
attctttggtggataaagtgcttaatgaatgcttcttatctctgtgaagtattttaaaagagactcatatacaaccaaaaaaaaagagtcttgaattgtattcacgctagtggaaaataagcttcatccttagccaggcttaggctacttaaggacattggagactcaaggggatgggatgtgctccacgcattccagcaatttgtaagatgctctgggagtattccaattgtgcctttatattgatgaagctgaccaaattatttaccatggcttttgtggaggctgtgcaattgtttatccatattttaaaaagtgctaattgaaatatgtttatctcatgatattgatataaagtaatataatatg

SEQ ID NO: 85764 - DNA, 423 bp, Homo sapiens
gattaggacgtcactcagcgacctgtgtcttcagccctgtcctttctattcctctgaccccgcctcctttctaaatgcagcgacctctgttcttcagccctatccctttctattcctctgaccccgactcctttctaaatgcagcgacctgtgttcttcagccctatccctttctattcctctgacccgcctcctttctaaatgcagcgacctgtgtacttcagtcctatccctttctattcctcttccatagcatattctgttccctcccctcgctctctctgaacagacatggaagagagtgaggggagggaacagaatatgctaaggaagaggaataagggcgtgtgggaggtttggggagcagcaccaagtacctgctagataggaggctagattgggcctcaggtgggaattggggtg

SEQ ID NO: 85765 - DNA, 464 bp, Homo sapiens
ttctctggcatggacctggaacgagagtttgatattggtagtggagtttgggcatgggctttctgaatattgtgatcataaataggtcttattaaaatgagttcttggctgggtgtggtggctcacgcctgtaaatcccagcactttgggaggccgaggcgggtggatcacttgaggtcaggagttcaagaccagcctggccaacatggtgaaaccccatctttactaaaaatacaaaaagtagtcaaggtggcacgtgcttataatcccagctacttaggagactgaggcacgagaatcacttgaacccagggggtggaggttgcagtgaaccgagattgtgccactgcactccagcctggatgagggggcaagactctgtctccaaaataaaagagttcttcatcttcatgacttttaatagggatcaaaaccaaaactatttctagccagtgtaactacag

SEQ ID NO: 85766 - DNA, 307 bp, Homo sapiens
tttttgtatttttggtataagacagggttttgccatgttgcccaggctggtctcgaactcctggattcaagcaattcctgcctcagcccctctagtagcggggattacaggtgcacgccaccatgcccggttaatttttgtatttttagtagagacggggcctcaccatgttggccaagctggtctcgaactcctgacctcaggtgatccacccacctctgcagtgggataattaaggaatcagagagaccgaggggttaaggtggaattatttaattatttaggtgcactgacccagtgggattca

SEQ ID NO: 85767 - DNA, 305 bp, Homo sapiens
gtaggtggacatgtgtttgggtctagcaagtacagagaaaacaggaatgctgcttaacatattgcaatgtgcagcacagcttctctcaacaacgacaacaaaaatcatccagcataaaatgtccataatgctgaggctgagaaaccctggattataattatgactgtattttacatagtgaggaagcacacaagaaactatctatataattaacatcaccaaattactttgtccgataagaaaaaaaaaatctaggccgggcgcggtggctcacgcctgtaatcccagcactttgggaggccgag

SEQ ID NO: 85768 - DNA, 507 bp, Homo sapiens
agggcccgtgggtctaggatctagacctctaggaggagcaacctggatggctattgctgatgtttgatggagtgctgtgaaactggttttgcaagcattggaaaactgcaactggtattgactattatttaatggaatgaactaccaccaaagaaaagaagcacaccctggggtgtttttgtcagcaggaacctcactaacagatacaggaaggagagtgtccattgctcttccagtcatgcagcccatttctccagtgcctcctattcgctgagccaaacggagccagctagcaaaggagaaatgtggtttgcagagtccttgctcagcatcctcaaacagactctagtagtatgggtttgaagctgagagacagtattctaataaccagcacaatatacaatatgttgggatgataagtagaatattgcttagtatgaatatgaataatctcattattctgctcaacttggtgaggaagctagaaagttttaaagcacagttctc

SEQ ID NO: 85769 - DNA, 172 bp, Homo sapiens
ctgtccctgccctgacagggtagaacatgaagttgccactgtcactcctctgctcccccaatatgagttcaggaggcgctgtctgcctctgcttttgcacccactcgcctgtccaggggagaccagatgggcaacataggaagacccggtctctacaaaaaataaattaaaa

SEQ ID NO: 85770 - DNA, 572 bp, Homo sapiens
caaagtgctagaagctctgagccgccacgcctggcccctgcaattctttaaaaaaaatgatggtagggtcccaggcccagataatctgacttcactgtgattaagccgggtggggacaggcatcagaggtttttctacttccccatgtgatgccactgtgcagccagcacgtagagcagctaggcgtgaggacccacacagaggatgctggaagcagctggttcatctgccaggagaatgcagtatcttgtgaccaagaagtgggcttctcccagggccacttctaaaccacctcatcagagagctcaggttcatatccgagggaagaaactgaagtgctttctcacacgcttccagcttgatgagaatcacagtagggagctttgcttttccaaacaggctttgtcacatgatcatggaagaaaggagatgcccacgtaagatcacagagacaaggtgaaaaacccgtagccccgaattggaattggaagcatcagtatgaattcatgctatatttttgtcttacaaagtaaagcaggtgtttgctagctctgtcaaccataaagtttaga

SEQ ID NO: 85771 - DNA, 1332 bp, Homo sapiens
  misc_feature (832)..(832): n is a, c, g, or t
agggcagttgttgggctcaccctattcctgtctctcagggatcactatcctgcattgcctgataaccagtgtcttgaaaactgtcctttcatatgttttaattttttgttttgttgtttttgttgttgttattgttgtgttgttgtgtcctgggagggtaaatcttagatattctcccatgcctttaaatatgttgtctccactgccaggaacagccagatcccttctcattggctaaattgtcctaactcagcatcactttttccaagaagtttcccctggcattcagcctcctctctcccacccagatgctagaatggcaccccttgccggttctcccctcatggtactctcaccccagtgtaactgaatgttttcttctctgtgatcaccattaaaccacaagagtcctgagggcagagtcctttgtgggaattcacttcactttgggaactgtgtacccaacatgtagagtttagagaaagatgcagctgtgttcaagattaagttgagaaagtaatcgcatccttatattaacaactattttggattcagtcattttgtacaagttaaaaatgtttaatgggaaaaaattaaaactgaatttaataaaaattgtatttctgaaaaagaagctacattttattttgtaaagaataaaaatggtcacttctggggaagtttacctcattaggaactcaaagttgctaagatgctgcttccgttgtctgtagaccttctggtccatataaccatttatgtgtagtcagtcttaaatggaaggcttagggacactttataagacaagatcctctaggtgctagtcacttcnttaaaaaaaaaaaaaaatgtaagggctgggcgccgtggctcacgcctgtaatcccagcacttgggaggccgaggcgggtgaatcactaggtcaggagtttgagaccagcctggccaacatgatgaaactctgtctctattaaaaatacaaaaattagctgggtgtgttggtgtacacctgtaatcctagctactcaggaggctgaggcaggagaattgcttgaatccaggaggcacaggttgcagtgagccaagatcacgacactgcactctagcctgggcaacagagtgagactccatcttaaaaaaaaaattttttttaaatgttggttggctctagcctagcatggtggctcacacctgtaatcccagcactttgggaggctgaggcgggcagatcacctgaggtcaggagttcgataccaacctggccaacatggtgaaactccgtctctgctaaaaatacaaaaattagctgggcatggtggtgggtgcctgtaa

SEQ ID NO: 85772 - DNA, 424 bp, Homo sapiens
gatgccttatttagtccatttggtgaggtaatgttttcttggatgtccttgatgcttgtagacatttgttgatacctgggcattaaagagttaggtatttattccagtcttcacagtataggcttgtttttagccatcctttttgagaggactttccaagaattcaaaagggattgagtgttgtgacctaagcctatggtcactgcagccatttcagcactagagagtgccctaagccccggaatgctgcaactcttacagactccttgatacacagctttggtagattttgggaaaataagggagaattccctgggttaccaggtaaaaagtctctcccacttccctctctttctggcaaaggaagtcagtctctgcaccaggctgcctggagttgggggagggataatgcggtcactctaat

SEQ ID NO: 85773 - DNA, 349 bp, Homo sapiens
acccaaggagcttttaaaaacacagatttctggtttgggaaccagagctttagagtctatccctcgctagactctggccaccccacaagataggtctatcttcagaccttcagataggtctaatttgttttagcagtttatttcctctgtatttttttgtcttctccgtagtctccaacttcagtgcacaaggctcataaactcataaagacttctacagccttgcctcgaactgtccttatatgcttctgagccccgtattctactcttcaatctcttctcttcgactcttgtttctgtcctgcttctccttttccctctgaggtatagagcctaaaattgatttcaa

SEQ ID NO: 85774 - DNA, 821 bp, Homo sapiens
gcgtggtggtgtgtacctgtagtctcagctacttgtaaggctgaggtgagagggactgcttgagctagggaggttgaggctgcagctgcagtgagctatgatcgtgtcactgctctccagcctgggtgacagagcaagactttgactcaaaaaaaaaacccgcaattctagcaagttgtttaaaacatttgaatcccttgtcttctcattgatttctcagaatttggtttattcttaccaaaaagttattgttatcaatgcaagtcacacttcagtgttccaaaagtctactttaaaagtaaatacatactctagttgtctctgaaagtatgtcatactttcatatcacttttggcccttagacacactcaattctttttattcctgaattacaatataaaattctcatttccttgtgcatctcttcttctaagaagtacaatcacaaatgatacaattccatggtattattgctcccttaaaatgctatcttctgcttttaactaactgctgttaacaattaagcatccttaacttttcaagaaaattgagtaataaatgtaatcagaaatcacatctttacatacataaaaaggactcttgccattactaagtgctttaaaacatggacacatgtctgtgtgtgtgtgtctgtgtgtgtgtatagattctatgtttctaccattactaccagtacataccatgacacagtagaatgcaaaatataaaactaaaacccagccatttttaacaggattggttggtatatttaatcctgcccacacattcatgaacctttatgcagaattttttctctcgtt

SEQ ID NO: 85775 - DNA, 736 bp, Homo sapiens
aaaaaaggatcctgatgggctgcggcagaggcctttcctgcagcgatggccaggctgcacgtacagacctggaagtctcatcatggtggtggtgtccaaagtgagggacaagctcatggaggatctggacacagagtaccccaggcctgtgagagtcgggggtcatagagggtcagaggtcaccaagatgaggaggggccagcaaggaacttccaagaccgggcacagtggctcgcgcctgtaatcccagcactttgggaggccaaggtgagaagatcgcttgagcccaggagtttgaggccattctgggcaacatagcaagacccagtctctactaaaaattaaaaaaattagccgtgtgtggtgttgctttcctgtagtcccagcttctccgggggctgaggtgggaggatcacttgagcctaggagtttgaggctgcagtgggcccgatcacaccactgcaccccagcctgggccacagagcaagaccctgtctcaaaagaaaaataaacttccagggagctccctgggccacatggggacactgaggcagggaagatgagggtctggttgggggtgcacggctaagtgggggacagtgaggaaagggcatcctgggaagtggagatgggcagggcaggcgaggcaggaagggtggctttgaagaggcccacggggagcctgaggtgtagcccagggactctgctgggggccttagtgcagagtggaggtccc

SEQ ID NO: 85776 - DNA, 712 bp, Homo sapiens
ccgttgcttggtcctagctggttaacctcacccttgcacaacaagcacgtcaatgggagcaggatcagctactttcttgtaggtgaattcccgtttttgaagtggggtttcggctccctaatctgcacttttttttttcctaccagtttggagaaacagctgggaagaactggatttgcaggtattgctggagccagagcgaagcccggccactgtcaccatgggctccagcctcgcctctctgggcctggtggtgagcggcttcagcaacaggtttccggtccccgcagagggtcccactctgaactcccgatttacagactgttctcgggccgtgatgaggattaagacaatgcaactaagagcactctgactacagaagcatgatttaaagctccacaaccctgcaataaccacgaagaaaaataaaaagcggctagtccgccaggcacggtggttcatgcctgtaatcctagcactttgggagcccgaggcaggcggatctcctgagcccaagagttcagtaacagcctgggtaacatagcaagactctgatctaacaacaaaaaaaaattagaccaggaacagtggctcacatctgtaatcccagcactttgggaggctgaggcaggagaatcgcttgaacccgggaggcggaggttgcgatgagccgagatcgcgccattgcactccagcctgggaaacaagagcg

SEQ ID NO: 85777 - DNA, 408 bp, Homo sapiens
ttgtcatgctgcttcctatcaactttatctatcataacctcacatcttcttctggtttttatttctcttctccagatcagtaaaaactcctttaagtgtacctcccagttcaaaattagtctgtactcctattatacatgtgctactacagcagtttgctaacatgcattataaaatattcaaaaatggaaattttagctatctgataatatatttaacatgttaattttttctcactaaaactaagacttggggaaacaatatgattgcatttcattttaaaagttaacttttttattactaaaacatttttggtaaaactacatgattaaatgttcttcatgcattttttattttcaattttatactttctgattcagtgattgaaaggtctgatatcatggtcag

SEQ ID NO: 85778 - DNA, 307 bp, Homo sapiens
ccacaaccccactgtaatcatgagaaaaatatcagacaaccctgatttgagggaaattctacagaatccctcatcttcaaaaagtatctaggttatgaaaaacaaagcaagactgagaaactaacatagccagggtggctgaggagacaagatgactaaatgcaatgtggggccgggcacagtggctcatgcctataatcccagcactctgggaggccgaggcgggtgggtcacctgaggtcgggagttcgagaccagcctggccaacatggggaaaccccatctctactaaaaatacaaaaattag

SEQ ID NO: 85779 - DNA, 157 bp, Homo sapiens
gaaataactataaatataggttaacatttattgaatgcctaccttgtgctaggtgctgtgctgagtatttgtattgacacatttaatctttgcaatgattctatgaaataaaggtattatttccattttacagatgaggaaactgaggaatagaggg

SEQ ID NO: 85780 - DNA, 203 bp, Homo sapiens
caggaagattgcttgagcccaggagttcacgaccagcctaggcaacataggagggggaccctgtctttaaaaaagaaaaaaagggagaggaaagaggagagagagagagaaagaggagagaagaaaaaggaagaaagaattggttaaattgttgccacattctaccagcctggctagtactcttcaagattgtcaaggtcatg

SEQ ID NO: 85781 - DNA, 302 bp, Homo sapiens
atgtttcttgatcttggtctcaataagatggtgaatcggtcattctcatcctcctgggagcaaatgagcagaatcccaagaaggcaataaagaaatcttaaacgcatgttaataaattcttaagttaagcacacaatgtgtgcgtgtacccacacatgccaattttgatagccagccagtatttataacagtatcattgactgaatgtcatcagcccataagcagatcctggaaagaacatatatagttgaattttatctaaataattacttgagagtatctttaaaaaatctaagcccctg

SEQ ID NO: 85782 - DNA, 496 bp, Homo sapiens
gttttggtgcagagtaggagctcaatactatttgaaagcataaatagatgaaaaatccaagatcacttaatatttgtttctgccaagctatgttctgacagttctagcatacataccagggaaacaatccttactaggcagcattcgacagcccataaaaatataaattatcttgaaaactcttaaactctaaagactgccttagaaaacaagtattatgtaggacttcttgcttggaaccagggtgatagcctgtgctttaagcatgctaccagtgaagagaaaatctcaaagacacataattcacttagacttttggtcttgatatcctaacatgtaaagtgcaagaggttagattaggtgatctttaagttcacagttctctagcaataattatgctactaactggtgatcaggatacaaatatgttttatacataattttactttacagagatgttaaggggcaagttttatagggcttcgaaaataacagc

SEQ ID NO: 85783 - DNA, 708 bp, Homo sapiens
cctggggaagtcccagtgatgtgctgggttcagagtcagtggaattggaggcgcaggccacctacggaggcaccagaggaacagcgaagggagcgcttgccatcactcctgcccttagccccaggcagcacaactcacagctctaggggagaatccatcctgcttgaggaggttgggggagagtaaagaggactttctattacaacttggataccagctcagccacagtatgatagggcactgggcagtcttgaggcctccattcccggccctagttcccaggtgacatttctaaacacaccttgggccagaagggaacccgatgccttgaagggaaggatccagtcctggcaagatgcatcattaaggagccgttggtccttgaataaatgtcagctgtagccagttagtacttgccatgggccttggttgagactcagaggcatgctagcttcaggtgtagcccagcgcattcccgcctttcttggccacagggaaagactccttatgcttgaggaaaggagaaggaagagtaaaggggacttttcctttactcaccagctcagccacagcgaagtggagcagcaaatggggaccctgagtccaggctttggctcctggacattatttttggacctgctatgggccagacgggagcccactaccctgaagggagagacccagacctggaagcattcaccacaagct

SEQ ID NO: 85784 - DNA, 376 bp, Homo sapiens
tgccgaccttactgctcttgacagagtctctacttgaacatagaaaatgacagaattacctttgaatccgggcttgtcagtcattcagtcaggtcttctccctaatcaccctcaattgtgaggatctgcgatgctatgaaaggcacgtgcctgttccaataattaccagtacatctgtttaatcacttaaacatttaaagcctgagttattcatatgttcatgtgactttataagcacatcggggacttctgaatatgaatttatgtcccatgtaaagaaccagtacactctctctacatgatgggacggggtgaccatcaaactgtggaaagtgggtacgttttgacgtgaaataagagtgatactatttcacta

SEQ ID NO: 85785 - DNA, 385 bp, Homo sapiens
gttcatgcctgtagtggtagctactcaggaagccaaggcagaaggatggcttgagccctggagttggagatcagcctaggcaacacagcaagaccccatctccaaagtaagactaaacaccacgcacacaacctctcctacctccctagcctccttctttgccactgccagatatgtcatcacaaaccctccctcggtctgacacagggcatggggaagagtagagactacagcagggtggaacagcccacacagtggccaagacgggaattggaggccaagggctgtgtctcccgctgggcaggccacttgctctactgtctttaagtggttaagtgactgggcaggggcaaatgggggattctgattagaaactggacaatgt

SEQ ID NO: 85786 - DNA, 199 bp, Homo sapiens
atatcctttagttaatgggcaaaatagcaatacaaataaaaggaaaatagatagttccatgacagacatttcatatatgtattcattaaaaacaaactttaggcatcttctacacacaataaattgtgctagatgcaatagcacagcaaatataaattggacatgggtattgactttaagaagctcagaactgtgggag

SEQ ID NO: 85787 - DNA, 490 bp, Homo sapiens
ttgatccagcatgttgggtcaaaatgatctagggaaaagtagcaggagtttaattcagagaggtcataggtaggagaaggagcaaatcattgtagtgccttattgcctgtgttaatgacttcgcattttatttggagacgggagttcttgggaggattttgagcagaggaatggcacgatccttcatttagtacatgttaagtgagcaggactctgtttatatatgtgatcacaaaaatataaaagatggggctcatgcctgtaatcccagcattttgggaggccgatgtgggaggattgtttgagcccaggagtttgagactagcctgggcaacatagagagacccttgtctcaaaaaaaaaattataggccagatgcagtggctcacacctgtaatcccggcgctttgggaggccgaggcaggtggatcacctgaagtcagaagttcgaggccagcctggccaaacgtggtgaaatcccatctctact

SEQ ID NO: 85788 - DNA, 467 bp, Homo sapiens
ctgagatcaagtgtgatcaagggagaccatgcagagcagacgcaacagccacgaagaagagggagcttgggaggcaggacgcagtcaccagtgcctctgaagaggggacttggctggaccttcaccctgaagaggagccattctcagtgactttggctctccacatggggagaatggcaagaacaaaagcctgagctgagggcgaggggggctgggtctgagtcaggacaccagccacctggccagagaaaggagttcatctgggatgagtgagattcgaggcaagagtcggagaatcaaacacaccaggcaggaacctggcaggggcagctgggagtcagggggtattaagaggccttgttttagaacatgaatatgttacctccaagctaactttaattcttagcatttaatgtgtcttttatgtgtaatttttttagcattcaaacttaaatcaacaattttaa

SEQ ID NO: 85789 - DNA, 322 bp, Homo sapiens
ccatttcaaaaggacacaggatcccactggccaataaatcaacagaaaaatagcacagtacattgaatatagaaagaattcatgattccatggtgatactgaaagaaggagagaaaaaggggaaactcttctttaaataaaaattttttaaaagctagctaattaccaggcatggggcatgcacctgttcatttcagctactcgaggctaaagaggcttgggtttggggtcctggcactttttcttactagccttctaattctgagaaagttaaattatctcccaaagtgctgggattacaggtgtgagccaccatgcccag

SEQ ID NO: 85790 - DNA, 747 bp, Homo sapiens
gattctcaggctaccctagttgcataggatactagcactcaccctgtaagtactgctttgtctgaatattgtggttaattttgtgccaacaagttacaggggttgcttgaggaaagctggcaagtccaaggtgctcatgaagctctgagagtgaagggaacaatttttctcttcttcagaggttggcttttctggccatgtgaagcaatgtttttaaagtacaatataaagagtacagtgttcagatcctgcagttaatcccaggactgacttcctgcagtttcagttgtgtgactgggacatgttcctaacttctctggccagagctgcttcatctgctcaccttccacatggtctagaggattctatgaagtactacgggcaaagcactttgtccctacaacactcttgcccattggagttagagtgtaattgggtccatatgtttatttctggcatggattaataattcacttttgacatttaatacaaatcaggcatcaattttttttgacactgccttatggtggttttgtgttattctttccattaggttttatgaggctcaggtgttagtaagcccacagagtggtgaatttatagaacatgaggcctggaaaggacttgacagatcaactagaatccaaccctcgcattttacacatggaaaaatagaagtaaatgggggtgaaatactttgcctagcagcacatagtgaatcagtaatagagagaagctaaaatataa

SEQ ID NO: 85791 - DNA, 436 bp, Homo sapiens
ctgtatagcctgtgttccatgggacaggatgggggctcagatgttcctcagagacaaggaatgaatctctgggatgaccactcccagattccctagctcaggacacacgttcaggcgcatctgccatacaaggtcattctcggggtaggcttaaggtattgctgtcagatgcatttgccatcagggagggagctgctctctcagagtcggatgacccacttatcccaatttgcttgggacttttctggtttcagcagtgacagtttccggtcccagaagccttagttccacctaacccagacagtggggtcagcctagctcagaggaggatgctggctggaaaccccaggcaggcagagctcagaagtctcaagataccaacaattgccacccagttttgagtacttacgtgccagatgctcaatcctcatgtctc

SEQ ID NO: 85792 - DNA, 455 bp, Homo sapiens
aactagccagtattgagggctcctgggttatggaaatgaaaccagggctgggaaaagatattccctgtcctgtatcacttccaatgaagagaaacaagaattttagcaaattgaacattgctgcagtgcctagaacaatgcctggcatgtagtagatgttgaataaatacttgtttaatgaacaactttatattcttcaattatctcatcctagggactgataagttttctcattctatcagagaaaataaaggttatgagggttgcattaggtagagtaagctaggctacagctgtaagtagactcaaagatgtgtaatggatcaaatgcaacagaagtttatttgttgctcttgttcaaggtgggtgtttctggttagcaggtgactctcctccattgagttcagggactcagtttccttctatcttgtggctctgccgtccccaaagaccac

SEQ ID NO: 85793 - DNA, 232 bp, Homo sapiens
gaaatatctacctggttacatagcagcaataccaggatacttgctcctgctattactttctcaggtcctgcccagcgatgctgagaactccctgcattttgtagtatgatatcgagttaacagccagagaaaatcacaaagtgtggagtgcccccaaagccagatgacaggagtgaatttaatcttgtgataaagtggagtcattggaggttttaaaaataacagtttagga

SEQ ID NO: 85794 - DNA, 342 bp, Homo sapiens
tggccctaacatccgggcatgcctcaaactccctgtattctccccccatgttaaaccaatatagcaggtttcaagtaaaacaccactcaagtcagagcctctaaggtgcttcaacttctaatccttccttcatggaagctccaatgctttggatattatgatcctgagtggtgatcaaaataagattacaaacaagaatttccaaagaattcagaattaatggagtcatgctaatttatgtggtttagccacttactagccatattactaattattttctctaggcttctggcctcaccttactgttcaatacttgtttccccacatcccagttatactacc

SEQ ID NO: 85795 - DNA, 284 bp, Homo sapiens
gtcgtagataccagttaggatacctaggagagttcttaaatgcctcttctttcaaggaaaaaaattagaatgaattaactagttaacaaccaagagtaatagctattatttctacatgtagctgcctaatgtcacacacttttatatattcatagtgattccttgtaacaaccttgatacatattgcccggattttgaaagggctttgaggttatttgcccaaggtcatgataacagagatggtattcagaataagatctgacttcaaagcctttccagtctgt

SEQ ID NO: 85796 - DNA, 360 bp, Homo sapiens
gacagagtgagtttttagttttatttctgccaggttaactgttatctttaaaaaaaaaaatcaatttaaaaagtccagaatctctacagcatatcatccacaatgttgagaacataatccaaaattacttggtacacaaaatgcaagaaaatgtggcccattcttaagcaaaaagacaatcaatggagaaaagtgagaagacaagggctgtggtttgaatgtgttccccaaagttcatgtgttgaaaacatgatccccaatgtgacactattaagagatggggtctttaagatatgattcgtgaggcagatccctcatgaatgaattaatgttattattgcaagagtgagctatcacagg

SEQ ID NO: 85797 - DNA, 383 bp, Homo sapiens
caagatgtgtcacactagatatgcttattgccgttgagtttctagggtgtagtttctttcaggctctttcagctgatagagtgtgaggaaacaggtgtatataatacacacatttgtaagtatttccatttgtgaccatctgtatctatatgaagttaaaaatgagttcataatgatgtgctcaactctaatccatgattacatggatcattcttgcttccttctcttgtttatttgtaaccttccactccagcagtgagaaacctggcttccaccatctgccatccagtttatttaattggtcagtcacagcatacatggttccagaattgttaatctttatttccatggggtacaactttcaactatagcataacagtgtt

SEQ ID NO: 85798 - DNA, 127 bp, Homo sapiens
cttacaagaatgtccataaaaccctgtttataatagccaaaagaacagggaacaaccataatgcacatcaaaagaagaatggattaaaaaaattatattcacacacaggagtactatatagtattga

SEQ ID NO: 85799 - DNA, 2402 bp, Homo sapiens
  misc_feature (2)..(2): n is a, c, g, or t
  misc_feature (232)..(232): n is a, c, g, or t
  misc_feature (653)..(653): n is a, c, g, or t
anagctaccatcatcctgatgtcgctataaaggccagcatttttctgaaaagttggggaaaatgggaaaagcaacaaggcaactagtaggtatcacttaccttacctgcccagaccccacacccctaggtctcctctcaaaggaattcctgcccctcccatggcccatcttggtccgagaagggggtggtcatccccaggctagccagccacttctgacctgtgtggcctgnctggctggaaggcccaggcaatgacatgtgtctcgcagtttggactgagacatggaatggggccgcattaacaacaggaaacaatctgaacagactgaaccacgagcagcagaaaggcagaagagcagccgcttcagccccttaccatccgagacctgggtgtgtggtctgtcttggtcactctctctgtctctctttctctctttctttctctgtccccaaggctggagtgcagtggtgcaatcttggctcactgcaacctccacctctgggattcaagcaattctcccacctcagcctctcgagtagctggggctacagctatgcgccaccatgcccagctaatttttttttttttttttgagatggagtcttgctctgtcccccatgctggagtgcagtggcatgatctcggctcgcngcaacctcctcctcctgggttcaagcgattctcctacctcagcctccccagtagctgggattacaggcgcccaccaccacacctggctaatttttatttttagtagagatggggtttcaccatgttggccaggctggtctcgaactcctgacctcatgatccacccgcctcggcctccccaagtgttgggattacaggcgtgagccactgcacccggcctaatttctgtatttttagtagagatggggtttcacgatgttggccaggctggtcttaatctaacttcaagtgatctgcccgcctcgccctctcaaagtgctgggattaggcatgaactaccatgcccagtggggtattctctttcaataaagctcctcttttccaaggaagccacaccagaacagagatgaagaccagtgggaaaacatgggagcaactccgtgggcaggccagcggggaggccatgctgcaaagctgccgtgattccctggtgatctctcagcaggccaaggccagacatgtgaggaaggccttgaggacttcattctgtgcctctccttggatggaagggggtgctttagtgtggcactcctgacttttcaattgactggtgaagaggcccttgtgtgcacctcactatgtctgcctaggtcatgggggctccctggccaagaatgacgtggttccccctttcatcagtccgattcgcagtttgtcttaactgtagtggtatagccagagcaagaaaaagaatgtgatttaggacaaatgattggatgagtgattggtagatgtcctcagctatggcgtggttttgcaggtcactgttccacccacctgggcacagcatatacgctttttctcttccccataatcctgtaggggctgcgacttctgaagcacaagaggcagaggcgaacagctccaggtgcccctctggagctaccctacctcatctcccaagggagcggccacagcccagagtggggtctttcattttgtgatcttttcccttgacattcagcaaaagccctgacagtggtagaataaaggcaggatgggtgagtgcagagtgattctgcttttgttgggtttcagggaaacccataggcagattctgaacctggtggttgattctacatgtgggaattgtggctttgaagacctctggacatgagaacatatttccaagacagaggattctatggggacgggtcaccattaaatggtgtgcaagcataattctgttcaaaaatgaaggcatgtttagaggtgtgtcacagttaaaaaccaacctgaactttgcagttagattttaaaagatggtcagttagagtagaaatagcttagaatattccattgagtctaagatacagttagaaatcaacatctttgaaattagggtgtgtcttttaatcagttgatgtcagagtttaacgggcagcatttttttctttcttgggattacaaaaaatgatggtgcattctataattggcagcatcttagatctgaggaagtatgatacttgtttgacggaatggttgacggcagaattttgttaaaaagctatatcttcactgtattttaacacattatctaatttaagaaattgttaagatcccccacctggcagaggacccagtacaaaataggcactcaatagatgttacaccaactttggaagggcaaacatatttcttaatgagaggcagtccttcatgttttgcaataaaatgacttttaaaaaa

SEQ ID NO: 85800 - DNA, 1742 bp, Homo sapiens
  misc_feature (2)..(2): n is a, c, g, or t
  misc_feature (232)..(232): n is a, c, g, or t
  misc_feature (653)..(653): n is a, c, g, or t
anagctaccatcatcctgatgtcgctataaaggccagcatttttctgaaaagttggggaaaatgggaaaagcaacaaggcaactagtaggtatcacttaccttacctgcccagaccccacacccctaggtctcctctcaaaggaattcctgcccctcccatggcccatcttggtccgagaagggggtggtcatccccaggctagccagccacttctgacctgtgtggcctgnctggctggaaggcccaggcaatgacatgtgtctcgcagtttggactgagacatggaatggggccgcattaacaacaggaaacaatctgaacagactgaaccacgagcagcagaaaggcagaagagcagccgcttcagccccttaccatccgagacctgggtgtgtggtctgtcttggtcactctctctgtctctctttctctctttctttctctgtccccaaggctggagtgcagtggtgcaatcttggctcactgcaacctccacctctgggattcaagcaattctcccacctcagcctctcgagtagctggggctacagctatgcgccaccatgcccagctaatttttttttttttttttgagatggagtcttgctctgtcccccatgctggagtgcagtggcatgatctcggctcgcngcaacctcctcctcctgggttcaagcgattctcctacctcagcctccccagtagctgggattacaggcgcccaccaccacacctggctaatttttatttttagtagagatggggtttcaccatgttggccaggctggtctcgaactcctgacctcatgatccacccgcctcggcctccccaagtgttgggattacaggcgtgagccactgcacccggcctaatttctgtatttttagtagagatggggtttcacgatgttggccaggctggtcttaatctaacttcaagtgatctgcccgcctcgccctctcaaagtgctgggattaggcatgaactaccatgcccagtggggtattctctttcaataaagctcctcttttccaaggaagccacaccagaacagagatgaagaccagtgggaaaacatgggagcaactccgtgggcaggccagcggggaggccatgctgcaaagctgccgtgattccctggtgatctctcagcaggccaaggccagacatgtgaggaaggccttgaggacttcattctgtgcctctccttggatggaagggggtgctttagtgtggcactcctgacttttcaattgactggtgaagaggcccttgtgtgcacctcactatgtctgcctaggtcatgggggctccctggccaagaatgacgtggttccccctttcatcagtccgattcgcagtttgtcttaactgtagtggtatagccagagcaagaaaaagaatgtgatttaggacaaatgattggatgagtgattggtagatgtcctcagctatggcgtggttttgcaggtcactgttccacccacctgggcacagcatatacgctttttctcttccccataatcctgtaggggctgcgacttctgaagcacaagaggcagaggcgaacagctccaggtgcccctctggagctaccctacctcatctcccaagggagcggccacagcccagagtggggtctttcattttgtgatcttttcccttgacattcagcaaaagccctgacagtggtagaataaaggcaggatgggtggtcaaacataaggtaccgagctgaa

SEQ ID NO: 85801 - DNA, 402 bp, Homo sapiens
tttcttggaaagcagacagaagagcaataaatgactaggcaagcccaagaaaactgaatcatagcccaactgtggtaaacttacgatcaacacaatttatgtcatacgttccccaaaatgttcagaaagtggaggtgaaagagagctaaagaaaataaggaggattggttgaaattgtttccgaagcttcagatcattacattttctccccaactagtgaagtcaggtgcctgctgctctaccatcctgagactttaggtttattctctagagagggttaaacagagggtttctagattgggggataccagcaacagtaaggggcagggtacaatactgaaaataaataaattaagtcaatatattgagtaagattttccggtcctctttccctaatcgtca

SEQ ID NO: 85802 - DNA, 331 bp, Homo sapiens
  misc_feature (1)..(1): n is a, c, g, or t
  misc_feature (3)..(3): n is a, c, g, or t
  misc_feature (6)..(10): n is a, c, g, or t
  misc_feature (130)..(130): n is a, c, g, or t
  misc_feature (165)..(167): n is a, c, g, or t
  misc_feature (328)..(328): n is a, c, g, or t
nanctnnnnnacagggtttctgtcatccaggctggagtgcaatggcacgatcatggctcactgcagccttgacctcccaagcttaagtgatcctcctgcctcagcctcccgagtagctgggacttcaggnacacatcaccatgcccggctaattttaaaaatttnnngtagagatgaggtctcactatgttcctcaggctgggctcaaactccttggctcaatcaatcctccggctttggtctcacaatatgttgagattacaggtgcgaaccactgtgcctggccaaattaatttatttttaatgacaaataaaaattatatatatntgt

SEQ ID NO: 85803 - DNA, 506 bp, Homo sapiens
ctcccactgcccaagacgctgaaaggaaagaaggccaaggggaagaaggtggccccggcccctgctgttgtgaagaagcaggaggccaagaaagtggtgaattccctgtttgagaaaaggcgtaagaattttggtattggacaggacatccagcccaaaagagaactcacctactttgtgaaatggcccgctatgtcaggttgcagcagcagagagccatcctctataagcagctgaaagtgcctcctgctattaaccagttcacccaggccctgaactgccaaacagttactcaactgcttaagctggcccacaaatacagaccagagacaaagcaagagaagaagcagaggctgttggcccaggctgagaagaaagctgctggcaaagggggcgtccccactaagagaccacctgcccttcgagcaggagttaacaccatcaccaccttggtggagaacaagaaagctcagctggtggtgattgcacacgatgtggattccatc

SEQ ID NO: 85804 - DNA, 391 bp, Homo sapiens
tgttacaggctaaattgtatccctcaaaaaaattcattgttgaagtcctaatacccagcacctcagaatgtgatcatatttagagacaaaaaatctttacaggccagatgtggtggctcatgcctgtaattccaggagtttgagagactgaggcagcaggatcacttgtggccaggagtttgaaactggcctgaaaaacatatcaagactccgtctctacaaaaaaatttaaaaattagccaggtatggtggggcacactggtagtcctggatacttagaagactgaggtgaaaagatctcttgagcccagaagtccaaggctgcccatgagctatgatcaaaccactgcaccccagcctggtcaacagaccaaagcttaatctcaaaaaa

SEQ ID NO: 85805 - DNA, 2642 bp, Homo sapiens
gagagctgccttcaccttgatcttgtaacctgtcttccttgcatatacggtagcacattccagatcacttcggtgagaaaagacctctgtttttgaagaggaaactttcttaaattgtaaaataaaacttaaaaaacataaaaactctgtacaaaaattgaagacctaaaaattatagcataccttttttttgctcttgagtttttgaagctcttgtctttaaatgacttaactttttaaaaaataagatgttttatggctttaacccatgtttttattaagatctgagaatagcatattttaaacactgatagatacagaagaaattattatttaatatataaattgcttggaatgatttcattgcagcttgtaaggatgggttgatgccagaatggtttcataaatctttcagtcttacagagccaaagtttgcagattatatcgagttgcgttgtgcagctgctaaaatggaatcatagctttttataatttgcagaaaacaattgcattaatgtctggatgtttctcagttttattcttttctcataaatgttcctcgaatgttggcaccttctactgctgatctatattagaatctagtccaagaaagtgtctgatttaataacattaaatagttatttcaatatattttttcaaattatcctcatagaacctgttgcctccagtgagatggtaatctactacccgaataaatttaagagcacctgttgagagcccctgttttgcggtagaagacaattgtccctatcccaatttccactgaaatatgagagcagatttgcagagaccatcatgtcagagaagaaatttccttgtcagagatgttaaagggctacagtcccttagcaaagaaacttcgaaatctaagttggtttgtgtttttctaaatttgataccgtaattcatttggcagcaaaatctgacttgaactgatgtgagagtattgtactttatatttatgctacttcattgtgacttaattttccctgaagaaatatccatggatttgattataggttttcccttagatgctgtggaggtgttttgtaatattcaaaatatgcccatattgcctttttaaaaccccaaagattatgaattctgaaacacatccagcccagcgggttttggataaggggttgtaggcatttaagcagcctcacataatgggctgacttcatccaaaacatgaaaatattacaaggcaaattctgttttttatattttttggttcaatgcttgaacaacttgtttttctgctgggggaagaaaaaaagaaccaaccctgagtgtgattgttacggaaactaatgactttgtttttaaaggatcacattgattcaacaccttctattggacccagaagtgcgtaaatattacctatggtagtaaacgtttaattatcattcagtttaaatgttggccttctgtatgtagccaagaacagctcattttgtgaatttcagtttttaagtggctgctttttgatttggttgtattattttattataatgtatttgcaagtatattaaaaaattaacattgagccataaaaatccccaaatatgttcaaggacttcataattgaaaaatatatagaaaacaatccttacttctttttacaaaaacaaaatcatgggaattattcttttctatatatttagttataaatctttctctgggccgggcgtggtggctcacgccagtaatcccagcactttgggaggctgagacaggcgaatcacgaggtcaggagttcgagaccagcctggccaacatggtgaaaccccgtctctactgaaaatacaaaaaattagctggacacggtggcaggcgcctgtgtgtggcgggcgccagctactcaggaggctgaggcaggagaatcgcttgaacccaggaggcagaggttgcagtgagccaagattgcgccactgcactccagcctaggtgacagtgcgagactctgtctcaaaaaaaaaaaaaagaaaaaaaatctttatctggatctgttaaaccatatattattgatcattgcaagtgaaattttgagagattgtttctagtatttaggtgatgaaaacatttggtaatattgctttggttcaaagaattttatgtctttatctttctagaagaaagcaattatatatatatttttgctaaattacataaacatttaattacatcaggttctaatttaaacatgtattactcacttgaggccacttttaaatattcatactctttgacataagatgctttgtatatttctcatttcttttagttcttagtaagtcagctttaaaaagtacctgccaaccagaaccttccatattctggactaaatcttgctcttcggattatacttcagtgcagtaactgtggatttgcaattttgaaggggagatagtagctattatattttacacttgcttgatgtgataactctaaagactttttaactgataaaagcgcacatggctattttgatacacaaagttgtgtttgctactttagaagcttttgtggcagaattgtaatctaattttcataccttgtatttctgaatcacaacaaaaaaataaatggggaacaagacttacagatttgcaaactta

SEQ ID NO: 85806 - DNA, 429 bp, Homo sapiens
gcagatggtttgaaatgttgcacagggcaggcagggaggcctcattaaggaggtggcatgtgagcaaccacacaaaggacctggatgacttagctatatctggaagaagagtgttctagacagaggggccagtcagttcagaggccccagggtggcagtgtttgtctggagtgtttaaagaacagcaaggtcagcgtgcctggacagttgtgatgaaagaaagaaaaataggaggtgaaatcaggggagtaagaaagtggagaaggaagcaaactgcacagtttatggtgtattgtaaatattttggcttttaatctgagttgagaagtgacacaatctgacttgtattttaagagttatgtcataggaaggcaagagtgaaaacagtcagatcattaggaaggtaatcctagtaagagttgacgatag

SEQ ID NO: 85807 - DNA, 1230 bp, Homo sapiens
gggaaaatagcaaccttccatttggtttcccttctataatagttttttcctctaacggggagcaatctttctctcgaaactgctaatattgatcccaaagttactttgactgcattaacttaacttacggggtgggggcgggggtgagggtaggtgcttttttcttatgcaaaaatactcctttccggtgagaccagattaactatctccatgtttgtccttttctacctcgttttttcaccactcccaaacataacctcccaatcttttttgttagtccggccgtcaatttgtatagtaccaatttctgtaaattctctcaattcattgaagatcgtagggttaaacttttttgtgtgtgatttaaacttacaaacaagtgaagaagctatcgtttatttcagacgaggctgtagtttaaataccaaaagagggaaaataaaaaagaacctttgtaaaatatatctgaacctaatggtttgtacaactggagaatcgttctagattagttaccaattaaatataactccgccagtgtaagggtgtgaggtgcagttgtccaggagacgattttgtatagtatttttcttgtacattacttccagtaaatatttgaaaatatattgaagtaaacttgaattttttttttgtcacaagaaaatattaagagttattgttgcagttctgatgagctgcaggttttttgaactcacttctggaggtgcagagccacaaacgcactttcggggcctagttttgctcgaatatgaatttagataggtatcaagctgtaactaagacaatatttgataaatgttggatgacatttaatttaatggagcatgtacttatttgcatttgctggcagttcaggcatagttaaagtgagagttctcctatatttcataataagtgggtctgccaaaacccatgtattaaataaattgtccaagtgaaactcgactaactttggcctttgtgtatttcctgaaggtaatattgttaactgttaataaatacttctgacactacatttaaatgtttgcagattctgcaaactaattgctcattgtaatgttgaaataatttggatatttcacattgaaatgaaaagcctttctctggagcattttagatttgcattttaaatgcatgaaatgtaattgatttatttgtaatattttaaatggtattaataaactcagataaaagactaggccagttaatttg

SEQ ID NO: 85808 - DNA, 701 bp, Homo sapiens
cccgggacagtttccagtcggcttctccgtgaccttcctcccccttccagctcggagcgggatgctgggatccctccaaggaccctctgaggacgtaggagggatgctgagacagggccagcttcaaaccttgtcaagctctgacaagggaagatgaagcctagttccagctaggggtgacctgtctatctgcattttttgagctgcagagtgatgggagtcatattcgctgcctgtgcagcaccacaggcctgatgaaaatgaaatggcaacaccgtgcagatggcaaagcgtaggcctcacaaacatcctggccgtgaagagcttgtcttcaagagtagctggtgcagaaactcgctcggactgacctggaagaagaccctgaggagaacccgggcacacagcagccattccagtcctcagcttcaagggggctcacgaaggttgtggatccttgcccagcctgcagtggggacctggtgtggcattgagtggctgtgagtgctcagtgtcccccatctcatgctaagcacagcgaagtagggggagattgcgtagtgtgctgatggagcagttgcctccacctggctgcgtgtccctccgtcatgtgacagaaaagaagaaggcaatggtgtttttctgtagcaagtcactatttatggaagaggagaccctttatctgcatcgcaattctgaagatt

SEQ ID NO: 85809 - DNA, 885 bp, Homo sapiens
tgttcgtattttaccatgttccctaaacattcagaaggaggcattcagtgggtgaatttgtgaaatatttttctagatccatttgtaatgtcctctttcctcctctaaacaaagggctgggattctgtaaaagccacagcacattacatgcctttctttttctaagcaggaatctctctttctgaaatgagtattacctccatgttggggcaagggaaagagccctggactgtggagagtgaagtgaaaataacaaaaacatcaagtggttgggaatgcatcaaaggtgtgaacacaggtaagagctcaaatggacagagaggaagctgcaccattagtattcaggtaactccttccgagttgaagagttctgtggaacaaaaagggtttaaatcctgtgagctctcaatggaaacctttctttgccctcatttatccctctgctcttctgacgtgtagtagtttatcctttcacactcccatggcgctacagctccaacagtgacaaaggcaaagtctttatcatgatggacaacaccctgtcatgtggcttctgtgacctctttggtttcttcactctgaggggcacagggagggttgtgtccaagaggtctcctgtgatctctcctgtacctgactgcgtctgatgctcagttctctgtctatacagatcagagctgaggcctccatggacctgcccccttgacctattcaggttttgccccatttcctgtacttgggagacctaatcaggtgacgggaaaacattggcagctcctcctttgcatctggggctccggaaacctcatggtgctgtctccagccctgtctgtctgtcaaagtctttcagcctcagtcatttcttctgttctgcttttgccacag

SEQ ID NO: 85810 - DNA, 262 bp, Homo sapiens
tgcatctgttgtcactcctgtcacagtgctgttccctctgctggagactctcccctctctcctggctaacctctattgttcgggtcctgctcaagtgtcacatcatttccttgggcaactgttccctgcccgcacaagtctgtgttaggtttctctttggcgctttcacatcaccctgcacttccttagcatagcacctggcacacggcacagcacggcacggcacttgcctgtgtagcctgttggtaccaccagagggtgg

SEQ ID NO: 85811 - DNA, 319 bp, Homo sapiens
ggcacacagtgggctgagcggacaagtcgcagcctcagggggacctcccgtcctcccaactggcactgcatctttctgggcctggctctgctgcctcacagccccgttcagctggtggcttttagaggcttccagagtgtgcttggcccctttacctctatgccattgggcccagggggagcagtagagtggctgcggctgggggtgggacttcccctttctgtgtcttgcttgccccgtgtctcccagtgagtggccgccctgagcctggggccagcagcccagccccagtgagaaataaaagtagccatcctgcctg

SEQ ID NO: 85812 - DNA, 403 bp, Homo sapiens
cctcttctcttctcttgcatacattatgagtgacatttcataatgtatttctggatattgttgatatccaatttttctttgaagattttgttgatatttttgaccagtgagactatttttaatgttagtactcagattaagagatgcaaacattttcattctggtaaatggtataataagcagtaccaaaccattttttatagtttattcttgggtagatatgtgctaggctatcagggatgtccagacgtatttcagacaccatgaccttgtatggagcttggaccattgatttattccatgaataagagttactcaaatatttagaaacccaaaggataaagtttttggctttggaaatagatagataatatgaaaaacgtagtaagtttaggtttgataa

SEQ ID NO: 85813 - DNA, 138 bp, Homo sapiens
gatctgagtacctgtctcgtggagtactggtctagtgaacagactgagcttgaatcctggttgctcctctctgtgtgaccttgggcgagtgacggtcagccccggccataacacagtactgcagacttggcagctcgc

SEQ ID NO: 85814 - DNA, 654 bp, Homo sapiens
gggatgaagagacaatgaagggagaaagagaaggaaggaaggagacattatactgacttttcagataaaagccagacaactagttaacaactgccatgtagtaatggggcggggctctactggggtgcaggggctcatggacccccagagcattctaatcagacatgctagatatttgacagaaaagtggattctgtttgatggtttgtttcaagaagttaaggggacagaagttaaattatgtttctgtttttttcttcttccaaatgaaactcactctaaacacccaactaaaaaatgatcttacagatctgtgtagtctaatacctatgtacatgttgctattcaaatttaaaattaaaaaccttttttttttttttgagacaaagtctcactcttgtcccccaggttggagtgcaatggcgtgaactcagctcactgcaacctccgccttccaggttcaagcaattctcctgcctcagcctcccgagtagctgggattacaggtgcctgccaccacgcctggctaagttttgtattttttaaatagagacggggtttcaccatgttggccagactggtcgtgaactcctgacctcagatgatccgctcgcctcggcctcccaaagtgctgggattacaggcgtgagccac

SEQ ID NO: 85815 - DNA, 753 bp, Homo sapiens
ccgcgagggcggagctgcgttctcctctgcacagatttcggtggtactgcgaaggcggagcagagttctcctcagatgatgattattccccaccttctaagagacaaagaccaacgagccaccacagccaccagtcccagaacctgccaatgctggggaacggaaaatgagggagttcaactctgtgccctcacaatccagtggaggagacgcaactcatctgcctctgtccctctgggcacgcctcatgccaggtgcatctgtggacaggggccatgctcctgggcttccaaagttggagaaagctgccaggctcaggtctgaaggccagaattctacagtaagtcctactgagtcaaggtgggagcagggtcggtagcttccgaggctctgcgggagaatccgtttcctggccgtagaggtggcctgcactccgcagcttgtgctgcccgtctcgaatgactggagtttcttccttctgtcggattttccagcaccacacaaagagctgtcttcgagaccagacaccctaccccttcttccttctgcttgggtacttccttctgcttggctcccagagtgagaaactaggcattcatttgttcaatcttcaaacatagtctatttgaaaatacctctcccctattgacaccctaatgtctaaaacaccaccataaacattttcatcctccttttgtgccccctattaagaagcaaacctgtgaagctactatcgtttatcatcagtgtgaa

SEQ ID NO: 85816 - DNA, 2360 bp, Homo sapiens
gatctttggtccttctgttacccagctcctggaggcagtggctgtagcagcccttgctgctccacaccatggccacctgctggcaggccctgtgggcctatcgctcctacctgatcgtgttcttcgtgcccattctcctgctgcctctgcccatcctcgtccccagtaaggaggcctactgcgcgtatgccatcatcctcatggcgctcttctggtgcactgaggccctgcccctggccgtcactgccctcttccccttaatcctgttccctatgatgggcatcgtggatgcctctgaggttgccgtcgagtatcttaaggactccaacctcctgttcttcggggggctgctggtggccatcgcggtggaacactggaacctgcataaacgcatcgccctccgtgtcctcctcatcgttggggtgcggcctgccccgctaatcctgggcttcatgctggtcacggccttcctgtccatgtggatcagcaacacggccacctcagccatgatggtgcccatcgcacatgccgtcctggaccagctgcacagctcgcaagccagcagcaacgtcgaggagggcagcaacaaccccaccttcgagctccaggaaccaagtccccagaaggaggtgaccaagcttgataatgggcaggccctccctgtcacgtctgcctcttcggaggggagggcacatctcagccagaagcatctccacctcacccagtgcatgagcctgtgcgtgtgctactccgccagcatcgggggcatcgccacgctgactggcaccgcacccaacctggtgctgcaaggccagatcaactcgctcttcccccaaaacggcaacgtggtgaacttcgcctcctggttcagcttcgccttccccaccatggtcatcttgctgctgctggcctggttgtggctgcagatcctcttcctgggcttcaacttccggaagaactttggcattggggaaaagatgcaggagcaacagcaggcagcctactgcgtcatccagaccgagcacaggctgctgggccccatgacctttgcagaaaaggccatcagcatcctattcgtcatcctggtgctgctctggttcacccgggagccgggcttttttcttggctggggcaatttggcttttcccaatgccaagggggagagcatggtgtccgatgggacagtggccatcttcatcggcataattatgttcatcataccctccaagttcccagggctgacccaggacccagaaaacccagggaagctgaaggcccctcttggcctcctcgactggaagacggtgaaccagaagatgccgtggaatatcgtgttattgctgggtggtggctatgccctggccaagggcagtgagcgatcgggcctgtcagagtggctgggaaacaagctgaccccactgcagagtgtgccagctccagccattgccatcatcctctccctcctggtggccaccttcaccgagtgcactagcaacgtggccaccactacgatcttcctgcccatcctagcctccatggcccaggccatctgcctccaccctctctacgtcatgctcccctgcactctggccacctccctggccttcatgttgcctgtggccaccccgcccaatgccatcgtcttctctttcggggacctcaaagtgttggatatggcccgggcaggattcctcctcaacatcattggagtcctgatcatcgcactggccatcaacagctggggcatccccctcttcagcctgcactctttcccctcctgggcacagtccaacaccacagcccagtgcctgccaagcctggccaacaccaccacaccaagcccctaggctggggcacagcctggccatgcccaggaagacccaccccattcccactcctctgagcccggaggggacaccccaagctccaagctccaagctccaggccaaaggctgaaaggcacgtgtgtacataatctcttgcgtgtctgtaaggaaggggtgtatgctcagtttcctatgtgctggaataaaaggtgtgtgcatgtgtgtgtgcgcatatgtgtgcgcctgcatggatgtgaggggtgtgtgacgtgaggctatctgaggggggctgtgtgcatgcacatgatcctaggtatgtatgttggacagtgcacacgtgtgtgttcacagacaatacaacatgccctctctggtgccccaggtcttggtatccccagcttagtgaccagacttacttgcactgtatttattgaaattcaggcttggagtggcctgggaggagggcctgccagcagctgccacgggaacagcctctgggctgttaaagtcacattaaagtctttttcagtaaag

SEQ ID NO: 85817 - DNA, 385 bp, Homo sapiens
cgcccggccgagcgcggtagcctttgtgagcggggtcttggcgttgctgcgcattactctctccgcctcgccgaagagtggatggaggctccgcgggtaaaattgccgagaatgaggtgggtcatccgagaggggattggaatccatccaggcttttccgactctaaggcctgcagtaaaacctctgcagtgtcaagtgcaaatggagatggcgccctaggcatcacgctttatgcaaacgaaatatcgggaacgttttgtagtggttttatcaattaaccagcctatctgaaatgacataatttcgcacgtatatagcggcctgaaaatggcaacttagtgttggttatgcggttcggttctcctcctgaattcttccttttct

SEQ ID NO: 85818 - DNA, 705 bp, Homo sapiens
atgagaatataaacatcactattcagtcttgaaggttaagacaccagttctgtaatgagctaggtttgttataacaaaaacccccacttccttcaacaaattctcaggagaaaaataacattcctttttaaaagtatgtttatgcaaacaatgggtttaaagggtggtttgatcacttttttaaaataaacttaaaactgagctctgagtttcagagactgggcaagatcatagtaacacaataagggagtgaattggatgaattggtgcctcatgcctttttgatcagcagaatttagtcactaatcctttcaatagaagattaatctgaaggtttcatttccctgaaggaagtttgcttctttcaaagtttgtgctttttcactgaggttagaaactggaaacatcctaacttcctaatacaacagatatctactgctggaggctcaccagctccttccttcacttcactatttgcccaacgaagacagattctgatcaaagagggacaagccagttgagaaattgctgcagcacattctccccatgcccttagaaattgttatgattgtcccagaaatccaggcttaaatgatactcaggtgtaatattcaagataagggtctgggagaatataaaatattaatttgagggtgaatcaatctaattcagtcattgtcttggattgtccactaagtataatgt

SEQ ID NO: 85819 - DNA, 713 bp, Homo sapiens
ttctgaacttgcctccaccattctcccctttcctaccatgttctcccttcatggtgagtcactggctcattcctgcctcaaggcttttgcccttgtctttctctgttcctggcacactcttcatctgattggttccttctcctaattcagacttgggccaggtgtcacctcctcagggagaccttctctgactccacctaatgcaggagtagccccagctcttgttcattgccttgtttggttttgtttcaagcactcactgctctgtttgtctgtttccttttctgttggcagcctttccccgtggaaggtgacctgggttgggacttggtttgacttgtacctgtgcctagctcagtgcttgacacacagtggacactagaccttatttgaaaaatgggtgaaggaatgaatgcttgagcagagcaatgcataagtgaccagagactggttctaggaggcatcttacagtattacagaaactataaaacgataacaaaaaagacacttcatgcaaatactacagggaaagggaactctatgtttgccactttgacatctgtgctctggcctcgggcttgttttcctacttgttctggtgctggacaccttatctctgaggaccttgtagctagggaatgaagaaggcatagttaaggagatcttaccatagataccaaaagcagaaagtgtctttactcacacgtttgcta

SEQ ID NO: 85820 - DNA, 219 bp, Homo sapiens
ggcctatatttattagacaaattgaatcagtaagtaataaccttccaaaaaagacagtaccgggaccaaacggcttcactggtaatttttaccaaacatttaaggaagacgtgataccaattccccacagtctcttccagaaaatatgtcagtcctcctttatctgcagttttgctttcttcagttttaggcacgtacagtcaactgcagctgtgctat

SEQ ID NO: 85821 - DNA, 747 bp, Homo sapiens
aacgcaggcggtacggcccgaagtcgttgggatatggttcaaagagaaaaagcacgtgataactttgaaggaggctgcctggctgagctgatcggatcacctagagactggaaatgctttctggtctgaagtcacctgccctatctggacattccatagactaccacttttacccacgacttcgatgtggcatgctcattggaccagataagcaagcagtggcaagtggattggaggtcttggaatatgaaggcctggccctcgtctcagcttggaataaatctgaaggcccatcacagcttcagagatgcttggagaaggctgaggtctcccctgcaaccttatgagaaccttgagttgttgaactcattaattctttgggaccatcttcctgatgttcaagtttgcgaaacaggctttccctttaagatttgttttcctcaaaatacaagactattgatgcttcagttttgaagtggattctgcactcaagaaatgtaccattgaagaatgggactggtaggaagggaaaaaaactaaaaggaaacgcattttcgagttgcacatcatgatcaggcacagagtccagatacacttggagtagcaagcatccatccttgtggagacgcacatgaaccaggactctctgcacccacccctctcaagttttattttccgacggctgtaatgttccaggacacctgccatcatggagggttatccagcacctggaggatacctgctacc

SEQ ID NO: 85822 - DNA, 739 bp, Homo sapiens
ctgctttccctctatgagagcttgagaccaaatgtggcatctcgtgggggctcagaggagggggcagcagtgagttctgtgatagtgtcatgaggcccttgtcccgtggacaagtgacccagagaacctgcccatggggccccaggctccaaccagtcgagcccccaccatatgccagcacccaagttctctgtaaggtatttggtagaacacaacgtgtggtgtggtagcttgcttttgaggcgtatctaacttggaagcaagccattcagacaaaacactttatcttgcaggccaagaagacgctggagggaggctgttaggagggactctgagcttcacacctgtctgctgccatgggtgcagagccctagtcctgatggcccctggtggcacatatcgaatgcctagggcagaaaggaagtgggaatggcgaagatgtgacattcctcggtgttagatcctgttttttcttaacaagttgaggcgtgggtagagcaggaattggttttccagcattgtgtccgtaaacctgagttagaataagatgtaacggaagccacgataaagactcggtcaaatcctgcagcctggggcttactgtgtgcagactgcaacatgtgggtcttggcctctctgagatggaatggggcccagagcctttcccccaaagctggcagggctgggacttggggacaccctgcctcaaggtccccgttttaaaacactctcactaagg

SEQ ID NO: 85823 - DNA, 326 bp, Homo sapiens
tttatagcggccgcctactactactatacgggtgcgattagacgacagaagggaggctgttaggagggactctgagcttcacacctgtctgctgccatgggtgcagagccctagtcctgatggcccctggtggcacatatcgaatgcctagggcagaaaggaagtgggaatggcgaagatgtgacattcctcggtgttagatcctgttttttcttaacaagttgaggcgtgggtagagcaggaattggttttccagcattgtgtccgtaaacctgagttagaataagatgtaacggaagccacgataaagactcggtcaaatcctg

SEQ ID NO: 85824 - DNA, 613 bp, Homo sapiens
aaagcctggccaattaagaagttcaggaaaggttatgggcggaagcgccgacctatcaagctgtttgacaccggaagaggacggacctaagatggcggcctccagggggctgggaatagccgctcatgtcggctaacggagcggtgtggggccgcgtgcgaagccgcctccgcgccttccccgagcggctggccgcctgcggggccgaggccgcggcgtacggcaggtgcgtgcaggcctccacggccccgggcggccgcctgagtaaggacttctgcgcgcgggagttcgaggccctgcggagctgcttcgccgctgcggccaagaagacgctggagggaggctgttaggagggactctgagcttcacacctgtctgctgccatgggtgcagagccctagtcctgatggcccctggtggcacatatcgaatgcctagggcagaaaggaagtgggaatggcgaagatgtgacattcctcggtgttagatcctgttttttcttaacaagttgaggcgtgggtagagcaggaattggttttccagcattgtgtccgtaaacctgagttagaataagatgtaacggaagccacgataaagactcggtcaaatcctg

SEQ ID NO: 85825 - DNA, 593 bp, Homo sapiens
tgggtagagcaggaattggttttccagcattgtgtccgtaaacctgagttagaataagatgtggacctaagatggcggcctccagggggctgggaatagccgctcatgtcggctaacggagcggtgtggggccgcgtgcgaagccgcctccgcgccttccccgagcggctggccgcctgcggggccgaggccgcggcgtacggcaggtgcgtgcaggcctccacggccccgggcggccgcctgagtaaggacttctgcgcgcgggagttcgaggccctgcggagctgcttcgccgctgcggccaagaagacgctggagggaggctgttaggagggactctgagcttcacacctgtctgctgccatgggtgcagagccctagtcctgatggcccctggtggcacatatcgaatgcctagggcagaaaggaagtgggaatggcgaagatgtgacattcctcggtgttagatcctgttttttcttaacaagttgaggcgtgggtagagcaggaattggttttccagcattgtgtccgtaaacctgagttagaataagatgtaacggaagccacgataaagactcggtcaaatcctg

SEQ ID NO: 85826 - DNA, 1130 bp, Homo sapiens
ccccaccagtttccggccgggcacagatggaagagtgctgtcttgtgtatccccttcggacagacagagttggcccagtcccgcggtgaaaggaaggttcaagtctcagctgccagatctaagtggccttcacagctacagtccggggagaaacagcgtggctggaagcaacccgcaaaagccaggcctgggcagtcctgggcgctacagccccgtgcacgggagccagctccgcaggatggcgcgcctggctgagcttgccgccctgtaggcttggcgctgggctctcggtttgttcttcatttttaaagaaggaagggtcatatgtttattgggacctaagatggcggcctccagggggctgggaatagccgctcatgtcggctaacggagcggtgtggggccgcgtgcgaagccgcctccgcgccttccccgagcggctggccgcctgcggggccgaggccgcggcgtacggcaggtgcgtgcaggcctccacggccccgggcggccgcctgagtaaggacttctgcgcgcgggagttcgaggccctgcggagctgcttcgccgctgcggtaggtgggcgcgggccccttccccccttcccagcccttcccctccaagagccagcgggccccggctttcctttgctttcccgttggttcaaggtttgagcgcctgccgcgtgctttagacgccggctgacaaaatcaccgagccatcgacgagcccgcgaaacctcggccgtcctgggcttgtccctgcatgtttgtaaagcgggactggcaccaacctcagaaaggatgggagatgtgtgcaaaaaagcgccttgtaaaacgcgccaagaagacgctggagggaggctgttaggagggactctgagcttcacacctgtctgctgccatgggtgcagagccctagtcctgatggcccctggtggcacatatcgaatgcctagggcagaaaggaagtgggaatggcgaagatgtgacattcctcggtgttagatcctgttttttcttaacaagttgaggcgtgggtagagcaggaattggttttccagcattgtgtccgtaaacctgagttagaataagatgtaacggaagccacgataaagactcggtcaaatcctg

SEQ ID NO: 85827 - DNA, 1018 bp, Homo sapiens
ccccaccagtttccggccgggcacagatggaagagtgctgtcttgtgtatccccttcggacagacagagttggcccagtcccgcggtgaaaggaaggttcaagtctcagctgccagatctaagtggccttcacagctacagtccggggagaaacagcgtggctggaagcaacccgcaaaagccaggcctgggcagtcctgggcgctacagccccgtgcacgggagccagctccgcaggatggcgcgcctggctgagcttgccgccctgtaggcttggcgctgggctctcggtttgttcttcatttttaaagaaggaagggtcatatgtttattgggacctaagatggcggcctccagggggctgggaatagccgctcatgtcggctaacggagcggtgtggggccgcgtgcgaagccgcctccgcgccttccccgagcggctggccgcctgcggggccgaggccgcggcgtacggcaggtgcgtgcaggcctccacggccccgggcggccgcctgagtaaggacttctgcgcgcgggagttcgaggccctgcggagctgcttcgccgctgcggccaagaagacgctggagggaggctgttaggagggactctgagcttcacacctgtctgctgccatgggtgcagagccctagtcctgatggcccctggtggcacatatcgaatgcctagggcagaaaggaagtgggaatggcgaagatgtgacattcctcggtgttagatcctgttttttcttaacaagttgaggcgtgggtagagcaggaattggttttccagcattgtgtccgtaaacctgagttagaataagatgtaacggaagccacgataaagactcggtcaaatcctgcagcctggggcttactgtgtgcagactgcaacatgtgggtcttggcctctctgagatggaatggggcccagagcctttcccccaaagctggcagggctgggacttggggacaccctgcctcaaggtccccgttttaaaacactctcactaagg

SEQ ID NO: 85828 - DNA, 586 bp, Homo sapiens
ctgctttccctctatgagagcttgagaccaaatgtggcatctcgtgggggctcagaggagggggcagcagtgagttctgtgatagtgtcatgaggcccttgtcccgtggacaagtgacccagagaacctgcccatggggccccaggctccaaccagtcgagcccccaccatatgccagcacccaagttctctgtaaggtatttggtagaacacaacgtgtggtgtggtagcttgcttttgaggcgtatctaacttggaagcaagccattcagacaaaacactttatcttgcaggccaagaagacgctggagggaggctgttaggagggactctgagcttcacacctgtctgctgccatgggtgcagagccctagtcctgatggcccctggtggcacatatcgaatgcctagggcagaaaggaagtgggaatggcgaagatgtgacattcctcggtgttagatcctgttttttcttaacaagttgaggcgtgggtagagcaggaattggttttccagcattgtgtccgtaaacctgagttagaataagatgtaacggaagccacgataaagactcggtcaaatcctg

SEQ ID NO: 85829 - DNA, 1401 bp, Homo sapiens
ccccaccagtttccggccgggcacagatggaagagtgctgtcttgtgtatccccttcggacagacagagttggcccagtcccgcggtgaaaggaaggttcaagtctcagctgccagatctaagtggccttcacagctacagtccggggagaaacagcgtggctggaagcaacccgcaaaagccaggcctgggcagtcctgggcgctacagccccgtgcacgggagccagctccgcaggatggcgcgcctggctgagcttgccgccctgtaggcttggcgctgggctctcggtttgttcttcatttttaaagaaggaagggtcatatgtttattgggacctaagatggcggcctccagggggctgggaatagccgctcatgtcggctaacggagcggtgtggggccgcgtgcgaagccgcctccgcgccttccccgagcggctggccgcctgcggggccgaggccgcggcgtacggcaggtgcgtgcaggcctccacggccccgggcggccgcctgagtaaggacttctgcgcgcgggagttcgaggccctgcggagctgcttcgccgctgcggtaggtgggcgcgggccccttccccccttcccagcccttcccctccaagagccagcgggccccggctttcctttgctttcccgttggttcaaggtttgagcgcctgccgcgtgctttagacgccggctgacaaaatcaccgagccatcgacgagcccgcgaaacctcggccgtcctgggcttgtccctgcatgtttgtaaagcgggactggcaccaacctcagaaaggatgggagatgtgtgcaaaaaagcgccttgtaaaacgcgtaagctttcgtgttagcactgccgccggggggtgtcatgccaggattgacccaacacaggactcccggaaagtgcccagcaccttccgggtcttcacctccctggcacttgcagcccctgtgcacctgcagtggtggattccttcagcacgtgtcctgcggggaacccccagccaccctcacaactggcacgatagggcttcttgcccgtggggctttaagtcattctgaggctggttccctaagtgtcagccgcaccgggtaccacctcagtgtatctgggtaggccttgatgccagtgctgactctgtttactgggagctgttaatccggagatttggaccagagaaagggtatttgaacaagagttccacggccttcatccctacccggccccagcagccttggatccaggggtggacaactcatcagaagttgcactttttgctgggtgtggtggcgcgtgcctgtaatcctaccgctttgggaggctgaggtgggtggattgcttaggcctagaagtttgagaccagcctgggcaacatatggagaccccgtctctac

SEQ ID NO: 85830 - DNA, 978 bp, Homo sapiens
  misc_feature (869)..(869): n is a, c, g, or t
ccccaccagtttccggccgggcacagatggaagagtgctgtcttgtgtatccccttcggacagacagagttggcccagtcccgcggtgaaaggaaggttcaagtctcagctgccagatctaagtggccttcacagctacagtccggggagaaacagcgtggctggaagcaacccgcaaaagccaggcctgggcagtcctgggcgctacagccccgtgcacgggagccagctccgcaggatggcgcgcctggctgagcttgccgccctgtaggcttggcgctgggctctcggtttgttcttcatttttaaagaaggaagggtcatatgtttattgggacctaagatggcggcctccagggggctgggaatagccgctcatgtcggctaacggagcggtgtggggccgcgtgcgaagccgcctccgcgccttccccgagcggctggccgcctgcggggccgaggccgcggcgtacggcaggtgcgtgcaggcctccacggccccgggcggccgcctgagtaaggacttctgcgcgcgggagttcgaggccctgcggagctgcttcgccgctgcggccaagaagacgctggagggaggctgttaggagggactctgagcttcacacctgtctgctgccatgggtgcagagccctagtcctgatggcccctggtggcacatatcgaatgcctagggcagaaaggaagtgggaatggcgaagatgtgacattcctcggtgttagatcctgttttttcttaacaagttgaggcgtgggtagagcaggaattggttttccagcattgtgtccgtaaacctgagttagaataagatgtaacggaagccacgataaagactcggtcaaatcctgaaanaaaatatctctttatcccctatttcttatatcatatcatcctcctcctctctcccctcctttcaacatataaaattaactggcccgcgtttaccaacgtggcaactggt

SEQ ID NO: 85831 - DNA, 1561 bp, Homo sapiens
ccccaccagtttccggccgggcacagatggaagagtgctgtcttgtgtatccccttcggacagacagagttggcccagtcccgcggtgaaaggaaggttcaagtctcagctgccagatctaagtggccttcacagctacagtccggggagaaacagcgtggctggaagcaacccgcaaaagccaggcctgggcagtcctgggcgctacagccccgtgcacgggagccagctccgcaggatggcgcgcctggctgagcttgccgccctgtaggcttggcgctgggctctcggtttgttcttcatttttaaagaaggaagggtcatatgtttattgggacctaagatggcggcctccagggggctgggaatagccgctcatgtcggctaacggagcggtgtggggccgcgtgcgaagccgcctccgcgccttccccgagcggctggccgcctgcggggccgaggccgcggcgtacggcaggtgcgtgcaggcctccacggccccgggcggccgcctgagtaaggacttctgcgcgcgggagttcgaggccctgcggagctgcttcgccgctgcggccaagaagacgctggagggaggctgttaggagggactctgagcttcacacctgtctgctgccatgggtgcagagccctagtcctgatggcccctggtggcacatatcgaatgcctagggcagaaaggaagtgggaatggcgaagatgtgacattcctcggtgttagatcctgttttttcttaacaagttgaggcgtgggtagagcaggaattggttttccagcattgtgtccgtaaacctgagttagaataagatgtaacggaagccacgataaagactcggtcaaatcctgaaaaaaaaaaaaaaaaaaaaaaaaaaaaaaaaaaaaaaaaaaaaaaaaaaaaaaaaaaaaaacaaaaaaaaaaaaaaagaaaaagaaaaaaaaaaaaaaaaaaaaaaacaaaaaaagaaaaataaaaaaaaaaaaaacaaaaaaagagagagagggcgggggcgaccctcgaaccacccctcctcgatggaggcgcacacaaaagaagaagcacacacatacatcgcctaacacgcggcaccacagagagataggggtgatctattattcataaacatcggcagctctccactatcttgtacacatcaaaccacaaaaatagactgggaagcaaaaacagcatacgacgagaaagaagcaaaaaacaatgagagaagagaaacaacatcactaatagagagggatggacgaagagagaaacagacaataggagagaaacgagaccgacaacaactaaagaaagatagcaacaagctaaatataaagagcagcaatcgtgaagataagtagtaggattggagacaaaacaatatatagagaagatgatagaaacgaaagagacgaaacgagaactcaaagcaacacaacaaacacacagctagatgatcatataattgataagaagataaagaatagtagagcataaactacgaaccatgaaaaatgagaagaacatatcgtaatccacctacacac

SEQ ID NO: 85832 - DNA, 1034 bp, Homo sapiens
  misc_feature (879)..(879): n is a, c, g, or t
  misc_feature (895)..(895): n is a, c, g, or t
ccccaccagtttccggccgggcacagatggaagagtgctgtcttgtgtatccccttcggacagacagagttggcccagtcccgcggtgaaaggaaggttcaagtctcagctgccagatctaagtggccttcacagctacagtccggggagaaacagcgtggctggaagcaacccgcaaaagccaggcctgggcagtcctgggcgctacagccccgtgcacgggagccagctccgcaggatggcgcgcctggctgagcttgccgccctgtaggcttggcgctgggctctcggtttgttcttcatttttaaagaaggaagggtcatatgtttattgggacctaagatggcggcctccagggggctgggaatagccgctcatgtcggctaacggagcggtgtggggccgcgtgcgaagccgcctccgcgccttccccgagcggctggccgcctgcggggccgaggccgcggcgtacggcaggtgcgtgcaggcctccacggccccgggcggccgcctgagtaaggacttctgcgcgcgggagttcgaggccctgcggagctgcttcgccgctgcggccaagaagacgctggagggaggctgttaggagggactctgagcttcacacctgtctgctgccatgggtgcagagccctagtcctgatggcccctggtggcacatatcgaatgcctagggcagaaaggaagtgggaatggcgaagatgtgacattcctcggtgttagatcctgttttttcttaacaagttgaggcgtgggtagagcaggaattggttttccagcattgtgtccgtaaacctgagttagaataagatgtaacggaagccacgataaagactcggtcaaatcctgaaaaaaaaaaaacntcagggggggcccggnacccaaattcgccctatagagagtccgattacaattcaactggcagtaataaaacatccggggtgggccccggaacccaatcggccctaaaggggagcgttacaatcacttgcccgtgtttcaaaacggcgtaattggg

SEQ ID NO: 85833 - DNA, 946 bp, Homo sapiens
  misc_feature (866)..(866): n is a, c, g, or t
  misc_feature (881)..(881): n is a, c, g, or t
  misc_feature (883)..(883): n is a, c, g, or t
  misc_feature (885)..(886): n is a, c, g, or t
ccccaccagtttccggccgggcacagatggaagagtgctgtcttgtgtatccccttcggacagacagagttggcccagtcccgcggtgaaaggaaggttcaagtctcagctgccagatctaagtggccttcacagctacagtccggggagaaacagcgtggctggaagcaacccgcaaaagccaggcctgggcagtcctgggcgctacagccccgtgcacgggagccagctccgcaggatggcgcgcctggctgagcttgccgccctgtaggcttggcgctgggctctcggtttgttcttcatttttaaagaaggaagggtcatatgtttattgggacctaagatggcggcctccagggggctgggaatagccgctcatgtcggctaacggagcggtgtggggccgcgtgcgaagccgcctccgcgccttccccgagcggctggccgcctgcggggccgaggccgcggcgtacggcaggtgcgtgcaggcctccacggccccgggcggccgcctgagtaaggacttctgcgcgcgggagttcgaggccctgcggagctgcttcgccgctgcggccaagaagacgctggagggaggctgttaggagggactctgagcttcacacctgtctgctgccatgggtgcagagccctagtcctgatggcccctggtggcacatatcgaatgcctagggcagaaaggaagtgggaatggcgaagatgtgacattcctcggtgttagatcctgttttttcttaacaagttgaggcgtgggtagagcaggaattggttttccagcattgtgtccgtaaacctgagttagaataagatgtaacggaagccacgataaagactcggtcaaatcctgnacaaagaaaactaantnannaaaagaagaaaatggaaacttacaactcaattttccactcagcatattaaaataaaaaaa

SEQ ID NO: 85834 - DNA, 411 bp, Homo sapiens
ggcctgcatgcacctgccgtacgccgcggcctcggccccgcaggcggccagccgctcggggaaggcgcggaggcggcttcgcacgcggccccacaccgctccgttagccgacatgagcggctattcccagccccctggaggctgttaggagggactctgagcttcacacctgtctgctgccatgggtgcagagccctagtcctgatggcccctggtggcacatatcgaatgcctagggcagaaaggaagtgggaatggcgaagatgtgacattcctcggtgttagatcctgttttttcttaacaagttgaggcgtgggtagagcaggaattggttttccagcattgtgtccgtaaacctgagttagaataagatgtaacggaagccacgataaagactcggtcaaatcctg

SEQ ID NO: 85835 - DNA, 865 bp, Homo sapiens
ccccaccagtttccggccgggcacagatggaagagtgctgtcttgtgtatccccttcggacagacagagttggcccagtcccgcggtgaaaggaaggttcaagtctcagctgccagatctaagtggccttcacagctacagtccggggagaaacagcgtggctggaagcaacccgcaaaagccaggcctgggcagtcctgggcgctacagccccgtgcacgggagccagctccgcaggatggcgcgcctggctgagcttgccgccctgtaggcttggcgctgggctctcggtttgttcttcatttttaaagaaggaagggtcatatgtttattgggacctaagatggcggcctccagggggctgggaatagccgctcatgtcggctaacggagcggtgtggggccgcgtgcgaagccgcctccgcgccttccccgagcggctggccgcctgcggggccgaggccgcggcgtacggcaggtgcgtgcaggcctccacggccccgggcggccgcctgagtaaggacttctgcgcgcgggagttcgaggccctgcggagctgcttcgccgctgcggccaagaagacgctggagggaggctgttaggagggactctgagcttcacacctgtctgctgccatgggtgcagagccctagtcctgatggcccctggtggcacatatcgaatgcctagggcagaaaggaagtgggaatggcgaagatgtgacattcctcggtgttagatcctgttttttcttaacaagttgaggcgtgggtagagcaggaattggttttccagcattgtgtccgtaaacctgagttagaataagatgtaacggaagccacgataaagactcggtcaaatcctg

SEQ ID NO: 85836 - DNA, 1037 bp, Homo sapiens
ccccaccagtttccggccgggcacagatggaagagtgctgtcttgtgtatccccttcggacagacagagttggcccagtcccgcggtgaaaggaaggttcaagtctcagctgccagatctaagtggccttcacagctacagtccggggagaaacagcgtggctggaagcaacccgcaaaagccaggcctgggcagtcctgggcgctacagccccgtgcacgggagccagctccgcaggatggcgcgcctggctgagcttgccgccctgtaggcttggcgctgggctctcggtttgttcttcatttttaaagaaggaagggtcatatgtttattgggacctaagatggcggcctccagggggctgggaatagccgctcatgtcggctaacggagcggtgtggggccgcgtgcgaagccgcctccgcgccttccccgagcggctggccgcctgcggggccgaggccgcggcgtacggcaggtgcgtgcaggcctccacggccccgggcggccgcctgagtaaggacttctgcgcgcgggagttcgaggccctgcggagctgcttcgccgctgcggtttgagcgcctgccgcgtgctttagacgccggctgacaaaatcaccgagccatcgacgagcccgcgaaacctcggccgtcctgggcttgtccctgcatgtttgtaaagcgggactggcaccaacctcagaaaggatgggagatgtgtgcaaaaaagcgccttgtaaaacgcgccaagaagacgctggagggaggctgttaggagggactctgagcttcacacctgtctgctgccatgggtgcagagccctagtcctgatggcccctggtggcacatatcgaatgcctagggcagaaaggaagtgggaatggcgaagatgtgacattcctcggtgttagatcctgttttttcttaacaagttgaggcgtgggtagagcaggaattggttttccagcattgtgtccgtaaacctgagttagaataagatgtaacggaagccacgataaagactcggtcaaatcctg

SEQ ID NO: 85837 - DNA, 1063 bp, Homo sapiens
  misc_feature (898)..(898): n is a, c, g, or t
ccccaccagtttccggccgggcacagatggaagagtgctgtcttgtgtatccccttcggacagacagagttggcccagtcccgcggtgaaaggaaggttcaagtctcagctgccagatctaagtggccttcacagctacagtccggggagaaacagcgtggctggaagcaacccgcaaaagccaggcctgggcagtcctgggcgctacagccccgtgcacgggagccagctccgcaggatggcgcgcctggctgagcttgccgccctgtaggcttggcgctgggctctcggtttgttcttcatttttaaagaaggaagggtcatatgtttattgggacctaagatggcggcctccagggggctgggaatagccgctcatgtcggctaacggagcggtgtggggccgcgtgcgaagccgcctccgcgccttccccgagcggctggccgcctgcggggccgaggccgcggcgtacggcaggtgcgtgcaggcctccacggccccgggcggccgcctgagtaaggacttctgcgcgcgggagttcgaggccctgcggagctgcttcgccgctgcggccaagaagacgctggagggaggctgttaggagggactctgagcttcacacctgtctgctgccatgggtgcagagccctagtcctgatggcccctggtggcacatatcgaatgcctagggcagaaaggaagtgggaatggcgaagatgtgacattcctcggtgttagatcctgttttttcttaacaagttgaggcgtgggtagagcaggaattggttttccagcattgtgtccgtaaacctgagttagaataagatgtaacggaagccacgataaagactcggtcaaatcctgaaaaaaaaaaaaaaaaaaaaaaaaaaaaacttncggagggaataaaaatgagggggggcggagaaaaagagagggattgaaatgggggcattgggcaataattggttccgtaaaccaagtttttttggcacaagtgggaaattggggggacccaaatagggaggagaataaatcagataagcagtgtacttgtagaag

SEQ ID NO: 85838 - DNA, 496 bp, Homo sapiens
agagagagcaggagggatgatactctgtcctgtgaatatctcagcttctctaggggtgaatagggctccctgttctgctctgcccaaggtactctgtaaattgatcaaagaccctggaatccttccattctgggtcagctgggagctctgctaactggcagctccccataccaaaccctagaaatagcttatctgtaggaagcccaagttttctaaagttattagaaaattgctggctcttacttttgaccagatatcattctgcccttctgcttctctcttctataaatctgggtaaatgggacacttttgttcttagagatctcactctatcccaaatggtcactgaaatattgacaattcatcccattggaagatcaggggcttatttctaaaatggggaactgccaggatcttctgcaggttggatgaaagcccctgtccagatttgaaagtggatcccacgttctgcagggagagcttcagattcatcctc

SEQ ID NO: 85839 - DNA, 1446 bp, Homo sapiens
tcctttgcacccttactgaggaagtatcttgaggaaattctccagcaaaatgaggatgaaaaccaggaaagaagaagaaatgggatccataaaacagtggaccttacttaggatgtctcattctagagtgacagccaaaagggtatctcaccctagagtgacagctatccagcagactaatttcagatgagagcatactgtctcgggctttctgggaagaatgtgcattcagtgccatagatagtatcattgaagagctgggatgcttgagaagattatttagtcaagaaaaaagaaagacaaatcaacaatatgtcaaaaaattcaggtccaattatagagcaaaataaaatgaggcatgattttgagttattcatgaagaataagaagaggcttgataggtacatttccttttctatggcacaggcatgatgatattgggtgtgtagggaagaaaatatcctagcttatactaggctcccagtaagaagtatttaaatagccaaaataatgtggatatcatttattagtattcagtgttcagatcagcctattaacaaagtgtgaaaggtttcattttttattcagaactgaagttgaaagtaattaatgctgacaaagggaaagaaagcagaaagagattgagaattagaggaagagaagtggaatcaaaggtagagatacttatatattcaaagtggggatgaaaagatcttcagttaatggaacaagaactagaggattagtgtattgttcaaagctataaaatcaaaccaatagatgtattaaaaagtgatgtaactatcagacatttggagagagatggacaaaggaaagtggcgatagtgtaagttaaatccttatcttttgtaatggggaattattaaagatgttgtaaagtcagtaagtcaagaaattattgctcaaacatattatttaaagttagaaagttagttaccagacgatctaaaataaatattgttaaaagcattacctctagggaatgggatttagatttaaaaagggtgggatgggaaactgtgtttttcattttaagtccttctgtactatttaattttttaccttgtgcatgtattactttgaaaaaatttttaataaacccaaataaaaatcttccagtgacttcccattgattaagatgcaacccagctaaagcctttaaaatggttttcaaggtcctcaagtatctaggtccacttgatgtgtccaggctcatgatatctccccacaagtctctatttccagccagattaagtatcttccagttattaaaacacacttcacattcttttgtttgtataggtgttccacaaaaaacaaagcctactgctgatctcaccatgtctgctgagtaagcttaccatctagtgggttttaatatttgttgaatgaaggaatgtccaatacagcattgaatgaagtttg

SEQ ID NO: 85840 - DNA, 327 bp, Homo sapiens
cagcttattaccctgtgtatatggcagtgttctcaggtttacctgcttctccatgatggggaaatcctggcatcggttattattgtgcccaataaaatgctattttgatgagatgccaaaatatttatcatctttactatgtagaagtgaatggttgcacaatttttgttttagttgctggctaggacttagaaaggatggatggaataaaaagtgaacttggtgcagaatgtccctccaggtggctgtaaccaccagtcctgctccttggtccagtggcgtcagggtttctcatacccacacagtggaacagtagagcctgctgtg

SEQ ID NO: 85841 - DNA, 2235 bp, Homo sapiens
  misc_feature (2)..(3): n is a, c, g, or t
  misc_feature (5)..(6): n is a, c, g, or t
  misc_feature (8)..(8): n is a, c, g, or t
  misc_feature (1747)..(1747): n is a, c, g, or t
  misc_feature (1765)..(1765): n is a, c, g, or t
  misc_feature (2191)..(2191): n is a, c, g, or t
gnnannangttcatagaaacaaaatgatcacacttctataattatagaactaaagtaatggttacctttggtaggattattgactaagggagctttctgtatcttggtctggatggtagttacatggatttatactcatgagaagacttcaaaaagtccatggaaaacatacttaaaagatacaaataaaaaatataaactttatttctcaacataagttccatcaagttcaagacacctttgtaagtgatgataccagccatttagttcatccctaaagaactgagtgtcctgggaatttaaccatgtcaattaagtcttttttacattataaactgaagaaaaatgcatgccttttacagattttaatattaagaaacaaaaaagtcagagccaaatcaagactgtaagatggatttcccatctaaacttgcaaaattgcctttgtttgatgagaggaatgagcaggagtatcattgtggtggaaaaggattctctggtggagctttcctaggtgtttttctgctcaagctttggcttgctcaaaacactttcatagtaagcaggcgggtcatttttggtcctccagaaagtcaacaagcaaaatgtcttgatcaccccagaaaactgttgccatgatgcttgctcttgactagtccacttttgctgtgactggactatttccacctcttggtagcccttgctttggttgtgctttgtcttcaggattgtactggtaaagccatgtttcatcccattaccattcttcaaagaaatgctccaggatccgaatcctactcattttgttttaaattttcattgaaagcatttctcttttctgcagctgatctggggacaatggttttggcacccatttagtggaaagtttgcccccattttaatttttcagtcataattgtgaaagcagaacccattgagacatctgtcatgttggctcttgtttgtgctgttatcatttgtccttttcaattgggatacaaacaagatgaatttttgtggatggtctgccactgcaggcttcaacactgtctcatcccttcttaaaacaagttatccatttgtaaaccgccgatttctttagcgtattgtctctgatatgatttggctgtgtccccacccaaaactcattttgaatcatagctcccacaattcccaagtgttgtgggagggacccagtgggaggtaattgaatcatggaggcaggtctttcctgtgctgttctcatgatagcgaataaatctcttgatttctcatggttttataaaggggagtatgtcatgtaagaggtgacttgctcctccttgccttctgccatgattgtgaggcccccagccatgtggaactgtgagtacattaaacctcttctcctgtgtaaattacccagtctagggtacgtctttattagcagtgtgaaaatggactaataacagtctccataaatgttttgtaaaaatcagtgattttactattcttccacccaggcttcaccataactttgctgtttatccttgcttcaattttagcagaattcatgttgctctgatgagggcttttttcacactaatgtcttgttcttaatgcctcaaactatatcctgttcagacatcttataataagttagtatgaatttattttgatgcaaaaaatttttgaaattcatccatagttttttcataagatgcatttcaatgaactttttgaagactctcacatgtataaaaataantaagctatacaccaaagntttatatactctatatatgtaaatcataccagtttttaaaatatataaaatgtggcagggcacagtggcttacacctgtaatctcagcactttgggaggacaaggtgggtggatcacttgaggtcaggagttcgagaccagcctgaacaacatggtgaaaccccgtctctactaaaaatacaaaaattggccaggtgcagtggctgacacctgtaatcccagcacgttgagaggctgaggcagacgaatcacgaggtcaggagttcaagaccagcctggccaacatggtgaaactccgtctctactaaaaatacaaaaacttagctgggcgtggtggcaggggcctgtaatcccagctactcgggaggctgaggcacagagaatcccttgaacccgggaggtggaggttgcagtgagctgagatcntgccactgcactccagcctgggcaacaaggcgggactccttatc

SEQ ID NO: 85842 - DNA, 319 bp, Homo sapiens
aataataagcacagctaaagatgctcaaaatcgttaaccatttggtaaatgcaaatcaaaaccatgagatactacctcacactcaattagggtgtcaactaccagaacgagtgagtataacaagtgttggcaaggatatggagaaattggagctcttgtgcaatgctggtaggaatgtaaaatggtgcagtcactctagaaaacagttcctcaaaaaatttggccgcatatggtggctcatgcctataatcccagcactttgggaggccaaggtgggtggatcacctgaaatcaggagttcgagaccagcctggccaat

SEQ ID NO: 85843 - DNA, 4368 bp, Homo sapiens
  misc_feature (791)..(791): n is a, c, g, or t
  misc_feature (3480)..(3480): n is a, c, g, or t
tctttcttcactctgaagccaagagccgaccttctgagccctcaagaaagatcagaacagattcatgggtgatttagcctatctgtcccaggccagcgtggctgagtgtgctggctggaggcctctctctctgcttcgagggtagctgagatccaccccggaaaccggcaggatgaagggggcaagtgaggagaagctggcatctgtgtccaacctggtcactgtgtttgagaatagcaggtatgggcagctggggtgggagggtcaccatggtgggctggcagccaccctccagcctttctggcagctctctccctgggccctgccccggaccctcctcctgcaggggcagccccgcgttcctcggtcacggattccttggagcatgggagagtgtcggtgggacaccaggagccaggcaggggtgagagtgccagtgtgtgttgggagagtccagacaggtgtggttacgagcaagcatgggcagaccaaagcctgtgtgtgggcacaggaccccacccagtgcctgccagcacctctcagaaaaggtagctgatactcaccaagaatttacgccctatgattaggataaccatataatttatcattcagcacacaattgaaactgaaagtaaatgccaaataaaatgtggtggttgtgggggaggcattacaggtaaagctgggaccgtatgaggcaaaccaggatgtacgggcagcatcctgatggggtactccctactctaagttcatgtccttacttatttaatttagtcatcgaacagcctaanaggggtagattctgtttctgttcccgtcttatagatgaggaaatggagacacagagaggtgaggatgccaagtgctttaagtatctggggcaatgctggggcgtctgtctggagggaaaaggctgggccagatgcgtggagtcattggtagccctgggagcatgtgtgtttgtgtgtgtgcgcgtgtgtgtatgtgtgtgttgtgtgttatgtgtggcatcaatccattctgcaggcatttcttaagctcaggactgtgttaggggctgtcccaggtagggttttctggaaatagactcagacagaggtttgcctcaggtgatttatcagggagagcttttgggaacaacagctgtgggtgtgagggaagcagggccgggcagggggagatgctgaactgcagtgcacctgccacagaggcctcagcctgtcccagggagctctggagctgggatgcctctcggttgttccagctgaggaagagggctgggtatttgtatctccatgtggactggacaagagactctgggtgaggcagctctctcttccagagagtgattcccagagagggactcagccaataaattacccggcagcccccagtactaccagtagctggtggggatggtgtggggaggcctcattcctgaaggagggacatgggtggcacagcacagcatcctacaggaactgtagaggatgaagaagggtttcagtatttggatgctgagctcatcgaataactatgatgcaaggtcatagacagtagatgtcctaggaatggcccggatgctgtattgagggcactcatggcaggcaatgtttcctgtaggcttcagggtggagatggcatagatgtagacctagaagtcttcaacttcctgagctgggtgattctcccctgcctctcccgggatctttgccaagctcgtcctgttcagcaccaaagacagctcttgggtgccgccttcctggcccaccacccccttgggtgtgggtggatggtaccacctcactcaacatgcttgacgtggactaggcacacctgggtggagcccctcagcatgctgtgctctgcccaggcaataaccctggcaggagtgggcagcccttagacgggagttaggtcccagcaggcatcaagagggtgagagccactccttactgagtgaggggacccataccaactgccttggcctgggcttccttatgaggtctccagcacctcagctgatctgaaactgaggggcaaagaggaaacagaagctggccaggggccctagaacagaaatgcagaacctgaaaccaaatgtagaacagaaagcctgagaaccagctacgcccatgagctgcagacccatgggctgagaaaccagggactggggtgccagggaggggtgggagagcctgggagtagccacacagcactaggtcccaatgctttcgctgccacaaacccaattgtgtcacttggggcaagtcactttgactccgcggacctgtttctcctttactcaaatggggaggggcaggttagagtgaaggctcaggaagcagtcgcctgatttgaatcccacctctgccacttccgagccgcatgttactcatcctgtccagacctcagtttccttgagtgcaaaatatgggtaatgaaaacctttctcacggagttttggagatttcgtatttgtttggccttccatttcctggcctgtctttctcataaggatgcctgccctgttctgtcatcacaagcccttccacaccaagggcaacgttgggtgtattcatcaagggtgggccctgttgtctaaggaatttgactggcttgcagaacccagtacacagggtaataaaggtgacctacgaaggcccgtccctgggagaacagagcatctgctgctgggctggctctccctgcttctggacgtgtggaggatgtcgatcccattgagaagccccagcttttgcaggcctgctctcactttatattgttctgtggctcctaccttcccttgatgtataggttactgatgtggaaactgaaaacagaggtgaggtccaaaggtgaggataatccagggggtaccactcaaaaacccctatatacagaaaggattcctggacactgtggcttcattttaaacaaggaagtatgcagttccccagaaaataaaatatagtccaccctgactcattttgaacactgagttccctccaagaatgtgttgggagagaagtgaaagtcttactcagcatgttcccaaagaaagccaggcacccaggggcccctgcactggggatttgcaccaggcaacccaaatccacaccagggacttgctgctgttttccctgttctccagggaggaagccctcaggtctgtctcttctcctcaggaccccagaagcagcacccagaggccagaggctagaggacgtgcatcaccgccctgagtgcaggcctcccgagtccccaggaccacgggagaagacgaatgtcggggaggccgtggggtctgagcccaggacagtcagcaggaggtacctgaactccctgaagaacaagctgtccagcgaagcctggaggaaatcttgccagcctgtgaccctctcaggatcggggacgcaggtgcctgagggctgaggtagaggtgtggggtgctggggtggggagctctccctgacctcncctccacacatgctttcctagccagagccagcagttccccaggtgggggtatggtgtgatcagaggtcagctgggagctagatttccccatgcttaatggcctttgattcactaactgcctgctacgcaccgtgctggattacttcgcgagtccctcgtgtaggagttttttggacaaggaagttgaaacacagttttaaggaacttattcaaggccacacagcttggaacagtctccatcttgtgaacctaatactcttctcaggtggggcctcagtttacccactggaggagacaacaatctcaacctagaaatagaggtctgagtgtgaactgtcctgcccttagactaaagcccagtctgatctcttctgtggcttgcagttttctcatctgcagagttcaagggttggcatgcagatactgtgcacccaaattccctggagtcacatcccagcacgtctgcttactaactgtgtgtccttgggcaagtcacttgagtctctttgtgccagtttcctcatttgtaaaatggggatagtggttatagtaatgcgtcctggttttcaatcgctgctgaacaaacctatcaaaaatgtagcggctggccgggtgcagtaactcacgcctgtaatcccagcactttgggaggccgaggtgggcagatcacctgaggtcaggagttcaagaccagcctggccaacatagggaaacactgtctcaactaaaaatacaaaaattagttgggcatggtggtgggcgcctgtaatcccagctactcagtaggctgagacaggagaatcacttgaatccaggaggaggaggttgcagtgagccgagattgcgccactccactctagcctgggtgacagagcgagactctgtctc

SEQ ID NO: 85844 - DNA, 1048 bp, Homo sapiens
tctttcttcactctgaagccaagagccgaccttctgagccctcaagaaagatcagaacagattcatgggtgatttagcctatctgtcccaggccagcgtggctgagtgtgctggctggaggcctctctctctgcttcgagggtagctgagatccaccccggaaaccggcaggatgaagggggcaagtgaggagaagctggcatctgtgtccaacctggtcactgtgtttgagaatagcaggaccccagaagcagcacccagaggccagaggctagaggacgtgcatcaccgccctgagtgcaggcctcccgagtccccaggaccacgggagaagacgaatgtcggggaggccgtggggtctgagcccaggacagtcagcaggaggtacctgaactccctgaagaacaagctgtccagcgaagcctggaggaaatcttgccagcctgtgaccctctcaggatcggggacgcaggagccagagaagaagatcgtccaggagctgctggagacagagcaggcctatgtggcgcgcctccacctgctagaccaggtgtttttccaggagctgctgaagacagcccgcagcagcaaggccttcccagaggatgtggtcagggtcatcttctccaacatctcctccatctatcagttccattctcagttcttcctcccagagctgcagcggcgcctggacgactggacagctaacccccgcatcggtgacgtgatccagaagctggcccccttcctgaagatgtacagtgagtatgtcaagaactttgagcgagcggctgagctgctggccacctggaccgacaagtctccactcttccaggaggttctcactcgcatccaggtgaggctgggggagggctggagtcagcattgccactcccagcatgcagtggctcaggttgccttgagtgattccgggcatctcccaggctcagctgcttccataggcccctgcctactcgtccggccctcaggagcagcctgacccacctcccttctctcaccctctccgtgttgctcccccatccctccc

SEQ ID NO: 85845 - DNA, 492 bp, Homo sapiens
atgacacccccgtaccccgcccacacccagaattgccgtggaaagttgctttgggggattcagggagcctggcctcacctggccctatctagagtcgagaggaggtctctaggctgagggcaatccctgtgcccctcctgcaggacagctaacccccgcatcggtgacgtgatccagaagctggcccccttcctgaagatgtacagtgagtatgtcaagaactttgagcgagcggctgagctgctggccacctggaccgacaagtctccactcttccaggaggttctcactcgcatccaggtgaggctgggggagggctggagtcagcattgccactcccagcatgcagtggctcaggttgccttgagtgattccgggcatctcccaggctcagctgcttccataggcccctgcctactcgtccggccctcaggagcagcctgacccacctcccttctctcaccctctccgtgttgctcccccatccctccc

SEQ ID NO: 85846 - DNA, 403 bp, Homo sapiens
aaacttcatttccccttgacttcttatgacagtgttcagttttggttcttaattctttagtactgtatgggttctggcaccaaattgtctgagcctgaatcccagtgtcatcacttagtagtaaccttggctaggttagttatctagcccctctagccttgataattcatctttaaaagcaggttactagtagtaattaccccagagggtagttttaaggaataagtgaaatgcacataaaatgctttgaaaagtgctgggacacacacaggaagcaataaattaaagtttgcttttatcgttatgatgattattattttcagacttctttgtggtcttttcttcctggatttactcatttaaatgttgatgttccttgggttctctcagattgcggtgtttt

SEQ ID NO: 85847 - DNA, 655 bp, Homo sapiens
attaatagcctctccctgggaatgggcgggcctgggtccagtccacagggcccctcgtgggccctgatgaaggaaagagttgagatgggggcagcgctggaccccagggcccctgcctgcctcctggagagcccggtgacccaggcagccctggtgaggctgtgggtgcctgggccatagcgaggcccgcgagctcccacaggacagatgcggacagtgaggccggggaggccctgctgccctccgaactgtccctccagcccccagctttctgtggttctctgggccccctctgcagaggggcaggggagcccaccctggatcctgagacgccaagcttgagggacccccagagctctagcgaggctgcttcctttgcggatggtgaagctgaggtccagaggagggcaggggcaggtcctgggcgctccctaggcaaagggagccgatctccgggaggcggtcacagggagcgctcctgcgacttctagggcccgaaagctggggaggatgagagaccaggggcctttcgtcgtcccctgggctgggcagaggctcagcctgtgccgcaaccctaagcggcttctggcaagtccgagccgcggtccctttaagagggggtggagcttcaacctggcactagggatgctgctag

SEQ ID NO: 85848 - DNA, 113 bp, Homo sapiens
gatcaacagttctattacagattagaatgtttcacttcacagttctttgtaaatcatgtcaatttttatgatagctgtcaatttgggaaaatctgtattaaaatttttaaatg

SEQ ID NO: 85849 - DNA, 244 bp, Homo sapiens
cgagtagctgggactacaggtgcgcgccaccacgcccagctaattttttgtatttttagtagagacggggtttcaccgtgttagccaggatggtctcgacctcctgacctcgtgattcatctgccttggcctcccaaagtgctgggattacaggcgtgagccactgcgcctggccttatacagagttttaatgacataaaagggttaatcatttaaaactcagtcaggaaggaataaaacacat

SEQ ID NO: 85850 - DNA, 1267 bp, Homo sapiens
tccaattctttaggcttcttcattttaaacttcatgcagactctctttcttcagatgttataatacagttgattgggtttaaacttactggttaacagtctctttatatttctctcttgctaaaaattaagaacaaatcaacatgtttagaatttagggtgttttgaaaactctcttgagtctttataagtcctttgggttaactctaaaagtagttaaagttgtctgtattgatttcatagtttaagctccagagtattccctaattttctccttcttgttcctttgtgggcatcttcctattgcctcttgcataaactatacttgcttgtttctaagaccaatattgagcttttggttgaaatagtttgagaatttcttgggtacaaatttttgtcagatacttttcctacccatcactttttatatcattaaaattaataatacacatgtattgagattaaaagagggaagatttttgaaagatgcaacgtgaaccttttataactagagcagaaagatttttagcctctttaaaggaaatcctggcatttaagaaaatgtgttttcataacaacatgtttcattctctcattaacaatttcttactccataaataattattgaggtagttgtgaaaaatgcttaccagttgaggatctcttttatttgtcttaaccgtgaaactaattttgagttaaaaagcccatttggagttcttaccacacctcaaagctgtctgttttaatactttgagaatgtgaggaagtgtatttgatagactaagtctatcaaatactctttagggacttaatttttttttttttttttttgagatggaatctcgctttgtcgccaggctggaatgtagtggcgcaatctcagctcactgcagcctccgcctcccaagttcaagtgattctccttcctcagccttcagagtagctgggattacaggcacgtgccaccacacccagctaatttttgtatttttagtagagaaagggtttcaccatgttggccaggatggtctctatctcttgacctagtgatccgcccacctcggcctccaaaagtgctgagattacaggcgtgagccactgtgccacagccagggacttaattttttttaatgagtatctttttaacctgagatgcttaaaatactaaattttttattgtggtcctggaacttgttatatattagttttgaaaatggctaatttttacatctctgtttttagaaaagatatatgtgaactggaaa

SEQ ID NO: 85851 - DNA, 364 bp, Homo sapiens
gtggcgggcgcctgtcgtctcagctactcgggaggctgaggcaggagaatggtgtgaacccgggaggcagagcttgcagtgagccgagatcgcgccgctgcactccagcctggcggacagagagagactccgcctcaaaaaaaaaaaaaagaaaaaagaaaaaagaaaaaaaaatgatccaaaagaatttttcaaatgatacaaactagaaatacacagaagaaatataaaaaggcccattgaaaactttataagtaggccgagcgcgatgcctgtaatcccagtgctttcggagatgaggcacgaggatcacttgagaccaggaattcgagaccagcctgggcagcgtaacaagaccctctac

SEQ ID NO: 85852 - DNA, 1200 bp, Homo sapiens
aataagtctaaatttttttctgttcctggagatgaaggagctctgcagaataggccacgtcttcatttacctttatctctagtagccaaaagtcttgatttttatataactggaaaaaccacgcagcataatgcttatacacacacgcgcgcatgcatgcacacacacgcacgcacacacgatgcacacgcatgcacacacgcacacatgcacacacacgcatgtgcgcgcacacaccacacatgcacacacgtacacaatgcacacatgcacacacgcacacacatgcacacacgcacacgcatgcacacacgtgcgcacgcacacacacacactgagcaccgttgagctttggtagaaaatggcaaaattacgatgtttttctcatttctggtgattggcttccgagtgttatttagagagcggagtggagagggctctttgcagccctgcggtagtgtcttgtgctcaccaagaggctcacgggaaacatgtcctccaacatgaaggtgtttgctaagattccaaccaggacccagtcttgggccacagaacactgactgctcccccaagcccctcgcagaccgcagggatattttcccttcagaacctgttgcatcagaatggggaaagcgagggctgagaatcccagaggaggccgtgaactgttctggaaaagcgagggctttgcagtcagaccttcatatgcactttgttctatctgttgcgctctgcctaaatgaccacgggccagtgactttacctctctgatccctgctccttgcctagatagtggggatcacgtcgtaatgtatgtaaagaaccgggtgcgggacttggcacctgggaagtgtcttaatacatgtctgtcgagaaaaggaagggtctcgacgtgcggaaacaagacggatgccaggaaatacgtctgcccacctccacgcccctgacagcggaggctcctggaggtctggtgagaggccccacgtgctccagccccctccgctctgtgctgagctctgcctttaagagactgcagctcctgcctctaaaaagcctttcaaaattctttattaaattttcatggcgcataaagtcaaggttctgttacttggcctcagttgtcttggcaacttcataaaacgcaataataaaacgaagctgagtgttgctaaacacaggctcattgtataaacgaaaaaa

SEQ ID NO: 85853 - DNA, 199 bp, Homo sapiens
tagtgtgggatgctgacagtaggaagcttgggtgtttatgagggcaggatatgtataagaactctcagcatattcagtcctcacaacaaccctatgtgtccaacatatccaagatattatcatctcaaaatgtaaccaatattttaaaaatttaaatagttttggctgggcacagtggctcacgcctgtaatcccagca

SEQ ID NO: 85854 - DNA, 528 bp, Homo sapiens
aaggtaaaattcaacagtctggaattcaataaaacattagtcctgcccagaagaattcaaaactatttatgtatacactccaccctcaaggagggtgctccccactccttacacatggactatgcatagtgacttccttcaaaacagcaccagtatgaaaatgaggggaaagattactttacagtggagaaatgtgacaagcattatctcaggcaggtgatcaaggataacatcaatagtaataaatcatgtcagtaataggtatccttgatatgatgtgatgacaccagcagttttcctctcaaaaacagaaaatcccagtgtaatcatgagaaaaacatcagaaaaatgtcagttgagggacattctacaaaatacctgacttgtactcctcaaacctatcaaggtcatcaaaaacaggaaaagtctgagaaactgtcatagccaaaaacagcctaaggtcatgtgactgctgaatgtgatttggtatcctagatatgactattaggatcagaaaaagacactgta

SEQ ID NO: 85855 - DNA, 700 bp, Homo sapiens
gttgacacagtctatacatgcattaagagatccactaagaagaatttaaaaagtagtttagaaaagaggagctgtcctgctttccttcttatagatagcattttggagaattttttaagctttaccatggtaactaaattgatcagtataccctgagatgtgagtctcctccattactggcctatgaatttcatccttccaagttcttaattccttgttataccagggacaatggaggaaaagtgtgaaaccagatcaaagacatcaaatcaagaacaagaacaactttgagtgtaaatatgtaactctactgcagcatcacctgtgttttccagatcagtcacctatcaaagataaaaacttatcaggcaaaagaaggtaatggaggcaaaagtgatggtacaattagtgccaacactggatgaaaagaaagatcttaaattagttgagtattaagaaaacagttccaacgaagcattagcccaggccagatactcgaaaattacatacctgtgtggctagtagtctgtgggacactcaaataagctaaagtttttggccaggcacagtggcacatgcctgtaatcccagcattttgggaggccgagccaggtggatcacttgaggtcaggagtttcgagaccagcctggacaacgtggtgaaacctcatctctactaaaaatacaaaaaaattagcca

SEQ ID NO: 85856 - DNA, 252 bp, Homo sapiens
gggattacaggcatgagccactgcacccagcccgtcgtgttctttcttgtcgtcattctgttctgaagttgtttcattttataagccttaagttttgaacagggcagtactcactgacaccctcttaacagactcagaaagatgtgttaattcattttttagggggagaggggagatatttgtgttccagcagcttatttaggtcacatacctcctgataggtcttcccattctttgaaatcatgacattga

SEQ ID NO: 85857 - DNA, 534 bp, Homo sapiens
ccatgattgctattgtcccattggccaaaccaagttacgtggccaagcccggagaaaatatgggagatcattacccagtgatatggatattgatattgggaggcaacaggctacaacaaatagtggtagacttatttaccatatcaggcaagagctccatgtttaaggtagtgacaaaagatgtgtttggcagaatgtgcattaaatctgattttatcactttctttagagaaaacaatcacttatctattatttatgttttaggttcaacatttgttggatttaagaatgtttgttcaggggaaactaatgttatattcattactaaccctttaaatgaggatttacagcatccaatccatgtgaagaatataaaactggttgataccactgaacaatcaaaaatatttatacataggcctgatataaggtaaaatacataaaaattgtggtttttctatctttatagtttttcattctcacttcctcctgctcaagatctgagaaagttggcatattaaaataactgccagt

SEQ ID NO: 85858 - DNA, 380 bp, Homo sapiens
  misc_feature (184)..(184): n is a, c, g, or t
cattgaattgacagacataccagccaatagctttccaactatcagttaacagaatgatgctatcttactgtgaggattctgggcttacagcattcgtttccagcataacagtgatgatatgctttatttattgagtttcctcataataacatgttaaatatacatttcatatttactttttatnattatggaagtaatgtactaacccttcatgaaaaaatgaaaaaatatcaggacgatgtaaaggcaaaaagacacatcacacatctcattcaaaaatgagttatattagtatatttcatattaatatttttctttcacaaatattgatttatagttatattttataacattagagctataatatacaataacttagg

SEQ ID NO: 85859 - DNA, 382 bp, Homo sapiens
agcgacagacaagtgagcatcactaccagagctctgcctcctgtcagatcagtagcgactttagattgtcataggaccatgaaccctgtgcatgcgagggatgtgggttgcacactccttatgagaatctaatgcctgatgatctgaggtggaacagtttcatcctgaagccatccctgtgcccctacctgtggaaaaattgtattccatgaaaccagtttttggggccaaaaagattgaggaccgctgctctataagaaactattactgaaataaggtataaagtctttatcttacttatatttatatcctctatggtgtccacacacaaggtgctttttacacttaagttgttaaactaaaatatttctttaaacttaat

SEQ ID NO: 85860 - DNA, 555 bp, Homo sapiens
cactcggcaatggaacagttggtttaaattaggtttccatgtgaaatatggtatcgctgtttttttcctagcattgtgggaaagtatatggaaaatgatttgactgataggaaataaatctggatgagtgatcaggattgtgacacaaaccaagtggtggtctccacctgccctgtgaagcagacctctccagggggaggtgagttaaccctttccagccactggactagtaagtcaatgcatggtatcagaacagcctgaaagaatgacaactttccagagaccctgatttgccatcaatttcaactagaaaggagctaaagccatagagacaatatagccagaggcctcaacaactaatgagttgggtggctttgagaaactgtttttttacttttcaggatctcatttttatttgtgagaagtgtttgaatttccaactcaaagagtcagtagggttatgatgctaagtgtttgctgatggtttcccattttaggatagggctcatcaaaagccagtcagactaaaggaagaattagatggatgcaccaatg

SEQ ID NO: 85861 - DNA, 341 bp, Homo sapiens
cctgggcagacactcacaacctccccggccaggacaccgcgcctcctcctaagtggctggaagcagggggcttggaaggtgagtgtcctagactcacccaggaatggcggtccctctcctgtcccagtgggccacgctccagcagcctctcatgagaacacaggagggggagccgacccaaagccccctggaggtgctctgctcaatgtacaggagggaacgcaggagctgggtggagaccagagcccctttgaggccgccccgaccagcccctgacaatgcagaccccgggcctacccagcagggagccctccacggctcatgtttgggtgaacacctgt

SEQ ID NO: 85862 - DNA, 380 bp, Homo sapiens
aggcatttgcaatgaatctcacattgctttttcttgttattgaatatgagatcgtctctctcaaatcagaatataagaagccccttgaagactacatcaagtgttattcattcctagtaccctcccttccttccgaatgttgtccttctttgtcttactcccaccccacaaaacacaaacacaaacacacacacacacacacacacacacacacacacatttgtagacagggaggtatgatggcattctagatgcttggtggaaaacaatttggagaatgaaaagacaagccacgaacttggagaaaattttgcaaaacacattatctgataaaagacttctgtccaaaagatacaaagaacttttaaaagtcaacaccc

SEQ ID NO: 85863 - DNA, 285 bp, Homo sapiens
caagaagaataagataaatatggtggggatgggggaggaaggagggaagagagggaaaatccctaggcatattatatttgaattgctgcaaatcagaggcagaggaagaaaaggagcattatatacacacagatttcttgtcagaaaccatttaaatcataagaaaaaaagtgacatctttttttattttttgagatggagtcttgctctgttgccaggctggagtgcagtggcgtgatctgggctactgcaacctctgcctcccgggtttaagtgattttcctg

SEQ ID NO: 85864 - DNA, 194 bp, Homo sapiens
acatcagcctatggttttgatattccgtcaaatctaatgtgtatttggctcagagctagaaacgtgacccattttttcaagtctcagctcaggagtcacctcttctgtttgacacacttgtttgttcatttgcccaacaaatagagacaccgcatctactgtgtgccagttactattccgagtgctgtggtttc

SEQ ID NO: 85865 - DNA, 262 bp, Homo sapiens
gatagagcccaacagtaatattttctgaccaagacaaccaaatattaaaattaaggtgcactacttgtctaataaaaccagttaaagaaatctgcatcttaaacatctcggtaattactgaaggtcctgtggtatcaaaatattacctaggcattatttactaagaattgatgcttgtaattagctgggtgtggtggggtgcgcctgtactcccagctacttgggaggctgaggcaggagaatcgcttgaacccaggaggcg

SEQ ID NO: 85866 - DNA, 409 bp, Homo sapiens
tgggatatctgaatagaggtgtttggtgggcagacagctgtacagtctcatgcacagttaaagaactgggctggagaaaaaggctcagcagtcatcagcttgtgggttacagtttgatgtcataggaaatgtcagagtttccaagggacatatgtagactgagaagaaactaagtcatcagtctttcagggatgttgggaaaagaggaagccacaatagtatatgattttaaaaagttgcgggggagtaagaaaatgaagagccagtggcagctccagaactaattgagtgtttcaagaagaagcttgcggttagtggcattaacctgctgtgagttgatttaagatgtgactaacatcatggatttaaataaagagggtggcctctgggtagagtcttaagggcaaaa

SEQ ID NO: 85867 - DNA, 359 bp, Homo sapiens
gaagagaatgtgccagcaagtgcagtatatcaggtatttgagactcatgaaggaaatagtaaatttaagaataacagaattgaatggccaagtgccactaatgctctgtagaaagagggcttctttggttgcatacaaatctcatctagaatttaatagtccaagtagccaaactggtatttgtccttaagaataaatactggaagatcaagcacagaaagtctagaatagaggcatgtgaatggacatacttgtgtcaagtatgtacatgaactgtgaaggtctctgtattacgtgcagtgcccaccagagagcattcagtactgaagagtctctaaacaataaagcaaactaaacac

SEQ ID NO: 85868 - DNA, 301 bp, Homo sapiens
ttattcacaggtctgtgagggactgcgaagcttactcaggaaatgaaaacaaatgatggtcatgttgcagttttttccttgaaggacaaccgaaccatagcctctaaagttcaagtgcactgaggtgtcggaacgctgaaagcatgaggaaacgaggacgtagggtgtgactgaatggtggctagattagtgggagcagttcacctggatgaagattgagagcatcgtctttgagaagtgaaagactagcaagaataaaataaattaagtccagtgtttgagccaaggttgccacctgtct

SEQ ID NO: 85869 - DNA, 361 bp, Homo sapiens
tgtaattagcgacacacacaccagccggtccctttgcctggttgggaaagggacagctttttggcaagaaaagatcacccagaacacccagaactaaatattctctggttcctattagccctgggcttcttacagcactaattaaaccactgttttgtcttcttagccattaatatgctgagatcacagcccccgggttgggggaggaaggatagtgcagaaaaaaacggtaattccctccctcaatcaataggtgcctgtacgaggaggcagagcccagggcacacatgcacacacacaacagccagatttctgctctcaaaggcagcggatttcaggggcatagccaagggattttgca

SEQ ID NO: 85870 - DNA, 689 bp, Homo sapiens
ctcttatatgaaatgcatatatatggtatacagttccagtaccattcaaatcagtaacaaatgagatgtttgctctgtttagggaataaggaagaagggaaaaaaaatgacaaaattatacccagcggttgaatatgtagacaaaggagtttgcaaatttaagattttttttttttctgccaggcaagaccaataaatggcattaggagcactgacctacacatttattatttagtatcagatgatgtttgtgagtcctgtagttaaagactttagaacacagaaaaggtacgtgtgtttgtaatctgtgtatttcctccaacggagttccaggatttacgctcattttaaaatataagggtacgaacattttctgtggcagtgtatgtcatctccccaatgaccactacatgtcagaacagttcaagattactctcttggcagtaagaatacatgtatttcctttaaacttcttcttttgttttcctttatcttctactaaattaaatttagtcaacaaatacttatcataaaagggttgggaaatgctgactaaataaaatggaatatgtttatgaatatatgtaatatacatagtcatacatatgtacatatacatatgtagatttacagattttctcagtgccctcttgcactaatttacactgtggatttctaagagggaaacc

SEQ ID NO: 85871 - DNA, 454 bp, Homo sapiens
tcccatgattcaattacctcctaccgggtccctcccatgacacttgggaattatgggagcaacaactcaagatgagatttgggtggggacacagccaaaccatatgaaacagtgaactgggaaatagaccaatagaaatcaccagtcagaacaacagagagaaaatagactgaaaacaaaaatgaacagagcctaagggacccacgggaccataacaaaaaagatttaacattcttgtgattggtcaccccaaaagaaaggagaaagagggtgaggttaataaaatactcagagaaacaatggctgaaaactttccaaatttggaaaataaaccaacagatttagaaagctatgtgaacctgaaacagtacaaaaccaaagaaatccatgccaagatgtagcattattaaatttctgaaaattaatggcaaaagaaaaaaaactgaaagcagcc

SEQ ID NO: 85872 - DNA, 387 bp, Homo sapiens
ttctaaaacgagtccagttctagtaacctaaagtaaatttgttaaccaaaatgataggtaaaaagatctatacatcttaatgaaataaaacattcctgcttttagttattatgtatgtacaccatatatgaataaacagtttccaaaaacttaaaatacaaaatatattttaccaaaaattatactgaatataatttaaccttggggaatccagaatacttagtattttcacatgaaactacaaatcatagactctgacactttgatttttaaagtactctgtccataaaagatttgtactgtttagatgggagaaacctctagagagagtaaaaatgaattacactgtatcttatatgaagtaaaaaataaatcagaggtgagaat

SEQ ID NO: 85873 - DNA, 337 bp, Homo sapiens
tagtcttagtctaaactctgcacactaggattctagaaatatacactctaaggagatgcactattagtggcttcttaaaggaaaatacacttgtttaaacctttttcttcacagctatcttctcatcaatactcaaacaggtcatgatacaaatgcaggccctagtttacttttaagtatcacagtttgtactccattaatattttccagaaatttcatttatactcaaacactgcaacaggcaatacacagtataaaagctaataaaggctttcttaataaatgtaaaacagatcatctaagactcaaatgcacaaattccactatcaaatatccc

SEQ ID NO: 85874 - DNA, 345 bp, Homo sapiens
ttggttgttcaatgtcttgctaatcaataacttctccttcacattagctactgtttcagcacattataggtttagtgtgaggtttattgttaatgagtaaatgtaaatatattttaactggtctgctgatgcatttgatctttttttttttggttgacttgttatatctggttagattgccatgcaaattttacttcatactgtagctaactgataaaatttgtgtattaagagtaagatatttgtattgccagttattagtaccagtattattagtcttatgtggggttttttttgccaattatttgcaggaatgatactatgaataaactcttattagtatat

SEQ ID NO: 85875 - DNA, 2669 bp, Homo sapiens
aacgccagagcacagaacacacagttcaagtttaaattattaaattgtatgcaagaaattattgccatagcatagtcttgaggagaacacctctacagtatttcttgatctaagaacctgaacatatgttaatgaaattattagagtaagttctatctcaaaaatttcttattttatgaatgttttcttcacctaataaacaatactaaaatccataacagctgtctggcaacagtgtaattagagcttcttttatgttagagattccatctacctctgcatcttatctagctagatacagtctttctaaactttctcctttattcccatgtagagaacaaacaaaaatcacacctaaattaaagatctgtggtgaaggggaagaggggttgctattaggagttttcccggtaaaactgtaaaaacagtaatctgcattcagtatttgtttgcctagttcatcaagatatttaccctaaaaacacattttaataaaaatttgggtaaactcatgtatcgcagtaaaatcttttatgaattgggtgggccctaaaaacatctgtagtacgtgatgtgtttggttagattcagccaaaccgacacccgtatgctaagactgcattgtcattctgacaggaggcaggcctcagtagttgcagtgagtgcatttactaatataaggatccttctttgtagtgacaacaaaaatgagattgtaacttaatcaaatatgagtcagatatagtaattcctgatattgcagatgaaagagcagggtcttttcaagtgcttgctacaactgactaaatttgaagctttttatgtaaaagttcttctcccagatattttaaaccagtatgttaattatttcctagaatgaataattctccttttttgatagatttttgaaattgttttacttactacttacatactttgaacaaatatgtttttctaatcccagcattaaattgaaacaaatatttaaaataagattgttggaataaaagttatagatagtcacttgttgctaataaaagacattccttggcaacagccacatccagctaacttttgcaagaattttttaagggattagatttaggggttaatgtttagaattatttttaaaatataaattatattttaggctgtatttttgtgatttttaagtgaaaaaaataaaatgtagttgtcttgtttattctatagatatcttaatgaccactgaacaaatgatcatattgccacatggtctatcaactatggttactatgatagtgaaataaagaggatagttttgcttgacacctaaatgatccaaacagttgtttttacatgacttaaatcatggctgtattatttcatttttaaagaaaataaagtataaaataatacatttaaaatacctgtcaaagttttaaaatataagatagaaccttctttttttgccttcttacacatgaatgtacttaaagtattgttatgtgatcttgggatacttatttatttttgaaatttttgtatatatagcatttctgaacttagcaaataatatgtgtaaaggaattaaccaaaaatgaaagaactggcattttcatatggatacatattttgcttaaactaaataaaataacttagatttatttaaatcaggaatattttacgtgttgatcatttttaaagtatatttgttcaaatattcctaattgtttttcagcacacttgtttaagttcttgcctttcaggtatactacagcgttatatgaacataatgttttaaaaaaatcttggttgtagtttctaattttcactgcataacaaatttgaaaccaaatgttgaatttctctgtgagggtacttattttgcctacagtttcaaatatattttcaaattcatctctttcttactagactgtgagctccttgtggacaaggatgttattttagttataatgacaactttaatatctagcaaagtgccaggcatagagtattcctttattgaaatgaattgatagatattgattattaaaatgctactacagtattctacgatgcaggctgaatgtatattacagtaattctctggctaattttaaaagtaagacatagaaaacaaaacacctgtagcattttctttatttaaaattgaaactctgttttgaatcctttttattttgtcaaacattctatgcaaatattgaaatatgcaacagctaaactttatggtacatattaattagttttattttcttttcaaaatcagaaatgctgtatttaagcttcctggaaatgtcgacaatcattttaatgaccaaaggtgctacttatttttcaacattgaccttgatcataagtgcttctatctgctgagctttatttattgtttttggacagaaagtttggtgggaaggttgcaataaaatcagaatctctcttgtctgaattatgcagtttaaccctgtccatgttcctctgtactctattcttactgtattttagttattgtttcttacttatcactaatttttactgcaggtctgtgctgtttcttagaaagtacatgcatatatatttctataatatgtaagaaaaaacctgtattgcttattaaattaaaattaaaataaaaaaattcatgttaaatttttgaaatgaaatctata

SEQ ID NO: 85876 - DNA, 268 bp, Homo sapiens
tttaaaaagtccatcctttattaattcaacaaatacttaaggagtctattacctaccaggcactatgcttagcactgaggtgcagctgtgaacaagaaacagtccctgctgccaatgggcttccagctcattgaggaagatggcaaggaaacagaggacacagcacagagtggcaagttctgtgacggaattaaatttgtgttgctttggaaacatttaagaggggatacccagtccagactacggggaaggagactggtttctgatc

SEQ ID NO: 85877 - DNA, 898 bp, Homo sapiens
cccgactgctgagccccctggtgaaaatccccccacagtacaagggcagcctgtatcccatcaatccccaggatcacccaggccctctgcactgcacagaaactgcaggaaacgcctccccaccagcttcgcctcctcctccagtttccgcaggcctgtggctccctcacacccctcctctctctttgctgttattttaaagaaaagcagaagcgagaaatctctcaaaatgtcccaaccttgggtcaaaccacagacctttcctcctgaccccttgtgagttgagggcttttcctctggttaagccagttcccgttcctgcgcaggatccctcctgacttctcaggaagtctttgccatccctgccctttcttgtgcctaacatttcccccttccctcagctgaggctggaccagtccagtttatcacatcacccaccaaaaatgagccccacctgctgccttgttctccccttcgtgaccacgcacacacacttgcacacacatacacatatgcacacacatatacacacgtgcacacacacgcacacatggtccccatttcgtcacgtccacctcactcgtcagcccctccattgtggcttctgccccatccctctgctgaagtagctctttgtaaagtcatggatgatgaacacaaggtcactaaacccagggcgcattttcattttccttgagctggacccctgagctgtggtcagctggccgctgcctgcttttgtcataactgtgactactcctccttcggttgcctcaggcttgcacttgaggtccttcccttctcagccatggtgtctccctgcgtggttccttctgcacccaggcatcagtgccatcctcttctgtcagagtcaagccacttccgagctccaggccca

SEQ ID NO: 85878 - DNA, 1874 bp, Homo sapiens
ttagaggatcccctcgaatcgacggtttctccatgttagtcgtggctggtcttgaactcctgacctcaggtgatccacctgtctcgacctcccaaagtgctgggattataggcgtgagccactgcgcctgaccacctacctgctgggttttctttgtatgtcagcatggagtttttcccaaagaaagggaatatggatggagagagagaggttatgaacaggttatgttacagaggttattgcctttgaaactgggccctcatcattctagacttgcttgctttgttataaattagaagaaaccagagggagatgtgccaagtaaacattcgaatgactgtttagaatatggttttcttaattagcagtcatggggaaaacatgcatttttaatttggaaaaaacctgacagttaacatggttctgtttaccttgattagtgaagtaatttgctgcagtgttacagaggagcagaatcacttgggtctcaaaatagactgaaaatttaactccccaaaccaaatttaacaaacagaattggttattagagatttataggcaaaaatatcagtttggaaattaaccttggctactggccaccttagctaggttttctccacagatctgttttctccacagatctgagtacttaacacttcccagatgattggagaatattctgggctgttggggatgacaggaaaatgtgagggggagtagcctaggtaagggtgatgatgaaattgttctatctgctgtcaaataatcttttcctgtttgcaatgtttttattttttctgagtccctttgggaaccaggtgctaacaagaagctgttatgtgtgggatttcggagccttactttaacgatagaggaaccaagtatcattttagatatcttttatttatgttctcggtgcatatgttgactttaatccctcttcccccacacctcgcccattaaggggaaggaggttaactctgcagatgatattcaggcccaaccagctcactctctggggtggctactgactaaaggcagagaatgtccatccaacatgcccttctgactatacagtcaccacttttttgggggaattctttagcagatcttattgttctttctgcagaagctatcattcctacctccccaacccccaaaatctctaatacaggccaagtcattttttatgatgggtctctgagatagggcagtttgttagaggagaggctagggtagagagggagagaatggaggtatctgaaaataagtaagaaaaaggcattgatttttatttactcggaacggtcctcttggcatcccagataagggaaataggatttgatctccaattgtattgccatggagagaatggcaggtgaggatgctttgaagtagttagaaattaaatattgaatacattaatggcaataccatttcatgactttgcatatctttctggattagtcatggaagttggggaaatattgcttagatcttctgggttagaggattccaactgtttattggcaaggttggattattaagaatcaaatagcagacaaaaatggctgggcacggtggctcacgcctgtaatcccagcactttgagaggctgaggtgggtggatcacttgaggtgaggagttcgagaccagcctggccgacatggcaaaaccctgtctctaccaaaatacaaaaattagttgggcatgatggcatacgcctgtagtcccagctactctggaggctgaaacaggagaattgcttgaacccaaaaggtggagtttacagtgagctgagattgtgccactgcactccagcctgggcaatagagcgagactctgtctcaaaaaaaaaaaaaaaagaaggaaa

SEQ ID NO: 85879 - DNA, 1857 bp, Homo sapiens
ttagaggatcccctcgaatcgacggtttctccatgttagtcgtggctggtcttgaactcctgacctcaggtgatccacctgtctcgacctcccaaagtgctgggattataggcgtgagccactgcgcctgaccacctacctgctgggttttctttgtatgtcagcatggagtttttcccaaagaaagggaatatggatggagagagagaggttatgaacaggttatgttacagaggttattgcctttgaaactgggccctcatcattctagacttgcttgctttgttataaattagaagaaaccagagggagatgtgccaagtaaacattcgaatgactgtttagaatatggttttcttaattagcagtcatggggaaaacatgcatttttaatttggaaaaaacctgacagttaacatggttctgtttaccttgattagtgaagtaatttgctgcagtgttacagaggagcagaatcacttgggtctcaaaatagactgaaaatttaactccccaaaccaaatttaacaaacagaattggttattagagatttataggcaaaaatatcagtttggaaattaaccttggctactggccaccttagctaggttttctccacagatctgagtacttaacacttcccagatgattggagaatattctgggctgttggggatgacaggaaaatgtgagggggagtagcctaggtaagggtgatgatgaaattgttctatctgctgtcaaataatcttttcctgtttgcaatgtttttattttttctgagtccctttgggaaccaggtgctaacaagaagctgttatgtgtgggatttcggagccttactttaacgatagaggaaccaagtatcattttagatatcttttatttatgttctcggtgcatatgttgactttaatccctcttcccccacacctcgcccattaaggggaaggaggttaactctgcagatgatattcaggcccaaccagctcactctctggggtggctactgactaaaggcagagaatgtccatccaacatgcccttctgactatacagtcaccacttttttgggggaattctttagcagatcttattgttctttctgcagaagctatcattcctacctccccaacccccaaaatctctaatacaggccaagtcattttttatgatgggtctctgagatagggcagtttgttagaggagaggctagggtagagagggagagaatggaggtatctgaaaataagtaagaaaaaggcattgatttttatttactcggaacggtcctcttggcatcccagataagggaaataggatttgatctccaattgtattgccatggagagaatggcaggtgaggatgctttgaagtagttagaaattaaatattgaatacattaatggcaataccatttcatgactttgcatatctttctggattagtcatggaagttggggaaatattgcttagatcttctgggttagaggattccaactgtttattggcaaggttggattattaagaatcaaatagcagacaaaaatggctgggcacggtggctcacgcctgtaatcccagcactttgagaggctgaggtgggtggatcacttgaggtgaggagttcgagaccagcctggccgacatggcaaaaccctgtctctaccaaaatacaaaaattagttgggcatgatggcatacgcctgtagtcccagctactctggaggctgaaacaggagaattgcttgaacccaaaaggtggagtttacagtgagctgagattgtgccactgcactccagcctgggcaatagagcgagactctgtctcaaaaaaaaaaaaaaaagaaggaaa

SEQ ID NO: 85880 - DNA, 1594 bp, Homo sapiens
aagaaagagcaggaagcagaacagtaccgtcttaagctggaggccatagcccgacagcagcccaatggagttgatttcaccatggttgaagaggtggctgaggtagatgctgtagtagtcacagagggggagttggaagagagagagacaaaagtgactgggtcagcagggaccacagagcctcacactagagtttccatggcaactgtttcatcttaatatgcaagggccacaatttgcactgtgttcatattaatcctcttttaaaaaaggaaatatacagaagacaaacattgtataaaaactaagagtgtctttaagaagaaaactatagcagggtacaatgcttgggctcaggaagtttctctgtgcaactagaaaattcaaagccatatttagggaacattttttctgaggggccaaaagaataaaggaccaaatttcttagctcatatcattgctttaaacatagaagtaaaagaatactgcatgttgtgggttgattttttttttttaaataactgactttctcacaaaagattttaagataacatttctaatatatatgcaccaatatatatgcctttaataattataccatcaagtgacctgaaaatgccccttagatttatgatgcgtatctgttggaaaaaccaattggaagggaggttagacaagctttggggaagagaaaaggaatatagtccatttccaaaggagcaggaactcccaaccttaagttaatttcactgaagagaattttccctttttttttttttttttgagacacggtctgactctgtcacccaggctagagtacagtggtgcaatcttggctcactgcaacctccgcctccagggcgcagcctcctgagtagctgggaggacaggcatatgccaccacatcactgagaagaaatttttgattgtctgacagatacttatccattatgtgtctatagttcagatgcttgtgtaagaaactgaaataagctgcgtgtggtggctcacacctgtaatcccaacactttgggacgttgaaatgggagaattgcttgagtccaggagtttgagatgcgcctgggcaacatagaaacctgtgtctacaaaaaatttaaaaattagccaagtatggtgacaggcacctatggttccagctactcaggaggctgaggtgggaggatcgcttgtgccttggaggtcaaaactgcagtgagccatggttgcaccactgctctccaggcttgagtgacagagcaagactgtatctcaaaggaaaaaggaaactaggccaggcgtggtggctcacgcctgtaatcccagcactttgagaggctgaggtgggtggatcacttgaggtgaggagttcgagaccagcctggccgacatggcaaaaccctgtctctaccaaaatacaaaaattagttgggcatgatggcatacgcctgtagtcccagctactctggaggctgaaacaggagaattgcttgaacccaaaaggtggagtttacagtgagctgagattgtgccactgcactccagcctgggcaatagagcgagactctgtctcaaaaaaaaaaaaaaaagaaggaaa

SEQ ID NO: 85881 - DNA, 3296 bp, Homo sapiens
cgcacgcagagacacacggtcactggaattccattagaaaaaagtgagccgagcaagggttagcgggagaagatttttttgaatcttgtcttcgtcttggtgcgaaagaagcgactccagtctctcgtcctcgaagctccgactggattgttcttgggcgctgacacccgtctgtggatttcttttctatttgcattttattccgaccccctccctcgccgcttccttccagcccttcactcgcaaatcgcctctctccccacctccccaggcccctcctgggaagcgcaggggaattggacccgcggggactcacgccttcccggacgattggaggggagggctgaccccaggactgggctgttggcttagaaagccgatacacagatacgcgtatatttgattgtagcgggcaaggggggcgtcgagaggcagcagcccatcgcccgcctctcaccccaccccctccagccagaggcgagaatcgcaggactcgggatcttcatcgggtggactagctgggatctccgcattggatttggggctgattaccactgcttgcctattattattgttgttgttactactattatttttttttacccaagggagaaagacaaaaaaacggtgggatttatttaacatgatcttggcaaacgtcttctgcctcttcttctttctagacgagaccctccgctctttggccagcccttcctccctgcagggccccgagctccacggctggcgccccccagtggactgtgtccgggccaatgagctgtgtgccgccgaatccaactgcagctctcgctaccgcactctgcggcagtgcctggcaggccgcgaccgcaacaccatgctggccaacaaggagtgccaggcggccttggaggtcttgcaggagagcccgctgtacgactgccgctgcaagcggggcatgaagaaggagctgcagtgtctgcagatctactggagcatccacctggggctgaccgagggtgaggagttctacgaagcctccccctatgagccggtgacctcccgcctctcggacatcttcaggcttgcttcaatcttctcagggacaggggcagacccggtggtcagcgccaagagcaaccattgcctggatgctgccaaggcctgcaacctgaatgacaactgcaagaagctgcgctcctcctacatctccatctgcaaccgcgagatctcgcccaccgagcgctgcaaccgccgcaagtgccacaaggccctgcgccagttcttcgaccgggtgcccagcgagtacacctaccgcatgctcttctgctcctgccaagaccaggcgtgcgctgagcgccgccggcaaaccatcctgcccagctgctcctatgaggacaaggagaagcccaactgcctggacctgcgtggcgtgtgccggactgaccacctgtgtcggtcccggctggccgacttccatgccaattgtcgagcctcctaccagacggtcaccagctgccctgcggacaattaccaggcgtgtctgggctcttatgctggcatgattgggtttgacatgacacctaactatgtggactccagccccactggcatcgtggtgtccccctggtgcagctgtcgtggcagcgggaacatggaggaggagtgtgagaagttcctcagggacttcaccgagaacccatgcctccggaacgccatccaggcctttggcaacggcacggacgtgaacgtgtccccaaaaggcccctcgttccaggccacccaggcccctcgggtggagaagacgccttctttgccagatgacctcagtgacagtaccagcttggggaccagtgtcatcaccacctgcacgtctgtccaggagcaggggctgaaggccaacaactccaaagagttaagcatgtgcttcacagagctcacgacaaatatcatcccagggagtaacaaggtgatcaaacctaactcaggccccagcagagccagaccgtcggctgccttgaccgtgctgtctgtcctgatgctgaaactggccttgtaggctgtgggaaccgagtcagaatatttttgaaagctacgcagacaagaacagccgcctgacgaaatggaaacacacacagacacacacacaccttgcaaaaaaaaaattgtttttcccaccttgtcgctgaacctgtctcctcccaggtttcttctctggagaagtttttgtaaaccaaacagacaagcaggcaggcagcctgagagctggcccaggggtcccctggcaggggaaactctggtgccggggagggcacgaggctctagaaatgcccttcactttctcctggtgtttttctctctggacccttctgaagcagagaccggacaagagcctgcagcggaagggactctgggctgtgcctgaggctggctgggggcaggacaacacagctgcttccccaggctgcccactctggggacccgctgggggctggcagagggcatcggtcagcggggcagcggggctggccatgagggtccaccttcagccctttggcttcaaggatggagatggttttgccctccctctctgccctcgggtggggctggtgggtctgcagctggtgtgggaacttccccacggatggcggtggagggggttcgcaccgtgctgggctccccctgactgtagcacggagtgttggggctgggggccagctccaggagggcttgagagctcagcctgcctgggagagcccttgtggcgaggcattaaaacttgggcaccagcttctttctcggtggcagaaattttgaagtcagagagaaacggtcctttgttggcttctttgctttctcgtgggtcctttggcaggcctccctttggggagagggaggggagagaccacagccgggtgtgtgtctgcagcaccgtgggccctcaagctttcctgctgtcttctccctcctcctcctttcccctttctctttcctcatttcctagacgtacgtcaactgtatgtacataccggggctcctctcctaacatatatgtatatacacatccatatacatatattgtgtggtttcccctttctttcctttttttaagcaacaaaactatggaaataataccccaacagatgagcgaaaatgtattattgtaaagtttattttttttaatactgttgtctataatggggaaaaaggacattggccccgcagtgccctgccccagtcagcctggctgggctctggtgggggctcctgatccgcatccaagcttaaccaaggctccaataaacgtgctaggaagc

SEQ ID NO: 85882 - DNA, 240 bp, Homo sapiens
tcaccaagaccctgcgcgcgcgggcagaagcaggaagcaaaggctttgatgaatacatgaaggagctaggagtgggaatagctttgcgaaaaatgggcgcaatggccaagccagattgtatcatcacttgtgatggtaaaaacctcaccataaaaactgagagcactttgaaaacaacacagttttcttgtactggcagaagcagaagcggcagaagcaggaagcggcagaagcaggaag

SEQ ID NO: 85883 - DNA, 615 bp, Homo sapiens
tcaccaagaccctgcgcgcgcgggcagaagcaggaagcaaaggctttgatgaatacatgaaggagctaggagtgggaatagctttgcgaaaaatgggcgcaatggccaagccagattgtatcatcacttgtgatggtaaaaacctcaccataaaaactgagagcactttgaaaacaacacagttttcttgtaccctgggagagaagtttgaagaaaccacagctgatggcagaaaaactcagactgtctgcaactttacagatggtgcattggttcagcatcaggagtgggatgggaaggaaagcacaataacaagaaaattgaaagatgggaaattagtggtggagtgtgtcatgaacaatgtcacctgtactcggatctatgaaaaagtagaataaaaattccatcatcactttggacaggagttaattaagagaatgaccaagctcagttcaatgagcaaatctccatactgtttctttcttttttttttcattactgtgttcaattatctttatcataaacattttacatgcagctatttcaaagtgtgttggattaattaggatcatccctttggttaataaataaatgtgtttgtgctaatataaaaaa

SEQ ID NO: 85884 - DNA, 832 bp, Homo sapiens
aggcacagcacatctttatggcgttaactcggctgccagctctcaccagcaggcaagtgcccacgcgtccagaagaactcagggaacccggcagggagggaaccagaggatgtttcaagtaaccccaggagctcctgccaccttccctttagggctgggtgatgccctggattgctctgtgggcagacctgtcttatctgatgccaggaagggcctgttctgagcccctgagccaaagaagggggcggggggcagccccagaaacacgggcaggacacggcattcgactccttggaagagaacctctgcccataaacagtagttcaggaaccattttacaagaggaatgcaagccgggtctctgcatcgggctttaggaacgacctgctgcagtgatgcctcggcaaccacagtcccacgatgaaggacaactgagaaccagatgtgcacagaaccaccgttcagggagtctggacccagccctgtctgcacgttatctaaacggtgacggcagcagctttggagtcccctctgccggctccaccaccacgttgctgctgggcctcggcatcaagccctgccaggtggccagaaaggcaggtggccgggcaggcaggcatcacttaacctagcgacaatcaagcctgtgcctggcatgaagtcaggcccccggaggtgctggctgaacctgaggcctttcctagccgtcaggttttgctgggcactgtgctctcaacatgctccggggcgacacaccatcctccctcctgcttcaacacagggcagctctgcagggggcaaacacaggaagccacagtcaccacagtgagcc

SEQ ID NO: 85885 - DNA, 119 bp, Homo sapiens
aaagaaaagggggggattaaaagctgagtttacagtgactaacaaccaccaacaggaaggggccctagagtaatatttaggaaatcgaagcattacatttatacaatggtctctggcta

SEQ ID NO: 85886 - DNA, 557 bp, Homo sapiens
taagtctggatgccacatcaaactgtttgtggtacttctaaacttcgtggaagagccctgtttcataaatctgagacagccttggtctgagggagcaaagacagagaattcacgtgctgcccaggcatagccacatagcaggtggacatccctggacacttttctggtttaatgaagccagctgtcatgttgatgagactcatgtgtcaaggaactgaagatggtccatagccaacagccagccaggaactgattggctagtagtccttgaggaactgaatctcaccaacaaccatatagtgaacttgcaaatggtgcttcctcagttgaaactaaagatgagactgaagtcctagttaacactttgtttgccaccttgtaagattgtgaaacagaggcctgagctaagccatgcccagattcttgatccacagaaactgtgagataataaatgtgcattgatttaagcctcagattttgtggtaatgctttacaaagcaataagtaactaatgcagtattcaacaaattttttgaaaaaaaaaagatgcttgaaga

SEQ ID NO: 85887 - DNA, 299 bp, Homo sapiens
taagtctggatgccacatcaaactgtttgtggtacttctaaacttcgtggaagagccctgtttcataaatctgagacagccttggtctgagggagcaaagacagagaattcacgtgctgcccaggcatagccacatagcaggtggacatccctggacacttttctgagattttatgtcatagaccctcattggattttcctggaagtacggagagttacatccagagaactctgaacattttggaaggaccccaatcctgcaaacaatgaatggcaataaatcctgggactggaaaggt

SEQ ID NO: 85888 - DNA, 562 bp, Homo sapiens
agtatgtatttcttgagtcattaacatacaacatatataggacttcctctgaggatacaataatgtatatgatggacaagatacgtaaaagtgccttgaagagacttggtcttgtgaggggacagacaggaaacaggcaattatcacctaacttaggtctgttgtttcaaggtttaatgaagccagctgtcatgttgatgagactcatgtgtcaaggaactgaagatggtccatagccaacagccagccaggaactgattggctagtagtccttgaggaactgaatctcaccaacaaccatatagtgaacttgcaaatggtgcttcctcagttgaaactaaagatgagactgaagtcctagttaacactttgtttgccaccttgtaagattgtgaaacagaggcctgagctaagccatgcccagattcttgatccacagaaactgtgagataataaatgtgcattgatttaagcctcagattttgtggtaatgctttacaaagcaataagtaactaatgcagtattcaacaaattttttgaaaaaaaaaagatgcttgaaga

SEQ ID NO: 85889 - DNA, 411 bp, Homo sapiens
taagtctggatgccacatcaaactgtttgtggtacttctaaacttcgtggaagagccctgtttcataaatctgagacagccttggtctgagggagcaaagacagagaattcacgtgctgcccaggcatagccacatagcaggtggacatccctggacacttttctgacaaagcacgcaatgtggggacaacacagaaatccaagaaaggcaagaccaatttcaaggcactaaataagtggactgagacaagaagtacacagatacttcccagaacaaaagattttatgtcatagaccctcattggattttcctggaagtacggagagttacatccagagaactctgaacattttggaaggaccccaatcctgcaaacaatgaatggcaataaatcctgggactggaaaggt

SEQ ID NO: 85890 - DNA, 1348 bp, Homo sapiens
  misc_feature (62)..(62): n is a, c, g, or t
  misc_feature (286)..(287): n is a, c, g, or t
  misc_feature (325)..(326): n is a, c, g, or t
  misc_feature (537)..(537): n is a, c, g, or t
  misc_feature (770)..(770): n is a, c, g, or t
  misc_feature (772)..(772): n is a, c, g, or t
gcctcaagtccaaggcctcatctttggagaaggcaaggaaggaggcggtgacagacgggctnaagcaagcccccaggagttttcggaacgcacttggaaattgtattctggacagagactacttgaggtcactaaacaagcttccacgccagctgcctcttgaagtggattaaactaaagcaaagagacaagattttgaaccatctgtggaagaggcaagatacaacagctgccaactgaacatggccctgggatacccacagcttcaagatgtgacctccccttnnagatcaagccacgttgtgattcagggggacaaggactnnagcttcctgacttctgagctcatccactattggtgagagaggccacgaaccagcagaagttctggcaaaagcagctgctgcagcagttctgggagcagatggagaaacagcaagtccacaccttttccccatcagttgagaagagtgaggagactcttggagacaactctgaaatgtgggatgtgactccagatgcaggggatggtgtggncaagccttgtctagagaagaaccaccccagacctctgacacaccagccttgaacaaccagatggtgacccagaacaggactccacacagcctttgctgtcagaaaccacaagcaaaatctggaccttgagacctccaaacttacagcactgaccaatgcataacaggaaactgggaatctcataggaagggccaggacatgaagaaaaggaaattggatccatcttaactgancntctggccacatcattggactctgtcgcaaagggactttggaaaactactttttagtcatgaagttgttcatcactcgtgaagaattacctttattgctaaggatttatcttgcttcattctgaacctcatcaataggatctgactgagagcccactgcagttagagctgagcacttttaaaaacctcatcccacactctagctgggagacgctccggacagatgaaataccttttctttggcctgtgaggcttcccactatttatttctaaactattatgttaacaccaatggacattttaggaatcaccaatggctgcttgccctcaagcaatataggccggacttattactaaccacctgcctcagcaattacctacattcaattgctttgcataacctctgccttctttcctttagggtacaaggcctttaatgttgtccacgttaagcaatgaggatcatgacaggaaaaaggttggagtattgctttttattgctttgtatcaatccaggctacaatcttcatttgatataaataaactcacttatgggtttatgacataaaaaaataggg

SEQ ID NO: 85891 - DNA, 399 bp, Homo sapiens
ccagttatattaggtctccccttttaatcggtccaggaagaatcctaagaaactggccgactcacttgataacacatgccaccaatgtgaaggccacccagcaaccacacaataaacatcctagacctgaaacacaagcattgtggaatccatcctctcactgagattacattttgtcccttcactttgtaccaactcatccagatctgctccagaagaacccacaacatttagaaaagccaacaagagtactcaaataaatgtaatgccattgtcacagcaaatccctgtagctatgaattacaatacataaaaattatattttatgcctttggggaaatattgtcaaaatagcaaggaaaaaccatctcaacataaaatttaattatggctccatgt

SEQ ID NO: 85892 - DNA, 819 bp, Homo sapiens
caacaggcgtattcgggcgtattcggcttgagacgtggcctgcaagaccccgtcagaacagaagagcaagagaaaccaaggagaagagaccaagaagaatgagaagagatgaaggtgaagagacagaaccttctgagctactccttccctgctaaatcccaggcacatgctccagattccttaggcaaaggaagaaatgaaaggagagaaagagaccaaaattttaaactctattaaaaaggactgcactgatatttataccccaaagaaccaatgatgccatgggatctaactaagatattaacagatatgaaaagagattcaacagagtagaggtgagagcagttgttagagaaaagtatacatatttcacttgtatacctacagggttcagacttcattatagacttcatggttgcatgtggggatttcttgcagagtatacttaatagttttaaaaggtaaaaaaagtaagttgagtataaaataaaaatgtgtttagttcaaaatctttgaaaataaagcacataaaaattgcagttgtggctgggtgcggtggctcatgcctgtgatcccagcactttgggaggctgaggtgggcagatcacaaggtcaggagtttgagactagcctggccaacatagtgaaaccccgtctctaataaaaatacaaaaaaatctgcagggtgtggtggcacgcacctgtaatcccagctacttggggggctgaggcaaggagaattgcttgaacctggaaggcagaggttgcagtgagccaagatcatgccactgcactccagccctggcaacagtgcgagac

SEQ ID NO: 85893 - DNA, 554 bp, Homo sapiens
tagatcccttttcacttaaaagatcttgaaggttagtcctttgttacataagccacctttcttctctttaatttactgtataataaagttctattatatggaagttccatctttaggagtagaaatctttagctaatggtatctactgtgtcctcattatgtcacctaatagtttaaatatgccagtatttatttattggttttagtgttttatttaacaaaaccaggattgagttttatatactccactaagttctccttctttcatactttctcacattgctttattgagctgtaactcacatacaatacacttctcctttctgtagtatacaaatgcagggttagtgctcttccctttcaccgagctcttcagaaataaagtggatttttatatgaacattgaaaatgacacaatctatggcaataaatgaaaaattatcaatgttttcctcaagtctgaagctttgtgattggctagtcactgacatttataataataaactttatatgcattaaaacctcttgtagcctcttgactttaggtattaact

SEQ ID NO: 85894 - DNA, 435 bp, Homo sapiens
ttctgtggtaaatagtttcacactatgtatttctgagtccttaggatgatgatctcattttttgttccctgtgctatccacccacctgcagcaagcacaattttgttagttttattttctctttattaaatcctaatatatttactgactgcttcctagagatacataggtaaattagacagactttattctgtgtttgttttctggattttaatttttctccactcagttaattgcatctaatcatcaacacatctgccatttatttatttatttttgccatttgcttgtctgttcgggtagttgatcttggacttcctaggctccaaatctgtgagaaagaagagaactaggcacctagtttatggtattttgttatagcagaccgaatgggccaagaaaatgttaaacaaattacttacattctgtctctgt

SEQ ID NO: 85895 - DNA, 281 bp, Homo sapiens
attgaagcagtcttgcattcccaggaaaaacccacttggttatggtgtattccaaggactacataaacacacacacacacacacacacacacacacacacacacacacgcacacattccagaagtagcacaagttcaaaatacaaaactcaatttcatttgtatatactaacaataactaacagaaaatcaacattttaaaataattgcatttgtactatctctgaaaaaatgattaagtctatataagatctgtatgctgaaaatgtacaaaatgctgta

SEQ ID NO: 85896 - DNA, 1080 bp, Homo sapiens
  misc_feature (128)..(128): n is a, c, g, or t
  misc_feature (256)..(256): n is a, c, g, or t
  misc_feature (952)..(953): n is a, c, g, or t
  misc_feature (1065)..(1065): n is a, c, g, or t
gttatttttttgctaacactttggctaacttttaaaaaacattctcataataagcagatgttatcattctttagctcttcagaaaatcaacaagtgaaacgccccgggcatcacgaaaacctgttgcngcgacctttgctattgaccagtccatttgtgttttgactggaccacttccacctcttggtagctgttgtttttactatgctttgtattctggattgtactggtaaagctatgtttcttctcctgttanaattcttcaaagaaatgcttcaggatctttatccaacttgtttacagtttctgttgaaagctctgatcttatctgcagccgatctgggagaaactgtttttgcacccactgagtgaaaagtttgctcaactttaatttgccagtcagaatgttgtaagctgaactaatggagatgtttttggtgttggctattgtttctgctgttaatgtcagtcctttttcaattaaggcattaacaagattagtttatttctcacaaattaatgtggatggtctgccattgcaggcttcatcttcagcgttgtctcctcccttgttaaaacaagttatccatttgtaaactattagtttatttggaacattgtcctcataaactttttgtaaaggatcagtgatttcaccattcttccacccaagcttcaccatcaatttgatgtttcttcttgcttccattttaacaaaattcatgttgcttttataggggctcttttcaaaccgatgtcttattcttaatgcctcagagtagatcatgtcagacatgttataacaagttagtacagttttattttggtgcaaaaaattgaaatccatgaatagttttttcatactatgcattttccctgaattttctgaacacccttcaattaatctaaggtaactctgcctctaagtttttgagacagggtcttaccctgnnacccaggatagagtgcattggcaagatcatggctcactgtaccttcagacttctgggctcaagtgatcctcttgccttagcctcttgagcagctaaaactacagacatgtgncatcacacccaggta

SEQ ID NO: 85897 - DNA, 863 bp, Homo sapiens
tagagttgctttattcagcagtacacattgcgaagctgctccctgctataatacagtgtcattgttgatgtaagcactttcaagggttcttttttgtgtttatacaggcatgccagaatcactcttgtactgctccctgcacgatccagtcagcccctgcccggctggttatgtaacaaacaaggtgtgttttcagaagggtctccaaggctgcagctttgtcccaggaagtcagcctatggtgtatccctcagatgctcagatcccactgtctgggatgatcccttataccttttccttatttcgataattatagtgggatgggatggtttataagacttagagtagggctgcctaaggatgaggttaagatgaagaacactgtatcctcagcattttcattgttgcaaaaaaatttgagggtagaggagggtcaaatacatgccaaaaaaagaaattgctatgataggggaaaacgatagtctttcggcgccatgctttgttggatttttaacaacttcaggaagagtggggaaagttgctgatgagtattatcacatgtataactatatatagtagaatctcaatataatattgtctgctgggtctacagccagagattttgtctagtgaagaacagtatcaaaagcacctcattaaaagtgttaggctgagaggtggccccattggcattatccctgaggacagcattctggcaaagcttcagtgtgtactgctactttacaaacgcaaatacttttcctgcactcactttattaatgtcagcaatatttattaattgtgcccctcagaacactgtttttactcattctcctgttttaagtttctatttattttgtagt

SEQ ID NO: 85898 - DNA, 740 bp, Homo sapiens
gcactggaggcagtgattttggggcagagaattttgcaacacgtggtagtgaactgtgaggagtttgaggggtctgaagactgaaagagtcgaatggtttgttggcaggacctagaagaatcccttaggatgaagctgagtcttaccaaggtagttaatggctgtcgcctaggaaaaataaaaaacctgggcaaaacaggggaccacaccatggatattccaggctgccttctgtataccaagactggctccgccccacacctcacccatcacacgctgcataatatccacggggttcctgccatggctcagcttacgctgtcatccctagcagaacatcatgaagtcttgacagaatataaagaaggagttggaaagtttataggtaaaaattaagttacttatatgtgccttgtgatgtgttaatttggagtttggaggtgctgttacctctttgatctttcattcatatgtttgtttattcataaatttaataagtattatttgaacatctaagagccaggcattggcaagtcaagattgaataggaaacagttgctgctctcatggaatttggagcctagctgggataaagatagagaattctagtaaaaattgtggttactgctttacaggattagggatatgtatggatatcatgacaggccagagggcagagcatataacctgctctagggtatatgtgcaaggtggtcagaataaaaaacggattctttttt

SEQ ID NO: 85899 - DNA, 4069 bp, Homo sapiens
cggacgcgtgggctagttctagatcgcgatctagaactaaggcagagaattttgcaacacgtggtagtgaactgtgaggagtttgaggggtctgaagactgaaagagtcgaatggtttgttggcagggtgtcctggtggattggtttctgtaagttcagattctcataaatcgtgtgagcgtcgccgacacctctgagataaaagggcccctttcgactagcctctgctgaaaggacctagaagaatcccttaggatgaagctgagtcttaccaaggtagttaatggctgtcgcctaggaaaaataaaaaacctgggcaaaacaggggaccacaccatggatattccaggctgccttctgtataccaagactggctccgccccacacctcacccatcacacgctgcataatatccacggggttcctgccatggctcagcttacgctgtcatccctagcagaacatcatgaagtcttgacagaatataaagaaggagttggaaagtttataggcatgccagaatcactcttgtactgctccctgcacgatccagtcagcccctgcccggctggttatgtaacaaacaagtctgtgtctgtgtggagtgttgcaggacgagtggaaatgactgtttccaagttcatggcaattcagaaggcccttcagccagactggttccagtgcctctccgatggagaagtatcttgtaaggaagcaacttccataaaaagggtcagaaagtctgttgaccgatcacttcttttcttggataactgtctgcggctgcaggaagagtcagaggttcttcagaagagtgtgatcattggagtgattgaaggtggagatgtgatggaagagaggctgaggtcagcacgagagacagccaagcggcctgtgggtggcttccttctggatggttttcaaggaaatccaacaaccctggaggctagactacgcttgctgtcatcagtcactgcagagctgccggaggacaagccaaggctcatatctggtgttagtcggccagatgaggtgctcgagtgtattgaaagaggagtggacttatttgagagttttttcccttatcaagtaacagagcggggatgtgccctgactttcagttttgattaccagccgaatcctgaagagacacgataaattctcaggagtgaaattacagagtcaaagatcatgaaataataactaaaataaaatgtttccaatggccacttcttatctgatcatcattcaagcctttttattggtttgtccttcagtactacaacaaaatggaacacaagaagaaataaaatgtatggatcaaataaagaaaattgaaacaactggttgcaaccaagaaataacatcatttgaaattaatctgaaggaaaaaaagtaccaggaggactttaacccgctggtgagaggatgttcctgttactgctgtaagaatcacactcgggcatacatccaccatctgctggtgaccaatgagctgctggccggagtcctgcttatgatgcacaactttgaacactactttgggtttttccattacatccgggaagcactaaaaagtgacaaactggcacagttgaaagagctcatccacaggcaagcatcttgagatcttgcaaatacaagtctcactcttcacactgagcctgtaccactgttgtaacatgggaagacgtgaagaagaaataatctgagctttaattatttatatttggatataaggtctgcttaaataaagaatctttgtaccaaactgcccacatgagggtgaagagatttcctcaaaagacttaaatgacctggattgatcagagagaattgaactgtgacctttaaaacttctagactaattcttttagttgatagagattcatttagtcaaagacaaaagctttaactgtgagggcacagccttgaagtgggagtgatgagattctgagggacccatgaattggattgaggcttgaggggaaatggtgtgagacgaatgggctctggacatatgcctgttgatttgagaagaaatctggctggtttgagggtttcctttagttcaccctcatactctcaggagactcttctggatacttttgtcttccaccctgccctggcagtgcagccaatcagaaatggctcttgtgacttaactgggcttggatatccctggaatgtggggcttgaacattgctcctgtgatgatcatctgtcccaggtcacactccttcatttgaccacatgcgcctatttgcaacttctttttagagccaatgtaattgcctgttaggagccagaagtttgcccagctgctttcttctggttgtacagatccattgtggtctgccttccaggctcattaatagtctaactacgtaataactgaagacctatctcttgtgaagattcattctcaatgtgttcacttggacagagccctgcctggcctaacgattagagggttagtctccatcctgctcagatatgactcctgggcaattcacttaacttctccatggctgcttcctgctgaataaatagggacaggcataatggataggaatgaatgaacttttaagatactgtctagctctaaaattggaagaacaaaaagttttagattagagtcatagccttaatagccctagttgtcatcctgggagacaggcaacagtagagatatttgagagcctaaagagaggtttggcctgtgggtttttaagtggttattgaattggtatcaggagatcctgaggctggtaggggaaggtaattctttctaagttacctctgtatttttcaagttttctataaggaatacacatacacccacatgcacacaccatagtttttatacaaacagcaataacaaaaccaaaaagatgcccctttttttgtagggataagaaatacatttgttttatacttctatgctatattttgctattcaaaatttagtgggcattacttaacattgtttctaattattttgtggctgctgtatgttttatgtgttgggagcccattgtattaggccgttcttggattgctataaagaaatacctgagactgggtaatttggttttttggttttttggggttttttttgagacggagccttgctctgtcgcccaggctggagtgcagtggcgcgatctcggctctatgcaacctccacctcctgggttcatgccattctcctgcctcagcctcccgagtagctgggactacaggcgcccgccaccatgcctggctaattttttatatttttagtagagatggggtttcaccgtatgagccaggatggtctcgatctcctgacctcatgatccacaagactgggtaatctgtaaagaaaagaggtttaattggctcatggctctgcaggctttacaggaagcatggtactggcatctgcttggtttctggggaggcctccggaagcttatagtcatggcagaaggtgaagggggagcaggcacatcacatgacaaaagcaggaacaagactcagagcaagaagtcacttatcaccaaggggatggcccaggccattcatgagggatccacctttgtgctccaaacacctcccaccaggccccacctccagtattggggattacatttcaacttgaggtttgggcgggaacaaatagtcaaattatattacccatctacatggttttctttttcttagtatgggagtgtccatgaataaattcatgggcatcctcataactcttccatgaatggcaaggggtacttatggaaaacagttttccaaagatctgattgttttgaaatgtgttagattggacttgttcaaatgttcatatttttgttctatgctaaatgcatcgttaggggagtagtggtaaatattccagaatccatatgaaattcatgagtttatttatgtctaaaacactgaaaactgtgtccaatatcgttcagtttcctgggtctttttcttattagcacatttgagaaaaatattcctttcctttattgtagtaaatctattaaaggcaatagccaataaaacatttttaatttta

SEQ ID NO: 85900 - DNA, 3837 bp, Homo sapiens
cggacgcgtgggctagttctagatcgcgatctagaactaaggcagagaattttgcaacacgtggtagtgaactgtgaggagtttgaggggtctgaagactgaaagagtcgaatggtttgttggcaggacctagaagaatcccttaggatgaagctgagtcttaccaaggtagttaatggctgtcgcctaggaaaaataaaaaacctgggcaaaacaggggaccacaccatggatattccaggctgccttctgtataccaagactggctccgccccacacctcacccatcacacgctgcataatatccacggggttcctgccatggctcagcttacgctgtcatccctagcagaacatcatgaagtcttgacagaatataaagaaggagttggaaagtttataggcatgccagaatcactcttgtactgctccctgcacgatccagtcagcccctgcccggctggttatgtaacaaacaagtctgtgtctgtgtggagtgttgcaggacgagtggaaatgactgtttccaagttcatggcaattcagaaggcccttcagccagactggttccagtgcctctccgatggagaagtatcttgtaaggaagcaacttccataaaaagggtcagaaagtctgttgaccgatcacttcttttcttggataactgtctgcggctgcaggaagagtcagaggttcttcagaagagtgtgatcattggagtgattgaaggtggagatgtgatggaagagaggctgaggtcagcacgagagacagccaagcggcctgtgggtggcttccttctggatggttttcaaggaaatccaacaaccctggaggctagactacgcttgctgtcatcagtcactgcagagctgccggaggacaagccaaggctcatatctggtgttagtcggccagatgaggtgctcgagtgtattgaaagaggagtggacttatttgagagttttttcccttatcaagtaacagagcggggatgtgccctgactttcagttttgattaccagccgaatcctgaagagacactactacaacaaaatggaacacaagaagaaataaaatgtatggatcaaataaagaaaattgaaacaactggttgcaaccaagaaataacatcatttgaaattaatctgaaggaaaaaaagtaccaggaggactttaacccgctggtgagaggatgttcctgttactgctgtaagaatcacactcgggcatacatccaccatctgctggtgaccaatgagctgctggccggagtcctgcttatgatgcacaactttgaacactactttgggtttttccattacatccgggaagcactaaaaagtgacaaactggcacagttgaaagagctcatccacaggcaagcatcttgagatcttgcaaatacaagtctcactcttcacactgagcctgtaccactgttgtaacatgggaagacgtgaagaagaaataatctgagctttaattatttatatttggatataaggtctgcttaaataaagaatctttgtaccaaactgcccacatgagggtgaagagatttcctcaaaagacttaaatgacctggattgatcagagagaattgaactgtgacctttaaaacttctagactaattcttttagttgatagagattcatttagtcaaagacaaaagctttaactgtgagggcacagccttgaagtgggagtgatgagattctgagggacccatgaattggattgaggcttgaggggaaatggtgtgagacgaatgggctctggacatatgcctgttgatttgagaagaaatctggctggtttgagggtttcctttagttcaccctcatactctcaggagactcttctggatacttttgtcttccaccctgccctggcagtgcagccaatcagaaatggctcttgtgacttaactgggcttggatatccctggaatgtggggcttgaacattgctcctgtgatgatcatctgtcccaggtcacactccttcatttgaccacatgcgcctatttgcaacttctttttagagccaatgtaattgcctgttaggagccagaagtttgcccagctgctttcttctggttgtacagatccattgtggtctgccttccaggctcattaatagtctaactacgtaataactgaagacctatctcttgtgaagattcattctcaatgtgttcacttggacagagccctgcctggcctaacgattagagggttagtctccatcctgctcagatatgactcctgggcaattcacttaacttctccatggctgcttcctgctgaataaatagggacaggcataatggataggaatgaatgaacttttaagatactgtctagctctaaaattggaagaacaaaaagttttagattagagtcatagccttaatagccctagttgtcatcctgggagacaggcaacagtagagatatttgagagcctaaagagaggtttggcctgtgggtttttaagtggttattgaattggtatcaggagatcctgaggctggtaggggaaggtaattctttctaagttacctctgtatttttcaagttttctataaggaatacacatacacccacatgcacacaccatagtttttatacaaacagcaataacaaaaccaaaaagatgcccctttttttgtagggataagaaatacatttgttttatacttctatgctatattttgctattcaaaatttagtgggcattacttaacattgtttctaattattttgtggctgctgtatgttttatgtgttgggagcccattgtattaggccgttcttggattgctataaagaaatacctgagactgggtaatttggttttttggttttttggggttttttttgagacggagccttgctctgtcgcccaggctggagtgcagtggcgcgatctcggctctatgcaacctccacctcctgggttcatgccattctcctgcctcagcctcccgagtagctgggactacaggcgcccgccaccatgcctggctaattttttatatttttagtagagatggggtttcaccgtatgagccaggatggtctcgatctcctgacctcatgatccacaagactgggtaatctgtaaagaaaagaggtttaattggctcatggctctgcaggctttacaggaagcatggtactggcatctgcttggtttctggggaggcctccggaagcttatagtcatggcagaaggtgaagggggagcaggcacatcacatgacaaaagcaggaacaagactcagagcaagaagtcacttatcaccaaggggatggcccaggccattcatgagggatccacctttgtgctccaaacacctcccaccaggccccacctccagtattggggattacatttcaacttgaggtttgggcgggaacaaatagtcaaattatattacccatctacatggttttctttttcttagtatgggagtgtccatgaataaattcatgggcatcctcataactcttccatgaatggcaaggggtacttatggaaaacagttttccaaagatctgattgttttgaaatgtgttagattggacttgttcaaatgttcatatttttgttctatgctaaatgcatcgttaggggagtagtggtaaatattccagaatccatatgaaattcatgagtttatttatgtctaaaacactgaaaactgtgtccaatatcgttcagtttcctgggtctttttcttattagcacatttgagaaaaatattcctttcctttattgtagtaaatctattaaaggcaatagccaataaaacatttttaatttta

SEQ ID NO: 85901 - DNA, 1840 bp, Homo sapiens
tactctagaggcgccccgctttggatgcgcctatttgcaacttctttttagagccaatgtaattgcctgttaggagccagaagtttgcccagctgctttcttctggttgtacagatccattgtggtctgccttccaggctcattaatagtctaactacgtaataactgaagacctatctcttgtgaagattcattctcaatgtgttcacttggacagagccctgcctggcctaacgattagagggttagtctccatcctgctcagatatgactcctgggcaattcacttaacttctccatggctgcttcctgctgaataaatagggacaggcataatggataggaatgaatgaacttttaagatactgtctagctctaaaattggaagaacaaaaagttttagattagagtcatagccttaatagccctagttgtcatcctgggagacaggcaacagtagagatatttgagagcctaaagagaggtttggcctgtgggtttttaagtggttattgaattggtatcaggagatcctgaggctggtaggggaaggtaattctttctaagttacctctgtatttttcaagttttctataaggaatacacatacacccacatgcacacaccatagtttttatacaaacagcaataacaaaaccaaaaagatgcccctttttttgtagggataagaaatacatttgttttatacttctatgctatattttgctattcaaaatttagtgggcattacttaacattgtttctaattattttgtggctgctgtatgttttatgtgttgggagcccattgtattaggccgttcttggattgctataaagaaatacctgagactgggtaatttggttttttggttttttggggttttttttgagacggagccttgctctgtcgcccaggctggagtgcagtggcgcgatctcggctctatgcaacctccacctcctgggttcatgccattctcctgcctcagcctcccgagtagctgggactacaggcgcccgccaccatgcctggctaattttttatatttttagtagagatggggtttcaccgtatgagccaggatggtctcgatctcctgacctcatgatccacaagactgggtaatctgtaaagaaaagaggtttaattggctcatggctctgcaggctttacaggaagcatggtactggcatctgcttggtttctggggaggcctccggaagcttatagtcatggcagaaggtgaagggggagcaggcacatcacatgacaaaagcaggaacaagactcagagcaagaagtcacttatcaccaaggggatggcccaggccattcatgagggatccacctttgtgctccaaacacctcccaccaggccccacctccagtattggggattacatttcaacttgaggtttgggcgggaacaaatagtcaaattatattacccatctacatggttttctttttcttagtatgggagtgtccatgaataaattcatgggcatcctcataactcttccatgaatggcaaggggtacttatggaaaacagttttccaaagatctgattgttttgaaatgtgttagattggacttgttcaaatgttcatatttttgttctatgctaaatgcatcgttaggggagtagtggtaaatattccagaatccatatgaaattcatgagtttatttatgtctaaaacactgaaaactgtgtccaatatcgttcagtttcctgggtctttttcttattagcacatttgagaaaaatattcctttcctttattgtagtaaatctattaaaggcaatagccaataaaacatttttaatttta

SEQ ID NO: 85902 - DNA, 3965 bp, Homo sapiens
cggacgcgtgggctagttctagatcgcgatctagaactaaggcagagaattttgcaacacgtggtagtgaactgtgaggagtttgaggggtctgaagactgaaagagtcgaatggtttgttggcagggtgtcctggtggattggtttctgtaagttcagattctcataaatcgtgtgagcgtcgccgacacctctgagataaaagggcccctttcgactagcctctgctgaaaggacctagaagaatcccttaggatgaagctgagtcttaccaaggtagttaatggctgtcgcctaggaaaaataaaaaacctgggcaaaacaggggaccacaccatggatattccaggctgccttctgtataccaagactggctccgccccacacctcacccatcacacgctgcataatatccacggggttcctgccatggctcagcttacgctgtcatccctagcagaacatcatgaagtcttgacagaatataaagaaggagttggaaagtttataggcatgccagaatcactcttgtactgctccctgcacgatccagtcagcccctgcccggctggttatgtaacaaacaagtctgtgtctgtgtggagtgttgcaggacgagtggaaatgactgtttccaagttcatggcaattcagaaggcccttcagccagactggttccagtgcctctccgatggagaagtatcttgtaaggaagcaacttccataaaaagggtcagaaagtctgttgaccgatcacttcttttcttggataactgtctgcggctgcaggaagagtcagaggttcttcagaagagtgtgatcattggagtgattgaaggtggagatgtgatggaagagaggctgaggtcagcacgagagacagccaagcggcctgtgggtggcttccttctggatggttttcaaggaaatccaacaaccctggaggctagactacgcttgctgtcatcagtcactgcagagctgccggaggacaagccaaggctcatatctggtgttagtcggccagatgaggtgctcgagtgtattgaaagaggagtggacttatttgagagttttttcccttatcaagtaacagagcggggatgtgccctgactttcagttttgattaccagccgaatcctgaagagacactactacaacaaaatggaacacaagaagaaataaaatgtatggatcaaataaagaaaattgaaacaactggttgcaaccaagaaataacatcatttgaaattaatctgaaggaaaaaaagtaccaggaggactttaacccgctggtgagaggatgttcctgttactgctgtaagaatcacactcgggcatacatccaccatctgctggtgaccaatgagctgctggccggagtcctgcttatgatgcacaactttgaacactactttgggtttttccattacatccgggaagcactaaaaagtgacaaactggcacagttgaaagagctcatccacaggcaagcatcttgagatcttgcaaatacaagtctcactcttcacactgagcctgtaccactgttgtaacatgggaagacgtgaagaagaaataatctgagctttaattatttatatttggatataaggtctgcttaaataaagaatctttgtaccaaactgcccacatgagggtgaagagatttcctcaaaagacttaaatgacctggattgatcagagagaattgaactgtgacctttaaaacttctagactaattcttttagttgatagagattcatttagtcaaagacaaaagctttaactgtgagggcacagccttgaagtgggagtgatgagattctgagggacccatgaattggattgaggcttgaggggaaatggtgtgagacgaatgggctctggacatatgcctgttgatttgagaagaaatctggctggtttgagggtttcctttagttcaccctcatactctcaggagactcttctggatacttttgtcttccaccctgccctggcagtgcagccaatcagaaatggctcttgtgacttaactgggcttggatatccctggaatgtggggcttgaacattgctcctgtgatgatcatctgtcccaggtcacactccttcatttgaccacatgcgcctatttgcaacttctttttagagccaatgtaattgcctgttaggagccagaagtttgcccagctgctttcttctggttgtacagatccattgtggtctgccttccaggctcattaatagtctaactacgtaataactgaagacctatctcttgtgaagattcattctcaatgtgttcacttggacagagccctgcctggcctaacgattagagggttagtctccatcctgctcagatatgactcctgggcaattcacttaacttctccatggctgcttcctgctgaataaatagggacaggcataatggataggaatgaatgaacttttaagatactgtctagctctaaaattggaagaacaaaaagttttagattagagtcatagccttaatagccctagttgtcatcctgggagacaggcaacagtagagatatttgagagcctaaagagaggtttggcctgtgggtttttaagtggttattgaattggtatcaggagatcctgaggctggtaggggaaggtaattctttctaagttacctctgtatttttcaagttttctataaggaatacacatacacccacatgcacacaccatagtttttatacaaacagcaataacaaaaccaaaaagatgcccctttttttgtagggataagaaatacatttgttttatacttctatgctatattttgctattcaaaatttagtgggcattacttaacattgtttctaattattttgtggctgctgtatgttttatgtgttgggagcccattgtattaggccgttcttggattgctataaagaaatacctgagactgggtaatttggttttttggttttttggggttttttttgagacggagccttgctctgtcgcccaggctggagtgcagtggcgcgatctcggctctatgcaacctccacctcctgggttcatgccattctcctgcctcagcctcccgagtagctgggactacaggcgcccgccaccatgcctggctaattttttatatttttagtagagatggggtttcaccgtatgagccaggatggtctcgatctcctgacctcatgatccacaagactgggtaatctgtaaagaaaagaggtttaattggctcatggctctgcaggctttacaggaagcatggtactggcatctgcttggtttctggggaggcctccggaagcttatagtcatggcagaaggtgaagggggagcaggcacatcacatgacaaaagcaggaacaagactcagagcaagaagtcacttatcaccaaggggatggcccaggccattcatgagggatccacctttgtgctccaaacacctcccaccaggccccacctccagtattggggattacatttcaacttgaggtttgggcgggaacaaatagtcaaattatattacccatctacatggttttctttttcttagtatgggagtgtccatgaataaattcatgggcatcctcataactcttccatgaatggcaaggggtacttatggaaaacagttttccaaagatctgattgttttgaaatgtgttagattggacttgttcaaatgttcatatttttgttctatgctaaatgcatcgttaggggagtagtggtaaatattccagaatccatatgaaattcatgagtttatttatgtctaaaacactgaaaactgtgtccaatatcgttcagtttcctgggtctttttcttattagcacatttgagaaaaatattcctttcctttacctccaaccctctcaagaccatgccccaatcaacatagtgccaatcaacatagtgccaatcaacatagtg

SEQ ID NO: 85903 - DNA, 1350 bp, Homo sapiens
gaacgcccatgtgttggtaccaggaatcgcggccgcgtccatcctgaggctggtaggggaaggtaattctttctaagttacctctgtatttttcaagttttctataaggaatacacatacacccacatgcacacaccatagtttttatacaaacagcaataacaaaaccaaaaagatgcccctttttttgtagggataagaaatacatttgttttatacttctatgctatattttgctattcaaaatttagtgggcattacttaacattgtttctaattattttgtggctgctgtatgttttatgtgttgggagcccattgtattaggccgttcttggattgctataaagaaatacctgagactgggtaatttggttttttggttttttggggttttttttgagacggagccttgctctgtcgcccaggctggagtgcagtggcgcgatctcggctctatgcaacctccacctcctgggttcatgccattctcctgcctcagcctcccgagtagctgggactacaggcgcccgccaccatgcctggctaattttttatatttttagtagagatggggtttcaccgtatgagccaggatggtctcgatctcctgacctcatgatccacaagactgggtaatctgtaaagaaaagaggtttaattggctcatggctctgcaggctttacaggaagcatggtactggcatctgcttggtttctggggaggcctccggaagcttatagtcatggcagaaggtgaagggggagcaggcacatcacatgacaaaagcaggaacaagactcagagcaagaagtcacttatcaccaaggggatggcccaggccattcatgagggatccacctttgtgctccaaacacctcccaccaggccccacctccagtattggggattacatttcaacttgaggtttgggcgggaacaaatagtcaaattatattacccatctacatggttttctttttcttagtatgggagtgtccatgaataaattcatgggcatcctcataactcttccatgaatggcaaggggtacttatggaaaacagttttccaaagatctgattgttttgaaatgtgttagattggacttgttcaaatgttcatatttttgttctatgctaaatgcatcgttaggggagtagtggtaaatattccagaatccatatgaaattcatgagtttatttatgtctaaaacactgaaaactgtgtccaatatcgttcagtttcctgggtctttttcttattagcacatttgagaaaaatattcctttcctttattgtagtaaatctattaaaggcaatagccaataaaacatttttaatttta

SEQ ID NO: 85904 - DNA, 1089 bp, Homo sapiens
cggacgcgtgggctagttctagatcgcgatctagaactaaggcagagaattttgcaacacgtggtagtgaactgtgaggagtttgaggggtctgaagactgaaagagtcgaatggtttgttggcagggtgtcctggtggattggtttctgtaagttcagattctcataaatcgtgtgagcgtcgccgacacctctgagataaaagggcccctttcgactagcctctgctgaaaggacctagaagaatcccttaggatgaagctgagtcttaccaaggtagttaatggctgtcgcctaggaaaaataaaaaacctgggcaaaacaggggaccacaccatggatattccaggctgccttctgtataccaagactggctccgccccacacctcacccatcacacgctgcataatatccacggggttcctgccatggctcagcttacgctgtcatccctagcagaacatcatgaagtcttgacagaatataaagaaggagttggaaagtttataggcatgccagaatcactcttgtactgctccctgcacgatccagtcagcccctgcccggctggttatgtaacaaacaagtctgtgtctgtgtggagtgttgcaggacgagtggaaatgactgtttccaagttcatggcaattcagaaggcccttcagccagactggttccagtgcctctccgatggagaagtatcttgtaaggaagcaacttccataaaaagggtcagaaagtctgttgaccgatcacttcttttcttggataactgtctgcggctgcaggaagagtcagaggttcttcagaagagtgtgatcattggagtgattgaaggtggagatgtgatggaagagaggctgaggtcagcacgagagacagccaagcggcctgtgggtggcttccttctggatggttttcaaggaaatccaacaaccctggaggctagactacgcttgctgtcatcagtcactgcagagctgccggaggacaagccaaggccagtgttcggttaggacacaggctggcctcaagggatgcagggaaggagtgctggccgattgtatattaaatagtgtctgtgcata

SEQ ID NO: 85905 - DNA, 3945 bp, Homo sapiens
cggacgcgtgggctagttctagatcgcgatctagaactaaggcagagaattttgcaacacgtggtagtgaactgtgaggagtttgaggggtctgaagactgaaagagtcgaatggtttgttggcagggtgtcctggtggattggtttctgtaagttcagattctcataaatcgtgtgagcgtcgccgacacctctgagataaaagggcccctttcgactagcctctgctgaaaggacctagaagaatcccttaggatgaagctgagtcttaccaaggtagttaatggctgtcgcctaggaaaaataaaaaacctgggcaaaacaggggaccacaccatggatattccaggctgccttctgtataccaagactggctccgccccacacctcacccatcacacgctgcataatatccacggggttcctgccatggctcagcttacgctgtcatccctagcagaacatcatgaagtcttgacagaatataaagaaggagttggaaagtttataggcatgccagaatcactcttgtactgctccctgcacgatccagtcagcccctgcccggctggttatgtaacaaacaagtctgtgtctgtgtggagtgttgcaggacgagtggaaatgactgtttccaagttcatggcaattcagaaggcccttcagccagactggttccagtgcctctccgatggagaagtatcttgtaaggaagcaacttccataaaaagggtcagaaagtctgttgaccgatcacttcttttcttggataactgtctgcggctgcaggaagagtcagaggttcttcagaagagtgtgatcattggagtgattgaaggtggagatgtgatggaagagaggctgaggtcagcacgagagacagccaagcggcctgtgggtggcttccttctggatggttttcaaggaaatccaacaaccctggaggctagactacgcttgctgtcatcagtcactgcagagctgccggaggacaagccaaggctcatatctggtgttagtcggccagatgaggtgctcgagtgtattgaaagaggagtggacttatttgagagttttttcccttatcaagtaacagagcggggatgtgccctgactttcagttttgattaccagccgaatcctgaagagacactactacaacaaaatggaacacaagaagaaataaaatgtatggatcaaataaagaaaattgaaacaactggttgcaaccaagaaataacatcatttgaaattaatctgaaggaaaaaaagtaccaggaggactttaacccgctggtgagaggatgttcctgttactgctgtaagaatcacactcgggcatacatccaccatctgctggtgaccaatgagctgctggccggagtcctgcttatgatgcacaactttgaacactactttgggtttttccattacatccgggaagcactaaaaagtgacaaactggcacagttgaaagagctcatccacaggcaagcatcttgagatcttgcaaatacaagtctcactcttcacactgagcctgtaccactgttgtaacatgggaagacgtgaagaagaaataatctgagctttaattatttatatttggatataaggtctgcttaaataaagaatctttgtaccaaactgcccacatgagggtgaagagatttcctcaaaagacttaaatgacctggattgatcagagagaattgaactgtgacctttaaaacttctagactaattcttttagttgatagagattcatttagtcaaagacaaaagctttaactgtgagggcacagccttgaagtgggagtgatgagattctgagggacccatgaattggattgaggcttgaggggaaatggtgtgagacgaatgggctctggacatatgcctgttgatttgagaagaaatctggctggtttgagggtttcctttagttcaccctcatactctcaggagactcttctggatacttttgtcttccaccctgccctggcagtgcagccaatcagaaatggctcttgtgacttaactgggcttggatatccctggaatgtggggcttgaacattgctcctgtgatgatcatctgtcccaggtcacactccttcatttgaccacatgcgcctatttgcaacttctttttagagccaatgtaattgcctgttaggagccagaagtttgcccagctgctttcttctggttgtacagatccattgtggtctgccttccaggctcattaatagtctaactacgtaataactgaagacctatctcttgtgaagattcattctcaatgtgttcacttggacagagccctgcctggcctaacgattagagggttagtctccatcctgctcagatatgactcctgggcaattcacttaacttctccatggctgcttcctgctgaataaatagggacaggcataatggataggaatgaatgaacttttaagatactgtctagctctaaaattggaagaacaaaaagttttagattagagtcatagccttaatagccctagttgtcatcctgggagacaggcaacagtagagatatttgagagcctaaagagaggtttggcctgtgggtttttaagtggttattgaattggtatcaggagatcctgaggctggtaggggaaggtaattctttctaagttacctctgtatttttcaagttttctataaggaatacacatacacccacatgcacacaccatagtttttatacaaacagcaataacaaaaccaaaaagatgcccctttttttgtagggataagaaatacatttgttttatacttctatgctatattttgctattcaaaatttagtgggcattacttaacattgtttctaattattttgtggctgctgtatgttttatgtgttgggagcccattgtattaggccgttcttggattgctataaagaaatacctgagactgggtaatttggttttttggttttttggggttttttttgagacggagccttgctctgtcgcccaggctggagtgcagtggcgcgatctcggctctatgcaacctccacctcctgggttcatgccattctcctgcctcagcctcccgagtagctgggactacaggcgcccgccaccatgcctggctaattttttatatttttagtagagatggggtttcaccgtatgagccaggatggtctcgatctcctgacctcatgatccacaagactgggtaatctgtaaagaaaagaggtttaattggctcatggctctgcaggctttacaggaagcatggtactggcatctgcttggtttctggggaggcctccggaagcttatagtcatggcagaaggtgaagggggagcaggcacatcacatgacaaaagcaggaacaagactcagagcaagaagtcacttatcaccaaggggatggcccaggccattcatgagggatccacctttgtgctccaaacacctcccaccaggccccacctccagtattggggattacatttcaacttgaggtttgggcgggaacaaatagtcaaattatattacccatctacatggttttctttttcttagtatgggagtgtccatgaataaattcatgggcatcctcataactcttccatgaatggcaaggggtacttatggaaaacagttttccaaagatctgattgttttgaaatgtgttagattggacttgttcaaatgttcatatttttgttctatgctaaatgcatcgttaggggagtagtggtaaatattccagaatccatatgaaattcatgagtttatttatgtctaaaacactgaaaactgtgtccaatatcgttcagtttcctgggtctttttcttattagcacatttgagaaaaatattcctttcctttattgtagtaaatctattaaaggcaatagccaataaaacatttttaatttta

SEQ ID NO: 85906 - DNA, 4145 bp, Homo sapiens
cggacgcgtgggctagttctagatcgcgatctagaactaaggcagagaattttgcaacacgtggtagtgaactgtgaggagtttgaggggtctgaagactgaaagagtcgaatggtttgttggcagggtgtcctggtggattggtttctgtaagttcagattctcataaatcgtgtgagcgtcgccgacacctctgagataaaagggcccctttcgactagcctctgctgaaaggacctagaagaatcccttaggatgaagctgagtcttaccaaggtagttaatggctgtcgcctaggaaaaataaaaaacctgggcaaaacaggggaccacaccatggatattccaggctgccttctgtataccaagactggctccgccccacacctcacccatcacacgctgcataatatccacggggttcctgccatggctcagcttacgctgtcatccctagcagaacatcatgaagtcttgacagaatataaagaaggagttggaaagtttataggcatgccagaatcactcttgtactgctccctgcacgatccagtcagcccctgcccggctggttatgtaacaaacaagtctgtgtctgtgtggagtgttgcaggacgagtggaaatgactgtttccaagttcatggcaattcagaaggcccttcagccagactggttccagtgcctctccgatggagaagtatcttgtaaggaagcaacttccataaaaagggtcagaaagtctgttgaccgatcacttcttttcttggataactgtctgcggctgcaggaagagtcagaggttcttcagaagagtgtgatcattggagtgattgaaggtggagatgtgatggaagagaggctgaggtcagcacgagagacagccaagcggcctgtgggtggcttccttctggatggttttcaaggaaatccaacaaccctggaggctagactacgcttgctgtcatcagtcactgcagagctgccggaggacaagccaaggctcatatctggtgttagtcggccagatgaggtgctcgagtgtattgaaagaggagtggacttatttgagagttttttcccttatcaagtaacagagcggggatgtgccctgactttcagttttgattaccagccgaatcctgaagagacactactacaacaaaatggaacacaagaagaaataaaatgtatggatcaaataaagaaaattgaaacaactggttgcaaccaagaaataacatcatttgaaattaatctgaaggaaaaaaagtaccaggaggactttaacccgctggtgagaggatgttcctgttactgctgtaagaatcacactcgggcatacatccaccatctgctggtgaccaatgagctgctggccggagtcctgcttatgatgcacaactttgaacactactttgggtttttccattacatccgggaagcactaaaaagtgacaaactggcacagttgaaagagctcatccacaggcaagcatcttgagatcttgcaaatacaagtctcactcttcacactgagcctgtaccactgttgtaacatgggaagacgtgaagaagaaataatctgagctttaattatttatatttggatataaggtctgcttaaataaagaatctttgtaccaaactgcccacatgagggtgaagagatttcctcaaaagacttaaatgacctggattgatcagagagaattgaactgtgacctttaaaacttctagactaattcttttagttgatagagattcatttagtcaaagacaaaagctttaactgtgagggcacagccttgaagtgggagtgatgagattctgagggacccatgaattggattgaggcttgaggggaaatggtgtgagacgaatgggctctggacatatgcctgttgatttgagaagaaatctggctggtttgagggtttcctttagttcaccctcatactctcaggagactcttctggatacttttgtcttccaccctgccctggcagtgcagccaatcagaaatggctcttgtgacttaactgggcttggatatccctggaatgtggggcttgaacattgctcctgtgatgatcatctgtcccaggtcacactccttcatttgaccacatgcgcctatttgcaacttctttttagagccaatgtaattgcctgttaggagccagaagtttgcccagctgctttcttctggttgtacagatccattgtggtctgccttccaggctcattaatagtctaactacgtaataactgaagacctatctcttgtgaagattcattctcaatgtgttcacttggacagagccctgcctggcctaacgattagagggttagtctccatcctgctcagatatgactcctgggcaattcacttaacttctccatggctgcttcctgctgaataaatagggacaggcataatggataggaatgaatgaacttttaagatactgtctagctctaaaattggaagaacaaaaagttttagattagagtcatagccttaatagccctagttgtcatcctgggagacaggcaacagtagagatatttgagagcctaaagagaggtttggcctgtgggtttttaagtggttattgaattggtatcaggagatcctgaggctggtaggggaaggtaattctttctaagttacctctgtatttttcaagttttctataaggaatacacatacacccacatgcacacaccatagtttttatacaaacagcaataacaaaaccaaaaagatgcccctttttttgtagggataagaaatacatttgttttatacttctatgctatattttgctattcaaaatttagtgggcattacttaacattgtttctaattattttgtggctgctgtatgttttatgtgttgggagcccattgtattaggccgttcttggattgctataaagaaatacctgagactgggtaatttggttttttggttttttggggttttttttgagacggagccttgctctgtcgcccaggctggagtgcagtggcgcgatctcggctctatgcaacctccacctcctgggttcatgccattctcctgcctcagcctcccgagtagctgggactacaggcgcccgccaccatgcctggctaattttttatatttttagtagagatggggtttcaccgtatgagccaggatggtctcgatctcctgacctcatgatccacaagactgggtaatctgtaaagaaaagaggtttaattggctcatggctctgcaggctttacaggaagcatggtactggcatctgcttggtttctggggaggcctccggaagcttatagtcatggcagaaggtgaagggggagcaggcacatcacatgacaaaagcaggaacaagactcagagcaagaagtcacttatcaccaaggggatggcccaggccattcatgagggatccacctttgtgctccaaacacctcccaccaggccccacctccagtattggggattacatttcaacttgaggtttgggcgggaacaaatagtcaaattatattacccatctacatggttttctttttcttagtatgggagtgtccatgaataaattcatgggcatcctcataactcttccatgaatggcaaggggtacttatggaaaacagttttccaaagatctgattgttttgaaatgtgttagattggacttgttcaaatgttcatatttttgttctatgctaaatgcatcgttaggggagtagtggtaaatattccagaatccatatgaaattcatgagtttatttatgtctaaaacactgaaaactgtgtccaatatcgttcagtttcctgggtctttttcttattagcacatttgagaaaaatattcctttcctttattgtagtaaatctattaaaggcaatagccaataaaacatttttaattttaaaaatttactgtgtttggctttctgtaaatgtagtaggtctgttaaacaaaatattaaatttccatagtaccagaaatgttgtagagatttctcattggaagaaaaaaatgtttatctgtattcattgttttgagagcttccatgataaatgtaatatccaaaaagatatttaattatatacattatgaagattccctta

SEQ ID NO: 85907 - DNA, 2952 bp, Homo sapiens
cggacgcgtgggctagttctagatcgcgatctagaactaaggcagagaattttgcaacacgtggtagtgaactgtgaggagtttgaggggtctgaagactgaaagagtcgaatggtttgttggcagggtgtcctggtggattggtttctgtaagttcagattctcataaatcgtgtgagcgtcgccgacacctctgagataaaagggcccctttcgactagcctctgctgaaaggacctagaagaatcccttaggatgaagctgagtcttaccaaggtagttaatggctgtcgcctaggaaaaataaaaaacctgggcaaaacaggggaccacaccatggatattccaggctgccttctgtataccaagactggctccgccccacacctcacccatcacacgctgcataatatccacggggttcctgccatggctcagcttacgctgtcatccctagcagaacatcatgaagtcttgacagaatataaagaaggagttggaaagtttataggcatgccagaatcactcttgtactgctccctgcacgatccagtcagcccctgcccggctggttatgtaacaaacaagtctgtgtctgtgtggagtgttgcaggacgagtggaaatgactgtttccaagttcatggcaattcagaaggcccttcagccagactggttccagtgcctctccgatggagaagtatcttgtaaggaagcaacttccataaaaagggtcagaaagtctgttgaccgatcacttcttttcttggataactgtctgcggctgcaggaagagtcagaggttcttcagaagagtgtgatcattggagtgattgaaggtggagatgtgatggaagagaggctgaggtcagcacgagagacagccaagcggcctgtgggtggcttccttctggatggttttcaaggaaatccaacaaccctggaggctagactacgcttgctgtcatcagtcactgcagagctgccggaggacaagccaaggctcatatctggtgttagtcggccagatgaggtgctcgagtgtattgaaagaggagtggacttatttgagagttttttcccttatcaagtaacagagcggggatgtgccctgactttcagttttgattaccagccgaatcctgaagagacactactacaacaaaatggaacacaagaagaaataaaatgtatggatcaaataaagaaaattgaaacaactggttgcaaccaagaaataacatcatttgaaattaatctgaaggaaaaaaagtaccaggaggactttaacccgctggtgagaggatgttcctgttactgctgtaagaatcacactcgggcatacatccaccatctgctggtgaccaatgagctgctggccggagtcctgcttatgatgcacaactttgaacactactttgggtttttccattacatccgggaagcactaaaaagtgacaaactggcacagttgaaagagctcatccacaggcaagcatcttgagatcttgcaaatacaagtctcactcttcacactgagcctgtaccactgttgtaacatgggaagacgtgaagaagaaataatctgagctttaattatttatatttggatataaggtctgcttaaataaagaatctttgtaccaaactgcccacatgagggtgaagagatttcctcaaaagacttaaatgacctggattgatcagagagaattgaactgtgacctttaaaacttctagactaattcttttagttgatagagattcatttagtcaaagacaaaagctttaactgtgagggcacagccttgaagtgggagtgatgagattctgagggacccatgaattggattgaggcttgaggggaaatggtgtgagacgaatgggctctggacatatgcctgttgatttgagaagaaatctggctggtttgagggtttcctttagttcaccctcatactctcaggagactcttctggatacttttgtcttccaccctgccctggcagtgcagccaatcagaaatggctcttgtgacttaactgggcttggatatccctggaatgtggggcttgaacattgctcctgtgatgatcatctgtcccaggtcacactccttcatttgaccacatgcgcctatttgcaacttctttttagagccaatgtaattgcctgttaggagccagaagtttgcccagctgctttcttctggttgtacagatccattgtggtctgccttccaggctcattaatagtctaactacgtaataactgaagacctatctcttgtgaagattcattctcaatgtgttcacttggacagagccctgcctggcctaacgattagagggttagtctccatcctgctcagatatgactcctgggcaattcacttaacttctccatggctgcttcctgctgaataaatagggacaggcataatggataggaatgaatgaacttttaagatactgtctagctctaaaattggaagaacaaaaagttttagattagagtcatagccttaatagccctagttgtcatcctgggagacaggcaacagtagagatatttgagagcctaaagagaggtttggcctgtgggtttttaagtggttattgaattggtatcaggagatcctgaggctggtaggggaaggtaattctttctaagttacctctgtatttttcaagttttctataaggaatacacatacacccacatgcacacaccatagtttttatacaaacagcaataacaaaaccaaaaagatgcccctttttttgtagggataagaaatacatttgttttatacttctatgctatattttgctattcaaaatttagtgggcattacttaacattgtttctaattattttgtggctgctgtatgttttatgtgttgggagcccattgtattagccgcatccaaagcgggatcctcagagtcac

SEQ ID NO: 85908 - DNA, 1267 bp, Homo sapiens
cggacgcgtgggctagttctagatcgcgatctagaactaaggcagagaattttgcaacacgtggtagtgaactgtgaggagtttgaggggtctgaagactgaaagagtcgaatggtttgttggcagggtgtcctggtggattggtttctgtaagttcagattctcataaatcgtgtgagcgtcgccgacacctctgagataaaagggcccctttcgactagcctctgctgaaaggacctagaagaatcccttaggatgaagctgagtcttaccaaggtagttaatggctgtcgcctaggaaaaataaaaaacctgggcaaaacaggggaccacaccatggatattccaggctgccttctgtataccaagactggctccgccccacacctcacccatcacacgctgcataatatccacggggttcctgccatggctcagcttacgctgtcatccctagcagaacatcatgaagtcttgacagaatataaagaaggagttggaaagtttataggcatgccagaatcactcttgtactgctccctgcacgatccagtcagcccctgcccggctggttatgtaacaaacaaggtgtgttttcagaagggtctccaaggctgcagctttgtcccaggaagtcagcctatggtgtatccctcagatgctcagatcccactgtctgggatgatcccttataccttttccttatttcgataattatagtgggatgggatggtttataagacttagagtagggctgcctaaggatgaggttaagatgaagaacactgtatcctcagcattttcattgttgcaaaaaaatttgagggtagaggagggtcaaatacatgccaaaaaaagaaattgctatgataggggaaaacgatagtctttcggcgccatgctttgttggatttttaacaacttcaggaagagtggggaaagttgctgatgagtattatcacatgtataactatatatagtagaatctcaatataatattgtctgctgggtctacagccagagattttgtctagtgaagaacagtatcaaaagcacctcattaaaagtgttaggctgagaggtggccccattggcattatccctgaggacagcattctggcaaagcttcagtgtgtactgctactttacaaacgcaaatacttttcctgcactcactttattaatgtcagcaatatttattaattgtgcccctcagaacactgtttttactcattctcctgttttaagtttctatttattttgtagt

SEQ ID NO: 85909 - DNA, 403 bp, Homo sapiens
aggctgaggcaggagaatcccttgaacctgggggacagaggttgcagtgagtggagatcgcactactacactccagctcaggtgaaagagtaagactccatctcaaaaaataaaaataaaaataaaataataaaataataatctctctttaaaatatggcatggggctactctggggacctccacctcccatcagatcagccatggcatttgattctcataggagctggaaccctattgtgaaacgcgcatcccagggatctaggttgtgtgctccttacaagaagaatctaatgcctgatccgaggtggaacggtttcatcctgaaactgctccatgctctgcctatggagtagccgttctttattcctttactttcttaataaacttgctttcacgaaaaa

SEQ ID NO: 85910 - DNA, 302 bp, Homo sapiens
ggggagggagcatccgccgctccgccgtgctgagcccttggcgctgtcatctcagtcttccgtctttcgtgggtctctgtgtcttgcagtgtcaggtgcaggccttcttttgggttgaatcctcaggatgtgatgtttttgttgccattataaatcgtagttctttacaagtttcttttcttttcgtctgagtgctatcgtctacagttttgttttctcaagataaaaatcatctttcaggttggccggtgtcagccgtgcgtcatccggaaggctgccataagcctgcgtttcgcagagct

SEQ ID NO: 85911 - DNA, 342 bp, Homo sapiens
agagacaaacatctctggggcctggcaactggggaagggactgattgtcaggcaggaggtggcactcagaggctgggcacagtggcccccacctgtaatcccaacactttgggaggccaagataggagaattgcttgagcccaggaggtcctgaccagcctgggcaacatagggagaccccatttctacaaaaactgggggaaaaaaataacctgtggggtggttgagtgcctgtggtctcaccagctacttgggaggctgaggtgggaggattggttgagcccaggaggtcgaggctgcagtaagccatgcttataccacttcgctgcaacctgggaaaca

SEQ ID NO: 85912 - DNA, 685 bp, Homo sapiens
gaaagcacagagatttccctttatgctccctgccccttcatatgcccagtctctctcacagtcaaattctctcaccagagtggtacatttgttagaatcagtgaacctgcattgacacatcataatcacctaaagtccacagtttacattagggttcattcttggtgttggacaaatgtgtaaggacatgtattcgtcattatagtatcatacagagtatttttgctgccctgaaaatcttctgtgctccaccttctcatcccttcttccacacacttacattttaagtatccttttgtccttttttctagagttttattagctctatagttttaattccagtaaagttctgttaatcatcctgttttctgagctgtcaaatgcaatgttggagtttttagaagtttaaaattatttctcgcttggtaatatgtccttttacaataaaaaaaatctatttaaccacagttggccttggtagcctcactacttctaaataaatgatgaaaccctaaattcatacatatctgtatttcagctggttattctcatgggaattttctcatttcttccttcagttttgactgtgacgttataaaataatatacttcgtaagcttcaaaaaaagaagtgtgtcaagttggaaagggagagagaggctagaaggcatgttgccagctcttct

SEQ ID NO: 85913 - DNA, 1788 bp, Homo sapiens
ggtgccggtggccccgccgccactccctccggctccctccctcccgccgcggcgcgcatctcattccagccctcattccgcgcattccagcgtcctcctcgcacactcgaggccagggggcgggagggccgcagctccggcgccgccgcgtcccgccagaacgatcgccgcggccggaagagttggcgctcggggcggactccttggaactggcttagcgcacccatcccaccttcccgcaccctgggaccggtccaacgagcgctcctccaagcggagccttggagggcacggccggcaccattacctccaacgagtggagctctcccacctcccctgaggggagcaccgcctctgggggcagtcaggcactggacaagcccatcgacaatgacgcagagggcgtgtggagcccggatattgagcagagtttccaggaggccctcgccatctacccgccctgtggcaggcgcaaaatcatcctgtcggacgagggcaagatgtatggtcggaacgagctgattgcccgctacatcaagctccggacagggaagacccgcaccaggaagcaggtctccagccacatccaggtgctggctcgtcgcaaagctcgcgagatccaggccaagctaaaggaccaggcagctaaggacaaggccctgcagagcatggctgccatgtcgtctgcacagatcatctccgccacggccttccacagtagcatggccctcgcccggggccccggccgcccagcagtctcagggttttggcaaggagctttgccaggccaagccggaacgtcccatgatgtgaagcctttctctcagcaaacctatgctgtccagcctccgctgcctctgccagggtttgagtctcctgcagggcccgccccatcgccctctgcgcccccggcacccccatggcagggccgcagcgtggccagctccaagctctggatgttggagttctctgccttcctggagcagcagcaggacccggacacgtacaacaagcacctgttcgtgcacattggccagtccagcccaagctacagcgacccctacctcgaagccgtggacatccgccaaatctatgacaaattcccggagaaaaagggtggactcaaggatctcttcgaacggggaccctccaatgccttttttcttgtgaagttctgggcagacctcaacaccaacatcgaggatgaaggcagctccttctatggggtctccagccagtatgagagccccgagaacatgatcatcacctgctccacgaaggtctgctctttcggcaagcaggtggtggagaaagttgagacagagtatgctcgctatgagaatggacactactcttaccgcatccaccggtccccgctctgtgagtacatgatcaacttcatccacaagctcaagcacctccctgagaagtacatgatgaacagcgtgctggagaacttcaccatcctgcaggtggtcaccaacagagacacacaggagaccttgctgtgcattgcctatgtctttgaggtgtcagccagtgagcacggggctcagcaccacatctacaggctggtgaaagaatgagagactcggggagcagggaggggggaagagacgtgtgtgcaggaaacggggacgtggggaggggacctgcaggggccagccccctgaagtgccaagagagctgagaggagcagttgtgactctacccaggaacaaactgtgcctgaacctgaggtgcccaaccccaaataaacccaagatgctgtgtattttcagaggaaaa

SEQ ID NO: 85914 - DNA, 1693 bp, Homo sapiens
ggtgccggtggccccgccgccactccctccggctccctccctcccgccgcggcgcgcatctcattccagccctcattccgcgcattccagcgtcctcctcgcacactcgaggccagggggcgggagggccgcagctccggcgccgccgcgtcccgccagccaacgagcgctcctccaagcggagccttggagggcacggccggcaccattacctccaacgagtggagctctcccacctcccctgaggggagcaccgcctctgggggcagtcaggcactggacaagcccatcgacaatgacgcagagggcgtgtggagcccggatattgagcagagtttccaggaggccctcgccatctacccgccctgtggcaggcgcaaaatcatcctgtcggacgagggcaagatgtatggtcggaacgagctgattgcccgctacatcaagctccggacagggaagacccgcaccaggaagcaggtctccagccacatccaggtgctggctcgtcgcaaagctcgcgagatccaggccaagctaaaggaccaggcagctaaggacaaggccctgcagagcatggctgccatgtcgtctgcacagatcatctccgccacggccttccacagtagcatggccctcgcccggggccccggccgcccagcagtctcagggttttggcaaggagctttgccaggccaagccggaacgtcccatgatgtgaagcctttctctcagcaaacctatgctgtccagcctccgctgcctctgccagggtttgagtctcctgcagggcccgccccatcgccctctgcgcccccggcacccccatggcagggccgcagcgtggccagctccaagctctggatgttggagttctctgccttcctggagcagcagcaggacccggacacgtacaacaagcacctgttcgtgcacattggccagtccagcccaagctacagcgacccctacctcgaagccgtggacatccgccaaatctatgacaaattcccggagaaaaagggtggactcaaggatctcttcgaacggggaccctccaatgccttttttcttgtgaagttctgggcagacctcaacaccaacatcgaggatgaaggcagctccttctatggggtctccagccagtatgagagccccgagaacatgatcatcacctgctccacgaaggtctgctctttcggcaagcaggtggtggagaaagttgagacagagtatgctcgctatgagaatggacactactcttaccgcatccaccggtccccgctctgtgagtacatgatcaacttcatccacaagctcaagcacctccctgagaagtacatgatgaacagcgtgctggagaacttcaccatcctgcaggtggtcaccaacagagacacacaggagaccttgctgtgcattgcctatgtctttgaggtgtcagccagtgagcacggggctcagcaccacatctacaggctggtgaaagaatgagagactcggggagcagggaggggggaagagacgtgtgtgcaggaaacggggacgtggggaggggacctgcaggggccagccccctgaagtgccaagagagctgagaggagcagttgtgactctacccaggaacaaactgtgcctgaacctgaggtgcccaaccccaaataaacccaagatgctgtgtattttcagaggaaaa

SEQ ID NO: 85915 - DNA, 1659 bp, Homo sapiens
ggtgccggtggccccgccgccactccctccggctccctccctcccgccgcggcgcgcatctcattccagccctcattccgcgcattccagcgtcctcctcgcacactcgaggccagggggcgggagggccgcagctccggcgccgccgcgtcccgccagaacgatcgccgcggccggaagagttggcgctcggggcggactccttggaactggcttagcgcacccatcccaccttcccgcaccctgggaccggtccaacgagcgctcctccaagcggagccttggagggcacggccggcaccattacctccaacgagtggagctctcccacctcccctgaggggagcaccgcctctgggggcagtcaggcactggacaagcccatcgacaatgacgcagagggcgtgtggagcccggatattgagcagagtttccaggaggccctcgccatctacccgccctgtggcaggcgcaaaatcatcctgtcggacgagggcaagatgtatggtcggaacgagctgattgcccgctacatcaagctccggacagggaagacccgcaccaggaagcaggtctccagccacatccaggtgctggctcgtcgcaaagctcgcgagatccaggccaagctaaagttttggcaaggagctttgccaggccaagccggaacgtcccatgatgtgaagcctttctctcagcaaacctatgctgtccagcctccgctgcctctgccagggtttgagtctcctgcagggcccgccccatcgccctctgcgcccccggcacccccatggcagggccgcagcgtggccagctccaagctctggatgttggagttctctgccttcctggagcagcagcaggacccggacacgtacaacaagcacctgttcgtgcacattggccagtccagcccaagctacagcgacccctacctcgaagccgtggacatccgccaaatctatgacaaattcccggagaaaaagggtggactcaaggatctcttcgaacggggaccctccaatgccttttttcttgtgaagttctgggcagacctcaacaccaacatcgaggatgaaggcagctccttctatggggtctccagccagtatgagagccccgagaacatgatcatcacctgctccacgaaggtctgctctttcggcaagcaggtggtggagaaagttgagacagagtatgctcgctatgagaatggacactactcttaccgcatccaccggtccccgctctgtgagtacatgatcaacttcatccacaagctcaagcacctccctgagaagtacatgatgaacagcgtgctggagaacttcaccatcctgcaggtggtcaccaacagagacacacaggagaccttgctgtgcattgcctatgtctttgaggtgtcagccagtgagcacggggctcagcaccacatctacaggctggtgaaagaatgagagactcggggagcagggaggggggaagagacgtgtgtgcaggaaacggggacgtggggaggggacctgcaggggccagccccctgaagtgccaagagagctgagaggagcagttgtgactctacccaggaacaaactgtgcctgaacctgaggtgcccaaccccaaataaacccaagatgctgtgtattttcagaggaaaa

SEQ ID NO: 85916 - DNA, 218 bp, Homo sapiens
tgtttgttcatttaatgagagaggaaactaatgcatctaagctttgctttgtttgcaaaattcaactgctgagcatcaaccttccccattttcttaaattttgattggcagaccagattgcagtaattcctccagccctcctcttcagaaggtggcaatttaactattaattaaagataaagaatctgatccttgtttcaccttgataatcagaggca

SEQ ID NO: 85917 - DNA, 377 bp, Homo sapiens
gaggaaagctgtaagatgaaaagacatcttgcagtccttgcagcgaagcatagctaaatgtgtgcatgcataagagaagctcttgaatccccaaaccacctcattctttcttcagcttttacagaagaagcaatggtatccaaaatctttcccctgttgtctgccttcccaagggcttttaccagcagcaagagtgcagaagtgtctgctagttttgagaaatgtgtctggttctccttttcctttccttataggcttccctccaccaatcctggagctaaaagaatcatacccattggcagggaccgacattaatgtgacctgctcagggcatgtattaacatcacccagccctactcttcggcttcagggagccc

SEQ ID NO: 85918 - DNA, 150 bp, Homo sapiens
gatcagtgtttgtctgggactgaagggatgactaacaaggagcagaggaaagcttttcgggatgatggcactcttctctgtctccattacggcattggatacaagtctctagaactcccagaactcgtcactgaaaagggtgaatagtac

SEQ ID NO: 85919 - DNA, 255 bp, Homo sapiens
atgtttgttattttgtgggtgtggggtcccacagtaagagtgactaggccttgtggtgaacttaacatagccccagtggtcagtgtaaggagccccagatgcaactgggaactcaggtagtattttcactctgctgtgatagtgtcaatataccagggtccagttatttctctacaactgagattcatcacttttcaagaacaactctctggctccaggttgagcctatgtcatgcacttggcctccagagccat

SEQ ID NO: 85920 - DNA, 4708 bp, Homo sapiens
ggagtggtccgaccgcgggcggccgccggtgaggtaggggcgggaggcggggggagacatggctcggcgcggctggcggcgggcacccctccgccgtggcgtcggcagcagtccccgagcccgcaggctcatgcggcccctttggttgctcctcgcagtgggcgtctttgactgggcaggggcttcggacggcggcggcggagaggctagagccatggacgaggagatcgtgtccgagaagcaagccgaggagagccaccggcaggacagcgccaacctgctcatcttcatcctgctgctcaccctcaccattctcacaatctggctcttcaagcaccgccgggcccgcttcctgcacgaaaccggcctggctatgatttatggtcttttggtgggccttgtgcttcggtatggcattcatgttccgagtgatgtaaataatgtgaccctgagctgtgaagtgcagtcaagtccaactaccttactggtaaatgttagtggaaaattttatgagtatatgctgaaaggagagattagttcacatgaactcaataatgttcaagataatgaaatgcttagaaaggttacttttgatccagaagtatttttcaacatattacttcctcctatcatattttatgcaggttatagcctgaaaaggagacatttttttcgaaatcttgggtctatcctagcatacgcttttcttggaacagcaatttcttgtttcgttattgggtcaataatgtatggctgtgtaacgctgatgaaggtaacgggacaacttgcaggagatttttactttacagattgcctactgtttggtgccattgtatcagcaactgatccagtgactgttcttgctatattccacgagcttcaagttgatgttgaactctatgcacttctttttggtgaaagtgtcctcaatgatgctgttgccatagtgctgtcctcctcaatagtggcataccagccagctggagacaacagtcacacctttgatgtcacagcgatgttcaagtctattgggatcttccttggaatcttcagtggatcttttgcaatgggtgctgctactggagtggtgacagctttagtgacaaagttcaccaaattacgggagttccagttgttggagacaggcctgttcttcttgatgtcctggagtaccttcctcttggctgaagcatggggcttcacaggtgtagttgcagtattgttttgtggcatcacacaagcacattatacgtataataatttgtccacggagtctcagcatagaactaaacagttgtttgagcttctcaatttcttggcagagaatttcatcttctcctacatggggctgacactgttcaccttccagaaccatgtctttaacccaacatttgtagtaggagcatttgttgctattttcttgggaagagctgccaatatttaccccttgtccctcttacttaatttgggtagaagaagtaagattggatcaaattttcaacacatgatgatgtttgctggccttcgtggtgcaatggcatttgccttggccattcgagatactgccacttatgcacggcaaatgatgttcagcaccacgcttctgattgtgttttttaccgtgtgggtatttggtggtggcaccactgcaatgctgtcatgcttgcatatcagggttggtgttgattcagaccaagaacacttgggtgttcctgaaaatgaaaggagaactaccaaagcagagagtgcttggcttttccggatgtggtacaactttgatcataactatctgaagcctctgctgacccacagcgggcctccgctgacaacaacactccctgcctgctgtggacccatcgccaggtgcctcaccagcccccaggcttacgaaaaccaggaacagttgaaagatgatgattctgatcttattctcaatgatggtgacatcagtttgacatatggagattctactgtgaacactgaaccggccacatccagcgccccaaggagatttatgggaaacagttctgaagatgccttggatcgggagcttgcatttggggaccatgaactggtcattcgaggaacacgcctggttcttccaatggatgattctgaacccccgctaaatttgttagataatacgagacatggtccagcctaagcttactaatactcacttagtgatttgtaaaatttgcacatgtgattgtgaagaaatttgtactacctaaaagtcccagtgcatgtctctgaatgtgtaagctatataaatgctatttatatggcatagaaagaatataaatatcctgtacacggcagattgtgaacaaactatattcctttaagttttcctggttgcactctgtagactggatctgttttaggaagttactttcacagtgatgttgtgtgttctgttagttttatgtctcagttaaagtgtaaaaagtgacggattttctctttcttaaacttacctgacacttaaccagagtaccagttctcgtgatgtgaattaatttttttgtgtgctaggggagggagagtgaggagggagtgttatttccttgggaacctagggaggagaggttcctttgttgggaaacttttgttgatagctgctgcctttgtcctgatcgttttctttcccttttctctggtggcctgttgtggtgcaacgagctgatggcatttgatcttgccccattcaggttggggagtgaagtgtgaggacccttttcccccgcttgctgtgaaagcacagattcattgactacagtacactgttgttcagaaaagaaggctgcaaatgacttctgagactttatgtcttttcttccagaccaagaccgtagaaggagtcacatctagccggcttagccaaagtacaggtgtatatagttcagggcacttgatttagatttggaggggctggggtgggcagagagcaagaggcgagtaaagagaatggtggtttcagagatctctcttcccaaatgtgtaaatattctataccagataagtttaaataagaaatttaattgctgcttaatttttgattatgtactttatctgtatagcaggctttgtcgtcagaagtttttatatcgatttaaattgctgctctttagcagccaaacaggagcaaaatgtaaaatttttgaacttactgtgtctaatcatcatttgttagtctgtagttaatgtcaacagttaatttatgaacccacgatcgttccacactgcaccaaagtcagtcataagagaaatcgaatattctggagcactgattgcagcagggtggctcctttgtgtgcagcaggtgtagtagtcttcattttcatggtacgttttaatattaattacctaagctgccatgcatttttttttttacagttctcaaggaagagcacagaacaatttctcatttcatatttggagtatgaaagtagattctattttgtaatgctgataatacctaaagatgcattgaatgcttggaagaatgctttttgatgttgattttgacctgttcatgattcagaagaaaaacaaacttttttggattttttttccctcaggtctgagtagcattgccttaaatcttatccagttagaacattgatttatttacatgatgttcagattttccagtgaaaaatacccttctgaacaaaacatgtacttactctccgaaaggcatctatctgtgctattgcaaacactccttgagattttaggggaattctaatgttgtaccctttcgtggcagctttgactgttggcatagccatttgttatgtagtggtagcgactttcctgctatgcaggaatccctcccatgacgtgtatgttttacatgatgtgtgcctcttcacgcagtaaatagtttcttgttaatgtatgtttgaggagtttgaacgtcagtgtcacttacccacaaagttattcaagttgtaaaaggttatacaataatttaacaactaccttttttattctgtcgggttactgacctcactttatgtaaatacttcgcatgacaaattcagtaactcgtctatttcagcatgcataagacttttcactagggaaactgataaagcttgagtcaactaaatctgccttcatactttatcaaggggaaccaagcctgctgtgcttacatcagcatctggaagactttcctctcctctaatctgtgtacacatctccaagcaaggaagaaaaaacaaactctgctcagacgcctatgaaacacctgaatgaactttgatgaagtacagtctgagttaccatcatgcacaagtagaactgctcttggacttgttttcctgttgtttgtggaacctacgcgtttgaatggcttgaacgttgcatcttttaaagttattttttaaggtttcttggcatttatcctagttgtccgtgtttggcaatgtgctgttaaagtaatagacttttaatctttatgtattttttgttttctctggagtacttggacagatgttatagtggtttcttttaggaaaatctgtcattaaaaaagttatagccttgcaaataaccactcacagtatttgagtcacagtttattttagtgagacgtaaagagtgctgacttcatttatttttctacctatatacctagtggaaaaggggaagactaatgttttcaaataaacaaacagaaacctaacagaactta

SEQ ID NO: 85921 - DNA, 4583 bp, Homo sapiens
ggagtggtccgaccgcgggcggccgccggtgagtgggcgtctttgactgggcaggggcttcggacggcggcggcggagaggctagagccatggacgaggagatcgtgtccgagaagcaagccgaggagagccaccggcaggacagcgccaacctgctcatcttcatcctgctgctcaccctcaccattctcacaatctggctcttcaagcaccgccgggcccgcttcctgcacgaaaccggcctggctatgatttatggtcttttggtgggccttgtgcttcggtatggcattcatgttccgagtgatgtaaataatgtgaccctgagctgtgaagtgcagtcaagtccaactaccttactggtaaatgttagtggaaaattttatgagtatatgctgaaaggagagattagttcacatgaactcaataatgttcaagataatgaaatgcttagaaaggttacttttgatccagaagtatttttcaacatattacttcctcctatcatattttatgcaggttatagcctgaaaaggagacatttttttcgaaatcttgggtctatcctagcatacgcttttcttggaacagcaatttcttgtttcgttattgggtcaataatgtatggctgtgtaacgctgatgaaggtaacgggacaacttgcaggagatttttactttacagattgcctactgtttggtgccattgtatcagcaactgatccagtgactgttcttgctatattccacgagcttcaagttgatgttgaactctatgcacttctttttggtgaaagtgtcctcaatgatgctgttgccatagtgctgtcctcctcaatagtggcataccagccagctggagacaacagtcacacctttgatgtcacagcgatgttcaagtctattgggatcttccttggaatcttcagtggatcttttgcaatgggtgctgctactggagtggtgacagctttagtgacaaagttcaccaaattacgggagttccagttgttggagacaggcctgttcttcttgatgtcctggagtaccttcctcttggctgaagcatggggcttcacaggtgtagttgcagtattgttttgtggcatcacacaagcacattatacgtataataatttgtccacggagtctcagcatagaactaaacagttgtttgagcttctcaatttcttggcagagaatttcatcttctcctacatggggctgacactgttcaccttccagaaccatgtctttaacccaacatttgtagtaggagcatttgttgctattttcttgggaagagctgccaatatttaccccttgtccctcttacttaatttgggtagaagaagtaagattggatcaaattttcaacacatgatgatgtttgctggccttcgtggtgcaatggcatttgccttggccattcgagatactgccacttatgcacggcaaatgatgttcagcaccacgcttctgattgtgttttttaccgtgtgggtatttggtggtggcaccactgcaatgctgtcatgcttgcatatcagggttggtgttgattcagaccaagaacacttgggtgttcctgaaaatgaaaggagaactaccaaagcagagagtgcttggcttttccggatgtggtacaactttgatcataactatctgaagcctctgctgacccacagcgggcctccgctgacaacaacactccctgcctgctgtggacccatcgccaggtgcctcaccagcccccaggcttacgaaaaccaggaacagttgaaagatgatgattctgatcttattctcaatgatggtgacatcagtttgacatatggagattctactgtgaacactgaaccggccacatccagcgccccaaggagatttatgggaaacagttctgaagatgccttggatcgggagcttgcatttggggaccatgaactggtcattcgaggaacacgcctggttcttccaatggatgattctgaacccccgctaaatttgttagataatacgagacatggtccagcctaagcttactaatactcacttagtgatttgtaaaatttgcacatgtgattgtgaagaaatttgtactacctaaaagtcccagtgcatgtctctgaatgtgtaagctatataaatgctatttatatggcatagaaagaatataaatatcctgtacacggcagattgtgaacaaactatattcctttaagttttcctggttgcactctgtagactggatctgttttaggaagttactttcacagtgatgttgtgtgttctgttagttttatgtctcagttaaagtgtaaaaagtgacggattttctctttcttaaacttacctgacacttaaccagagtaccagttctcgtgatgtgaattaatttttttgtgtgctaggggagggagagtgaggagggagtgttatttccttgggaacctagggaggagaggttcctttgttgggaaacttttgttgatagctgctgcctttgtcctgatcgttttctttcccttttctctggtggcctgttgtggtgcaacgagctgatggcatttgatcttgccccattcaggttggggagtgaagtgtgaggacccttttcccccgcttgctgtgaaagcacagattcattgactacagtacactgttgttcagaaaagaaggctgcaaatgacttctgagactttatgtcttttcttccagaccaagaccgtagaaggagtcacatctagccggcttagccaaagtacaggtgtatatagttcagggcacttgatttagatttggaggggctggggtgggcagagagcaagaggcgagtaaagagaatggtggtttcagagatctctcttcccaaatgtgtaaatattctataccagataagtttaaataagaaatttaattgctgcttaatttttgattatgtactttatctgtatagcaggctttgtcgtcagaagtttttatatcgatttaaattgctgctctttagcagccaaacaggagcaaaatgtaaaatttttgaacttactgtgtctaatcatcatttgttagtctgtagttaatgtcaacagttaatttatgaacccacgatcgttccacactgcaccaaagtcagtcataagagaaatcgaatattctggagcactgattgcagcagggtggctcctttgtgtgcagcaggtgtagtagtcttcattttcatggtacgttttaatattaattacctaagctgccatgcatttttttttttacagttctcaaggaagagcacagaacaatttctcatttcatatttggagtatgaaagtagattctattttgtaatgctgataatacctaaagatgcattgaatgcttggaagaatgctttttgatgttgattttgacctgttcatgattcagaagaaaaacaaacttttttggattttttttccctcaggtctgagtagcattgccttaaatcttatccagttagaacattgatttatttacatgatgttcagattttccagtgaaaaatacccttctgaacaaaacatgtacttactctccgaaaggcatctatctgtgctattgcaaacactccttgagattttaggggaattctaatgttgtaccctttcgtggcagctttgactgttggcatagccatttgttatgtagtggtagcgactttcctgctatgcaggaatccctcccatgacgtgtatgttttacatgatgtgtgcctcttcacgcagtaaatagtttcttgttaatgtatgtttgaggagtttgaacgtcagtgtcacttacccacaaagttattcaagttgtaaaaggttatacaataatttaacaactaccttttttattctgtcgggttactgacctcactttatgtaaatacttcgcatgacaaattcagtaactcgtctatttcagcatgcataagacttttcactagggaaactgataaagcttgagtcaactaaatctgccttcatactttatcaaggggaaccaagcctgctgtgcttacatcagcatctggaagactttcctctcctctaatctgtgtacacatctccaagcaaggaagaaaaaacaaactctgctcagacgcctatgaaacacctgaatgaactttgatgaagtacagtctgagttaccatcatgcacaagtagaactgctcttggacttgttttcctgttgtttgtggaacctacgcgtttgaatggcttgaacgttgcatcttttaaagttattttttaaggtttcttggcatttatcctagttgtccgtgtttggcaatgtgctgttaaagtaatagacttttaatctttatgtattttttgttttctctggagtacttggacagatgttatagtggtttcttttaggaaaatctgtcattaaaaaagttatagccttgcaaataaccactcacagtatttgagtcacagtttattttagtgagacgtaaagagtgctgacttcatttatttttctacctatatacctagtggaaaaggggaagactaatgttttcaaataaacaaacagaaacctaacagaactta

SEQ ID NO: 85922 - DNA, 3304 bp, Homo sapiens
ggagtggtccgaccgcgggcggccgccggtgaggtaggggcgggaggcggggggagacatggctcggcgcggctggcggcgggcacccctccgccgtggcgtcggcagcagtccccgagcccgcaggctcatgcggcccctttggttgctcctcgcagtgggcgtctttgactgggcaggggcttcggacggcggcggcggagaggctagagccatggacgaggagatcgtgtccgagaagcaagccgaggagagccaccggcaggacagcgccaacctgctcatcttcatcctgctgctcaccctcaccattctcacaatctggctcttcaagcaccgccgggcccgcttcctgcacgaaaccggcctggctatgatttatggtcttttggtgggccttgtgcttcggtatggcattcatgttccgagtgatgtaaataatgtgaccctgagctgtgaagtgcagtcaagtccaactaccttactggtaaatgttagtggaaaattttatgagtatatgctgaaaggagagattagttcacatgaactcaataatgttcaagataatgaaatgcttagaaaggttacttttgatccagaagtatttttcaacatattacttcctcctatcatattttatgcaggttatagcctgaaaaggagacatttttttcgaaatcttgggtctatcctagcatacgcttttcttggaacagcaatttcttgtttcgttattgggtcaataatgtatggctgtgtaacgctgatgaaggtaacgggacaacttgcaggagatttttactttacagattgcctactgtttggtgccattgtatcagcaactgatccagtgactgttcttgctatattccacgagcttcaagttgatgttgaactctatgcacttctttttggtgaaagtgtcctcaatgatgctgttgccatagtgctgtcctcctcaatagtggcataccagccagctggagacaacagtcacacctttgatgtcacagcgatgttcaagtctattgggatcttccttggaatcttcagtggatcttttgcaatgggtgctgctactggagtggtgacagctttagtgacaaagttcaccaaattacgggagttccagttgttggagacaggcctgttcttcttgatgtcctggagtaccttcctcttggctgaagcatggggcttcacaggtgtagttgcagtattgttttgtggcatcacacaagcacattatacgtataataatttgtccacggagtctcagcatagaactaaacagttgtttgagcttctcaatttcttggcagagaatttcatcttctcctacatggggctgacactgttcaccttccagaaccatgtctttaacccaacatttgtagtaggagcatttgttgctattttcttgggaagagctgccaatatttaccccttgtccctcttacttaatttgggtagaagaagtaagattggatcaaattttcaacacatgatgatgtttgctggccttcgtggtgcaatggcatttgccttggccattcgagatactgccacttatgcacggcaaatgatgttcagcaccacgcttctgattgtgttttttaccgtgtgggtatttggtggtggcaccactgcaatgctgtcatgcttgcatatcagggttggtgttgattcagaccaagaacacttgggtgttcctgaaaatgaaaggagaactaccaaagcagagagtgcttggcttttccggatgtggtacaactttgatcataactatctgaagcctctgctgacccacagcgggcctccgctgacaacaacactccctgcctgctgtggacccatcgccaggtgcctcaccagcccccaggcttacgaaaaccaggaacagttgaaagatgatgattctgatcttattctcaatgatggtgacatcagtttgacatatggagattctactgtgaacactgaaccggccacatccagcgccccaaggagatttatgggaaacagttctgaagatgccttggatcgggagcttgcatttggggaccatgaactggtcattcgaggaacacgcctggttcttccaatggatgattctgaacccccgctaaatttgttagataatacgagacatggtccagcctaagcttactaatactcacttagtgatttgtaaaatttgcacatgtgattgtgaagaaatttgtactacctaaaagtcccagtgcatgtctctgaatgtgtaagctatataaatgctatttatatggcatagaaagaatataaatatcctgtacacggcagattgtgaacaaactatattcctttaagttttcctggttgcactctgtagactggatctgttttaggaagttactttcacagtgatgttgtgtgttctgttagttttatgtctcagttaaagtgtaaaaagtgacggattttctctttcttaaacttacctgacacttaaccagagtaccagttctcgtgatgtgaattaatttttttgtgtgctaggggagggagagtgaggagggagtgttatttccttgggaacctagggaggagaggttcctttgttgggaaacttttgttgatagctgctgcctttgtcctgatcgttttctttcccttttctctggtggcctgttgtggtgcaacgagctgatggcatttgatcttgccccattcaggttggggagtgaagtgtgaggacccttttcccccgctgctgtgcttacatcagcatctggaagactttcctctcctctaatctgtgtacacatctccaagcaaggaagaaaaaacaaactctgctcagacgcctatgaaacacctgaatgaactttgatgaagtacagtctgagttaccatcatgcacaagtagaactgctcttggacttgttttcctgttgtttgtggaacctacgcgtttgaatggcttgaacgttgcatcttttaaagttattttttaaggtttcttggcatttatcctagttgtccgtgtttggcaatgtgctgttaaagtaatagacttttaatctttatgtattttttgttttctctggagtacttggacagatgttatagtggtttcttttaggaaaatctgtcattaaaaaagttatagccttgcaaataaccactcacagtatttgagtcacagtttattttagtgagacgtaaagagtgctgacttcatttatttttctacctatatacctagtggaaaaggggaagactaatgttttcaaataaacaaacagaaacctaacagaactta

SEQ ID NO: 85923 - DNA, 4612 bp, Homo sapiens
ggagtggtccgaccgcgggcggccgccggtgaggtaggggcgggaggcggggggagacatggctcggcgcggctggcggcgggcacccctccgccgtggcgtcggcagcagtccccgagcccgcaggctcatgcggcccctttggttgctcctcgcagtgggcgtctttgactgggcaggggcttcggacggcggcggcggagaggctagagccatggacgaggagatcgtgtccgagaagcaagccgaggagagccaccggcaggacagcgccaacctgctcatcttcatcctgctgctcaccctcaccattctcacaatctggctcttcaagcaccgccgggcccgcttcctgcacgaaaccggcctggctatgatttatggtcttttggtgggccttgtgcttcggtatggcattcatgttccgagtgatgtaaataatgtgaccctgagctgtgaagtgcagtcaagtccaactaccttactggttacttttgatccagaagtatttttcaacatattacttcctcctatcatattttatgcaggttatagcctgaaaaggagacatttttttcgaaatcttgggtctatcctagcatacgcttttcttggaacagcaatttcttgtttcgttattgggtcaataatgtatggctgtgtaacgctgatgaaggtaacgggacaacttgcaggagatttttactttacagattgcctactgtttggtgccattgtatcagcaactgatccagtgactgttcttgctatattccacgagcttcaagttgatgttgaactctatgcacttctttttggtgaaagtgtcctcaatgatgctgttgccatagtgctgtcctcctcaatagtggcataccagccagctggagacaacagtcacacctttgatgtcacagcgatgttcaagtctattgggatcttccttggaatcttcagtggatcttttgcaatgggtgctgctactggagtggtgacagctttagtgacaaagttcaccaaattacgggagttccagttgttggagacaggcctgttcttcttgatgtcctggagtaccttcctcttggctgaagcatggggcttcacaggtgtagttgcagtattgttttgtggcatcacacaagcacattatacgtataataatttgtccacggagtctcagcatagaactaaacagttgtttgagcttctcaatttcttggcagagaatttcatcttctcctacatggggctgacactgttcaccttccagaaccatgtctttaacccaacatttgtagtaggagcatttgttgctattttcttgggaagagctgccaatatttaccccttgtccctcttacttaatttgggtagaagaagtaagattggatcaaattttcaacacatgatgatgtttgctggccttcgtggtgcaatggcatttgccttggccattcgagatactgccacttatgcacggcaaatgatgttcagcaccacgcttctgattgtgttttttaccgtgtgggtatttggtggtggcaccactgcaatgctgtcatgcttgcatatcagggttggtgttgattcagaccaagaacacttgggtgttcctgaaaatgaaaggagaactaccaaagcagagagtgcttggcttttccggatgtggtacaactttgatcataactatctgaagcctctgctgacccacagcgggcctccgctgacaacaacactccctgcctgctgtggacccatcgccaggtgcctcaccagcccccaggcttacgaaaaccaggaacagttgaaagatgatgattctgatcttattctcaatgatggtgacatcagtttgacatatggagattctactgtgaacactgaaccggccacatccagcgccccaaggagatttatgggaaacagttctgaagatgccttggatcgggagcttgcatttggggaccatgaactggtcattcgaggaacacgcctggttcttccaatggatgattctgaacccccgctaaatttgttagataatacgagacatggtccagcctaagcttactaatactcacttagtgatttgtaaaatttgcacatgtgattgtgaagaaatttgtactacctaaaagtcccagtgcatgtctctgaatgtgtaagctatataaatgctatttatatggcatagaaagaatataaatatcctgtacacggcagattgtgaacaaactatattcctttaagttttcctggttgcactctgtagactggatctgttttaggaagttactttcacagtgatgttgtgtgttctgttagttttatgtctcagttaaagtgtaaaaagtgacggattttctctttcttaaacttacctgacacttaaccagagtaccagttctcgtgatgtgaattaatttttttgtgtgctaggggagggagagtgaggagggagtgttatttccttgggaacctagggaggagaggttcctttgttgggaaacttttgttgatagctgctgcctttgtcctgatcgttttctttcccttttctctggtggcctgttgtggtgcaacgagctgatggcatttgatcttgccccattcaggttggggagtgaagtgtgaggacccttttcccccgcttgctgtgaaagcacagattcattgactacagtacactgttgttcagaaaagaaggctgcaaatgacttctgagactttatgtcttttcttccagaccaagaccgtagaaggagtcacatctagccggcttagccaaagtacaggtgtatatagttcagggcacttgatttagatttggaggggctggggtgggcagagagcaagaggcgagtaaagagaatggtggtttcagagatctctcttcccaaatgtgtaaatattctataccagataagtttaaataagaaatttaattgctgcttaatttttgattatgtactttatctgtatagcaggctttgtcgtcagaagtttttatatcgatttaaattgctgctctttagcagccaaacaggagcaaaatgtaaaatttttgaacttactgtgtctaatcatcatttgttagtctgtagttaatgtcaacagttaatttatgaacccacgatcgttccacactgcaccaaagtcagtcataagagaaatcgaatattctggagcactgattgcagcagggtggctcctttgtgtgcagcaggtgtagtagtcttcattttcatggtacgttttaatattaattacctaagctgccatgcatttttttttttacagttctcaaggaagagcacagaacaatttctcatttcatatttggagtatgaaagtagattctattttgtaatgctgataatacctaaagatgcattgaatgcttggaagaatgctttttgatgttgattttgacctgttcatgattcagaagaaaaacaaacttttttggattttttttccctcaggtctgagtagcattgccttaaatcttatccagttagaacattgatttatttacatgatgttcagattttccagtgaaaaatacccttctgaacaaaacatgtacttactctccgaaaggcatctatctgtgctattgcaaacactccttgagattttaggggaattctaatgttgtaccctttcgtggcagctttgactgttggcatagccatttgttatgtagtggtagcgactttcctgctatgcaggaatccctcccatgacgtgtatgttttacatgatgtgtgcctcttcacgcagtaaatagtttcttgttaatgtatgtttgaggagtttgaacgtcagtgtcacttacccacaaagttattcaagttgtaaaaggttatacaataatttaacaactaccttttttattctgtcgggttactgacctcactttatgtaaatacttcgcatgacaaattcagtaactcgtctatttcagcatgcataagacttttcactagggaaactgataaagcttgagtcaactaaatctgccttcatactttatcaaggggaaccaagcctgctgtgcttacatcagcatctggaagactttcctctcctctaatctgtgtacacatctccaagcaaggaagaaaaaacaaactctgctcagacgcctatgaaacacctgaatgaactttgatgaagtacagtctgagttaccatcatgcacaagtagaactgctcttggacttgttttcctgttgtttgtggaacctacgcgtttgaatggcttgaacgttgcatcttttaaagttattttttaaggtttcttggcatttatcctagttgtccgtgtttggcaatgtgctgttaaagtaatagacttttaatctttatgtattttttgttttctctggagtacttggacagatgttatagtggtttcttttaggaaaatctgtcattaaaaaagttatagccttgcaaataaccactcacagtatttgagtcacagtttattttagtgagacgtaaagagtgctgacttcatttatttttctacctatatacctagtggaaaaggggaagactaatgttttcaaataaacaaacagaaacctaacagaactta

SEQ ID NO: 85924 - DNA, 4566 bp, Homo sapiens
ggagtggtccgaccgcgggcggccgccggtgaggtaggggcgggaggcggggggagacatggctcggcgcggctggcggcgggcacccctccgccgtggcgtcggcagcagtccccgagcccgcaggctcatgcggcccctttggttgctcctcgcagtgggcgtctttgactgggcaggggcttcggacggcggcggcggagaggctagagccatggacgaggagatcgtgtccgagaagcaagccgaggagagccaccggcaggacagcgccaacctgctcatcttcatcctgctgctcaccctcaccattctcacaatctggctcttcaagcaccgccgggcccgcttcctgcacgaaaccggcctggctatgatttatggtcttttggtgggccttgtgcttcggtatggcattcatgttccgagtgatgtaaataatgtgaccctgagctgtgaagtgcagtcaagtccaactaccttactggtaaatgttagtggaaaattttatgagtatatgctgaaaggagagattagttcacatgaactcaataatgttcaagataatgaaatgcttagaaaggttacttttgatccagaagtatttttcaacatattacttcctcctatcatattttatgcaggttatagcctgaaaaggagacatttttttcgaaatcttgggtctatcctagcatacgcttttcttggaacagcaatttcttgtttcgttattgggtcaataatgtatggctgtgtaacgctgatgaaggtaacgggacaacttgcaggagatttttactttacagattgcctactgtttggtgccattgtatcagcaactgatccagtgactgttcttgctatattccacgagcttcaagttgatgttgaactctatgcacttctttttggtgaaagtgtcctcaatgatgctgttgccatagtgctgtcctcctcaatagtggcataccagccagctggagacaacagtcacacctttgatgtcacagcgatgttcaagtctattgggatcttccttggaatcttcagtggatcttttgcaatgggtgctgctactggagtggtgacagctttagtgacaaagttcaccaaattacgggagttccagttgttggagacaggcctgttcttcttgatgtcctggagtaccttcctcttggctgaagcatggggcttcacaggtgtagttgcagtattgttttgtggcatcacacaagcacattatacgtataataatttgtccacggagtctcagcatagaactaaacagttgtttgagcttctcaatttcttggcagagaatttcatcttctcctacatggggctgacactgttcaccttccagaaccatgtctttaacccaacatttgtagtaggagcatttgttgctattttcttgggaagagctgccaatatttaccccttgtccctcttacttaatttgggtagaagaagtaagattggatcaaattttcaacacatgatgatgtttgctggccttcgtggtgcaatggcatttgccttggccattcgagatactgccacttatgcacggcaaatgatgttcagcaccacgcttctgattgtgttttttaccgtgtgggtatttggtggtggcaccactgcaatgctgtcatgcttgcatatcagggttggtgttgattcagaccaagaacacttgggtgttcctgaaaatgaaaggagaactaccaaagcagagagtgcttggcttttccggatgtggtacaactttgatcataactatctgaagcctctgctgacccacagcgggcctccgctgacaacaacactccctgcctgctgtggacccatcgccaggtgcctcaccagcccccaggcttacgaaaaccaggaacagttgaaagatgatgattctgatcttattctcaatgatggtgacatcagtttgacatatggagattctactgtgaacactgaaccggccacatccagcgccccaaggagatttatgggaaacagttctgaagatgccttggatcgggagcttgcatttggggaccatgaactggtcattcgaggaacacgcctggttcttccaatggatgattctgaacccccgctaaatttgttagataatacgagacatggtccagcctaagcttactaatactcacttagtgatttgtaaaatttgcacatgtgattgtgaagaaatttgtactacctaaaagtcccagtgcatgtctctgaatgtgtaagctatataaatgctatttatatggcatagaaagaatataaatatcctgtacacggcagattgtgaacaaactatattcctttaagttttcctggttgcactctgtagactggatctgttttaggaagttactttcacagtgatgttgtgtgttctgttagttttatgtctcagttaaagtgtaaaaagtgacggattttctctttcttaaacttacctgacacttaaccagagtaccagttctcgtgatgtgaattaatttttttgtgtgctaggggagggagagtgaggagggagtgttatttccttgggaacctagggaggagaggttcctttgttgggaaacttttgttgatagctgctgcctttgtcctgatcgttttctttcccttttctctggtggcctgttgtggtgcaacgagctgatggcatttgatcttgccccattcaggttggggagtgaagtgtgaggacccttttcccccgcttgctgtgaaagcacagattcattgactacagtacactgttgttcagaaaagaaggctgcaaatgacttctgagactttatgtcttttcttccagaccaagaccgtagaaggagtcacatctagccggcttagccaaagtacaggtgtatatagttcagggcacttgatttagatttggaggggctggggtgggcagagagcaagaggcgagtaaagagaatggtggtttcagagatctctcttcccaaatgtgtaaatattctataccagataagtttaaataagaaatttaattgctgcttaatttttgattatgtactttatctgtatagcaggctttgtcgtcagaagtttttatatcgatttaaattgctgctctttagcagccaaacaggagcaaaatgtaaaatttttgaacttactgtgtctaatcatcatttgttagtctgtagttaatgtcaacagttaatttatgaacccacgatcgttccacactgcaccaaagtcagtcataagagaaatcgaatattctggagcactgattgcagcagggtggctcctttgtgtgcagcaggtgtagtagtcttcattttcatggtacgttttaatattaattacctaagctgccatgcatttttttttttacagttctcaaggaagagcacagaacaatttctcatttcatatttggagtatgaaagtagattctattttgtaatgctgataatacctaaagatgcattgaatgcttggaagaatgctttttgatgttgattttgacctgttcatgattcagaagaaaaacaaacttttttggattttttttccctcaggtctgagtagcattgccttaaatcttatccagttagaacattgatttatttacatgatgttcagattttccagtgaaaaatacccttctgaacaaaacatgtacttactctccgaaaggcatctatctgtgctattgcaaacactccttgagattttaggggaattctaatgttgtaccctttcgtggcagctttgactgttggcatagccatttgttatgtagtggtagcgactttcctgctatgcaggaatccctcccatgacgtgtatgttttacatgatgtgtgcctcttcacgcagtaaatagtttcttgttaatgtatgtttgaggagtttgaacgtcagtgtcacttacccacaaagttattcaagttgtaaaaggttatacaataatttaacaactaccttttttattctgtcgggttactgacctcactttatgtaaatacttcgcatgacaaattcagtaactcgtctatttcagcatgcataagacttttcactagggaaactgataaagcttgagtcaactaaatctgccttcatactttatcaaggggaaccaagcctgctgtgcttacatcagcatctggaagactttcctctcctctaatctgtgtacacatctccaagcaaggaagaaaaaacaaactctgctcagacgcctatgaaacacctgaatgaactttgatgaagtacagtctgagttaccatcatgcacaagtagaactgctcttggacttgttttcctgttgtttgtggaacctacgcgtttgaatggcttgaacgttgcatcttttaaagttattttttaaggtttcttggcatttatcctagttgtccgtgtttggcaatgtgctgttaaagtaatagacttttaatctttatgtattttttgttttctctggagtacttggacagatgttatagtggtttcttttaggaaaatctgtcattaaaaaagttatagccttgcaaata

SEQ ID NO: 85925 - DNA, 867 bp, Homo sapiens
ggagtggtccgaccgcgggcggccgccggtgaggtaggggcgggaggcggggggagacatggctcggcgcggctggcggcgggcacccctccgccgtggcgtcggcagcagtccccgagcccgcaggctcatgcggcccctttggttgctcctcgcagtgggcgtctttgactgggcaggggcttcggacggcggcggcggagaggctagagccatggacgaggagatcgtgtccgagaagcaagccgaggagagccaccggcaggacagcgccaacctgctcatcttcatcctgctgctcaccctcaccattctcacaatctggctcttcaagcaccgccgggcccgcttcctgcacgaaaccggcctggctatgatttatggtcttttggtgggccttgtgcttcggtatggcattcatgttccgagtgatgtaaataatgtgaccctgagctgtgaagtgcagtcaagtccaactaccttactggtaaatgttagtggaaaattttatgagtatatgctgaaaggagagattagttcacatgaactcaataatgttcaagataatgaaatgcttagaaaggttacttttgatccagaagtatttttcaacatattacttcctcctatcatattttatgcaggttatagcctgaaaaggagacatttttttcgaaatcttgggtctatcctagcatacgcttttcttggaacagcaatttcttgtttcgttattgggtcaataatgtatggctgtgtaacgctgatgaaggtaacgggacaacttgcaggagatttttactttacagattgcctactgtttggtgccattgtatcagcaactgatccaggtatgttttatatgag

SEQ ID NO: 85926 - DNA, 318 bp, Homo sapiens
tgggctagacaagagtttcccaaccacagcactatggaaatttggggctggatcattcttgttgtggggcctgtgccttggtggatgtttagccgtgtccaaagtctctacctaccagatgccggtggttcccctgttgccagatgtagcaaccaaaaatgcctccagatgtcccccaaagtcaaatgtcccctgtgggggaggaattgcccctggtttaggaaccctgagctatactctgttctgggacttgacatgtattatctggctcagttctcactgcaggcacagttttcccttccatttgacagagaagaa

SEQ ID NO: 85927 - DNA, 461 bp, Homo sapiens
acaaataccctttaatttattccagataaacaaatgatttatatctgctgtttggattacttcttcttcccttaactaatataaataatcacgggagagtataatggaaaaatggtttgccccttatgatgtttagccctgtaatttaaaggtgatagaggcagtatcatttttatggatgttatgccttctattcaaatattcatttgaaaaacagttatgtagccatttttataagtcaagaaagtatctgggagagggagctttcagatgaaagtagtagtgcggaggagtgaaactcatttctgactttctaagcaattagatataggaggttctggaacagaataggaacatactccctccctttgttcttagtttcgtactcttgctatgtggccattgaccaagtagtcagtaaagccagaatagaagattgctgaaacccggctgattgagtc

SEQ ID NO: 85928 - DNA, 807 bp, Homo sapiens
taattcaggcactgtttaggggctggggttatgacagtgaagaaaacagacaaaatccctgcccttatggtgtttgtattctaggggttaacagtgagtcagttactaaaaagtggtatatggtttgtatacatgtatatgtttatgtgtatatgtacgtgggtttggttttgtttaaaggtggcaaaatcattctgtgcagaattggtttttttttcaatcagtaaatcagggacatcctcccatgtcagaatatatattaataaatctatgtcatttgtagaatggactaaggttttgtctggaggtagatgcgttaccttacataacttccttttctgtttccccaaagaaaagattaaaaattaggttttgtgagctaacgcagataaacttttgaggatttagggaaaattggcatgtatctattaataattattttatgctttcacaaacctgtttaaaatcacacatataaataggttaagaagtaatgcctttcttccactcccatagtttgtgaaacaagtttattcaggctttgcacgtcttcagtgccagtatctttcacatcactcatgaagattccatcatcttagtgaagttttcagcacatttttacttcagggttatttaagataaagtactttttgaaacttttcttttttaattatactttaagttctagggtacatgttcacaacatgcaggtttgttacatatgtatacatgtgccatgttggtgtgctgcacccattaactcgtcatttacattaggtgtatctcctaatgctatccctccccctc

SEQ ID NO: 85929 - DNA, 336 bp, Homo sapiens
tttttaatatttagaacttttcctaaatcctgaattaactaagaaatgaccattaaattaatcacttttttaactttaaaaggtgaaaacctgttactttttaggtgcctggaattctgttggattgctaaagcatatgttaagtcaaaaatcatagcagaggcctttttttttttttttaactttgtacatttcatagaaagctcatacatttcttccattctttctcagaaaaaaatggcatttaacaaatgttcggtgtataaagctgtcagtttgctagtagttataatttgttgtgttcttgaataaaaatatattgggtacataaaaaag

SEQ ID NO: 85930 - DNA, 289 bp, Homo sapiens
agggcattcgtggcgataagggagagcccctctccttcgtctgggaaggcaccagcatgagtcccacacacccagccttctcatttctagaggcttccacctttttatacactcagccttccctctcccaggcaggaggacccccagaccctgttcccctgcagacctcacttctgggagacagagctacagctgggacagctccaagctaccctaacccctcctttcccaggtttctagaatagtgtctggcatgtagtagatgctcaataaacacttgttgaatgaa

SEQ ID NO: 85931 - DNA, 2264 bp, Homo sapiens
gggcggcgccctgggcggccgcggagtcatggacggcagtggacccttcagctgccccatctgcctagagccactccgggagccggtgacgctgccctgcggccacaacttctgtctcgcctgcctgggcgcgctctggccgcatcgtggcgcgagtggagccggcggacccggaggcgcggcccgctgcccgctgtgccaggagcccttccccgacggccttcagctccgcaagaaccacacgctgtccgagctgctgcagctccgccagggctcgggccccgggtccggccccggcccggcccctgccctggccccggagccctcggcacccagcgcgctgcccagtgtcccggagccgtcggccccctgcgctcccgagccgtggcccgcgggcgaagagccagtgcgctgcgacgcgtgccccgagggcgcggccctgcccgccgcgctgtcctgcctctcctgcctcgcctccttttgccccgcgcacctgggcccgcacgagcgcagccccgccctccgcggacaccgcctggtgccgccgctgcgccggctagaggagagcctgtgcccgcgccacctacggccgctcgagcgctactgccgcgcggagcgcgtgtgtctgtgcgaggcctgcgccgcacaggagcaccgcggccacgagctggtgccgctggagcaggagcgcgcgcttcaggaggctgagcagtccaaagtcctgagcgccgtggaggaccgcatggacgagctgggtgctggcattgcacagtccaggcgcacagtggccctcatcaagagtgcagccgtagcagagcgggagagggtgagccggctgtttgcagatgctgcggccgccctgcagggcttccagacccaggtgctgggcttcatcgaggagggggaagctgccatgctaggccgctcccagggtgacctgcggcgacaggaggaacagcgcagccgcctgagccgagcccgccagaatctcagccaggtccctgaagctgactcagtcagcttcctgcaggagctgctggcactaaggctggccctggaggatgggtgtggccctgggcctggacccccgagggagctcagcttcaccaaatcatcccaagctgtccgtgcagtgagagacatgctggccgtggcctgcgtcaaccagtgggagcagctgagggggccgggtggcaacgaggatgggccacagaagctggactcggaagctgatgctgagccccaagacctcgagagtacgaacctcttggagagtgaagctcccagggactatttcctcaagtttgcctatattgtggatttggacagcgacacagcagacaagttcctgcagctgtttggaaccaaaggtgtcaagagggtgctgtgtcctatcaactaccccttgtcgcccacccgcttcacccattgtgagcaggtgctgggcgagggtgccctggaccgaggcacctactactgggaggtggagattatcgagggctgggtcagcatgggggtcatggccgaagacttctccccacaagagccctacgaccgcggccggctgggccgcaacgcccactcctgctgcctgcagtggaatggacgcagcttctccgtctggtttcatgggctggaggctcccctgccccaccccttctcgcccacggttggggtctgcctggaatacgctgaccgtgccttggccttctatgctgtacgggacggcaagatgagcctcctgcggaggctgaaggcctcccggccccgccggggtggcatcccggcctcccccattgaccccttccagagccgcctggacagtcactttgcggggctcttcacccacagactcaagcctgccttcttcctggagagtgtggacgcccacttgcagatcgggcccctcaagaagtcctgcatatccgtgctgaagaggaggtgatgccgggcacgggcgctcctgctgccgtctctgctccaggaagctgcctcctctgggccctctccttcgtctgggaaggcaccagcatgagtcccacacacccagccttctcatttctagaggcttccacctttttatacactcagccttccctctcccaggcaggaggacccccagaccctgttcccctgcagacctcacttctgggagacagagctacagctgggacagctccaagctaccctaacccctcctttcccaggtttctagaatagtgtctggcatgtagtagatgctcaataaacacttgttgaatgaa

SEQ ID NO: 85932 - DNA, 2366 bp, Homo sapiens
ctatgggggtgtaggcgggagggagccgggttaggcccgcggggttccggtagcgtggctgctgctcccgcccggagggtcacgccggtctcagctcagatttgccctgggctgaggcagcagctttcgatgggtgtggcaggcggcaggagggcggcagagggcgaccgggcacacagattctctgtccagctgttccgggggccagtggtgggagcatgtgagccgcggcctctacctcccgcccccagtttcctttggcctccagcccggtcttggcgcctctggccaagggattttccgtttctcctgcctggagcagtgactcataagacctaggggatttgcccggaatcccctttttttccaggcctggactgtggatgcaggctctttgggaacagtgatcctcaggacagcttaatgcctccttgtgcagtcacccctccgccgcccacctcccaacctaactggcttactctctgcctcttccccgccggaggaagttctcaaattcatctgagcaacactgagaccagcggacggccctgtactaggcctcctgtcagagacccgaggcagacacccagtcagcctgcacgccccccaggcgttcaggaaaggcaccagcctgggctgcaggcacctctggcatattatgggacatcgtggccactccagtcccacctgatgcacagataccactccccagtcacccccttctctcccctggcaaggcctgggacccgagtgtagggctgtggcctctgccagacctcacactcatggagggtgttgtccacaggctgagcagtccaaagtcctgagcgccgtggaggaccgcatggacgagctgggtgctggcattgcacagtccaggcgcacagtggccctcatcaagagtgcagccgtagcagagcgggagagggtgagccggctgtttgcagatgctgcggccgccctgcagggcttccagacccaggtgctgggcttcatcgaggagggggaagctgccatgctaggccgctcccagggtgacctgcggcgacaggaggaacagcgcagccgcctgagccgagcccgccagaatctcagccaggtccctgaagctgactcagtcagcttcctgcaggagctgctggcactaaggctggccctggaggatgggtgtggccctgggcctggacccccgagggagctcagcttcaccaaatcatcccaagctgtccgtgcagtgagagacatgctggccgtggcctgcgtcaaccagtgggagcagctgagggggccgggtggcaacgaggatgggccacagaagctggactcggaagctgatgctgagccccaagacctcgagagtacgaacctcttggagagtgaagctcccagggactatttcctcaagtttgcctatattgtggatttggacagcgacacagcagacaagttcctgcagctgtttggaaccaaaggtgtcaagagggtgctgtgtcctatcaactaccccttgtcgcccacccgcttcacccattgtgagcaggtgctgggcgagggtgccctggaccgaggcacctactactgggaggtggagattatcgagggctgggtcagcatgggggtcatggccgaagacttctccccacaagagccctacgaccgcggccggctgggccgcaacgcccactcctgctgcctgcagtggaatggacgcagcttctccgtctggtttcatgggctggaggctcccctgccccaccccttctcgcccacggttggggtctgcctggaatacgctgaccgtgccttggccttctatgctgtacgggacggcaagatgagcctcctgcggaggctgaaggcctcccggccccgccggggtggcatcccggcctcccccattgaccccttccagagccgcctggacagtcactttgcggggctcttcacccacagactcaagcctgccttcttcctggagagtgtggacgcccacttgcagatcgggcccctcaagaagtcctgcatatccgtgctgaagaggaggtgatgccgggcacgggcgctcctgctgccgtctctgctccaggaagctgcctcctctgggccctctccttcgtctgggaaggcaccagcatgagtcccacacacccagccttctcatttctagaggcttccacctttttatacactcagccttccctctcccaggcaggaggacccccagaccctgttcccctgcagacctcacttctgggagacagagctacagctgggacagctccaagctaccctaacccctcctttcccaggtttctagaatagtgtctggcatgtagtagatgctcaataaacacttgttgaatgaa

SEQ ID NO: 85933 - DNA, 2417 bp, Homo sapiens
gggcggcgccctgggcggccgcggagtcatggacggcagtggacccttcagctgccccatctgcctagagccactccgggagccggtgacgctgccctgcggccacaacttctgtctcgcctgcctgggcgcgctctggccgcatcgtggcgcgagtggagccggcggacccggaggcgcggcccgctgcccgctgtgccaggagcccttccccgacggccttcagctccgcaagaaccacacgctgtccgagctgctgcagctccgccagggctcgggccccgggtccggccccggcccggcccctgccctggccccggagccctcggcacccagcgcgctgcccagtgtcccggagccgtcggccccctgcgctcccgagccgtggcccgcgggcgaagagccagtgcgctgcgacgcgtgccccgagggcgcggccctgcccgccgcgctgtcctgcctctcctgcctcgcctccttttgccccgcgcacctgggcccgcacgagcgcagccccgccctccgcggacaccgcctggtgccgccgctgcgccggctagaggagagcctgtgcccgcgccacctacggccgctcgagcgctactgccgcgcggagcgcgtgtgtctgtgcgaggcctgcgccgcacaggagcaccgcggccacgagctggtgccgctggagcaggagcgcgcgcttcaggaggtgggctccgggggcacactcgggtgagccggggctggtgaccgaccgcgcgcgagcgggccgaggaccttggaccccccagtcttcccgggttgggtcttaatctcctcctctaacctgaggatctttgcggtcccttccagccttgacaaggctgagcagtccaaagtcctgagcgccgtggaggaccgcatggacgagctgggtgctggcattgcacagtccaggcgcacagtggccctcatcaagagtgcagccgtagcagagcgggagagggtgagccggctgtttgcagatgctgcggccgccctgcagggcttccagacccaggtgctgggcttcatcgaggagggggaagctgccatgctaggccgctcccagggtgacctgcggcgacaggaggaacagcgcagccgcctgagccgagcccgccagaatctcagccaggtccctgaagctgactcagtcagcttcctgcaggagctgctggcactaaggctggccctggaggatgggtgtggccctgggcctggacccccgagggagctcagcttcaccaaatcatcccaagctgtccgtgcagtgagagacatgctggccgtggcctgcgtcaaccagtgggagcagctgagggggccgggtggcaacgaggatgggccacagaagctggactcggaagctgatgctgagccccaagacctcgagagtacgaacctcttggagagtgaagctcccagggactatttcctcaagtttgcctatattgtggatttggacagcgacacagcagacaagttcctgcagctgtttggaaccaaaggtgtcaagagggtgctgtgtcctatcaactaccccttgtcgcccacccgcttcacccattgtgagcaggtgctgggcgagggtgccctggaccgaggcacctactactgggaggtggagattatcgagggctgggtcagcatgggggtcatggccgaagacttctccccacaagagccctacgaccgcggccggctgggccgcaacgcccactcctgctgcctgcagtggaatggacgcagcttctccgtctggtttcatgggctggaggctcccctgccccaccccttctcgcccacggttggggtctgcctggaatacgctgaccgtgccttggccttctatgctgtacgggacggcaagatgagcctcctgcggaggctgaaggcctcccggccccgccggggtggcatcccggcctcccccattgaccccttccagagccgcctggacagtcactttgcggggctcttcacccacagactcaagcctgccttcttcctggagagtgtggacgcccacttgcagatcgggcccctcaagaagtcctgcatatccgtgctgaagaggaggtgatgccgggcacgggcgctcctgctgccgtctctgctccaggaagctgcctcctctgggccctctccttcgtctgggaaggcaccagcatgagtcccacacacccagccttctcatttctagaggcttccacctttttatacactcagccttccctctcccaggcaggaggacccccagaccctgttcccctgcagacctcacttctgggagacagagctacagctgggacagctccaagctaccctaacccctcctttcccaggtttctagaatagtgtctggcatgtagtagatgctcaataaacacttgttgaatgaa

SEQ ID NO: 85934 - DNA, 2489 bp, Homo sapiens
gggcggcgccctgggcggccgcggagtcatggacggcagtggacccttcagctgccccatctgcctagagccactccgggagccggtgacgctgccctgcggccacaacttctgtctcgcctgcctgggcgcgctctggccgcatcgtggcgcgagtggagccggcggacccggaggcgcggcccgctgcccgctgtgccaggagcccttccccgacggccttcagctccgcaagaaccacacgctgtccgagctgctgcagctccgccagggctcgggccccgggtccggccccggcccggcccctgccctggccccggagccctcggcacccagcgcgctgcccagtgtcccggagccgtcggccccctgcgctcccgagccgtggcccgcgggcgaagagccagtgcgctgcgacgcgtgccccgagggcgcggccctgcccgccgcgctgtcctgcctctcctgcctcgcctccttttgccccgcgcacctgggcccgcacgagcgcagccccgccctccgcggacaccgcctggtgccgccgctgcgccggctagaggagagcctgtgcccgcgccacctacggccgctcgagcgctactgccgcgcggagcgcgtgtgtctgtgcgaggcctgcgccgcacaggagcaccgcggccacgagctggtgccgctggagcaggagcgcgcgcttcaggaggctgagcagtccaaagtcctgagcgccgtggaggaccgcatggacgagctgggtgctggcattgcacagtccaggcgcacagtggccctcatcaaggtcaaacacccctccctcagcatggaacaatccactccaaacaaaccatgcccatacctactgagcacaagtgtcccctgacctggcccagatccaggacaggctcagtctggcccctctgtcccctcaagagggccggtgggaagccggggtcagggaaggaggggggtacagtccgggacggttctttgccctcattgccccctctactgtcgtcctgtgcagagtgcagccgtagcagagcgggagagggtgagccggctgtttgcagatgctgcggccgccctgcagggcttccagacccaggtgctgggcttcatcgaggagggggaagctgccatgctaggccgctcccagggtgacctgcggcgacaggaggaacagcgcagccgcctgagccgagcccgccagaatctcagccaggtccctgaagctgactcagtcagcttcctgcaggagctgctggcactaaggctggccctggaggatgggtgtggccctgggcctggacccccgagggagctcagcttcaccaaatcatcccaagctgtccgtgcagtgagagacatgctggccgtggcctgcgtcaaccagtgggagcagctgagggggccgggtggcaacgaggatgggccacagaagctggactcggaagctgatgctgagccccaagacctcgagagtacgaacctcttggagagtgaagctcccagggactatttcctcaagtttgcctatattgtggatttggacagcgacacagcagacaagttcctgcagctgtttggaaccaaaggtgtcaagagggtgctgtgtcctatcaactaccccttgtcgcccacccgcttcacccattgtgagcaggtgctgggcgagggtgccctggaccgaggcacctactactgggaggtggagattatcgagggctgggtcagcatgggggtcatggccgaagacttctccccacaagagccctacgaccgcggccggctgggccgcaacgcccactcctgctgcctgcagtggaatggacgcagcttctccgtctggtttcatgggctggaggctcccctgccccaccccttctcgcccacggttggggtctgcctggaatacgctgaccgtgccttggccttctatgctgtacgggacggcaagatgagcctcctgcggaggctgaaggcctcccggccccgccggggtggcatcccggcctcccccattgaccccttccagagccgcctggacagtcactttgcggggctcttcacccacagactcaagcctgccttcttcctggagagtgtggacgcccacttgcagatcgggcccctcaagaagtcctgcatatccgtgctgaagaggaggtgatgccgggcacgggcgctcctgctgccgtctctgctccaggaagctgcctcctctgggccctctccttcgtctgggaaggcaccagcatgagtcccacacacccagccttctcatttctagaggcttccacctttttatacactcagccttccctctcccaggcaggaggacccccagaccctgttcccctgcagacctcacttctgggagacagagctacagctgggacagctccaagctaccctaacccctcctttcccaggtttctagaatagtgtctggcatgtagtagatgctcaataaacacttgttgaatgaa

SEQ ID NO: 85935 - DNA, 2327 bp, Homo sapiens
gggcggcgccctgggcggccgcggagtcatggacggcagtggacccttcagctgccccatctgcctagagccactccgggagccggtgacgctgccctgcggccacaacttctgtctcgcctgcctgggcgcgctctggccgcatcgtggcgcgagtggagccggcggacccggaggcgcggcccgctgcccgctgtgccaggagcccttccccgacggccttcagctccgcaagaaccacacgctgtccgagctgctgcagctccgccagggctcgggccccgggtccggccccggcccggcccctgccctggccccggagccctcggcacccagcgcgctgcccagtgtcccggagccgtcggccccctgcgctcccgagccgtggcccgcgggcgaagagccagtgcgctgcgacgcgtgccccgagggcgcggccctgcccgccgcgctgtcctgcctctcctgcctcgcctccttttgccccgcgcacctgggcccgcacgagcgcagccccgccctccgcggacaccgcctggtgccgccgctgcgccggctagaggagagcctgtgcccgcgccacctacggccgctcgagcgctactgccgcgcggagcgcgtgtgtctgtgcgaggcctgcgccgcacaggagcaccgcggccacgagctggtgccgctggagcaggagcgcgcgcttcaggaggctgagcagtccaaagtcctgagcgccgtggaggaccgcatggacgagctgggtgctggcattgcacagtccaggcgcacagtggccctcatcaagagtgcagccgtagcagagcgggagagggtgagccggctgtttgcagatgctgcggccgccctgcagggcttccagacccaggtgctgggcttcatcgaggagggggaagctgccatgctaggccgctcccagggtgacctgcggcgacaggaggaacagcgcagccgcctgagccgagcccgccagaatctcagccaggtccctgaagctgactcagtcagcttcctgcaggagctgctggcactaaggctggccctggaggatgggtgtggccctgggcctggacccccgagggagctcagcttcaccaaatcatcccaagctgtccgtgcagtgagagacatgctggccgtggcctgcgtcaaccagtgggagcagctgagggggccgggtggcaacgaggatgggccacagaagctggactcggaagctgatgctgagccccaagacctcgagagtacgaacctcttggagagtgaagctcccagggactatttcctcaagtttgcctatattgtggatttggacagcgacacagcagacaagttcctgcagctgtttggaaccaaaggtgtcaagagggtgctgtgtcctatcaactaccccttgtcgcccacccgcttcacccattgtgagcaggtgctgggcgagggtgccctggaccgaggcacctactactgggaggtggagattatcgagggctgggtcagcatgggggtcatggccgaagacttctccccacaagagccctacgaccgcggccggctgggccgcaacgcccactcctgctgcctgcagtggaatggacgcagcttctccgtctggtttcatgggctggaggctcccctgccccaccccttctcgcccacggttggggtctgcctggaatacgctgaccgtgccttggccttctatgctgtacgggacggcaagatgagcctcctgcggaggctgaaggcctcccggccccgccggggtggcatcccggcctcccccattgaccccttccagagccgcctggacagtcactttgcggggctcttcacccacagactcaagcctgccttcttcctggagagtgtggacgcccacttgcagatcgggcccctcaagaagtcctgcatatccgtgctgaagaggaggtgatgccgggcacgggcgctcctgctgccgtctctgctccaggaagctgcctcctctgggccctctccttcgtctgggaaggcaccagcatgagtcccacacacccagccttctcatttctagaggcttccacctttttatacactcagccttccctctcccaggcaggaggacccccagaccctgttcccctgcagacctcacttctgggagacagagctacagctgggacagctccaagctaccctaacccctcctttcccaggtttctagaatagtgtctggcatgtagtagatgctcaataaacacttgttgaatgaacgaggggcccgatctgcaagtggggtccgtcgaccggccgctaatttagtagtagtagtaggc

SEQ ID NO: 85936 - DNA, 1858 bp, Homo sapiens
gggcggcgccctgggcggccgcggagtcatggacggcagtggacccttcagctgccccatctgcctagagccactccgggagccggtgacgctgccctgcggccacaacttctgtctcgcctgcctgggcgcgctctggccgcatcgtggcgcgagtggagccggcggacccggaggcgcggcccgctgcccgctgtgccaggagcccttccccgacggccttcagctccgcaagaaccacacgctgtccgagctgctgcagctccgccagggctcgggccccgggtccggccccggcccggcccctgccctggccccggagccctcggcacccagcgcgctgcccagtgtcccggagccgtcggccccctgcgctcccgagccgtggcccgcgggcgaagagccagtgcgctgcgacgcgtgccccgagggcgcggccctgcccgccgcgctgtcctgcctctcctgcctcgcctccttttgccccgcgcacctgggcccgcacgagcgcagccccgccctccgcggacaccgcctggtgccgccgctgcgccggctagaggagagcctgtgcccgcgccacctacggccgctcgagcgctactgccgcgcggagcgcgtgtgtctgtgcgaggcctgcgccgcacaggagcaccgcggccacgagctggtgccgctggagcaggagcgcgcgcttcaggaggctgagcagtccaaagtcctgagcgccgtggaggaccgcatggacgagctgggtgctggcattgcacagtccaggcgcacagtggccctcatcaagagtgcagccgtagcagagcgggagagggtgagccggctgtttgcagatgctgcggccgccctgcagggcttccagacccaggtgctgggcttcatcgaggagggggaagctgccatgctaggccgctcccagggtgacctgcggcgacaggaggaacagcgcagccgcctgagccgagcccgccagaatctcagccaggtccctgaagctgactcagtcagcttcctgcaggagctgctggcactaaggctggccctggaggatgggtgtggccctgggcctggacccccgagggagctcagcttcaccaaatcatcccaagctgtccgtgcagtgagagacatgctggccgtggcctgcgtcaaccagtgggagcagctgagggggccgggtggcaacgaggatgggccacagaagctggactcggaagctgatgctgagccccaagacctcgagagtacgaacctcttggagagtgaagctcccagggactatttcctcaagtttgcctatattgtggatttggacagcgacacagcagacaagttcctgcagctgtttggaaccaaaggtgtcaagagggtgctgtgtcctatcaactaccccttgtcgcccacccgcttcacccattgtgagcaggtgctgggcgagggtgccctggaccgaggcacctactactgggaggtggagattatcgagggctgggtcagcatgggggtcatggccgaagacttctccccacaagagccctacgaccgcggccggctgggccgcaacgcccactcctgctgcctgcagtggaatggacgcagcttctccgtctggtttcatgggctggaggctcccctgccccaccccttctcgcccacgctttttatacactcagccttccctctcccaggcaggaggacccccagaccctgttcccctgcagacctcacttctgggagacagagctacagctgggacagctccaagctaccctaacccctcctttcccaggtttctagaatagtgtctggcatgtagtagatgctcaataaacacttgttgaatgaa

SEQ ID NO: 85937 - DNA, 1094 bp, Homo sapiens
gggcggcgccctgggcggccgcggagtcatggacggcagtggacccttcagctgccccatctgcctagagccactccgggagccggtgacgctgccctgcggccacaacttctgtctcgcctgcctgggcgcgctctggccgcatcgtggcgcgagtggagccggcggacccggaggcgcggcccgctgcccgctgtgccaggagcccttccccgacggccttcagctccgcaagaaccacacgctgtccgagctgctgcagctccgccagggctcgggccccgggtccggccccggcccggcccctgccctggccccggagccctcggcacccagcgcgctgcccagtgtcccggagccgtcggccccctgcgctcccgagccgtggcccgcgggcgaagagccagtgcgctgcgacgcgtgccccgagggcgcggccctgcccgccgcgctgtcctgcctctcctgcctcgcctccttttgccccgcgcacctgggcccgcacgagcgcagccccgccctccgcggacaccgcctggtgccgccgctgcgccggctagaggagagcctgtgcccgcgccacctacggccgctcgagcgctactgccgcgcggagcgcgtgtgtctgtgcgaggcctgcgccgcacaggagcaccgcggccacgagctggtgccgctggagcaggagcgcgcgcttcaggaggctgagcagtccaaagtcctgagcgccgtggaggaccgcatggacgagctgggtgctggcattgcacagtccaggcgcacagtggccctcatcaagagtgcagccgtagcagagcgggagagggtgagccggctgtttgcagatgctgcggccgccctgcagggcttccagacccaggtgctgggcttcatcgaggagggggaagctgccatgctaggccgctcccagggtgacctgcggcgacaggaggaacagcgcagccgcctgagccgagcccgccagaatctcagccaggtccctgaagctgactcagtcagcttcctgcaggagctgctggcactaaggctggcctggaggatgggtgaagctgagctccctcgggggtccaggc

SEQ ID NO: 85938 - DNA, 165 bp, Homo sapiens
cctcttggagagtgaagctcccagggactatttcctcaagtgtaagtggacgcccgtgccccctccactcacactgggccctcccagggctgctgggctggtcccagcagggccctggcacacaagggttaggattcctctccccagtttgtggggagagctagg

SEQ ID NO: 85939 - DNA, 2975 bp, Homo sapiens
gggcggcgccctgggcggccgcggagtcatggacggcagtggacccttcagctgccccatctgcctagagccactccgggagccggtgacgctgccctgcggccacaacttctgtctcgcctgcctgggcgcgctctggccgcatcgtggcgcgagtggagccggcggacccggaggcgcggcccgctgcccgctgtgccaggagcccttccccgacggccttcagctccgcaagaaccacacgctgtccgagctgctgcagctccgccagggctcgggccccgggtccggccccggcccggcccctgccctggccccggagccctcggcacccagcgcgctgcccagtgtcccggagccgtcggccccctgcgctcccgagccgtggcccgcgggcgaagagccagtgcgctgcgacgcgtgccccgagggcgcggccctgcccgccgcgctgtcctgcctctcctgcctcgcctccttttgccccgcgcacctgggcccgcacgagcgcagccccgccctccgcggacaccgcctggtgccgccgctgcgccggctagaggagagcctgtgcccgcgccacctacggccgctcgagcgctactgccgcgcggagcgcgtgtgtctgtgcgaggcctgcgccgcacaggagcaccgcggccacgagctggtgccgctggagcaggagcgcgcgcttcaggaggctgagcagtccaaagtcctgagcgccgtggaggaccgcatggacgagctgggtgctggcattgcacagtccaggcgcacagtggccctcatcaagagtgcagccgtagcagagcgggagagggtgagccggctgtttgcagatgctgcggccgccctgcagggcttccagacccaggtgctgggcttcatcgaggagggggaagctgccatgctaggccgctcccagggtgacctgcggcgacaggaggaacagcgcagccgcctgagccgagcccgccagaatctcagccaggtccctgaagctgactcagtcagcttcctgcaggagctgctggcactaaggctggccctggaggatgggtgtggccctgggcctggacccccgagggagctcagcttcaccaaatcatcccaagctgtccgtgcagtgagagacatgctggccgtggcctgcgtcaaccagtgggagcagctgagggggccgggtggcaacgaggatgggccacagaagctggactcggaagctgatgctgagccccaagacctcgagagtacgaacctcttggagagtgaagctcccagggactatttcctcaagtttgcctatattgtggatttggacagcgacacagcagacaagttcctgcagctgtttggaaccaaaggtgtcaagagggtgctgtgtcctatcaactaccccttgtcgcccacccgcttcacccattgtgagcaggtgctgggcgagggtgccctggaccgaggcacctactactgggaggtggagattatcgagggctgggtcagcatgggggtcatggccgaagacttctccccacaagagccctacgaccgcggccggctgggccgcaacgcccactcctgctgcctgcagtggaatggacgcagcttctccgtctggtttcatgggctggaggctcccctgccccaccccttctcgcccacggttggggtctgcctggaatacgctgaccgtgccttggccttctatgctgtacgggacggcaagatgagcctcctgcggaggctgaaggcctcccggccccgccggggtggcatcccggcctcccccattgaccccttccagagccgcctggacagtcactttgcggggctcttcacccacagactcaagcctgccttcttcctggagagtgtggacgcccacttgcagatcgggcccctcaagaagtcctgcatatccgtgctgaagaggaggtgatgccgggcacgggcgctcctgctgccgtctctgctccaggaagctgcctcctctgggccctctccttcgtctgggaaggcaccagcatgagtcccacacacccagccttctcatttctagaggcttccacctttttatacactcagccttccctctcccaggcaggaggacccccagaccctgttcccctgcagacctcacttctgggagacagagctacagctgggacagctccaagctaccctaacccctcctttcccaggtttctagaatagtgtctggcatgtagtagatgctcaataaacacttgttgaatgaaaaaaaaaaaaaacacaaaaaaaaaaaaaaaaacaaaaaaaaaaaaagaagagaaggggcgcgcgcgcgcgccccagaagaatttctccccgcgggggcggccccaagttcttgccccgcgctccccccggttttctttgttacccaagagggggcgcccccaataactgggaggagctcgcgtgtatatatatatatagcgccgctagggccgcgggggcgcacgcgccgtgtttcaacaaagacgcgcttgaggaagtcggggaaaaacgccgcgcgagaacacggggggaggcaccctcttgtgggagaagagaggaccccatttataccctcgtgggggggggggggggaccacaatatagtgtgtggggagacacacaactctatcccctctcaaagagagatgatatatatataagaggactctctcaagaggggggggatactaaattttcatacaccatgttgtaaaagagggtgggtatattatagcggcgtggggtgtgtacacccacacgagagagggggctggaacttatagtgtgctgtgcgggagccggcgtcgtttgaaagaaatagagttttgttgtggcgccgcttcacgagtgcgaggagcttgtagtgtcgagattgtatattctgagacgaacaatcattttttttcatataacagcggagggaggagccgcactaggtgggacaaacaacc

SEQ ID NO: 85940 - DNA, 2287 bp, Homo sapiens
gggcggcgccctgggcggccgcggagtcatggacggcagtggacccttcagctgccccatctgcctagagccactccgggagccggtgacgctgccctgcggccacaacttctgtctcgcctgcctgggcgcgctctggccgcatcgtggcgcgagtggagccggcggacccggaggcgcggcccgctgcccgctgtgccaggagcccttccccgacggccttcagctccgcaagaaccacacgctgtccgagctgctgcagctccgccagggctcgggccccgggtccggccccggcccggcccctgccctggccccggagccctcggcacccagcgcgctgcccagtgtcccggagccgtcggccccctgcgctcccgagccgtggcccgcgggcgaagagccagtgcgctgcgacgcgtgccccgagggcgcggccctgcccgccgcgctgtcctgcctctcctgcctcgcctccttttgccccgcgcacctgggcccgcacgagcgcagccccgccctccgcggacaccgcctggtgccgccgctgcgccggctagaggagagcctgtgcccgcgccacctacggccgctcgagcgctactgccgcgcggagcgcgtgtgtctgtgcgaggcctgcgccgcacaggagcaccgcggccacgagctggtgccgctggagcaggagcgcgcgcttcaggaggtgggctccgggggcacactcgggctgagcagtccaaagtcctgagcgccgtggaggaccgcatggacgagctgggtgctggcattgcacagtccaggcgcacagtggccctcatcaagagtgcagccgtagcagagcgggagagggtgagccggctgtttgcagatgctgcggccgccctgcagggcttccagacccaggtgctgggcttcatcgaggagggggaagctgccatgctaggccgctcccagggtgacctgcggcgacaggaggaacagcgcagccgcctgagccgagcccgccagaatctcagccaggtccctgaagctgactcagtcagcttcctgcaggagctgctggcactaaggctggccctggaggatgggtgtggccctgggcctggacccccgagggagctcagcttcaccaaatcatcccaagctgtccgtgcagtgagagacatgctggccgtggcctgcgtcaaccagtgggagcagctgagggggccgggtggcaacgaggatgggccacagaagctggactcggaagctgatgctgagccccaagacctcgagagtacgaacctcttggagagtgaagctcccagggactatttcctcaagtttgcctatattgtggatttggacagcgacacagcagacaagttcctgcagctgtttggaaccaaaggtgtcaagagggtgctgtgtcctatcaactaccccttgtcgcccacccgcttcacccattgtgagcaggtgctgggcgagggtgccctggaccgaggcacctactactgggaggtggagattatcgagggctgggtcagcatgggggtcatggccgaagacttctccccacaagagccctacgaccgcggccggctgggccgcaacgcccactcctgctgcctgcagtggaatggacgcagcttctccgtctggtttcatgggctggaggctcccctgccccaccccttctcgcccacggttggggtctgcctggaatacgctgaccgtgccttggccttctatgctgtacgggacggcaagatgagcctcctgcggaggctgaaggcctcccggccccgccggggtggcatcccggcctcccccattgaccccttccagagccgcctggacagtcactttgcggggctcttcacccacagactcaagcctgccttcttcctggagagtgtggacgcccacttgcagatcgggcccctcaagaagtcctgcatatccgtgctgaagaggaggtgatgccgggcacgggcgctcctgctgccgtctctgctccaggaagctgcctcctctgggccctctccttcgtctgggaaggcaccagcatgagtcccacacacccagccttctcatttctagaggcttccacctttttatacactcagccttccctctcccaggcaggaggacccccagaccctgttcccctgcagacctcacttctgggagacagagctacagctgggacagctccaagctaccctaacccctcctttcccaggtttctagaatagtgtctggcatgtagtagatgctcaataaacacttgttgaatgaa

SEQ ID NO: 85941 - DNA, 2591 bp, Homo sapiens
ctatgggggtgtaggcgggagggagccgggttaggcccgcggggttccggtagcgtggctgctgctcccgcccggagggtcacgccggtctcagctcagatttgccctgggctgaggcagcagctttcgatgggtgtggcaggcggcaggagggcggcagagggcgaccgggcacacagattctctgtccagctgttccgggggccagtggtgggagcatgtgagccgcggcctctacctcccgcccccagtttcctttggcctccagcccggtcttggcgcctctggccaagggattttccgtttctcctgcctggagcagtgactcataagacctaggggatttgcccggaatcccctttttttccaggcctggactgtggatgcaggctctttgggaacagtgatcctcaggacagcttaatgcctccttgtgcagtcacccctccgccgcccacctcccaacctaactggcttactctctgcctcttccccgccggaggaagttctcaaattcatctgagcaacactgagaccagcggacggccctgtactaggcctcctgtcagagacccgaggcagacacccagtcagcctgcacgccccccaggcgttcaggaaaggcaccagcctgggctgcaggcacctctggcatattatgggacatcgtggccactccagtcccacctgatgcacagataccactccccagtcacccccttctctcccctggcaaggcctgggacccgagtgtagggctgtggcctctgccagacctcacactcatggagggtgttgtccacaggctgagcagtccaaagtcctgagcgccgtggaggaccgcatggacgagctgggtgctggcattgcacagtccaggcgcacagtggccctcatcaaggtcaaacacccctccctcagcatggaacaatccactccaaacaaaccatgcccatacctactgagcacaagtgtcccctgacctggcccagatccaggacaggctcagtctggcccctctgtcccctcaagagggccggtgggaagccggggtcagggaaggaggggggtacagtccgggacggttctttgccctcattgccccctctactgtcgtcctgtgcagagtgcagccgtagcagagcgggagagggtgagccggctgtttgcagatgctgcggccgccctgcagggcttccagacccaggtgctgggcttcatcgaggagggggaagctgccatgctaggccgctcccagggtgacctgcggcgacaggaggaacagcgcagccgcctgagccgagcccgccagaatctcagccaggtccctgaagctgactcagtcagcttcctgcaggagctgctggcactaaggctggccctggaggatgggtgtggccctgggcctggacccccgagggagctcagcttcaccaaatcatcccaagctgtccgtgcagtgagagacatgctggccgtggcctgcgtcaaccagtgggagcagctgagggggccgggtggcaacgaggatgggccacagaagctggactcggaagctgatgctgagccccaagacctcgagagtacgaacctcttggagagtgaagctcccagggactatttcctcaagtttgcctatattgtggatttggacagcgacacagcagacaagttcctgcagctgtttggaaccaaaggtgtcaagagggtgctgtgtcctatcaactaccccttgtcgcccacccgcttcacccattgtgagcaggtgctgggcgagggtgccctggaccgaggcacctactactgggaggtggagattatcgagggctgggtcagcatgggggtcatggccgaagacttctccccacaagagccctacgaccgcggccggctgggccgcaacgcccactcctgctgcctgcagtggaatggacgcagcttctccgtctggtttcatgggctggaggctcccctgccccaccccttctcgcccacggttggggtctgcctggaatacgctgaccgtgccttggccttctatgctgtacgggacggcaagatgagcctcctgcggaggctgaaggcctcccggccccgccggggtggcatcccggcctcccccattgaccccttccagagccgcctggacagtcactttgcggggctcttcacccacagactcaagcctgccttcttcctggagagtgtggacgcccacttgcagatcgggcccctcaagaagtcctgcatatccgtgctgaagaggaggtgatgccgggcacgggcgctcctgctgccgtctctgctccaggaagctgcctcctctgggccctctccttcgtctgggaaggcaccagcatgagtcccacacacccagccttctcatttctagaggcttccacctttttatacactcagccttccctctcccaggcaggaggacccccagaccctgttcccctgcagacctcacttctgggagacagagctacagctgggacagctccaagctaccctaacccctcctttcccaggtttctagaatagtgtctggcatgtagtagatgctcaataaacacttgttgaatgaa

SEQ ID NO: 85942 - DNA, 1207 bp, Homo sapiens
ttctttaagcttgatcagacaggcggacccccgagggagctcagcttcaccaaatcatcccaagctgtccgtgcagtgagagacatgctggccgtggcctgcgtcaaccagtgggagcagctgagggggccgggtggcaacgaggatgggccacagaagctggactcggaagctgatgctgagccccaagacctcgagagtacgaacctcttggagagtgaagctcccagggactatttcctcaagtttgcctatattgtggatttggacagcgacacagcagacaagttcctgcagctgtttggaaccaaaggtgtcaagagggtgctgtgtcctatcaactaccccttgtcgcccacccgcttcacccattgtgagcaggtgctgggcgagggtgccctggaccgaggcacctactactgggaggtggagattatcgagggctgggtcagcatgggggtcatggccgaagacttctccccacaagagccctacgaccgcggccggctgggccgcaacgcccactcctgctgcctgcagtggaatggacgcagcttctccgtctggtttcatgggctggaggctcccctgccccaccccttctcgcccacggttggggtctgcctggaatacgctgaccgtgccttggccttctatgctgtacgggacggcaagatgagcctcctgcggaggctgaaggcctcccggccccgccggggtggcatcccggcctcccccattgaccccttccagagccgcctggacagtcactttgcggggctcttcacccacagactcaagcctgccttcttcctggagagtgtggacgcccacttgcagatcgggcccctcaagaagtcctgcatatccgtgctgaagaggaggtgatgccgggcacgggcgctcctgctgccgtctctgctccaggaagctgcctcctctgggccctctccttcgtctgggaaggcaccagcatgagtcccacacacccagccttctcatttctagaggcttccacctttttatacactcagccttccctctcccaggcaggaggacccccagaccctgttcccctgcagacctcacttctgggagacagagctacagctgggacagctccaagctaccctaacccctcctttcccaggtttctagaatagtgtctggcatgtagtagatgctcaataaacacttgttgaatgaa

SEQ ID NO: 85943 - DNA, 1289 bp, Homo sapiens
gggcggcgccctgggcggccgcggagtcatggacggcagtggacccttcagctgccccatctgcctagagccactccgggagccggtgacgctgccctgcggccacaacttctgtctcgcctgcctgggcgcgctctggccgcatcgtggcgcgagtggagccggcggacccggaggcgcggcccgctgcccgctgtgccaggagcccttccccgacggccttcagctccgcaagaaccacacgctgtccgagctgctgcagctccgccagggctcgggccccgggtccggccccggcccggcccctgccctggccccggagccctcggcacccagcgcgctgcccagtgtcccggagccgtcggccccctgcgctcccgagccgtggcccgcgggcgaagagccagtgcgctgcgacgcgtgccccgagggcgcggccctgcccgccgcgctgtcctgcctctcctgcctcgcctccttttgccccgcgcacctgggcccgcacgagcgcagccccgccctccgcggacaccgcctggtgccgccgctgcgccggctagaggagagcctgtgcccgcgccacctacggccgctcgagcgctactgccgcgcggagcgcgtgtgtctgtgcgaggcctgcgccgcacaggagcaccgcggccacgagctggtgccgctggagcaggagcgcgcgcttcaggaggctgagcagtccaaagtcctgagcgccgtggaggaccgcatggacgagctgggtgctggcattgcacagtccaggcgcacagtggccctcatcaagagtgcagccgtagcagagcgggagagggtgagccggctgtttgcagatgctgcggccgccctgcagggcttccagacccaggtgctgggcttcatcgaggagggggaagctgccatgctaggccgctcccagggtgacctgcggcgacaggaggaacagcgcagccgcctgagccgagcccgccagaatctcagccaggtccctgaagctgactcagtcagcttcctgcaggagctgctggcactaaggctggccctggaggatgggtgtggccctgggcctggacccccgagggagctcagcttcaccaaatcatcccaagctgtccgtgcagtgagagacatgctggccgtggcctgcgtcaaccagtgggagcagctgagggggccgggtggcaacgaggatgggccacagaagctggactcggaaggtgggcaccgccccacgcccccccgatgactcaccctctgccagcctctcgcacaggccc

SEQ ID NO: 85944 - DNA, 156 bp, Homo sapiens
tgcaaaatttctcttcaatgtgttgattctatgcacctctttttcatttttaaattatcattaattctcccccgatcccccacagtataaatcttctcttctcactatgttctgacacattaattatttaagcaaggttattattattttaaaaat

SEQ ID NO: 85945 - DNA, 390 bp, Homo sapiens
ttactcctatatgagaacagaatatcaatgcttcttgactacagtctcccctactgatacttaatgtgccaagttaaaatacttgcatagtggacaataaggcagcatggggatttcctattcctgtttcctgccaaattgacaggttgcattgcagcaggtgcacctcaaagtgattaagaatgtaagggctgacaaaacatgtgtgatgtgactgcaggcattttatgtgagtgacatgtcatggcaagtattggcctcaagagattatacttggggctctagggtgtgagggcaatctatacgtgtgtaaaagcatcattgagaaggtgagtactcaagaaaaaataaccttgactgggagtctttacataaatgaagtacattgca

SEQ ID NO: 85946 - DNA, 460 bp, Homo sapiens
ggacactgccaagggcttcctggctctaggaccgccttgggtttctgccccttcaggctgcttctccagtcctcccagtgagcctgtgtcctcctcagaccctttggcttctgtctgcaaagtaagtttctgtcctaacttagggagtgataatattcagaatttctctccattttcacggttgagattttggcgctaaaatcacaaacccaaataaaaaaataaataagaacaaatagcctctagtctatattcatataaataaataactgaatgagtgactaaatggggggaaagggcaactcttttttttcttcgaggcaagatgtcactctgtcgcccaggctggagggcagtgacatgatctcagctcactgcagcctggccgacaactctttcttgcagaattccaattaatacatatggaaggaatgagagacttggcaaatcaccactgaaa

SEQ ID NO: 85947 - DNA, 163 bp, Homo sapiens
tgtgctcctgtggtcccagctacttggaaggttgaggtgcaaggatcacttgaacctgagaggtagaggctgcaatgagtcacgatggtacctccagcttgggtgacagagcaagacactgacacacacacatacacacacatgcacacagagcaagacactg

SEQ ID NO: 85948 - DNA, 279 bp, Homo sapiens
agtcagagtcctggtggctgaagggaccactgaggcttgtggagagcagctgcgctgcatggggccctcaggtgggcactcagatggggacagagagtccggggggctcccccaaggagccaggaccagggtgagttagaggagcagggagccaggcagcttggcatccactcccctgcagccctgccgtctccgctgcggtgtcccgagcaactccccagggactgcgaggaggctgggaaggggcgcccgtgggctgcctgggctgcctgtcctggt

SEQ ID NO: 85949 - DNA, 487 bp, Homo sapiens
ccccagaaaagggaatacacacggtagtagtttcttaggttggagaatctgtccctgaaggaaataattcggcagaacagcaggaaacgaagtcaaagaggctgtggggacaaggacatgggggggccttagaggtcatgctaaggactttgtttggccttttactctgagaagtcactggagggtctggagcagaggagtgccatctggcttaggtttcaacagatcactctgcaactgcggagtgaaaggcatgagattagaagcagagaccattcaggaggcttttgccatagtccaggcagctgatgatggtggcttggagccaggtagggagagtgaagtggtgagaaatgcatacattctggatatttttaaaagatggatctggcaagatttgtcaatggattggcggtatgtgtaagagaaagaagagtcaagaatgatttgaagatttatgacctgagtaactggcaggatggaattg

SEQ ID NO: 85950 - DNA, 362 bp, Homo sapiens
aacccaggtctttctcctgaaccttctatgttgcttagaagccttgctcccaggatgagccgaacttcctatgatgtcctgttgagtgtgcgtcctagccttttaatgtataggtactctagacttgcattcgaggttatggtcagtatcacaagtgattcatacaagaaatcatccagatatcttcaccatgaaccaaagggaagggtacagactgagaagctcaactcacagaggctggcaggctgaggccggggattgtactctgagggaaaacagatagtatgccgcaaactcccaccaacaaaatgatcatttccctggtgagcaggcacacagtattaacattagccaggggccag

SEQ ID NO: 85951 - DNA, 631 bp, Homo sapiens
actggcccagcacctcctctgcatggagtaagggtctgctgcatccttgatcatatcacgtaggcaggaggcttagagctaaccacatggtctggcctccaggggaccatcaaccagcaggaagaattccccaaggcaatgcactgttggctttctcaacgttccacaaaataactgcacctgatattccccaccaactaaggcaggaggctctgctaatttcattaataacttaatgagattattaaccactacccagtgggggcagatttggtttttccttggttataggaatgtatccatttttcacacaattacagcctgagaggatcatcactgaggctgacaattgtgggcttattaggagcaatttagacacaagattggatttcctttctgcccataaccttttgttcaaagcaaatgaactggtgttcctcatattagtatattaataaaggttgtccaggaggtgtttgatctttaagattggcccagtagcagagtagtaacactgccctgggaggcagggtgccaggcttctcatgccagcttcaagcagccagcccaagccacttggtgtctctgagcctcagtttctcattacctactgtgatagaactggaccggt

SEQ ID NO: 85952 - DNA, 338 bp, Homo sapiens
cacgaaaacacccagtcacaacgaccaacccagtaaccatgaccaacccgctgccgcacggcgggtcttgaaataccgtcttgcaggaaaagaaagcagggcttcttggagacttggctgattccaggtctggagcaggacatgagtgtgaaaaatcctgactcccagacagcagaggccacaaccgccggggtcaggacacaagagcccacagaaaacacctcaaggtgcagcaactgaggtcaggagtgagattcaggagggagcatggggcaggaccaatccccacgttcacacacaaacattcagtgatgacacttgattgactgattgatttt

SEQ ID NO: 85953 - DNA, 531 bp, Homo sapiens
tacaatcgagctcggtaccgacagcatcctaaccagctcacctcccatttagttatatgatctttccatgagtatataagcacctaaaccagaggtcgtctcacctgagagacaccctattttagaggcactcagatgaggcaaacagagcatgcaaaaaacatttttaaaaatctctttttggccaggcatgatggctcatgcctgtaatcccagcactttgggaggccaaggtgagcccatcacttgaggtcaggagttccagcctggccaacatgtcgaaaccctgtctgtactaaaaaatacaaaagttagctgggtgtggtggtgcacgcctgtagtcccagctacttgggaggctgaggcaggagaattgcttgaacccgggaggcagaggctgcagtgagctgagatcatgccagtgtactccagcctggacaacagaacaagactccatctgggggggaaaaaaaaaggaaaatttggtgtattagagtgttagtacattttattgtatgcatggaagaaatc

SEQ ID NO: 85954 - DNA, 442 bp, Homo sapiens
ccactgttttcatgttcacacctaagaaagtcattcttaaacacctcctcaaggtcactgaaaacatccttagtaggaaagagaagcaatttttaaactgcctgacgtctcttctcctggacttcatccaggtgttgaaatagttcagcaaagagaccaacactttaggaggttcatgcttgagtacaaagtgactcctgaatgcttttccccctgcttccagaggccttgcttgattcagtttgtgactcacgcacagcaggccccattagtcatagtttgaatttgtttttctttcttcatggatggttctgatcaacagtttagtatttttgatgatctgaaaataaaaacaaatccctctgccctccattttgatattttttcgcacctcaggtttcaaagatcaaaggggtgggtccagattagtactgtgagcttt

SEQ ID NO: 85955 - DNA, 526 bp, Homo sapiens
taaatctattttttaaattttaattaaaaataaataaatgaattacaggcaataagtaaattacaggcaataccccaggcattgtcccattgaaacaccttagccatacaaactaaaaattcttccacgattatgcagttgagttattcctgtgtagctttctctttatgagtagctaaaactcggttaaatgtgatcatattgattcttaagacagtgattcaaatggcacctagaattaagttatcctttcccatatttaaggatttggtacctggcatcttttggggaattagagtcatatatggcttcatatcactcatgcaattttgtacatgttcttctttttgtttctttttttaatcaatgaatatttgtgcccattgataaaagatgaacaacttcttaatttggagaccataaagaaatctagttagaaaatactactaataatcaatcttaaaagaaaattcttttcatgaccaacaactggcagctgacattataacactgggagtgacagctg

SEQ ID NO: 85956 - DNA, 485 bp, Homo sapiens
gacttcctggctacttatggaatgtgtagtttactgtggaaagagaacagatggaacctcccatctcaaaggtttttatactgagcattagatcatttaacacacaaaaccctataaggaagatgtcattacccatattttacatgaaaagaaacagaagctcagggaggttaggttagttttccaaagcgacacagctattaagagtgacagccaggctgggcatggtggctcatgcctgtaatctcaggaccttggaaggctgaagtgggaggactgcttgaggctaggagtttgagaccagcctgggcaatattgcaagaccctgtctccacaaaaaatgagcgtggtggtacatgtttgtagtcccacatacttgggaggctgaggtgggaagactgcttgagcccgagaggtcaaggctgcagtaagccgagatcaagccactgcacttcagcctgagtgacagagcaagaccttgtctc

SEQ ID NO: 85957 - DNA, 426 bp, Homo sapiens
tgtggatgaagtagatgttatatctgaatagttcatttcactaggctataaaatcaattatcagcataaaaaatatttatttatttaggagacagggtctcactgtgttacccaggctggtcttgaactcttggcctcaagggatccttccaccttggcctccaaaagtgctggaattacaggcatgagccactgtacctggcctaatacaaatcgtttttaaccagatactagagaactaaagaggcaaaaagggaacagtagggtattatggacaaagcagctgtgagaattggctaccatacctatggcttggggaaccaaggaaagagattggaattattaaaaagtaggagttggaggggtttgccccatgaagctgggatactgctaggctgttactggtgcctcagaggtctgaaaaga

SEQ ID NO: 85958 - DNA, 270 bp, Homo sapiens
cacactatgtcattctgatgaagaaaccattgccactgaactacaggccgtcacagctggaagggattgaattcaactcactcgacacttgcccagttgttctggatgctggtcaaaaggcaggttagggtacaaaccttggtggggtcacttatatgaagaaggtgtgattttttttcctcctctagaggggaatttacaaactatcaggagcccccaaggatgctccaagcagctgtaggagtccagggaagcacagttagctcatta

SEQ ID NO: 85959 - DNA, 265 bp, Homo sapiens
aaacccaagtaagcaacagaaaagagataataaacattaaagcagaaatcaataacattaaaaacatgaaatcagtagagaaaaatcaattcaatcaaaagctgattctttgaaaagataattaaaatgataatcctctagccaggctaattttaaaaaaaagaagataaagagaatggatacaaactactaatattaaaaatgatgtcctttcatttttaatattagtacatgctacagatcccatgtacattgaaagtataat

SEQ ID NO: 85960 - DNA, 201 bp, Homo sapiens
tattatctcatttaacaaatgaggaaacaagttcaggtaagtgcccatagctctcctcctagctactaagccttcattgccacccactattcccgcttctcttgctttcccttgttttaaaatcagtccaggccgggcgcggtggctcctgtaatcccaacactttgggaggccgaggcaagtgggtcatttgaggtcagg

SEQ ID NO: 85961 - DNA, 375 bp, Homo sapiens
gtggggggcaccgcgggttctggtctttcccacgctcacgtccaccgcccaggcccaaaggaaatggctgtgagagcaagatgtaaagatagttacaaataccagctagggccagtgacagttgcagaaatgaggacttgtaatagttaggagtatttcttcattattttgagatgaatacatttggttatatgttaaccaatacttttcttgagaattctcgtcttccatcatcctcgctatcatattcattaataattaacttttagaaatctcaatatttaggttacaggatagcaaatatggaatgtgatctagctaaaaaaggagtgaacatcattcaaagacaaataaaagactttatcctgttgggga

SEQ ID NO: 85962 - DNA, 436 bp, Homo sapiens
gacagagttgttcagtggaaagtctggggtaagttcctgatttagaacaggctttagtgcactttaaaaggaaaacaatgaattatataaaacttttagaggacacagtggtgccagatttttgttggattcctgtgctttcctcctccaaatagttaccaaaaaatattcctttgggaattagtatcaaaaggattctatagcatctcaaaagaatcttattcactttgggaggccgaggcaggcagatcacaaggtcaggagatcgagaccatcctggctaacacggtgaaaccccatctctactaaaaatacaaaaaattagccaggcgtggtggtgggcgcctgtagtcccagctactcgggaggctgaggcaggagaatggcgtgaacccaggaggcagagcttgcagtgagccgagatcgctccactgca

SEQ ID NO: 85963 - DNA, 1055 bp, Homo sapiens
tgcaatggtgcgatctcggctcactacaacctctgcctcctgggttcatgcgattctcctgcctcagcctcccgagtagctgggattacaggcgtgtgccaccacggtggcctggctaattttgtatttttagtagagatgggaggtttccccatgttggccaggctggtctcaaactcatgatctcaagtgatccgcccgtgtaggcctcccaaagttctgggattacacccagagccactgcgcccggccagagaaaaattttgcctttttatttaggtgttgcctactgaagagaatgggagatcagtttcgaatctgcctcctcgaccaactaaaactggggagtttatgtaccgaaaaaaggaatgtaactatgtgtgaggaaaacagcaattaggaaaaggataaggaagcagtcctgacctatgaggggaaagaggtgtctggggtctcattgtcaaatggtgatttggtgagtttcagtccgttgcctgaggaaagaactcattggagacaaatataagttttaggttttaaaactggaagggtcagtttctatgtttattcaaagacctgtacatataatttctatggggaaattgagccagtttcatttatgcgcaactttttttgcctccagtcttaaaggaaaaaaaaaaaacaactgataatatttgttgcctatgataaaattccagcttccaaatgaaaaaaaaaaaaagactccactatttcccagagttacttggatcactgcctttccccataccccctttagtgaggttgtttcctgtgtttgtactgcaattagattcttttgctacattctgcgttccatcctgggattctccacctctgaaatgttttctaaaagttaacatgtactgaggctcactcttgttctctgaagttctgctggttttgaaaaatgcgtggtgccgtttacctatcattaaaatatcatacagaacaattttactacctgaaagtgtcctgtgcttcatccatttaaccctaccctccaactccagctaccactgatctggtactat

SEQ ID NO: 85964 - DNA, 274 bp, Homo sapiens
taattagctgggcacactggctgtatgcctgttgtctcagtttctcaggagggtgaggcaggaggattgtctgagcataggaggttgaggctgcagtgacctacgagtgctccgttgtactctagcctgggtgacagagcaagaccctgtctccaaaaaataaataaatatttaaaatttaaaattaggatttaaaatatgttaaagctcaaagatgaaagtgtagaatggatatcacttattattatgtagtattcagtgtgaattacgatga

SEQ ID NO: 85965 - DNA, 416 bp, Homo sapiens
tcccaggttcacgccattctcctgcctcagcctcccaagtagctgggattacaggtgcccaccaccacgcctgcttaattttgtatttttagtagagatggggtttcaccatgctggccaggctggtttcaaactcctgacctcaggtgatccactcgcctcggcattccaaagtgctgggattacaggagtgagctcccacacctggcactattttcttttcttttttttatttgtttctgttttgttttgtttgttttggtggtctaaaataaattttttaattgcacatttgtgtcttgggttatctgtggggtgagaaacctattcctcacttccaatcccagctatccaggtacaatctggtgttgtggtctggctgtgggcaaggggtacaggtgggtgcagagctggcc

SEQ ID NO: 85966 - DNA, 588 bp, Homo sapiens
gtaaggggtaaggggtaggggaggaggaggtttaccctgcatccatggaggtaaatggattaagctgaatgtctgggaagacgaggattgctgggtggaggtgtgaggcccagggctcggggataccatcagattacttgctcctcaagttttgggagctaataatacctgtgcttgcatttccctgcaaagcaagggataccttctgggataagtcccgagggaatcactcataacttatttctgcttccctcccacttatttaacataaatatagggcctagtttggggttaaattcagattttacacatttatgtctctgtcacatttcttgccaccaacttactgaagtctgaaatttctttaacaagaggaagtattccatcccatagttagaaatgtaagaatttcaatacctgttgtttaacacagcgaatgagattaggctaaacttaacagtaattggaaacgtattctgtacctgctaataactagaaaaaaaacaaagacaaacaagtaagcctttctgttttctcttgagacgtgggaattgtacagtaattacagtgggatgtaagtttcacgaa

SEQ ID NO: 85967 - DNA, 186 bp, Homo sapiens
ggtggagaggaggtgggaagaagaccacacacttacacaattaactcgcaatgcatgccacgtggccagggaatggctgcaggagcccggggctctaacatttaaaagacgtttgcttcattaattatcttttttttttttttttttttttttttttttttttttttttttttttttttttttttg

SEQ ID NO: 85968 - DNA, 772 bp, Homo sapiens
ttactactactaaatttgcggccgcgtcgacagaaatacctctttcagctgaagtaacaacggaggaaagtttttatttgagcatccagaaagatctcaccgcgctgttaactggagacactcaggcagagatttcccagataatgaataatgggaggaaaggggctgtctgtgtgcaggagccatcttgtcctttggcctccctcgggagctcagcagtgacctgccactctgcaggcagtgttggtttcttgaaagagcagaggtctgctcttgggagagagcacccagggggatgtgatcgaagcagctccatgggacgcccaggccgggtcaaacatgtggaatttcaaggagtggaaatactgtggacaggaggagacaagagagagacccagcatcctatagattttgagacatcactgcaaagaacagcctctcctgacagcaaagagtcttccaaagtgccacgccatctcatctcatcagctggtttgtgtaattcaagtagtttaactgagaatgtttgggatgaatcctggaaagctccttcagagaggcctggcactagctcggggacattttcccctgtgcgtcttgatgagagtggagaggatgaagtcttcctacaggaaaacaaacagcatcttgagaagacacctaaaccagagagagacagggaaaggatcagcgaacaagaggagcacgttaagggggaagatgaagacatccttgggcctggatatacggaggactccaccgacgtgtacag

SEQ ID NO: 85969 - DNA, 522 bp, Homo sapiens
attaggaaattcatgtaagactttttaagagtattttttaggttttcactcaatctttcctgtcacagtaacgtgaaaactgattattctttactccaagagaatgttttaacccaagcaagtatctaatactagagcattggttctgacattcattgtaaatcagtgaactgtaagatactgtctaaaaaatgtacatttgtaattagtgcctttattcatattttgaaataagttcttagttttatattatacctgttctttagaagtcatgttagcagctaattatttcagtgatgaaataatttgtgttttatatcccccttcacctccatgtattggttagcacagtttatagtaagtgaaaagcaagggacccacctacattaccttcaggagactgttctaccttttaatttgaaaacaaggaaattaaattttaacagaaatcttttaagtatgttataaccaaagtgttcaattatccttgcaagttcaaatacagcatttttcttaattttg

SEQ ID NO: 85970 - DNA, 291 bp, Homo sapiens
gttcaagctattctcatgtctcagcctcctgagtagctgggactacaggtgcacgccaccacgcctggctaatttttgtatttttagtagagatggggtttcactatgttggccaggctggtctcaaactcctgacctcaagtgatccacctgccttggcctcccaaagtgctgggattacaggtgtgagccaccacgcctggtcgttgttaatttcatgatatgaacataccttcatgcatggtttctttttgtgttttcctgatagcaaacttgagtttcccctttaaa

SEQ ID NO: 85971 - DNA, 702 bp, Homo sapiens
agccaggatggtctcaatctcctgaccttgtgatccgcccacttcggcctcccaaagtgttgggattacaggcgtgagccaccacgcccggcctgatttttctattccttgtaaatgcccagcctgggcatacccactcgcagaatattgtactactgtgttcgttattgcatcccagagtctgagcttgaataaatgctacgaaagcctccagcgtgtttgttgcatgctgctctcccatcaaggcataatcgttgtataataagggatagtgtgacatttcttatcatattgcagcatgaagactgtattttgtgcttattgtggatttcaggggtataacatttatatttgtgatacacaacatgcgtggttgttcaatgttgcccatgaaatcaaaatcctaccacttctctttcaagattttctggaccaaagtgtatcctgggactccaatgcaagttgtcatgcaaaactgtcaccatttgaagctacttagctgagtgaaaacatcactggtagggcaaatcccaagcaaaaattcacaagtaaattgaatgtgccagctgttggagggctgcatctggcttctgtaaacccctgatttcaaaagggggttcagctaaaactcttcattgttctttgtgattgagatgctcttttgtacaaatatgaactcataaaataaatgtttgctaatga

SEQ ID NO: 85972 - DNA, 403 bp, Homo sapiens
acatgattacgtcactggggtgaggaacgtcactgggatgaggaacgtactgggatgaggaacgtaaatatggtagttcttgcctcaaagatactgcacaaaattagcagactacttggtcattcgccagttcatacttataccctcccttttaatacagcactttgttcatatctctgttacagtacttacattgtaatataatttatctggtttatgtctgtcttccccactagattacaagctcctctaggaaggtggaccatgtcttattcatcattttatctttagtgcttatcacaaagccaggcttatagtgggcactcaaatgtttgttggatgaattaatgaatgaatgaatgcatatttaaatatccaatcatagagtgacaaatacctccct

SEQ ID NO: 85973 - DNA, 634 bp, Homo sapiens
tacaggttttcacccttcctcaaagccctgttatagttgacaagtatgagttctcttcagacaatttttccaagtataaagcatgtgggatttcaatacaaatcctgtctctgacataatacctttataactttgggcaaattgtttaacctatgtgagctttagtttccttgtctgtaaattggtaatggtaatagatacttcattgcttatagtgagaattagagataccgtatataaagtgactagcctattacttggtgactgacatgcactcactaagtattagtttcctgttctaccaagccttctgtctgcctcctgacaagacgtgacacctgagagggtgacaaaggcataatctcaacaatctgttctggtattttctctgaaatgacaaatgactcaagtgcattatctgagttgaacaaatacaagacttatagttattattctccaagggtagcaagaggtaatgactaacaattctgggaagatcttatttgtgttaggtgttggcagctctaagcatgcatggtaaaagtgatatggaggcccatttcctggagaatgtagactggatgtgtccactttcttctgtcacacatgaaactgctgtcagtatgctatctac

SEQ ID NO: 85974 - DNA, 364 bp, Homo sapiens
ttacatttttttataccctggcatttctgtggttaaagtaatgctaacacatattttgtgtccatacactatacttttaatgatcatttcttaagactattttgttcatttacaccatttggttttttgaacttgaaatgtcaaaagtttaatgaactatcgtaagttggaaaattaactaaaatagacagtatttgtttaccagaattcatttgagggccgtgtatcctttagtgtataaaaatctttttggtgtaaaaacatttgctataatcttttgctgattgttgtttttatgctagctcttaataggatattgttaacatctaagtctaggaattgggattcccaagatactgatata

SEQ ID NO: 85975 - DNA, 238 bp, Homo sapiens
gtatgctctggctgttccacctccgtgtgcttgttaattaacttgtaggactttgactgtaagatgtgaaaccacgtttcttgcatgatgttttagagattatttcatttacagtcttttaacctgcagctgcagcacttagttcacgttttcacaaatttcaagagtcactacactaaagacaatgccttttcatgaataagaagttttcagaaggctctagggggctgggaggcag

SEQ ID NO: 85976 - DNA, 283 bp, Homo sapiens
aggattataaatgcgtgcgtaaggggaaggcaaaaagcaaggtggcaactctcaggactaccgatgggaacctgtctgcttctgggactgggcgaggaaggacagagtgacctgatcaaggttgcaggctaatatggtttggctgtgtccccacccaaatctcatcttgaattgtagctcccacaatccccacatgtcatgggaggggcccggcaggaggtcactgaatcatggaggtgggtctttcccaggctgtccccgtgacagtaagtctcacgagatc

SEQ ID NO: 85977 - DNA, 822 bp, Homo sapiens
gctttctgcctctatagatttgactattctggacctttcacataaatggaatcatgtaatatatataataagcaaaaggtaacaacaaccaagctggcaatttggttgatgaatgaataaacaaaatgtgctgtatccatacagtggaaatattggtgcctactacatgtggatggaccttggaaacatcatgctgagtgagagagagccttggtattgtttcatctccccaggagattccaaggtgcagccaaggttgagacccactgacaagcaatggatatggttgggtgcagatgaaataaggcagccaggggcaggagggatgtctcattgaagatgactgtttgtggatgcctagcaggggtggggatgaggtatgataacagcaaccccaatctcaacacagcgtgaccgattttatcttcagtcagctgatacacctcatggggtgtggacacaggacacctctgcctcccaggttcaagcgataattcctgcctcagcctcctaagtggctgggattacaggcatgtaccaccacgcctagctaatttttatatttttagtagaaacacggtctcgtcatgttgcccagattggtctcaaatttctggcctcaaatgatccacccacctcagcctcctaaagtgctgggattacaggcgcgagcagctgcgcccggcctatatgactttatatttacctgctcccttcaccaggagatcatgggctgtgatgctgggttttcttaacagcataaggaagacttgcccccttgccctatcaaagagaatagttttggaggggagaagtgggacc

SEQ ID NO: 85978 - DNA, 543 bp, Homo sapiens
ggaatgcagcccagtagatctcagcttcattttgaagtggctacattgtctggggtatatacctgggatttgttgtctggcgccaggaaaatttaggacacagacacacatgaggagtttaagagcgaaggtttaataggcagaagaaaagaaagtaaaacagctctgcctcttgagagagaggggacttctgagaagaaagacctgccagcagtggatgggccagattttatagtcaggtttgaggaggcagtgtttgatttacatagggctcacaaattggttcgatcaggtatgatgttttcatagtgcttgtggtaagactggttgccccaccctaatcttattgtgcaaatgggctttccagttaaccagcgccatcttgtctgctccttactgtacagaagaagggaagatgggccaggcgcggtggctcacgcctgtaatcctagcactttgggaggctgaggtgggtagatcacttgaggtcaggagttcgagaccagcctgaccaacatggtgaaaccctgtctctactaaaaa

SEQ ID NO: 85979 - DNA, 661 bp, Homo sapiens
ggtgggaaaccctggctgggcatccatgggtgacgggatgaaacccgagcgtctccttcacacacatgctcttcctttgtctctacctaagaatgttcctgcctgattctagtagttgttttaagcattaaaaaaaagcaatagattctaggaaaagagacagggaaagtgacagtgattccgcttaaccccttcatcaccagagattattggaaatgcccacttttcaggcctcctcatctccatcagcaaaggcttccttgtaaggtaataagtctctctcattttacatggttctgtacatctgtctccccatctgtcagcccagcatcctgagctattagagctaggtgctacctccaccacggtattcacacgaaatggagcaggcttcaaactcaaaagtagctgaagaatacttacaatggaaatgaaagtgaccatagagcatcaatctgtaagtttatccacacacacaaaaagagggtttgtaagagttaaatgtaactggctgaagcttatagctggtgtttgttacaaagtacccaagcttttcctttccaacttcgtggctttgaagaattataggaattttatgatgtgctgttggagttatactggcagagattacagtaaaggggttaaagttggtttatggtag

SEQ ID NO: 85980 - DNA, 253 bp, Homo sapiens
gagctttccacttttccctaagtctcccatcaccactagggttatgtgaattggctgcgcgtgatggctcatacctgtaatcccagcactttcggaggccgaggcgggaggatcacttgaggtcaggagttcgagaccagcctggccaacatggggaaaccctgtctctactaaaaatacaaaaattagctgggcgtggtggctcaggcctatagtcccagctactcaggaggctgaagcatgagaatcgctt

SEQ ID NO: 85981 - DNA, 317 bp, Homo sapiens
aggtaggtattgtttccttccccacttttacagatgaggaaaatgagggtcagaggtgaaaagatctgcccaaggtctcacaactaaaaggcggccgagctcagatttaaattcaggtttgactttaaagctcatccccttggccaggtgcaatggctcacgcctataatcccaacactttcagaggccaaggagggagggttgtttgagcctaggagttcaagaccagccaggacaacatagcgagaccttatctctaccagaataaaaatactactactcagccaggtgtggtggcatgcacctgtagccccagc

SEQ ID NO: 85982 - DNA, 1162 bp, Homo sapiens
tgaaatgaaccacttctgattttctacggagaaagcaagggttaggtccaggttacctgtaaaggtgtgacttagggctccccagaagtgaaccttgctctggagaccccatttggtgaggttcttttcaaaagagattgtatatttttgacccagggattgtcgatttgttgagctcccatgtaagtatgccgccttgccattgacaggtcttcacaatgctttcttaaacgacattctttggaactgtctttcatagtcaggcgacccgccagccaggccgccaggtaggtggaagggcggcttcgggaactagatccggctggttctctgctaacatgtggtcctcgatgctctagcggattggccccaaacctcagcacacagagctttggtagggctggggatgcaggtcagcctgctgaaggcgtctagaggacttgggcgggggcgtgacttcctgctgcaccacttcctttccagccacgtgggcttctgggaccctatgacataatttctggagtggtctgttgggagttgtggcggcggcgaggcccaagcacagctggccaaggcgggtgtaaaacgcgggtcgtgtccaccccaaagctcgacgcctctagaagccatggcttttctgctgaagctagagccggacatgcaggggaaagtagatttgtttcgagcccgtatcgcccaggaggccgaggatctcgtgtccaccttctttcctcagaaggtcttggagctgaatagccgagttcaggagctccggctgcaagacctgtccagaatccattcggtgccaacctcggagcccctggccaccccaggcaacaagggagatgggcccaaccaaaatctgccagttctgctgactcagttctccatcaaggtcccagcactgcttggcagcgagggacagcttctgcggagcaaccagcatctggtggagttgactgagtgggtgaaacctgagatcaagctgctgagagagaaatgcaacacagtgcacatgtaggtgcacccgcttatcctgaaggtgcaggacggcaacaacttcagggtgtctatccaggaagacactgtggaccagctgtggaccgtggatagcacagcggcctcctctctatgcggcttctccacctactacaacacccag

SEQ ID NO: 85983 - DNA, 422 bp, Homo sapiens
aagtgggcaatttaggaagtcagagaacttttgcaaatgaggtagtacttaagttagttttaaagaagaggtgagaattcacctgctacacctaggagttactccagttagagggaacaatatgtgcaaagggactgagatttgaagcacatagtacacttcgggaactcccagtacaaggaagggaataatgggaggtagaaaaggctggagaattaggtagagccagatcatgaagggccttgtttgtcctgtatagattttttttttttttcatacagggtctcactgtgtccctcaggctgagtgcagtggtgccatcatggctgactgcagcatcaaccttctgtgctcaagtgatcctcccacctcagcctcctgagtagctgggactacaggagtgcacctccacacccgactaa

SEQ ID NO: 85984 - DNA, 191 bp, Homo sapiens
ggcagattcaggctgggaagggattgtgatacgtatcaagacattaagagacttactaagggccaggtgcggtggctcacacctgtaatcccaaaatgctgggattataggcgtgagccaccatgcctggccaaaaaagcatattttaaacaaaagtactgggacatgaagttaagggcagaacaccggtt

SEQ ID NO: 85985 - DNA, 388 bp, Homo sapiens
ggggatctctgtggacttctgccagtctcggaaaccagacctaatgtgggcaatcaagcccaactatcggactttaagtgttagagaatgaagctgtataatctaactatggtatatttgattgcttgaaataatcgctttataaatttattctgccttttaagcaaacttaacagatggctgaatctggacataactgtggagaccactttcaacacttttattgttggctaaagcatgctttgttaatgatgttcccaagttattcattcatttttaccaacctgcaaacactgttatatattagttattgaaagattctgatttcacaaaaggaaagtttcactagggattgggttagcacattgtcattccctttttgcatgct

SEQ ID NO: 85986 - DNA, 359 bp, Homo sapiens
gacacaatttctgctctaatccacaaatacttggacattctagctcttctcattgtcccaaccttttaaaacaacttcagtaatagcacctttcttaacctctggggtgataaaatggtgctacttccaatgactgtttgaggccttatctatagggtaacacacagccatcaaagtatagatcaaaagctcaaaaggtttaagttcatcagtagaaaaaccagggagtttttttctcctgttctagagaaaaaagctcacagattgcaggactgtagttaactagtatttatacttgtcctgggttgaagcaattgtaatagtatggttgacagtaggtttataaaatacacttttgt

SEQ ID NO: 85987 - DNA, 428 bp, Homo sapiens
acatagttctatgacatttcttacttttcttacttctgtccattgtaaacaaatgcatcttcctcctgtccacacagtttagaatacatccctgtcatggagggcttaatcctgaagaagtcaatatcagagaccaccatcaaatccatgttgacatttcaaaattaaaaacagaggctgggcaccatggttcatgcctgttatcccagccctttgggaggctgagggaggatcatttgaagctgtagtaagctatgattgtaccactgcattctagcctgggagacacggtgagacttttaaaatatttatgtatttattcattaatattttaaataaataaatgttgtaaaagaaattgtatcacctgcacttactatactgcatatatttcacaggccttatcaaattttcacaacagcctacga

SEQ ID NO: 85988 - DNA, 854 bp, Homo sapiens
ctgcactcgggcttctgggcgctcggctttctcatcgcgctgttctcagccttgccgcttgctctctccgatgggaatggcgaggcgagatctagcctttagggtgggaagagaatgcacagaaagcgctaaggatcaaggaggctgtcaataaacgggagttgttgctgtgaaaaaaaaaaaaaaaaaaaaaaaaaaaaaaaaaaaaaaaaaaaaaaaaaaaaaaaaaaaaaaaaaatgcaagaaaaaaacacaaaatacacaatgcaaacatacgcccatgcacagtatcaacgacccaccacagcaatcaacgaaacagaacttccaatactcatcgaccaatctcgacctgacttcaaacacatactacttcaacagaacctatacacatcacacttatcctacacactcccatcaaaccatgcactccgatcctacatcctccttatctctatcaatagctatatctataacttaaataccaactataacatatatatgaataacctgcactaataagcacgtgaagatccgacagagacccacaccagaacctgcataagtacactatacgaccccaatatctcccacgcgacaatgacgtacaacctcagcagcacttacactaacagcaaagacgccagatgatctaagtatacgacgaacatcatccatcgctatacaactactaaaattacattattacttccacgatcattccttcaccatatttcacaaccatagcacacgaaacagacaaaccctactgacagaccacatagtcacgatcacttactcaatcacgaactgcatacgcaatctcacactcactacctcacacagcaccttca

SEQ ID NO: 85989 - DNA, 408 bp, Homo sapiens
  misc_feature (279)..(279): n is a, c, g, or t
tatcatgttgtctttatgagcattgagcacacttagtagaaaggctgccacactgtgtttagccttgtcatcctggaacaagatttttcatcttgaatagtctgataccaagactgaacccatctactgcaaagacctgtgttctgggaacgcaaagaatattctgacccccttttccagtattgagctgaaatcacaaagattttgtggtatagtgataagagctgtaagatttgggtttctattcctgggcactaaccttgggagtacggggacttngggagaggtgtggtgtaggggaaacagggcaaggtcagtggctacacagagtgtggattcttgggatagggcaccatcaaaggggaccacggagctttggtaggaaatacgcattttctagggtttcac

SEQ ID NO: 85990 - DNA, 384 bp, Homo sapiens
gaagaggcaagagagggctgggagtgacagaaacccgctccaccatgactggagcgatgggtacatggatgtgcactttcgtgaaaattcaacaaactgtgcacttagaatgggaggacttggccaggcaatctgtatttccataaaaacaaacttttaaaaaatgataatttgttctcattgttcaattcccacctatgagtgagaacatgcggtgtttggttttttgtccttgcgatagtttgctgagaatgatggtttccagcttcacccatgtccctacaaaggacatgaactcatcattttttatggctgcatagtattccatggtgtatatgtgccacattttcttaatccaatctatcactgttggacatttggctt

SEQ ID NO: 85991 - DNA, 322 bp, Homo sapiens
ctcagctgctgcagatggggtgtctgcgaggtcaagcaagacaggcaggggaccggggaagccccagtgtgcaggggacggggagtcctgggtgccagcccccttgcccctgcctcatttgagcgtctgatatctctgatgtggggcctggtgatagaggcctgggagcctccttgtccccatgctgccctgtgcgtctctcaggcctgccccactggcctagaatctctccctcccgggccttctgcacttctcagcactgtgacgtccttctcccctttcttcaccgggggaactcctacctggcgggaagcaactgggg

SEQ ID NO: 85992 - DNA, 368 bp, Homo sapiens
aatctctaatatataaagagctcctacaaattgatgagactaaatttttatctaatttttaaaaagagcagataatcagtctattgtcaggaaaaaagtacatatggctcttaaaaatgtgaaaaggtgattaacttcatcctaagagaaatgcaaattaaaattgtacttgagatattttcactcatcagattggcaataatcccaaagtttaataacatactctattgaggttgtagggaaaggtcttttcttgtttttttgggtttttttttggtttggtttttttttttttgagaaggagttttgctattgttgcccaggctggagtgcaatggcatgatcttggctcaccgcaacctctgcct

SEQ ID NO: 85993 - DNA, 750 bp, Homo sapiens
ttcatcttttattccgtagcagtagtttcagggggttctccctacagcaagtgaaggttttttttccctatatatactcctgtttcctaggctttgctcctttttcttcattgttggataaaacaagatttgcactactgtctgaaaatagagatttataagaggaaaatatttttaaatctgatcattatagaattaggaggaatctactagccttcaagaacaacatgtattaaccatctcataatatatgaatctactgtggggttaataactaaaggcctaattctagaaatttattttcctgatgatcaattctgctttgaatagaaaagggggggattaaatgaggcataattataaaatatatatgcagaggttagaaaaattttgctgagtcacttgggatgactttgtgccactgctttttatgacacagctagttagtgtgacttaccacaacagagattgataaattataaaatacttgttttcatctctaaattacaatttgtgtgctggtacatatgattaaaatgtccttcatacccaaagtctgtttattgagtgactgataatactgaggataaatgcagagttacatttatttctctcatttgaatgaagtaaaggtatggtaatatcaagactctagatgtaggcagtgaggcatggagaggacactaccttgcaaaggccacacagagattgcaaaatgatgcttagaaaggtcctgctaactctacgagg

SEQ ID NO: 85994 - DNA, 189 bp, Homo sapiens
gatcttactctcttttctgctgcggatagtctatctgccccaataataattgtgctatcacttcatgtttctttcttagttcagattttcatatgcagaagatatgtggttaaatgttggcaaactgacttttactttagtgcttatttgtaaatgatgagttattaaaaataaactaaactgagaagt

SEQ ID NO: 85995 - DNA, 694 bp, Homo sapiens
tgagggcagagatcctgtcttcttttttttatgagggcatactcagggcctaatacagtgagtgcctggcacagagtaggtgctcaataaatacctctgcatgagtgaatgcaagtatcacttaccttattacataaaaatcattttcctacattgatcttacccccacatggtaagcttccagatggcaaggaaaaggaattattttgtatttagagtgcctagcccagggattcaatttttgtaagaataaaagctaaaacataaaaaaaaaaaaaaaaaaaaaaaaaaaaaaaaaaaaaaaaaaaaaaaaaaaaaaaaaaaaaaaaacaaaaaagagagggggggcgccgccacaaaagaattaccccgcgaggggggcccacatacgacgccgcaagccacgacttgtgtctgacacagggggcgccccaaatagaagaggcggttatatattaagcacaaagacggcgaggcggcgcgcggattacaacacgaccgagggcacgagggagagaaaacagatgcgcagcagcagggggaaactctgcggtgaagagagagaaaccccctcacgccgcgggggagggggaaacaaaagagtggcggaccaaccatacctcagcacaagagaatataaagaccccccggggaggaaaacaaaacacaacttgcgaagaggcgatcaaagtgg

SEQ ID NO: 85996 - DNA, 396 bp, Homo sapiens
gactggtgtatgtttccacatcctgtgtttactctgtgctttgtttattggcactgcttagtgcttggtcttgtctaaggataggttttcccaatttagacttaactgtgaccacaaattaaaagcaaatgtaggaaaaaaaattaacttgctagttatgaaagatatacaaattagagcagcattaaggtaatgttttatccctactaaattagtaaagtaaaaaatggtcaaggtctgtgtagatacagcagtgataaaactgaaggctcatttgttgcagagtgtagtataaactggtacagtcctattgaaagagaatataatgcctgtcaagagacaaaaaattgtttataccccttgagttcataatcttatttctgggaaattattcca

SEQ ID NO: 85997 - DNA, 161 bp, Homo sapiens
ggcccccatcacatgagcacaactgtttcctgtgtgtgatgtgttgttctctggctgtgcactgccaaaaaagacatcattaaaaaaaaaatctaaatataatgtaaaacctgccttgtcttaggaaaagtttttctggcagtggctcacacctataatcc

SEQ ID NO: 85998 - DNA, 297 bp, Homo sapiens
  misc_feature (59)..(59): n is a, c, g, or t
  misc_feature (66)..(66): n is a, c, g, or t
  misc_feature (136)..(136): n is a, c, g, or t
  misc_feature (212)..(212): n is a, c, g, or t
  misc_feature (214)..(214): n is a, c, g, or t
gaaacacaggaagcgctgtcagagttcagaggatttttaatgccgatagagtaagagancgtagangttatggctctcacagagcataaacgctggaggtaggtgcacgtgtgtcctcagaggaccagtgtggggncagtcattaggagaatcctgtaaacactgctccttcctcaaaccagggcagttacgccccggtgagaccacctttntntccagtcccaccctgtctgaggctggccttcatagagggtggatgcagacatggatcgcctggcatcagggcaaagttcaaat

SEQ ID NO: 85999 - DNA, 335 bp, Homo sapiens
gtttataatgggggagactgtacatgtatgggaacagggagtatatgggaaatcgctttactttcctcttaattttgctgcaaacctaaaactaccctaagaaaagtatttaagaaagtttgcaagcaaattaacacaataaatttaattcaattactcagcaaaaaaattttttagcacgtattatatgccaggtcctgtactagacagcagtcttcagctgagggcaactttccccaccccccaccctgtcccacaagggtgtggttgacaatgtctagagggtgaggatgctgctaaacaccctgcaaagcacagaacagccacccacagca

SEQ ID NO: 86000 - DNA, 181 bp, Homo sapiens
tccttggcttcccaaagtgttgggattacaggcgtgaggcaccatgcctgtccgacatgttacgttttaagatgcctattcaagatctaagtggagatgttgactaggcacttggatatacaaagctggaattcagacaaggaagtttgggctagagaggaaaagttgggagttatcagta

SEQ ID NO: 86001 - DNA, 765 bp, Homo sapiens
  misc_feature (11)..(11): n is a, c, g, or t
  misc_feature (15)..(15): n is a, c, g, or t
  misc_feature (17)..(17): n is a, c, g, or t
  misc_feature (58)..(58): n is a, c, g, or t
  misc_feature (76)..(76): n is a, c, g, or t
  misc_feature (740)..(740): n is a, c, g, or t
actactggggnacgngnttcttctgggggcccccgtcagcatttccagcagcgatgancacagagagaaaaagaanaggtttactgtttataaagttctggtttcagtgggaagaagtgaatggtttgtcttcaggagatatgcagagtttgataaactttataacactttaaaaaaacagtttcctgctatggccctgaagattcctgccaagagaatatttggtgataattttgatccagattttattaaacaaagacgagcaggactaaacgaattcattcagaacctagttaggtatccagaactttataaccatccagatgtcagagcattccttcaaatggacagtccaaaacaccagtcagatccatctgaagatgaggatgaaagaagttctcagaagctacactctacctcacagaacatcaacctgggaccgtctggaaatcctcatgccaaaccaactgactttgatttcttaaaagttattggaaaaggcagctttggcaaggttcttcttgcaaaacggaaactggatggaaaattttatgctgtcaaagtgttacagaaaaaaatagttctcaacagaaaagagcaaaaacatattatggctgaacgtaatgtgctcttgaaaaatgtgaaacatccgtttttggttggattgcattattccttccaaacaactgaaaagctttattttgttctggattttgttaatggaggggagctttttttcncttacaagggaacggcctttctgga

SEQ ID NO: 86002 - DNA, 2671 bp, Homo sapiens
agccgccagcggccgtgacgcgtcaaggaggaaacgccggcgcccggcggccctgccgggaaggaggaagcgcagtgcgttcggctccgcgcccgccgcgccgggagcagcaccgcggggccagatgaagaaactgaggcatggaaatgttaaagtgctttagcctggattgcacagcaggttgcatgatggaatttgaacattacttcaagaggttttgtattttggattagttaattgggtttgtcctctgctgactgtttcttcggatgcattttttggtgtgctcttgagggattaaatgcaaagagatcacaccatggactacaaggaaagctgcccaagtgtaagcattcccagctccgatgaacacagagagaaaaagaagaggtttactgtttataaagttctggtttcagtgggaagaagtgaatggtttgtcttcaggagatatgcagagtttgataaactttataacactttaaaaaaacagtttcctgctatggccctgaagattcctgccaagagaatatttggtgataattttgatccagattttattaaacaaagacgagcaggactaaacgaattcattcagaacctagttaggtatccagaactttataaccatccagatgtcagagcattccttcaaatggacagtccaaaacaccagtcagatccatctgaagatgaggatgaaagaagttctcagaagctacactctacctcacagaacatcaacctgggaccgtctggaaatcctcatgccaaaccaactgactttgatttcttaaaagttattggaaaaggcagctttggcaaggttcttcttgcaaaacggaaactggatggaaaattttatgctgtcaaagtgttacagaaaaaaatagttctcaacagaaaagagcaaaaacatattatggctgaacgtaatgtgctcttgaaaaatgtgaaacatccgtttttggttggattgcattattccttccaaacaactgaaaagctttattttgttctggattttgttaatggaggggagctttttttccacttacaaagagaacggtcctttcctgagcacagagctaggttttacgctgctgaaattgctagtgcattgggttacttacattccatcaaaatagtatacagagacttgaaaccagaaaatattcttttggattcagtaggacatgttgtcttaacagattttgggctttgtaaagaaggaattgctatttctgacaccactaccacattttgtgggacaccagagtatcttgcacctgaagtaattagaaaacagccctatgacaatactgtagattggtggtgccttggggctgttctgtatgaaatgctgtatggattgcctcctttttattgccgagatgttgctgaaatgtatgacaatatccttcacaaacccctaagtttgaggccaggagtgagtcttacagcctggtccattctggaagaactcctagaaaaagacaggcaaaatcgacttggtgccaaggaagactttcttgaaattcagaatcatcctttttttgaatcactcagctgggctgaccttgtacaaaagaagattccaccaccatttaatcctaatgtggctggaccagatgatatcagaaactttgacacagcatttacagaagaaacagttccatattctgtgtgtgtatcttctgactattctatagtgaatgccagtgtattggaggcagatgatgcattcgttggtttctcttatgcacctccttcagaagacttatttttgtgagcagtttgccattcagaaaccattgagcaaaataagtctatagatgggactgaaacttctatttgtgtgaatatattcaaatatgtataactagtgcctcatttttatatgtaatgatgaaaactatgaaaaaatgtattttcttctatgtgcaagaaaaatagggcatttcaaagagctgttttgattaaaatttatattcttgtttaataagcttatttttaaacaatttaaaagctattattcttagcattaacctatttttaaagaaaccttttttgctattgactgttttttccctctaagtttacactaacatctacccaagatagactgttttttaacagtcaatttcagttcagctaacatatattaatacctttgtaactctttgctatggcttttgttatcacaccaaaactatgcaattggtacatggttgtttaagaagaaaccgtatttttccatgataaatcactgtttgaaatatttggttcatggtatgatcgaaatgtaaaagcataattaacacattggctgctagttaacaattggaataactttattctgcagatcatttaagaagtaacaggccgggcgcggtggctcacgcctgtaatcccagcactttgggaggctgaggcgggcagatcacctgaggtcaggagttggagaccagcctgaccaacatggacaaaccccgtctctactaaaaatacaaaattggcagggtgtggtggcacatgcctataatcccagctacttgggaggctaaggcaggagaatcgcttgaacccgggaggcggaggttgcagtgagccgagatcgcaccattgcactcctgcctgggcaacaagagtgaaactccatctccaaaaa

SEQ ID NO: 86003 - DNA, 1250 bp, Homo sapiens
agccgccagcggccgtgacgcgtcaaggaggaaacgccggcgcccggcggccctgccgggaaggaggaagcgcagtgcgttcggctccgcgcccgccgcgccgggagcagcaccgcggggccagatgaagaaactgaggcatggaaatgttaaagtgctttagcctggattgcacagcaggttgcatgatggaatttgaacattacttcaagaggttttgtattttggattagttaattgggtttgtcctctgctgactgtttcttcggatgcattttttggtgtgctcttgagggattaaatgcaaagagatcacaccatggactacaaggaaagctgcccaagtgtaagcattcccagctccgatgaacacagagagaaaaagaagaggtttactgtttataaagttctggtttcagtgggaagaagtgaatggtttgtcttcaggagatatgcagagtttgataaactttataacactttaaaaaaacagtttcctgctatggccctgaagattcctgccaagagaatatttggtgataattttgatccagattttattaaacaaagacgagcaggactaaacgaattcattcagaacctagttaggtatccagaactttataaccatccagatgtcagagcattccttcaaatggacagtccaaaacaccagtcagatccatctgaagatgaggatgaaagaagttctcagaagctacactctacctcacagaacatcaacctgggaccgtctggaaatcctcatgccaaaccaactgactttgatttcttaaaagttattggaaaaggcagctttggcaaggttcttcttgcaaaacggaaactggatggaaaattttatgctgtcaaagtgttacagaaaaaaatagttctcaacagaaaagagcaaaaacatattatggctgaacgtaatgtgctcttgaaaaatgtgaaacatccgtttttggttggattgcattattccttccaaacaactgaaaagctttattttgttctggattttgttaatggaggggagctttttttccacttacaaagaaagagaatagctctctgttgcatagaggggtcctggagaaatgggttaccccagttgtcttatgtaaatggttacccatccgattttaatgctatcttctctttgagagctttgtaattaagaaccacttaaattactccaaagaaagactttaaaaagggaccagggaaaaggccttaataaatta

SEQ ID NO: 86004 - DNA, 2283 bp, Homo sapiens
  misc_feature (11)..(11): n is a, c, g, or t
  misc_feature (15)..(15): n is a, c, g, or t
  misc_feature (17)..(17): n is a, c, g, or t
  misc_feature (58)..(58): n is a, c, g, or t
  misc_feature (76)..(76): n is a, c, g, or t
actactggggnacgngnttcttctgggggcccccgtcagcatttccagcagcgatgancacagagagaaaaagaanaggtttactgtttataaagttctggtttcagtgggaagaagtgaatggtttgtcttcaggagatatgcagagtttgataaactttataacactttaaaaaaacagtttcctgctatggccctgaagattcctgccaagagaatatttggtgataattttgatccagtccagatgtcagagcattccttcaaatggacagtccaaaacaccagtcagatccatctgaagatgaggatgaaagaagttctcagaagctacactctacctcacagaacatcaacctgggaccgtctggaaatcctcatgccaaaccaactgactttgatttcttaaaagttattggaaaaggcagctttggcaaggttcttcttgcaaaacggaaactggatggaaaattttatgctgtcaaagtgttacagaaaaaaatagttctcaacagaaaagagcaaaaacatattatggctgaacgtaatgtgctcttgaaaaatgtgaaacatccgtttttggttggattgcattattccttccaaacaactgaaaagctttattttgttctggattttgttaatggaggggagctttttttccacttacaaagagaacggtcctttcctgagcacagagctaggttttacgctgctgaaattgctagtgcattgggttacttacattccatcaaaatagtatacagagacttgaaaccagaaaatattcttttggattcagtaggacatgttgtcttaacagattttgggctttgtaaagaaggaattgctatttctgacaccactaccacattttgtgggacaccagagtatcttgcacctgaagtaattagaaaacagccctatgacaatactgtagattggtggtgccttggggctgttctgtatgaaatgctgtatggattgcctcctttttattgccgagatgttgctgaaatgtatgacaatatccttcacaaacccctaagtttgaggccaggagtgagtcttacagcctggtccattctggaagaactcctagaaaaagacaggcaaaatcgacttggtgccaaggaagactttcttgaaattcagaatcatcctttttttgaatcactcagctgggctgaccttgtacaaaagaagattccaccaccatttaatcctaatgtggctggaccagatgatatcagaaactttgacacagcatttacagaagaaacagttccatattctgtgtgtgtatcttctgactattctatagtgaatgccagtgtattggaggcagatgatgcattcgttggtttctcttatgcacctccttcagaagacttatttttgtgagcagtttgccattcagaaaccattgagcaaaataagtctatagatgggactgaaacttctatttgtgtgaatatattcaaatatgtataactagtgcctcatttttatatgtaatgatgaaaactatgaaaaaatgtattttcttctatgtgcaagaaaaatagggcatttcaaagagctgttttgattaaaatttatattcttgtttaataagcttatttttaaacaatttaaaagctattattcttagcattaacctatttttaaagaaaccttttttgctattgactgttttttccctctaagtttacactaacatctacccaagatagactgttttttaacagtcaatttcagttcagctaacatatattaatacctttgtaactctttgctatggcttttgttatcacaccaaaactatgcaattggtacatggttgtttaagaagaaaccgtatttttccatgataaatcactgtttgaaatatttggttcatggtatgatcgaaatgtaaaagcataattaacacattggctgctagttaacaattggaataactttattctgcagatcatttaagaagtaacaggccgggcgcggtggctcacgcctgtaatcccagcactttgggaggctgaggcgggcagatcacctgaggtcaggagttggagaccagcctgaccaacatggacaaaccccgtctctactaaaaatacaaaattggcagggtgtggtggcacatgcctataatcccagctacttgggaggctaaggcaggagaatcgcttgaacccgggaggcggaggttgcagtgagccgagatcgcaccattgcactcctgcctgggcaacaagagtgaaactccatctccaaaaa

SEQ ID NO: 86005 - DNA, 1341 bp, Homo sapiens
ggcagtcatcagctcggtccaatcgatgaaatgccgtatggattgcctcctttttattgccgagatgttgctgaaatgtatgacaatatccttcacaaacccctaagtttgaggccaggagtgagtcttacagcctggtccattctggaagaactcctagaaaaagacaggcaaaatcgacttggtgccaaggaagactttcttgaaattcagaatcatcctttttttgaatcactcagctgggctgaccttgtacaaaagaagattccaccaccatttaatcctaatgtggctggaccagatgatatcagaaactttgacacagcatttacagaagaaacagttccatattctgtgtgtgtatcttctgactattctatagtgaatgccagtgtattggaggcagatgatgcattcgttggtttctcttatgcacctccttcagaagacttatttttgtgagcagtttgccattcagaaaccattgagcaaaataagtctatagatgggactgaaacttctatttgtgtgaatatattcaaatatgtataactagtgcctcatttttatatgtaatgatgaaaactatgaaaaaatgtattttcttctatgtgcaagaaaaatagggcatttcaaagagctgttttgattaaaatttatattcttgtttaataagcttatttttaaacaatttaaaagctattattcttagcattaacctatttttaaagaaaccttttttgctattgactgttttttccctctaagtttacactaacatctacccaagatagactgttttttaacagtcaatttcagttcagctaacatatattaatacctttgtaactctttgctatggcttttgttatcacaccaaaactatgcaattggtacatggttgtttaagaagaaaccgtatttttccatgataaatcactgtttgaaatatttggttcatggtatgatcgaaatgtaaaagcataattaacacattggctgctagttaacaattggaataactttattctgcagatcatttaagaagtaacaggccgggcgcggtggctcacgcctgtaatcccagcactttgggaggctgaggcgggcagatcacctgaggtcaggagttggagaccagcctgaccaacatggacaaaccccgtctctactaaaaatacaaaattggcagggtgtggtggcacatgcctataatcccagctacttgggaggctaaggcaggagaatcgcttgaacccgggaggcggaggttgcagtgagccgagatcgcaccattgcactcctgcctgggcaacaagagtgaaactccatctccaaaaa

SEQ ID NO: 86006 - DNA, 363 bp, Homo sapiens
agccgccagcggccgtgacgcgtcaaggaggaaacgccggcgcccggcggccctgccgggaaggaggaagcgcagtgcgttcggctccgcgcccgccgcgccgggagcagcaccgcggggccagatgaagaaactgaggcatggaaatgttaaagtgctttagcctggattgcacagcaggtgagaggcagagcttgaatggagggcaggtgtgtggacagtgcctggcacgtgcaggcctgtaataaacatctgtggaatgaatgactccaaatggcttcagatatcttgctctttcaaaacatgtctctcaaaataccgtagtaattgatttatgcctgagagatttccaggcctaatcca

SEQ ID NO: 86007 - DNA, 466 bp, Homo sapiens
  misc_feature (304)..(304): n is a, c, g, or t
gtgattgtgccactgcattccagcttgggcgacagagaaagatcctgtctcaaaaaaacaaaaaaattatttaaggggaaaacatgaataatgaccaaatgaacttctaaaataatctttgaaagactttccccacaaatacctacatcacctattgggaattatagattctaccttcgcgatactcttatttattttaactgtatcacagtttccaaggagaaatgcagaatacatgtattgtgaagtgttctagttgacattagctaagaaccactggtgtagaatgagaatatccaacccnactggaaatctagataatttggtttcagtatgatagcaaaaactaaaatttgttaaatctctcaattatttataaattttgtcttgatttgtttactgactgcctctaatattttattgttttctatagtatcttgcacctgaagtaattagaaaacagccc

SEQ ID NO: 86008 - DNA, 252 bp, Homo sapiens
  misc_feature (35)..(35): n is a, c, g, or t
  misc_feature (53)..(53): n is a, c, g, or t
  misc_feature (71)..(71): n is a, c, g, or t
tacccttactgagaatcaggactttgggtttcttntaacatggcaacaaaccnaaatatttgtggtacagnttataaatactttatttcaaaacattaattaatttttgaagctccaataagaatgttgtttttctttccccaccttcacagctacactctacctcacagaacatcaacctgggaccgtctggaaatcctcagtatgtttaatttgcttcaaacaattttttaactgaattttaggaagatc

SEQ ID NO: 86009 - DNA, 938 bp, Homo sapiens
agccgccagcggccgtgacgcgtcaaggaggaaacgccggcgcccggcggccctgccgggaaggaggaagcgcagtgcgttcggctccgcgcccgccgcgccgggagcagcaccgcggggccaggttgcatgatggaatttgaacattacttcaagaggttttgtattttggattagttaattgggtttgtcctctgctgactgtttcttcggatgcattttttggtgtgctcttgagggattaaatgcaaagagatcacaccatggactacaaggaaagctgcccaagtgtaagcattcccagctccgatgaacacagagagaaaaagaagaggtttactgtttataaagttctggtttcagtgggaagaagtgaatggtttgtcttcaggagatatgcagagtttgataaactttataacactttaaaaaaacagtttcctgctatggccctgaagattcctgccaagagaatatttggtgataattttgatccagattttattaaacaaagacgagcaggactaaacgaattcattcagaacctagttaggtatccagaactttataaccatccagatgtcagagcattccttcaaatggacagtccaaaacaccagtcagatccatctgaagatgaggatgaaagaagttctcagaagatggaatctctctgttgcccatgctggaatgcaatggctcaatctcggctcactgcaacctccccctcctggtttcaagtgattctcctgcctcagcctcccaagtagctgggactacaggcgcacgccaccacgccaagctaatttttgtatttttagtagagacggggtttcaccatattggccaggctggtctcgaactcttgacctcgtgatccacccgcctcggcctcccaaagtgctgggattacaggtgtgagccaccacgcctggcct

SEQ ID NO: 86010 - DNA, 2000 bp, Homo sapiens
agccgccagcggccgtgacgcgtcaaggaggaaacgccggcgcccggcggccctgccgggaaggaggaagcgcagtgcgttcggctccgcgcccgccgcgccgggagcagcaccgcggggccagatgaagaaactgaggcatggaaatgttaaagtgctttagcctggattgcacagcaggttgcatgatggaatttgaacattacttcaagaggttttgtattttggattagttaattgggtttgtcctctgctgactgtttcttcggatgcattttttggtgtgctcttgagggattaaatgcaaagagatcacaccatggactacaaggaaagctgcccaagtgtaagcattcccagctccgatgaacacagagagaaaaagaagaggtttactgtttataaagttctggtttcagtgggaagaagtgaatggtttgtcttcaggagatatgcagagtttgataaactttataacactttaaaaaaacagtttcctgctatggccctgaagattcctgccaagagaatatttggtgataattttgatccagattttattaaacaaagacgagcaggactaaacgaattcattcagaacctagttaggtatccagaactttataaccatccagatgtcagagcattccttcaaatggacagtccaaaacaccagtcagatccatctgaagatgaggatgaaagaagttctcagaagctacactctacctcacagaacatcaacctgggaccgtctggaaatcctcatgccaaaccaactgactttgatttcttaaaagttattggaaaaggcagctttggcaaggttcttcttgcaaaacggaaactggatggaaaattttatgctgtcaaagtgttacagaaaaaaatagttctcaacagaaaagagcaaaaacatattatggctgaacgtaatgtgctcttgaaaaatgtgaaacatccgtttttggttggattgcattattccttccaaacaactgaaaagctttattttgttctggattttgttaatggaggggagctttttttccacttacaaagagaacggtcctttcctgagcacagagctaggttttacgctgctgaaattgctagtgcattgggttacttacattccatcaaaatagtatacagagacttgaaaccagaaaatattcttttggattcagtaggacatgttgtcttaacagattttgggctttgtaaagaaggaattgctatttctgacaccactaccacattttgtgggacaccagagtatcttgcacctgaagtaattagaaaacagccctatgacaatactgtagattggtggtgccttggggctgttctgtatgaaatgctgtatggattgcctcctttttattgccgagatgttgctgaaatgtatgacaatatccttcacaaacccctaagtttgaggccaggagtgagtcttacagcctggtccattctggaagaactcctagaaaaagacaggcaaaatcgacttggtgccaaggaagactttcttgaaattcagaatcatcctttttttgaatcactcagctgggctgaccttgtacaaaagaagattccaccaccatttaatcctaatgtggctggaccagatgatatcagaaactttgacacagcatttacagaagaaacagttccatattctgtgtgtgtatcttctgactattctatagtgaatgccagtgtattggaggcagatgatgcattcgttggtttctcttatgcacctccttcagaagacttatttttgtgagcagtttgccattcagaaaccattgagcaaaataagtctatagatgggactgaaacttctatttgtgtgaatatattcaaatatgtataactagtgcctcatttttatatgtaatgatgaaaactatgaaaaaatgtattttcttctatgtgcaagaaaaatagggcatttcaaagagctgttttgattaaaatttatattcttgttt

SEQ ID NO: 86011 - DNA, 2485 bp, Homo sapiens
ggcgccgctgggagctggtggcgcggcgcaggtcccggccgagtgtggcgcagcagtggcggcgcttcccattcgccatgcgccgggggtgggtgcccgaaggttgcatgatggaatttgaacattacttcaagaggttttgtattttggattagttaattgggtttgtcctctgctgactgtttcttcggatgcattttttggtgtgctcttgagggattaaatgcaaagagatcacaccatggactacaaggaaagctgcccaagtgtaagcattcccagctccgatgaacacagagagaaaaagaagaggtttactgtttataaagttctggtttcagtgggaagaagtgaatggtttgtcttcaggagatatgcagagtttgataaactttataacactttaaaaaaacagtttcctgctatggccctgaagattcctgccaagagaatatttggtgataattttgatccagattttattaaacaaagacgagcaggactaaacgaattcattcagaacctagttaggtatccagaactttataaccatccagatgtcagagcattccttcaaatggacagtccaaaacaccagtcagatccatctgaagatgaggatgaaagaagttctcagaaggttcttcttgcaaaacggaaactggatggaaaattttatgctgtcaaagtgttacagaaaaaaatagttctcaacagaaaagagcaaaaacatattatggctgaacgtaatgtgctcttgaaaaatgtgaaacatccgtttttggttggattgcattattccttccaaacaactgaaaagctttattttgttctggattttgttaatggaggggagctttttttccacttacaaagagaacggtcctttcctgagcacagagctaggttttacgctgctgaaattgctagtgcattgggttacttacattccatcaaaatagtatacagagacttgaaaccagaaaatattcttttggattcagtaggacatgttgtcttaacagattttgggctttgtaaagaaggaattgctatttctgacaccactaccacattttgtgggacaccagagtatcttgcacctgaagtaattagaaaacagccctatgacaatactgtagattggtggtgccttggggctgttctgtatgaaatgctgtatggattgcctcctttttattgccgagatgttgctgaaatgtatgacaatatccttcacaaacccctaagtttgaggccaggagtgagtcttacagcctggtccattctggaagaactcctagaaaaagacaggcaaaatcgacttggtgccaaggaagactttcttgaaattcagaatcatcctttttttgaatcactcagctgggctgaccttgtacaaaagaagattccaccaccatttaatcctaatgtggctggaccagatgatatcagaaactttgacacagcatttacagaagaaacagttccatattctgtgtgtgtatcttctgactattctatagtgaatgccagtgtattggaggcagatgatgcattcgttggtttctcttatgcacctccttcagaagacttatttttgtgagcagtttgccattcagaaaccattgagcaaaataagtctatagatgggactgaaacttctatttgtgtgaatatattcaaatatgtataactagtgcctcatttttatatgtaatgatgaaaactatgaaaaaatgtattttcttctatgtgcaagaaaaatagggcatttcaaagagctgttttgattaaaatttatattcttgtttaataagcttatttttaaacaatttaaaagctattattcttagcattaacctatttttaaagaaaccttttttgctattgactgttttttccctctaagtttacactaacatctacccaagatagactgttttttaacagtcaatttcagttcagctaacatatattaatacctttgtaactctttgctatggcttttgttatcacaccaaaactatgcaattggtacatggttgtttaagaagaaaccgtatttttccatgataaatcactgtttgaaatatttggttcatggtatgatcgaaatgtaaaagcataattaacacattggctgctagttaacaattggaataactttattctgcagatcatttaagaagtaacaggccgggcgcggtggctcacgcctgtaatcccagcactttgggaggctgaggcgggcagatcacctgaggtcaggagttggagaccagcctgaccaacatggacaaaccccgtctctactaaaaatacaaaattggcagggtgtggtggcacatgcctataatcccagctacttgggaggctaaggcaggagaatcgcttgaacccgggaggcggaggttgcagtgagccgagatcgcaccattgcactcctgcctgggcaacaagagtgaaactccatctccaaaaa

SEQ ID NO: 86012 - DNA, 483 bp, Homo sapiens
cagcaggaagatcaggtggagaaggggttactgcagggagccaggagggagcagacaggaattgagattagggtagggggcttctgactgttttgaagagaatctaaaatgaacactgaaaaacccacatgcattatttttaagaatctaagtttatccctccctctcaaaagattccctctgtacttctgtaggaacagggtgcacaggaccacacaggatgagacatcaaattccatgtcatatcataggcttctcaaagtgaaaaaattaaaaattagaggaagacggccaagtgctggtggctgacacctgtaatctagcactttgagaggctgaggcggaagaatcacttgaacccaggagatcaagactaggctgagggatatagccaagacctgtctctacaaaaaatagaacaaaaaagttagctgggtatagtggtgtgcggctgtagtcccagctactctgagactacagtgg

SEQ ID NO: 86013 - DNA, 518 bp, Homo sapiens
gaaagctgtggactctgcaccaggcaacagtcagctgatactgaggaactaccaggggttcttcctggtatcagtgaggtaccagatgtctaatctccaggtcccatacatgcattcttttgggttctttgcatgaacatgggtaattcacatattttctgagcggtacaaatgccttttggctacttcctcttttatgccagtagtttgtggacacaatccctttttgttttttattttatggcttagagataatctctcccttattagtcaggattatttctgtctctggaatctggattgtaccataaaaatactgtatttgcctccttttgtggcaagaagggctagatgttttccccctcaagctctggaaggttactttttatagttgtcatgatgtacaaatgtttcatcaaatgtgggatgatgatttgatagtgaggaaactgtggtactgattgcaaaagctcctggggcttgtgggattcatagacgtaggcagtgtctctggacaa

SEQ ID NO: 86014 - DNA, 263 bp, Homo sapiens
cttggggtcattggctgggtacacttggattcccaggccctgcctgctctaaaagctcacctttcaccagcacatggcttcagggaactgggggtggagcagggagggttattccaagtcactatttccactggggtatgaattgaatgagagctgaagaagaggtaccattcatgagcacttcttgggtgccggcatggttctaagaccagtacaatgtatcctcctcacagtatggtgaggtgggcaccgctggcaccctc

SEQ ID NO: 86015 - DNA, 185 bp, Homo sapiens
gatcattggtttattttgtagtccacctttcaatcacttcatgtatataaaaagggactttgaatgtaatagtcttcatcttatttattgaaaagatgtactaaaggaatgactattttttaaaaaaactctagtatttatcaatatgactctaagggaaaaatcaagaaaattagaggaaggtt

SEQ ID NO: 86016 - DNA, 267 bp, Homo sapiens
ttttgtattttcagtagagatgggatttcaccatgttggccaggctggtctcgaactactgacctcaggtgatccacccgcctgggcctcccagagtgctgggattacaggtgtgagcccctgtgcccagcctgatttttcttttcttcattccttttcatgattttttcaccagtttccatcaattttgtggcttatgatagatttcagtggatgtggatataattttccttacatactttttcccagtttcagataaggtgtata

SEQ ID NO: 86017 - DNA, 561 bp, Homo sapiens
tgggccatggttttgttgttgctgctattgtttactttattttattttttctttgcatctactttttaaattgagatatacttaaccataaaattcatccttttaacatgtacagttcagtagtttttagtgtattcacaaagttgtgcaatcagtattatccagaatactttcattgtatgcaattgtctacctgatcagcaggtattccacattaacccctcctaaggtctttgataaatttttgtatatggagtgaggggtccaggttcattcttgcatatgagtatccagttgtcccaggacccctcctgttttgtttgttttattcaatttatttggtcattcaccaaatatgttttgaatacctactatgtatttctaagacactaatataatccatagttatatcatttgtgatccttacctagtttacaaggaaaaaaatgtgagaattaatgagaacaaatatataccaagatttcactaacattgtttttgggccattgtctaccctcttcagagaaatattaaatcctcctgtcctggcaaaaaaaaaaa

SEQ ID NO: 86018 - DNA, 393 bp, Homo sapiens
cgcaccagcatggcacatgtatacatatgtaactaacctgcacaatgtgcacatgtaccctaaaacttaaagtataataaaaaaaaaggcagttcacatttatagatgggtgaagataaaaatgggcattttacagagttatctacatgacaattaaagaaataagaatagtgatgtctttcaaaagctatttaatttatccccctacttttagacagattttttccccaaattatctttagactgttgagtatccacattagtataaacatctgctaagaaggaaattactcaaactcccctggtattctattcctgtattaacaaccctacttccaagaagctggtctttggtcatcacattgtaattagttaccagccagcatgtctatc

SEQ ID NO: 86019 - DNA, 446 bp, Homo sapiens
tttttttatatatgttttcttgaggagttttaaggttttatgtcttacatttaagtgtttcattttgagttaatttcggggtatggtataagaaaatattctacttttattctttcacttgtggatacccagtttttctggtaccatgtatcaacaagactgtattttctgcattgtatattcttggtggccttttcaaagattagtttaccttgtattctggttttgtttctgggctccctattctgttccattggcttttgtatctgtttttatgcacatacaatactcttgattactataacctttaaataaaatttgaaattaaagagtatgatgccccagcattgttctttctcaagattgctcaggttatttaaagttctttaagcttacacttaaattttacaattgtgttttctattactgtgaaaaatgcccctaaa

SEQ ID NO: 86020 - DNA, 690 bp, Homo sapiens
cagggtgatcataattaccacatcaaattttaaggactcagtgtgggtttgagctagctttttaatgctgtgaattgtgcaactgaagttgttggatttataactttattgaggaattaatttgattctgagtgagaaagcactaagaggaaaaaagtgctacttggctaaagtttgtatatggcatgattgtgaccacataggtaacaggttcatgtctaaattgatggatggctgcagtggccttgtggaaaagacgctgtcttggggatccggagacctggatttgaatcctaattcccgccccatcttcagatttgagctcgtggctttctttctatggccttgttcttcatctgcaaaacaagagtgaattagaggcaagattcttttcacttctgggattgaaagaaccagcatttgtgaagtgtttatataggaactacagtggatacattctgtttaaagatttatgatcagctgcttgttctctcctatctcttttggcgaacttgatggcatttttgcttagcagattgtacattatgtttttataacgtcttttcttcaccctcatatgtgtcctctttacaattaagatgagtttatttatacaacagtcatatgtgaagttgatttggtggatatggttttcttctctctgccagccctaaccagcaccttcttgct

SEQ ID NO: 86021 - DNA, 414 bp, Homo sapiens
tatttgaatatgcagacattagagaatgtaagacagtttatgacagattatttttcgggaactggttacagaattaggatgaggatttatgcataattgatatttgtctctattggtcttcacagatataagtgcacatatggaggattttgagacattggtgacccaaagcaattgtctttaactttttttgacttccagttcttagtgaaggcatttcagccagtggagaaaagaaattgtgtgccaatgctaagtcattcacttcttgtgttggtgtaactaaaggtttttaaacattatgattactggtattcatttgcttttttcagcttccttgaatttctaaaacagtgatttctaaatgctttagaataattatatattattatcatgcataatatcatgcccata

SEQ ID NO: 86022 - DNA, 444 bp, Homo sapiens
tcccaaaggcaaatggccttcaaacaaccccagactttcttgcaagagcatgacttttctggcaagagcaaggccatgagccctgcctgggacctggcactattctgagtgttgggggcataatggggaaaaagtggcagccacattaagattcatgaccaaggccgggtgtggtggctcacacctgcaatcctagcactttgagagactgaggcaggcagatcacttgaggccaggacaacatggcaaacttggtctctacaaaaaatgcaaaaattagccgggcgagatggcatgtgcctgtaatctcagctactcaggaggctgaagcaaggagattgcttgagcccagggaagtcaaggctacagtgagccataatcgtgccactgcactgcagcctgggtgagagagtgacagtgacagaccctgtctggggaaaaaaa

SEQ ID NO: 86023 - DNA, 418 bp, Homo sapiens
gatacacacacacggataattatttgatgctttaattgccttttgcaaagtttgttcctgtttggaatgctttgttctttgcctctaagactatctgtgggtttttcttgcttagaggaattgctctcatgtggtgtctgggtggccaatctggccctgctatttattagtatctactaagtgggctgccattttaaactgatcttctagtctgtcttcttgttctttactttgcttactttttgtccactcacatagctgggtacataacatgtattttgaaatcttgtggtcatccacctgtatgtgtaatgagtccccagcatggctaggttgtagcaagatctatgtggatgctggggatcatctgtatcactacactttttcttcagcaccttaacagtgactggttgatagg

SEQ ID NO: 86024 - DNA, 480 bp, Homo sapiens
ctgatgattagtatgtaagtgaatggagagaactgtggggttatgtgaagacatttgctagaagccatagttgacaatcgagttggaagagttgggatggtagtggtgatgggtagcagctgccatgaccaatggtccactctgggcaagggtcagccctgcatgtgttagcagttcagtgtttagaaatgatacgtggtatctggagtttggtgtctggatctatggcctatgctagtatatttaacgtaggaaacctattcaggggatgaatttagatccctttgtgtcatctagaaggaaatgttgtggcttacaatattgtatgtggttattaatctttttattgaaaaattattgtatattcagaaataagatttaaattactaaattaaatggagttaaacaagcaggcccccatcatctgtgtctgctcctcatggtttgctggggtaatggttttttaacagtttggtatga

SEQ ID NO: 86025 - DNA, 350 bp, Homo sapiens
ggggtctggctgtttgggaggtagactagggactgagcaggggtccaggctctggagtcgcacaggtttgagtttgagctctgtgtcttaccttactagctgcgtgaccttaggcagaggcaagcttttctgggcctcagtttcctcatctgtaaagaagtctgtagtaacaaactctttgagatgtggaaatctatgagataatatctgtcaagtgctcaatatagcatctgtaaacagtaggtgctcttgaagcacttagagaaaacacctgggcagccaaggagcctggctgagtctaggggcgcggaatggaggactctgagaaccctggagtgggcatgaagggg

SEQ ID NO: 86026 - DNA, 107 bp, Homo sapiens
taaatattaggttcaaggtgatgtttacagttttatattttgaaaaatgtatgtgctcatatgagaaggaattataggaaaaggttagtgattaattttgagaatat

SEQ ID NO: 86027 - DNA, 979 bp, Homo sapiens
  misc_feature (619)..(619): n is a, c, g, or t
  misc_feature (881)..(881): n is a, c, g, or t
agctgacacaacagacatatccgctggttccggttacacaattctgactgaaaaattaaagctgatcaaactttacactcaatgggtgccaaaaccattccacccagatcagctgcagacaagagcagagccttcaacggaaattttaaataagtgagatcaagatcctgaagcatttatttgaagaattgtagcaggagatgaaacatggctttaccagtatgatcctgaagacaaagcacaatcaaagcaatggctatcaagaggtggaagtggtctagtcaaagcaaaagcagatcagtcaaatgtgaaagttcatggcaacaggttttttgtttgtttggttttggttttggtttgtttgttttgagatggagtctccttctgccacccaggctggagtacaatggtgcaatctcggcttactgcaacctccccatcccaggttcaaatgattctcctgccacagcctctggagtagctgggattacaggcatccaccaccatgcccagctaatttttgtatttttagtagacacgaggttttaccatgttggtcaagctggtcttgaactcctgacctcatgatccacctgcctcagtctcccaaagtgctggnattagagcatgagccactgtgcctggccatggtaacagttttttgggatgctcaaagcattttgcttgctgactttccagaaagccaaagaacaataatatcaacttattatgagagtattttgagaaagccaaagctttagcagaaaagcacccaggagagcttcaccagagagttctccaccatgacaatgctcctgctcatttctgtcatcaaaaaagaattttgtgagagtttcaatgggaaattattaggcatccancttaccatcctgatttagcttcttctgacttcttttttgttgcctaatcttagaaaatatttgagaggcatccattttcctcagttaataaggtggaa

SEQ ID NO: 86028 - DNA, 255 bp, Homo sapiens
gttccaggtttacatccttgcccacagggattgaaaaaggaatagaagagcatggtcctggtgctggtgctgcaggccagatggggaggagggcaggatactgcaagcggagccggacttggggaagggaagggctgcagaaagctccaagtaccgaaggggaaagcgcagcggattcgtgtctggcaagagcaggtggggtagagcagaaggtcgacgcagagcagaaggtcgacgcagagcagaaggtcgacg

SEQ ID NO: 86029 - DNA, 430 bp, Homo sapiens
ttgcattgaatctgtagattgcttttggtggtgtggacattttttaaatattgatttttccaatccattaatacaggatatctttccatttatctgtgttttgatttctttcatcagtgttatatagttttcagtgtacagatattttacctccttggttaaatttattcctattttaattttgttgatgttattataaatgggatttttttttaaatttctttttcagatagtttgttgttgtgctgggattatagacgtgagccaccacagctgggccagctttattcattttgctcaatattgctttgggtatttggaggttttttgtggttccctatgaattttatgattgatttttctatttctgtgaaaaatgtccttggaattttggtagggattgccttgaatctgtagattgcggtgtttg

SEQ ID NO: 86030 - DNA, 804 bp, Homo sapiens
ttcctactcaataaactcctttgataacatccttaatagatggtttcatggcaaccctcacctccaccatgaatgatctgtgtctgagattcattacatcagaaaataatctcattttattgtcatatatgtgaggatgtcttccttaaacttggttctatttgccaagacttctatctactcattggtacaggcccctaatctcttatctgaaatccttggggctgcacgtcttacaacttaatttttcaggttttagatagggcacacatactgtgtgttttatactctccccagtggggtccagggaagcactccatcatcaaacacatttgtattttcgcagtgaagcatataaatattcacaattagtgggctaacgagtatatataaataacttcacattaattaaagttggattttgccaccaaatttaccaaaaaaaaaaaaaaatcaactttcacatatctttcaattccaaatttacaaataaagaactgtggacatatattattttgtcctcagtgaatacacaagtaagtccacttcctcttccatgctagcagtccttccactattggaagacagctcttacacttctcccttatccactgtgcctccacacgtcatacttctaaattatcaactgacaaattaacctagtgtaatcaaagagggctagagtagggctctactgctcatccagagcagctttctttctttatttaaagttcaaatgtagaataatacagggcactggaggagcaggctacagcactggcactccatcctagaaaagaggag

SEQ ID NO: 86031 - DNA, 746 bp, Homo sapiens
cgagatcgcgccactgcactccagcctgggcgacagagcgagaccccatctcaaaaaaaaaaaaaagaaaacaatttggttttcatcctatttcctaggacagagttcctaaaaacccttgtaatctctagagcaataagagcgtcttttgtgtgctcatgagatggttggtgtctggaagcccctagagagactcagaatgggggctggttcagaaagacccaggcaagatcagaggattgggacttaaatcagccatgcctgtgatggagcctccttaaaaacccaaaggactggcttgaggagctcgtggatagctggacgtgtggtggttcccggagggtggcatgccaggagagggcatggaatctctgcaccccttcccagcataccttggcctgtccatctcttcatctggctattttatctgtgtacttcgtaatgaccttggtgataaaccagtaaacatgtttccctgagttctgtgagttgttccagcaaattaatcaaactcaaggagagggtagtaggagccctgattttagccagtcagaagtataattgacagccttttaacttgggattggcatctgaagtgggaggcagtttagtgggacctcctgtggaatctccaacctgtggaatctccaggtagatagtatcagaagcaagttgtaggatacccagctggtgtccactggggaattgcttggtgtttgtggaaaatatcccccacacatctggtg

SEQ ID NO: 86032 - DNA, 809 bp, Homo sapiens
gtagcatcctgctaaatttggttgaatggaattttgtgttttcagagaagtagggggttggagggagctgtccctataaacatacagaaatactgtcatatactaaaaagagcagttttggagccaaatgacctagggtacccaactaccagttatcctctctgaactgcacttttcctatctacataatggaatggtattttcttcctctcaggagtgttgttgagaaataatgtatgtaatagatactcagtgccttagttcactttgtgctgttataacaaaacctcagattgggtatggtttttgtgggttggttggttggttggttttttgagacagggtctggctctgttgcccaggctagagtgcagtggcacgatctcgactcattgcaacctttgcacctttgctttctggctcaagccatcctccaacctcagcctcctgggtagctgggaccacaggcttgcaccaccacacctgctaattttgtatttttttgtagagacagggtctgactttgttgcccaggctggtctcaaactcctaggatcacgaggtcaggaaatcaagaccattctggctaacagggtgaaacccggtctctactaaaaatacaaaaaaaaaaattaggcgtggtagcgggcgcctgtagtcctagctactcaggagtgttgggaacaagccccccaaaatctggccataaactggccccaaaactggccacaaacaaaatctctgcagcactgtgacatgttatgatggtcacaacacccacgctggaaggttgtggatttactggaatg

SEQ ID NO: 86033 - DNA, 711 bp, Homo sapiens
gcattaatcattcatgatggcagagctctcataacctaatcatctcttaaagtttccacctcttaacactgttgcattggggattatttctaacacacgaactttgggggacatattcaaaccatagcactcagaaaatgttacttcccttcccagccacctttcagattgtttcatgggaaatgttttcagatttcacataaccaggaaagacatgatcattgtctggaaagattcttagttgggaactgcttgtattaacatctctcagccttgggtatattcttgtcgtggagaaacactctagtagggcacaagtggttgtaaaatcagtttagtaaattatgaccagcttttctttttaatgaaataacaaattagaaaataccacatgtggggccgggcgcagtggctcacgcctgtaatcccagcatgttgggaggccgaggcgggtggatcacgaggtcaggaaatcaagaccattctggctaacagggtgaaacccggtctctactaaaaatacaaaaaaaaaaattaggcgtggtagcgggcgcctgtagtcctagctactcaggagtgttgggaacaagccccccaaaatctggccataaactggccccaaaactggccacaaacaaaatctctgcagcactgtgacatgttatgatggtcacaacacccacgctggaaggttgtggatttactggaatg

SEQ ID NO: 86034 - DNA, 368 bp, Homo sapiens
aacatgcctgcagtgttcccttcctaaaccaactttgccattttctcaggcagacacacaaacatgcaagcgtccacagtaatgtgcgtgtgtgagggatgggggaagagtgattgttgctttgtagtagctcctttgaagtgtttaattcctcccttgtaatctcttcatcaacacacatttaaagcatatcagttttacctcagcaatttgattctcagaggcttatgtggctcagggcctctgtccagcacctgggtggcacagtttgttttatgtgcatgcagaagtgttaacagaattaatttttttccttctttctctctttcttcttcccccacctcccccaatttaggttaatgagccca

SEQ ID NO: 86035 - DNA, 860 bp, Homo sapiens
ttttatttagctcatatccaaaatattgcaaaatgtagtcaatatggaacttactaatgagaatttttgcattcttttctttatattgtttttgaaatatagctgatctcaagtcagctttgaatatagctgatctcaaactagtcacattttaaatgcacagtgactatatgtggaaaatttttagagtgtgagttgacaaatgtcttctgtacaaaaggctgttgaatatttaaagctttgcataccatatgggtttggtcacgaccactccactgtgctggtaaagcatgaaaatggttattagatgatgcataaatattgctatgttccagtaaaactttacttatgggtgctgaaataggaatttcaaataattttcatgtgtttgaattttatttttttgaaccatttaaaaatattaaaactattcttagctagtttgtacaaaaataggtaagacgcaggcttaacccatgtacttggccagacagaaataatagataggatagaatgaaaacaaaaagacagggttatgtagttgattggagagttcctagagtacaaggagttgagggagaatccataggggggtaaattgggaataaagccaggtgacctacagatggctagaagaggaataaacaaacaaaaaggggcctatgcagttcaggctttgggggttgagttgtagtaaccatgtaagagctcccccagctactaataaaagacctggtttggagatttgaccctatagtatgtagtttaggcaataattctgataccacataatgaacaagtgagtgcaagagaaactctcatgtaagataatgtttcaaacaaaaatgacagtacaaaga

SEQ ID NO: 86036 - DNA, 841 bp, Homo sapiens
agaccctccagccattccccttgaaaacaccccccgaccccaagccacaataatgacagcgagagctccaattaactaagcacctacctgggggcagaataacccttcactgcctgatccccatctgcagtgtggcccaacagcccccagaactatgcccacatagactggaggtaggcagttcaccgtccctccctgttaggaatgagaccatccctgaggctatggcccaggcccacaggcgtccagtgtctgagatctttgggaagggagactagggcaggtggagacagcgcagaacccccgtgctgggtgggaagcatgaccacatggtgggtgagcagcccccatgcactgacggtaaattcccctgtggactcatttctgttggtttctattacacctggccaggcgtggtacaatacaggtcggtgctcacaatctttccagcattccactttcacagggcaggatggtggcccccggttccccagtgaggaaagtgagtctcagggggcagcctgactgcagaaagtgctgcgacaggggccctgatggacaggacccgcggcggacagtcctcgaatcctggagttttctctgctcaaccctgctgggctgctgagactccagtctgagtggggaggtggggggagactctggattcagccccatcactgcccaggggaaatcccctactataatccactttctaactccatttcttcatttcacaaaacacaaaaacccctgtcctcctagagctgacattctaggtaagaagacaaacacctatatgatacacagtgtaatacaataaatatatatatgatacatacac

SEQ ID NO: 86037 - DNA, 426 bp, Homo sapiens
atctcatgtaccccataaatatattcacctactatgtacccgcaaaagactgtgtccttggcccagctctatgcccctcccaagagtgaaggtgatgaaggcatccctaggtgctgacctcagacataccacacttctacagagtgtacagtgaaattcccaagaggaagacagtcaaggtcagggatccacgaaatgatgctcccaaaacctttgcagccccaaggagcatgaggagttatcagtggagcaattgagctgcaaactcagccctcttatttgggcttttaggaagtctttactgtcaggtggatgttttcaaccaaacaaaacaggctcccattcctgctgtgcactggataagttccgaaaggttaacattattaacactctttctttctcttcatgcttttccaagtcttttta

SEQ ID NO: 86038 - DNA, 279 bp, Homo sapiens
atatgatggttttaaataaatatgataagagatgaagagagttttaagtaatagaactattctaagttttggatgtttggtttagtgtctctagctatatttctgtttaatgtcaaggcataatatattcgaaccattttatttattaaatttaataaacattgattgtcctattagtcaaagtttcagaaaaatgcaaaaagtcttgttctcaaaggaatgctccctggaccatgcacatcaaagtcgtgggtggctgcttgtgggggtagaaaatat

SEQ ID NO: 86039 - DNA, 469 bp, Homo sapiens
ctcactatttgccccctgtattagtccaatttcacacatctataaaaaaactacctgaaactgggtaatttacaagcaaaggaggtttaattgactcacagttctgcatggctggagaggactcagggaacgtacaatcatggtggaaggtgagggggaagcaaggcacttcttacatggtggcaggagaagagagagagcacagagaaaacggccacttttaaaccatcagatctcatgagaaaactcttattatcacaaggacagtttgggggaaaccaccggcatcagccaatcacctcctaccagcctctccctagacacatgaggattacaattggagatgaagtttgggtgaggacacagagccaagccatgttacccccaaaccctttatgaataattctatataacctggaaaaacccctgaatgtctcaccatttcctcagcttagtctaagaacctgcc

SEQ ID NO: 86040 - DNA, 1982 bp, Homo sapiens
gccacaaggaggggaaggaaggtagagggagggaacactttcgaaggccccggccggatgcaggtcctggattaatgagccttggatatgtgtggcacttccgtaatgggggcacaattcaaacgcctaatgggtccagataggaaccctgaatgagtgaaatcggtgaagtctaagaggaacaacaaaacaagtgtgaagataaataacaatggacaatccacctatcgtcggaagacaaaagggaatggcgggggctgtggacagagcaagtggatgttccaactaaaggaagtagcctctgctcagggccagccttggttttgactcccagtagctgccatgcaggaggtggggcccaaggtggctagatccttggattttctaagcaaagtcagaaatccctatttttatgtgcaatccccggtttttcaacactggcatctaatcaaaatattttttcaaataccgtgtgggccaaacaaaatatctgcgggcgaaatgcagcccatggagcaccagttggccgctccttttccaagtgctgaagcagaccacaactcaatccagttggggagagggtgctttcatcaagtttgggtcaattcttttttgggcatttaataaagctgagaattcaaaagacaccatcaacttccagaaatctataagaaccggctgcggaacatttcaaaggcgtcctccacgtcatcagcttatgcaacagaacctctactttgcccagagttttggaaattaacaacgagggagtgtcctttcagctttcctgggatagtggaactaacaggcttcagatgaaacctatttgttggtttgcagacagcctgggacttaagtccaaactgctcgcaacagacagtcctgccataaaaccaagttggggtgctcaaggctcatcataaaatgaccagagaatccacttcggctgccttgccagagatctgattttatgactgtttaaagggatgagacagatgtcatccccaaacctgagagcagcagaatttgttgctgaggaccagaacggactccttcaaattcagccctcagtttgtctttgacttcatctagagaaagattcttgacactctggatgggcaaaacaggccccagccctgcgtctattcacaggcacaacttgaccagatccctggatccataaaaaattaaagaggtgtcaaaaatgcagcagagaagagccaaataaatggtttcatcattccccaggaagaaaacccctcttttttttttttttctgaaagggtggaaactaaaggaaaattggtgctaaaacaaagttgaactggttcagagcaaaaagagagtccagaatgttacttgaaggcagcacacaccaaaacacacccaaatctcaagtctaggaatgactggcaaccacagctacttcagggcagggggctttcatttgttctttgtgggttttcccctgggaaaacaaagctttgcccttgatccaaaatgggtttatcaagggtgggaagggaaggagcacagagaataatctagtgtatgaaatgagttgagtaactgccacccaattcatagactaaagtaaccaaattctttttcaagttctacatttctagagagaaacagactacagctagcgctgatattagaaagttatgtagattttttaacattatgatattctggctgggcacagtggctcacgcttataatcccagctttttgggaggctgaggcgagaggatcacttgagcccaggagttcgagaccagactgggcaacatagcaagaccctgtgtctctataaaaaataaaaagttgagccaggcatggtggcatgtgcctatagtcccagctactgagaagactgaggcaggcagattgcttgagcctgggaggttaaggctgcagtgagctatgggggcaccactgcactgcagcctgggtgacagagtgagagaccctctctc

SEQ ID NO: 86041 - DNA, 201 bp, Homo sapiens
gcagctcaaatctcaaccattactacagcctacagatcattcttctttctcatctcccaaaaatctctctagagacccaagacaactcctctagaaattctgactccaaaggtctgggtggaatgcaggtatcagtattaattaattaattaattatttttgagacagaattttgctctgtcacccatgctggagtacagt

SEQ ID NO: 86042 - DNA, 815 bp, Homo sapiens
acaacagtaaggagtggtgaagccagtcaataaagggcatgttatcaagcccactaccactgcgcgcgactgcagctgaatacagttgggaaactgggaaatagtaccggatgtgggcaatttatcagagtcaacaacctggttttttcagcaaataaatggcaagagaacaaagaggaagtggaactcctttagattaatagaggtttaaaaggcatcaacaaaatgtaacatatggctttaatttgcatcctcattcaaacaaaccaactgtaaagttatatttatgagacaagcagaaaaatttgactgttgacaaatgttagatgatattaaggaattactattaaattttaagtataataatgacattttattgtttaaaaaaagaattcttaactcttctacatgctgaagtagttaagaatgaaataatatcatgtctggtatttaccttaaaaccatccagtgtatggcttatttcacttagcataatgcttactaggttcatccatgttgtcacaaatggcaagatctccttatttttaaggctgaataatattccattgtatacatatgccacaatttctttatccattcatacattgacaaacatttacgttgtttctatatcttagctactgtgagtaatgctgcaataaacatgggcatgcagatacatttacaaggtggtgaattcattttctttgggtatatacctgaaaaaaaccttgctgggttatatggtagttttatttttaatttctctcacttacatgtaaaatataaaaaacaaaacaactcgaatatataga

SEQ ID NO: 86043 - DNA, 751 bp, Homo sapiens
aggataggctcaccacatctggtgaggcaggcagggcctcgctgcaacacagaatgatcccgtaggtctcaaggcctacttgtactgttgtacataatgtatataattgacttttattcactcgacaaaatttcctaaaaatacatccaaatgattgcattaattaatattttgttcctttgatgactgagtagtatttcatggtttctggtataaattcatcacaaattaaacattcacctgggcttattgaccttttcaactgtaacaaattaagctgttgtagacattcgtgaacaagtttttgtgggaccacaagtttcatcactccaaattaaacacccacaactgcaattgctgggatctatggtctatgcatatctggtttttattttactttaaaaaatttttaattattttctcaaaattttatgtgtacactgagtgcccacagaagctagtaaggatactggggcattggagaggaggtagagaaggttaatcagcacaaaaaaaaaaatgtggaaagaatgaataacatgtctgtcttttaaaaaaactgtcaactatttttcagagtggctctattattttacttttccactagcaacttatgagtgatcgtattttttacatcctgaatagcttttgctattgtcacaatttttaaaagtcattttgataggtgtgtagaaatatctcactatggttttatttgacatgtccatgatgattaataatattgaacatg

SEQ ID NO: 86044 - DNA, 418 bp, Homo sapiens
acaggattattcaggataatgcagtgccatctggaagacccttatagctatagggcagctccactgaggagagagcggaatctccccagttgagcaggtgatttaaactcccctggcattcgcagcaataacaaccgtatttttccctccgcctggcctgtgtcttgactttggacaggagtccaaagtgagctgcgtctttgtgtctgctccctgcactgcagagggtgtgagctgcacgctgcctacccgggtctgatagggagtggggattagacgccaacattccaacatcattatgtaaagtaaaatagcatcattgagagaggtgaggctgagcagtccaaaatatttgataacactgaaagagcgtttttcctcttccacagtgaatccatgtctccatttgcatttgtta

SEQ ID NO: 86045 - DNA, 337 bp, Homo sapiens
catatttaaaaaaatatgttttctgtgtgttgccaaagaatagaaatgcaattgattttttaatattaaacttatatctagccatggtattgaattcttctaatttctaataatttgtctgtcaatcattttattctttctaggtaaatatgatactataataaattttgcttctttctgtttctttccttttcctattatttacttttcttgcattactaggctactttggacctttaataaaatgtgaaaaagcacatttatctttatattgattttaaacagaacactctaaataccttattatcggtaagactaatgactgctgaagaatttt

SEQ ID NO: 86046 - DNA, 470 bp, Homo sapiens
cagaggagagagggtttcaagcaagatgtggagtcagcaggtctcccactatgaagattaccacgggaaccaaggggtgctcctgggactgaagtggatgagagcagtgttggagggtgctgggctgatgacacatgggagagggttgaagagaatgtgggtggtagctgaggacagacgagtgtcctggaacgtgtggtgagaaggagaatagaaggagaggtggaaactgcagagggccatggtgttgggctgagcgatggccgagcaggtatgtaagctgaagggagtgatccaatacctgggagaaaccgctgggacaggagagagggtgtccgcggaagcagagtcccttggaagatgagaggtgatgagttcagaggtggaagggatgccctaccccatgtccaagcaggaacagatcatacatggaagctccagaggctggagaggcatgggttttggcatgg

SEQ ID NO: 86047 - DNA, 322 bp, Homo sapiens
cttagccgcccaggacagctagcttttcattttcgttctctcccggctgggtgtcctaccccgggcccagccctgttatcttgggcacgaacaatgcaccggtaggctggtgatcggtggcgggaagactactcccgggacattgggtactaagtggtggccgctgccgccttctctgctgcccgctcccgccttcctctgctggccctggctccctctgctcccgtttccactctgggcactcaactctccctctggcgtggatcccttcccccgttctcactttctgctccccttagggttccctggatcctagaccacg

SEQ ID NO: 86048 - DNA, 396 bp, Homo sapiens
gcacgagggaggcggagatgttagaacattggcaagttgtgtgagaggagtggacaaaagaagggaagacgacaatctcaaactgaatgataacctggaagccgaaggaaaaaatactgaaatatgatgctgagattaacgggggtggtagagaaaagttacatcaccttaccagatgaggaaggttgctttcgagatgtgtaacaagtatggatgcagttccaaagaagagctccatcagttccccgctagcagcctgagctgaacgcattctctgcattgcagtctagcttgcttttctgcaagcaagagttcagaagctttctttacttcaagattagaactgatttcatactgatggattgttgtatgtgagaaataaaaacacttaagtaa

SEQ ID NO: 86049 - DNA, 1090 bp, Homo sapiens
gctcgtgagtccgcggctcgcacccaggggcgcccgcacgtgcggctagaacgtccgagtcggggtccggggcggggggcgcaggcccgcggcggtaggggaggagagcgggcacccgagtctccatcctcagggtggcctgaaggttccaggagggcgtccggcgaaggcacggggctgcgaccatccagttagcagggctggtgtgactgttgagagtaaatgaaaattcgttttgtgacaccgaccacctccaaggaatgaaaggagcagtcagccgaaacgacagcattacttgcgtccttacctaattggaaccttatccgtggctgagggtgccaccattggaggggccgccgccccctctgacaccacctggcgctccgctccatttaggagctagaacgaaaaggaggcccatcccccagtaagtcacagcccacgccaagatgagttctggagcctgtgcgaccgaagtttcttcaccgcagggcgaggtggacaagggtgtgagttactttgacttcaagacgtctcagtggcggctggttctggagagaggctttatgctggagcacttccagcaaagttcggctggggcctccttaactcactggctggtcacccttggcctcggttttcaaccaaagcctaaggcctcagttttcaacgctgtaaatggaaataaatgagagaagaaagtacagcccgtgtgacaagtgcagcaagcaatgcaacttccttgggacctaccctttgtggtcccttgctttaaaagtatagattcacatttagttagacctgtttcttcctcgcatgcaatttcaccagtcttttcccagacttctgtactcaacagaggaagttccttcctgggagaccatagctgtttgtatgtaaagagttgcgaaaaaacaaaagcaaaacaaaaaactccaacacctctctgtcacagaagtattgaattatatagactggaaaaatggaagtatccaagaaaacgcgtgtggtaagaaaatggctaaggtgcaggattctgttttgtggctctggtctcagaaatagacctcacatacacattattccttat

SEQ ID NO: 86050 - DNA, 389 bp, Homo sapiens
ttagggttatttgtacgtgctgtattccacgttgggtttgccacatctcgcttggttttaactaattgtttaattttggagtgtgtgaagggtgtgtgatacatcactgtggccctaggagtcagatacaaaaaggcctactcagtgccaggcctcctcagccctgccttcccgtttccagtcccctttccccagcctggcttatttgtcctgtatttcttttgttttgtgccattttacactcatcagatttgtatgaaaaattattgactctggcagtagggacatactcactccgacctcatccttgtcggccactccttacctgagggagagaggaccacaccactgaaagatggggtcatgggataaaactggaaactttatgg

SEQ ID NO: 86051 - DNA, 428 bp, Homo sapiens
cacatcatcacatgctttacagagaaatcttttctgaaagagaaagtccattgatgtggcaagcttcattgttgtcttaagaaattaccacagccaccccaactttcagtgacctccatcctggtgaatattcagacagtcaatcctttgaaggtttgaagctaggcttctctctagctttgaaaatgccagatagcatcttcttctattataaggctgttttacctacattgaaaatctgttgtttagtgtaaccaccttcatcagtcagggaccatcaatatcaaggcaagaccctacaatggcaaaaagataactcactgaaggctcagttaattattagaattttttttagcaatgaagtattttagtaagctatctacatttttagagataatgctatttcacacttaacagacctacagtag

SEQ ID NO: 86052 - DNA, 1524 bp, Homo sapiens
  misc_feature (18)..(18): n is a, c, g, or t
  misc_feature (46)..(48): n is a, c, g, or t
  misc_feature (74)..(74): n is a, c, g, or t
  misc_feature (202)..(202): n is a, c, g, or t
  misc_feature (1458)..(1458): n is a, c, g, or t
  misc_feature (1470)..(1471): n is a, c, g, or t
ttaaatagagcccctgtnagaacaatatgaattctgctaaaactgnnncaagaacaaacatcaaatttatggcnaagcttaggtggaagaatggtgcaatcattgatgctttgcaaaaagtttatgggaacaacgccccaaggaaatcagtttacaaatggataattcattttaagaaaggacaagacaatgttgaagatgnaacctacagcagcagaccatgccacttcgtgaggaaaaaattatctcattcatgccctacttgaagaggaccaatgattaacagcagaaacgatagccaacacaatatgctcctcagttggttcagcttttataaatctgactgaaaaattaaagttgagcacactttccactcaatggataccaaaaccatccagcccaggtcagctgcagacaaaagcagagctttcgatggaaatgtcaaacaagtgagatcaagatcctgaagcatttcttcaaagaattgtagcaaaaacagacttttaaaaccttgaattcagagacaggtataaagactgcttggtgattttgaaaggactgagatcattttgggagagatcatcttcagaaaatgaccagatacaacaagaatttaacatggcagccaaaccaacccactaacacacatttaaataagatacccaaatgcagaaagaaaagcacagtcgtcatgcaaaatagtcactactcattcaaaaactctatagttgtctgagtcgttatgctcaaaatatccaataatatttcttttgctgagctgtaaaataattattttgcaaacataaaagaaaaaaaaaagaattgtaacagaaacatggctttaccagtatgaccctcaagacaaaatacaaaacaatggctaccaagaggtggaagtggcccagtcacagcaagagcagattgatcaagagcaaaggtcatggtaacagttttttggatcctcaagtcattttgcttgttgactttttggagggccaaataaagatatcatctgcttattatgagagtgtttcgagagaaatccaaagcttagcagagaaacgcctgggaaagcttcaccagagggtcttccaccgtgacagttcccctgcgcattcctctcataaagcaagggcagtttagctagaatttctatcaaaaatcattaggtatccatctcccagtcctgatttggctccttctgacttctttttgtttcccaatcttaaaaaaatcctgaagggcacctgtttttcttcagctaataaaaaagacatggttaatttcccaggaccctcagttctttagggatagactgaatggctggtatcattgcttgaacttaatggagcttatgttgagaaataaaagaaattatattttatttttatcttttaattctatttttccatgaactttttgaagtcccctcagatataagcagaacgttatgaaacngagttaccttgnntctagaagagtacaatgataaaggggaagatagaaacacacacatatgcgttg

SEQ ID NO: 86053 - DNA, 341 bp, Homo sapiens
gatttcctgagctttacaagggagactggaaagtttgattaagtttgaatttgtgtttggctgattgccagccaaaaccgaatgggcttgtgggagagttctgttgttgctgattctgttcctgttttgtggcagctctcttggggtgggggcaggcacactggtgttgtgttgtgggttttttttagacccccttacttgctgaatggctattcctctgttgtgatgcatgagatgtaaatcccccaaagactggttgccagagcgacgggctggaattgagctcagctaaacaaagtccttcagctttgaagggagaagcgcttgtttcccatgtggag

SEQ ID NO: 86054 - DNA, 347 bp, Homo sapiens
tccccccaaaaaaacacagtaaaataggacaacatgagttgttcttgcccacagttcttttctatttgtactatgtttatcttcatatgctgaaaaatgttcctttttctacattgagattttgatgtgccaaacaaattgaatttctttttcctaccacatttctattggcggggactgaaagtttctctggatttccttgttgctgttgtttgtgctgtgaaattattcagaatttctagatgttaacattttaaccttcttttagttaatctcaaatttttttccagacataatattgaaattatgtttaaatggaatcagaagaaatttacatccagtacatt

SEQ ID NO: 86055 - DNA, 779 bp, Homo sapiens
tgtggagctctgggtttgctcttagtactgctgccagaaacactgttagaatggcaaccctgccattctcccctccagtggaagattctactttattcaggaaggctggtggcttgcaggggctaggcttacacaagccagccaagattgagaaggtaggggagtgctttcaatggaggccatagttgtcatcttttcttctgagcaggctctaggacaaacaatgagcaaattgagatgtcctgtattgggaggatgaggctgatatgtttcatcattctcagaatttgtgggctagagcacctttttgggaatatgggcctagggaaaagaacggtcacttacctggacactatggccatagtcttgagtttttctagtcagcatgtgattggttgtaccttaagtttatgacaccaaaaatactattaactctgttatttttgttcttaatcccatctcaaattagtttctagagttagaatcagaacacaaggatgctcattttcacatggagggaaagttgccaaagcatttaaaaaataaccccaaaagtatatctagcagtgaagcttggtagataaaggtgaactgctaaacagacactggcgtgccacactcctgccagggcagtctcattgtgtgtgacggtgctgcaacactgccagtattacttgagatgcagtctctctcccctgttctcagttcctgggctcagcctcctccaaggcctgccagtgagtagcagtttggaaggcaggccaagggagatccccaaa

SEQ ID NO: 86056 - DNA, 666 bp, Homo sapiens
tgtggagctctgggtttgctcttagtactgctgccagaaacactgttagaatggcaaccctgccattctcccctccagtggaagattctactttattcaggaaggctggtggcttgcaggggctaggcttacacaagccagccaagattgagaaggtaggggagtgctttcaatggaggccatagttgtcatcttttcttctgagcaggctctaggacaaacaatgagcaaattgagatgtcctgtattgggaggatgaggctgatatgtttcatcattctcagaatttgtgggctagagcacctttttgggaatatgggcctagggaaaagaacggtcacttacctggacactatggccatagtcttgagtttttctagtcagcatgtgattggttgtaccttaagtttatgccaaagcatttaaaaaataaccccaaaagtatatctagcagtgaagcttggtagataaaggtgaactgctaaacagacactggcgtgccacactcctgccagggcagtctcattgtgtgtgacggtgctgcaacactgccagtattacttgagatgcagtctctctcccctgttctcagttcctgggctcagcctcctccaaggcctgccagtgagtagcagtttggaaggcaggccaagggagatccccaaa

SEQ ID NO: 86057 - DNA, 332 bp, Homo sapiens
agagagagagagagagagagagagagagagagagagagagagagagagagagagagaggtcaaaatccactggtggcgtttggggtgttcccgtggacgcggcctcccggcaggcggacctccaccgggtgggcgcggcaggcgggctgtgcgggcaggaagagcgacgagcttgagagtgggagatggggtgcaacggcgggcctctccggggaggtgacactgccgctgagacccgaatggaagggcgcgcccggcgggggaacagcaggcgccgagatggagtctcactgtagtccagatggagtgcaatggcgtgatctcggctcact

SEQ ID NO: 86058 - DNA, 132 bp, Homo sapiens
tcaccgtggaggttctctgcagcttactcagtggggcagcaagtagctcaggacaccaggcaacttttaagctctcataatgctgtgctggagttggagcagaagcttgtgctgtatgaagggccttggttg

SEQ ID NO: 86059 - DNA, 325 bp, Homo sapiens
caaaatcatggattcctgctcctgggatgtggaatcattcttaggggctgcctatgtgaggtgggagctggagatggttccaggtcagggaggctaagaggatcaatggcatgccccactacttgctggctgtgcggcctgagacaaggtactcttctttctcagggcttcagagtttaatctgtgaaagaggaggtctgggctaggtgatcacataaatctcttccacatctagaatttgatggagtggctatagcagaaaagtagtttacaattcagggttaataaggaggaaaaaggattacagagggaaaaggttctaaat

SEQ ID NO: 86060 - DNA, 632 bp, Homo sapiens
gagaaaaagtaaataaggctttctggagatgacggaaattttgtatgaataaaagccttataaacaatgaatacatttggataaacaactcattaaaatgcacattaatggaatacctgtacaaatagttttaatacttgtgtccagtggcactaaagagatatattaaaatagattctggttgagttgattataagattgtcaatcataggatacacagggaaagcacagacacgattgctcatctctttggtagtctaaaatatgttccttttaaccacatcaaaagatactatctgattctaatacagaaggtgcaacttcctaggaattatactttgtattatattcaataattattttatgttttgcatcacatgggtgttgcaagaacacagctcttgaactaaaaaggcattacattaagaatttatttttgtaaattttaataaactctaaattaatgcaaaatatttatgaaaatagcacagcttcacattaatacccacagtacttaaatatctcccttagttgactcacagctttgtatgtaagcttcaaatttttaatggtaaaaataagaaaattaggactagcgaactgctagttgttccctcagtgcatgtgcttga

SEQ ID NO: 86061 - DNA, 371 bp, Homo sapiens
ccagatttaggaacgaaataaacccttctgttaagaagacctgaaataaagctgtattgagaccatcatccattcacagaggagatttctcagggacagttccccatgttgttggagacccaattctaacatatctgagaaccggtgatgaagtgagtttaggtttggggacccaaaggaacccacagaagataagccattcagtaagatgattttaaatttagagaaaaaataattttgttgaaattcccaccttaacaaattggaaacacatacatgtttcaagttaatatgtccgtgcttacaataatcgtgaaggaagtattaataatgaaaaaatcaagagccacacaaaagtatagggaatgcta

SEQ ID NO: 86062 - DNA, 1023 bp, Homo sapiens
agatatttactttatgaattaaagctggagtcagtgtcagcccgaaggctgaaggaaaaagagcaacagatccagggagcattcacctgccctgtctccaaacagccttgtgcctcacctacccccaacctcccagagggagcagctatttaaggggagcaggagtgcagaacaaacaagacggcctggggatacaactctggagtcctctgagagagccaccaaggaggagcaggggagcgacggccggggcagaagttgagaccacccagcagaggagctaggccagtccatctgcatttgtcacccaagaactcttaccatgaagaccctcctactgttggcagtgatcatgatctttggcctactgcaggcccatgggaatttggtgaatttccacagaatgatcaagttgacgacaggaaaggaagccgcactcagttatggcttctacggctgccactgtggcgtgggtggcagaggatcccccaaggatgcaacggatcgctgctgtgtcactcatgactgttgctacaaacgtctggagaaacgtggatgtggcaccaaatttctgagctacaagtttagcaactcggggagcagaatcacctgtgcaaaacaggactcctgcagaagtcaactgtgtgagtgtgataaggctgctgccacctgttttgctagaaacaagacgacctacaataaaaagtaccagtactattccaataaacactgcagagggagcacccctcgttgctgagtcccctcttccctggaaaccttccacccagtgctgaatttccctctctcataccctccctccctaccctaaccaagttccttggccatgcagaaagcatccctcacccatcctagaggccaggcaggagcccttctatacccacccagaatgagacatccagcagatttccagccttctactgctctcctccacctcaactccgtgcttaaccaaagaagctgtactccggggggtctcttctgaataaagcaattagcaaatca

SEQ ID NO: 86063 - DNA, 290 bp, Homo sapiens
  misc_feature (288)..(288): n is a, c, g, or t
catagaaaatacaagtagcattccttacacatcttaaaggcgagcacgaacgccttctatacccacccagaacgagaccatgcaccagccgagaagattttcctggatggatagcctccctccctaccctaaccaagttccttggccatgcagaaagcatccctcacccatcctagaggccaggcaggagcccttctatacccacccagaatgagacatccagcagatcccaggaggtcctggtggctggcacgtcgacgcggccgcgaatttagtagtagtagtcgncc

SEQ ID NO: 86064 - DNA, 1041 bp, Homo sapiens
  misc_feature (1039)..(1039): n is a, c, g, or t
agatatttactttatgaattaaagctggagtcagtgtcagcccgaaggctgaaggaaaaagagcaacagatccagggagcattcacctgccctgtctccaaacagccttgtgcctcacctacccccaacctcccagagggagcagctatttaaggggagcaggagtgcagaacaaacaagacggcctggggatacaactctggagtcctctgagagagccaccaaggaggagcaggggagcgacggccggggcagaagttgagaccacccagcagaggagctaggccagtccatctgcatttgtcacccaagaactcttaccatgaagaccctcctactgttggcagtgatcatgatctttggcctactgcaggcccatgggaatttggtgaatttccacagaatgatcaagttgacgacaggaaaggaagccgcactcagttatggcttctacggctgccactgtggcgtgggtggcagaggatcccccaaggatgcaacggatcgctgctgtgtcactcatgactgttgctacaaacgtctggagaaacgtggatgtggcaccaaatttctgagctacaagtttagcaactcggggagcagaatcacctgtgcaaaacaggactcctgcagaagtcaactgtgtgagtgtgataaggctgctgccacctgttttgctagaaacaagacgacctacaataaaaagtaccagtactattccaataaacactgcagagggagcacccctcgttgctgagtcccctcttccctggaaaccttccacccagtgctgaatttccctctctcataccctccctccctaccctaaccaagttccttggccatgcagaaagcatccctcacccatcctagaggccaggcaggagcccttctatacccacccagaatgagacatccagcagatttccagccttctactgctctcctccacctcaactccgtgcttaaccaaagaagctgtactccggggggtctcttctgaagtcgacgcggccgcgaatttagtagtagtagtcgncc

SEQ ID NO: 86065 - DNA, 974 bp, Homo sapiens
agatatttactttatgaattaaagctggagtcagtgtcagcccgaaggctgaaggaaaaagagcaacagatccagggagcattcacctgccctgtctccaaacagccttgtgcctcacctacccccaacctcccagagggagcagctatttaaggggagcaggagtgcagaacaaacaagacggcctggggatacaactctggagtcctctgagagagccaccaaggaggagcaggggagcgacggccggggcagaagttgagaccacccagcagaggagctaggccagtccatctgcatttgtcacccaagaactcttaccatgaagaccctcctactgttggcagtgatcatgatctttggcctactgcaggcccatgggaatttggtgaatttccacagaatgatcaagttgacgacaggaaaggaagccgcactcagttatggcttctacggctgccactgtggcgtgggtggcagaggatcccccaaggatgcaacggatcgctgctgtgtcactcatgactgttgctacaaacgtctggagaaacgtggatgtggcaccaaatttctgagctacaagtttagcaactcggggagcagaatcacctgtgcaaaacaggactcctgcagaagtcaactgtgtgagtgtgataaggctgctgccacctgttttgctagaaacaagacgacctacaataaaaagtaccagtactattccaataaacactgcagagggagcacccctcgttgctgagtcccctcttccctggaaaccttccacccagtgctgaatttccctctctcataccctccctccctaccctaaccaagttccttggccatgcagaaagcatccctcacccatcctagaggccaggcaggagcccttctatacccacccagaatgagacatccagcagatgggaactttttcccttccctactccaggtcgtctcgtcactaagggtcc

SEQ ID NO: 86066 - DNA, 962 bp, Homo sapiens
  misc_feature (960)..(960): n is a, c, g, or t
agatatttactttatgaattaaagctggagtcagtgtcagcccgaaggctgaaggaaaaagagcaacagatccagggagcattcacctgccctgtctccaaacagccttgtgcctcacctacccccaacctcccagagggagcagctatttaaggggagcaggagtgcagaacaaacaagacggcctggggatacaactctggagtcctctgagagagccaccaaggaggagcaggggagcgacggccggggcagaagttgagaccacccagcagaggagctaggccagtccatctgcatttgtcacccaagaactcttaccatgaagaccctcctactgttggcagtgatcatgatctttggcctactgcaggcccatgggaatttggtgaatttccacagaatgatcaagttgacgacaggaaaggaagccgcactcagttatggcttctacggctgccactgtggcgtgggtggcagaggatcccccaaggatgcaacggatcgctgctgtgtcactcatgactgttgctacaaacgtctggagaaacgtggatgtggcaccaaatttctgagctacaagtttagcaactcggggagcagaatcacctgtgcaaaacaggactcctgcagaagtcaactgtgtgagtgtgataaggctgctgccacctgttttgctagaaacaagacgacctacaataaaaagtaccagtactattccaataaacactgcagagggagcacccctcgttgctgagtcccctcttccctggaaaccttccacccagtgctgaatttccctctctcataccctccctccctaccctaaccaagttccttggccatgcagaaagcatccctcacccatcctagaggccaggcaggagcccttctatacccacccagaatgagacatccagcagatgtcgacgcggccgcgaatttagtagtagtagtcgncc

SEQ ID NO: 86067 - DNA, 969 bp, Homo sapiens
agatatttactttatgaattaaagctggagtcagtgtcagcccgaaggctgaaggaaaaagagcaacagatccagggagcattcacctgccctgtctccaaacagccttgtgcctcacctacccccaacctcccagagggagcagctatttaaggggagcaggagtgcagaacaaacaagacggcctggggatacaactctggagtcctctgagagagccaccaaggaggagcaggggagcgacggccggggcagaagttgagaccacccagcagaggagctaggccagtccatctgcatttgtcacccaagaactcttaccatgaagaccctcctactgttggcagtgatcatgatctttggcctactgcaggcccatgggaatttggtgaatttccacagaatgatcaagttgacgacaggaaaggaagccgcactcagttatggcttctacggctgccactgtggcgtgggtggcagaggatcccccaaggatgcaacggatcgctgctgtgtcactcatgactgttgctacaaacgtctggagaaacgtggatgtggcaccaaatttctgagctacaagtttagcaactcggggagcagaatcacctgtgcaaaacaggactcctgcagaagtcaactgtgtgagtgtgataaggctgctgccacctgttttgctagaaacaagacgacctacaatagagtcccctcttccctggaaaccttccacccagtgctgaatttccctctctcataccctccctccctaccctaaccaagttccttggccatgcagaaagcatccctcacccatcctagaggccaggcaggagcccttctatacccacccagaatgagacatccagcagatttccagccttctactgctctcctccacctcaactccgtgcttaaccaaagaagctgtactccggggggtctcttctgaataaagcaattagcaaatca

SEQ ID NO: 86068 - DNA, 373 bp, Homo sapiens
ggctactactactaaattcgcgggcgagtggaaacaagacgacctacaataaaaagtaccagtactattccaataaacactgcagagggagcacccctcgttgctgagtcccctcttccctggaaaccttccacccagtgctgaatttccctctctcataccctccctccctaccctaaccaagttccttggccatgcagaaagcatccctcacccatcctagaggccaggcaggagcccttctatacccacccagaatgagacatccagcagatttccagccttctactgctctcctccacctcaactccgtgcttaaccaaagaagctgtactccggggggtctcttctgaataaagcaattagcaaatca

SEQ ID NO: 86069 - DNA, 851 bp, Homo sapiens
  misc_feature (1)..(1): n is a, c, g, or t
natttcggcacaggtggggatacaactctggagtcctctgagagagccaccaaggaggagcaggggagcgacggccggggcagaagttgagaccacccagcagaggagctaggccagtccatctgcatttgtcacccaagaactcttaccatgaagaccctcctactgttggcagtgatcatgatctttggcctactgcaggcccatgggaatttggtgaatttccacagaatgatcaagttgacgacaggaaaggaagccgcactcagttatggcttctacggctgccactgtggcgtgggtggcagaggatcccccaaggatgcaacggatcgctgctgtgtcactcatgactgttgctacaaacgtctggagaaacgtggatgtggcaccaaatttctgagctacaagtttagcaactcggggagcagaatcacctgtgcaaaacaggactcctgcagaagtcaactgtgtgagtgtgataaggctgctgccacctgttttgctagaaacaagacgacctacaataaaaagtaccagtactattccaataaacactgcagagggagcacccctcgttgctgagtcccctcttccctggaaaccttccacccagtgctgaatttccctctctcataccctccctccctaccctaaccaagttccttggccatgcagaaagcatccctcacccatcctagaggccaggcaggagcccttctatacccacccagaatgagacatccagcagatttccagccttctactgctctcctccacctcaactccgtgcttaaccaaagaagctgtactccggggggtctcttctgaataaagcaattagcaaatca

SEQ ID NO: 86070 - DNA, 853 bp, Homo sapiens
gagtcctctgagaggttggatgggagagcatgtctgtgtgtctcagagccaccaaggaggagcaggggagcgacggccggggcagaagttgagaccacccagcagaggagctaggccagtccatctgcatttgtcacccaagaactcttaccatgaagaccctcctactgttggcagtgatcatgatctttggcctactgcaggcccatgggaatttggtgaatttccacagaatgatcaagttgacgacaggaaaggaagccgcactcagttatggcttctacggctgccactgtggcgtgggtggcagaggatcccccaaggatgcaacggatcgctgctgtgtcactcatgactgttgctacaaacgtctggagaaacgtggatgtggcaccaaatttctgagctacaagtttagcaactcggggagcagaatcacctgtgcaaaacaggactcctgcagaagtcaactgtgtgagtgtgataaggctgctgccacctgttttgctagaaacaagacgacctacaataaaaagtaccagtactattccaataaacactgcagagggagcacccctcgttgctgagtcccctcttccctggaaaccttccacccagtgctgaatttccctctctcataccctccctccctaccctaaccaagttccttggccatgcagaaagcatccctcacccatcctagaggccaggcaggagcccttctatacccacccagaatgagacatccagcagatttccagccttctactgctctcctccacctcaactccgtgcttaaccaaagaagctgtactccggggggtctcttctgaataaagcaattagcaaatca

SEQ ID NO: 86071 - DNA, 912 bp, Homo sapiens
agatatttactttatgaattaaagctggagtcagtgtcagcccgaaggctgaaggaaaaagagcaacagatccagggagcattcacctgccctgtctccaaacagagccaccaaggaggagcaggggagcgacggccggggcagaagttgagaccacccagcagaggagctaggccagtccatctgcatttgtcacccaagaactcttaccatgaagaccctcctactgttggcagtgatcatgatctttggcctactgcaggcccatgggaatttggtgaatttccacagaatgatcaagttgacgacaggaaaggaagccgcactcagttatggcttctacggctgccactgtggcgtgggtggcagaggatcccccaaggatgcaacggatcgctgctgtgtcactcatgactgttgctacaaacgtctggagaaacgtggatgtggcaccaaatttctgagctacaagtttagcaactcggggagcagaatcacctgtgcaaaacaggactcctgcagaagtcaactgtgtgagtgtgataaggctgctgccacctgttttgctagaaacaagacgacctacaataaaaagtaccagtactattccaataaacactgcagagggagcacccctcgttgctgagtcccctcttccctggaaaccttccacccagtgctgaatttccctctctcataccctccctccctaccctaaccaagttccttggccatgcagaaagcatccctcacccatcctagaggccaggcaggagcccttctatacccacccagaatgagacatccagcagatttccagccttctactgctctcctccacctcaactccgtgcttaaccaaagaagctgtactccggggggtctcttctgaataaagcaattagcaaatca

SEQ ID NO: 86072 - DNA, 797 bp, Homo sapiens
  misc_feature (1)..(1): n is a, c, g, or t
natttcggcacaggtggggatacaactctggagtcctctgagagagccaccaaggaggagcaggggagcgacggccggggcagaagttgagaccacccagcagaggagctaggccagtccatctgcatttgtcacccaagaactcttaccatgaagaccctcctactgttggcagtgatcatgatctttggcctactgcaggcccatgggaatttggtgaatttccacagaatgatcaagttgacgacaggaaaggaagccgcactcagttatggcttctacggctgccactgtggcgtgggtggcagaggatcccccaaggatgcaacggatcgctgctgtgtcactcatgactgttgctacaaacgtctggagaaacgtggatgtggcaccaaatttctgagctacaagtttagcaactcggggagcagaatcacctgtgcaaaacaggactcctgcagaagtcaactgtgtgagtgtgataaggctgctgccacctgttttgctagaaacaagacgacctacaatagagtcccctcttccctggaaaccttccacccagtgctgaatttccctctctcataccctccctccctaccctaaccaagttccttggccatgcagaaagcatccctcacccatcctagaggccaggcaggagcccttctatacccacccagaatgagacatccagcagatttccagccttctactgctctcctccacctcaactccgtgcttaaccaaagaagctgtactccggggggtctcttctgaataaagcaattagcaaatca

SEQ ID NO: 86073 - DNA, 258 bp, Homo sapiens
gatcaatatatccaggaatttgtgaaaagatcctaaacttttcaaacatgtcacaggtagtacttgaagtatgcttggtaaaatgtaccggttaaagcagtatgtttctcagatagcctgagattttatttaacaattatgtatctaagtctactaatacatttgagcaaaagagtgttgggttcataaataagaagtcagtatttcacttagattatttcagaaacttgtaagtacctgtaaatagctactctgaaa

SEQ ID NO: 86074 - DNA, 311 bp, Homo sapiens
caaatattatcattaactatactctttatgctatttaatctgcttatcctaatttccctatgctactccttgaactggtagatatacccactcagtaagaaagcaaataaaaataaaatagtttgagtcttactctggtgatctctctatcttgcatgaagctttctttatatgtaaattgtattcctcccctattccaaaccattatttttttctgtctctagatgtaaggttcttaacagtgctggagatttcatcagatggggacagacagctgatgaacattctttggctcttcaaccccttttctt

SEQ ID NO: 86075 - DNA, 180 bp, Homo sapiens
catttcctgcctctctcaccttcctggttcctgccagcatttcttggtttgtggccacatctttccaacgtttgccacaagcttctctttgccttctcttctgtctgcatctctgctcttgctgcctctctaaggatgctttgattacatttagaacccactagataatccagggtaatc

SEQ ID NO: 86076 - DNA, 1522 bp, Homo sapiens
agtggcgcggacgcctgctcagtgcgcgccggccgggcaaccctatgctggcgtaatcgggttcctccgagccgccgtaggactggttccggcgggctggtgaggaatggagccggtaggctgctgcggcgagtgccgcggctcctccgtagacccgcggagcaccttcgtgttgagtaacctggcggaggtggtggagcgtgtgctcaccttcctgcccgccaaggcgttgctgcgggtggcctgcgtgtgccgcttatggagggagtgtgtgcgcagagtattgcggacccatcggagcgtaacctggatctccgcaggcctggcggaggccggccacctggaggggcattgcttggttcgcgtggtagcagaggagcttgagaatgttcgcatcttaccacatacagttctttacatggctgattcagaaactttcattagtctggaagagtgtcgtggccataagagagcaaggaaaagaactagtatggaaacagcacttgcccttgagaagctattccccaaacaatgccaagtccttgggattgtgaccccaggaattgtagtgactccaatgggatcaggtagcaatcgacctcaggaaatagaaattggagaatctggttttgctttattattccctcaaattgaaggaataaaaatacaaccctttcattttattaaggatccaaagaatttaacattagaaagacatcaactcactgaagtaggtcttttagataaccctgaacttcgtgtggtccttgtctttggttataattgctgtaaggtgggagccagtaattatctgcagcaagtagtcagcactttcagtgatatgaatatcatcttggctggaggccaggtggacaacctgtcatcactgacttctgaaaaaagtatgtcttgtgtgcttctgatttcgtctgtgaatgaagggaaatggtctcaggttttgtcactttggggttaacaatttaaaaaacgtgtttaaagaattattaagataatagttcattccattttgtagtagacattggctaaggggcttactgaacataattctgcttacggttgaataattacatttttatatatattgtccttcaagaacttccttgagtcacattctccttaaaatttgacattgcctgttgatctttcctttgacagatgtggtactctgtgtgacctcaatgtgtcacctcctttctagtttcctcctttaaaggaaacacatggttagagtgtatctttatggcaaaacttctcagagcttctaatatgcccggtgctgtggaaatctggaaggagaatagcattacctgtgacagttcccaaatctgtttggtcacaaaacttttttccacagaatgtcttgcaagtcgtactggtttttggaaattctgtattagatcttttgaaaggctttttcaagcttaaaaattgtggatcttttttgttactaaggcttttgctttcaaagataaaaatatttgctcttctgtcttgggagcca

SEQ ID NO: 86077 - DNA, 1102 bp, Homo sapiens
aaaaaaaaaaaaaaaaaaaaaaaagtaaaagatgatgatctgtttcatagctatacaacaataatggcactcatacatctggggtcatctaaataataattaaagtggctttcataatatgtaacttttgggttctgcctttttcagaaaatggaaacttgggccatgtgtatttcaaacaaaaataactttagatatatcttttttgtagctttgattgatgctctaagatcacatgagggtagtatttaatatattagatgaaggacaactttggacataacactgactaggagttgagagcttttgcatcaggcagaagcaaactgattatagttgtgttgcaccagatcatgtagctgctgtgtaacatgaccttaaatagtcttcctgcataggaagagcaaaagggtattcatcaataggatatagatttaagacattccctgactaccccttgcgttgttaggtgatgtcttttagcagaatcatgaagaccttttttctcccttaataaaggagaaaaatatactgatggctggagaaatttttctctgcctttcagttttatgaattttttcagaagtaacaatattattattgactttttacttatttgataaaaattaaagaactatttttgttttggtcagataaattgacaagactaatcagtattttattataagtaaaagatttttcttctttccttaaaaatatttttttttcacctaggtctaaatagctaactaactggtagaccagagtattacatcatcttattttggttttataccaataaaacatagcgtggaactcattcaggtaatgttttgcatttcattgcttttggatgaacaaaggaagtaaactaatcctttataaatgaaaacccagaatagttggtatgtcagctagtcattcctgtcatattcccagtagaatgattttcaagtttgaatttctgtacaaatatctaaataagagatgtgcagagagcaccaattttccttcaatatccattctttacttttcacataatgatagaacctttgatttttcaagtgggtatgcctcctagaataaagactacatttcccag

SEQ ID NO: 86078 - DNA, 2829 bp, Homo sapiens
agtggcgcggacgcctgctcagtgcgcgccggccgggcaaccctatgctggcgtaatcgggttcctccgagccgccgtaggactggttccggcgggctggtgaggaatggagccggtaggctgctgcggcgagtgccgcggctcctccgtagacccgcggagcaccttcgtgttgagtaacctggcggaggtggtggagcgtgtgctcaccttcctgcccgccaaggcgttgctgcgggtggcctgcgtgtgccgcttatggagggagtgtgtgcgcagagtattgcggacccatcggagcgtaacctggatctccgcaggcctggcggaggccggccacctggaggggcattgcttggttcgcgtggtagcagaggagcttgagaatgttcgcatcttaccacatacagttctttacatggctgattcagaaactttcattagtctggaagagtgtcgtggccataagagagcaaggaaaagaactagtatggaaacagcacttgcccttgagaagctattccccaaacaatgccaagtccttgggattgtgaccccaggaattgtagtgactccaatgggatcaggtagcaatcgacctcaggaaatagaaattggagaatctggttttgctttattattccctcaaattgaaggaataaaaatacaaccctttcattttattaaggatccaaagaatttaacattagaaagacatcaactcactgaagtaggtcttttagataaccctgaacttcgtgtggtccttgtctttggttataattgctgtaaggtgggagccagtaattatctgcagcaagtagtcagcactttcagtgatatgaatatcatcttggctggaggccaggtggacaacctgtcatcactgacttctgaaaagaaccctctggatattgatgcctcgggtgtggttggactgtcatttagtggacaccgaatccagagtgccactgtgctcctcaacgaggacgtcagtgatgagaagactgctgaggctgcgatgcagcgcctcaaagcggccaacattccagagcataacaccattggcttcatgtttgcatgcgttggcaggggctttcagtattacagagccaaggggaatgttgaggctgatgcatttagaaagttttttcctagtgttcccttattcggcttctttggaaatggagaaattggatgtgatcggatagtcactgggaactttatattgaggaaatgtaatgaggtaaaagatgatgatctgtttcatagctatacaacaataatggcactcatacatctggggtcatctaaataataattaaagtggctttcataatatgtaacttttgggttctgcctttttcagaaaatggaaacttgggccatgtgtatttcaaacaaaaataactttagatatatcttttttgtagctttgattgatgctctaagatcacatgagggtagtatttaatatattagatgaaggacaactttggacataacactgactaggagttgagagcttttgcatcaggcagaagcaaactgattatagttgtgttgcaccagatcatgtagctgctgtgtaacatgaccttaaatagtcttcctgcataggaagagcaaaagggtattcatcaataggatatagatttaagacattccctgactaccccttgcgttgttaggtgatgtcttttagcagaatcatgaagaccttttttctcccttaataaaggagaaaaatatactgatggctggagaaatttttctctgcctttcagttttatgaattttttcagaagtaacaatattattattgactttttacttatttgataaaaattaaagaactatttttgttttggtcagataaattgacaagactaatcagtattttattataagtaaaagatttttcttctttccttaaaaatatttttttttcacctaggtctaaatagctaactaactggtagaccagagtattacatcatcttattttggttttataccaataaaacatagcgtggaactcattcaggtaatgttttgcatttcattgcttttggatgaacaaaggaagtaaactaatcctttataaatgaaaacccagaatagttggtatgtcagctagtcattcctgtcatattcccagtagaatgattttcaagtttgaatttctgtacaaatatctaaataagagatgtgcagagagcaccaattttccttcaatatccattctttacttttcacataatgatagaacctttgatttttcaagtgggtatgcctcctagaataaagactacatttcccagtctcctgtgcaggtatgactgtgttctggacaatggaatgtgaggggaaacgattttttgtgtccttaaaatggcatgaccatttatttgcccctttctccatcctgttgcttggaatgtggatctggtagtgagccatcttggaccctgaagaggaggcaacacaccattgtagaagaaaaacaacagaaggatcctggtccctgtacgacctcattgaagaaacaccataagtggcgtggactatctacctccagactgttttacaagagagaaattagcatattccatctaatacagtatgatgtaactaatgttacttttgtaacagtcagtggtttgttctaacaggacagtagaacacttgcaaggtaagtaaaaccaaatgtattagcattattcctgcttttccttttttgtcacttttatcctttttttaaaactgaaaatatttttctcttgctatttatatatatatgataaaaatgcttggaagagtccttta

SEQ ID NO: 86079 - DNA, 2324 bp, Homo sapiens
agtggcgcggacgcctgctcagtgcgcgccggccgggcaaccctatgctggcgtaatcgggttcctccgagccgccgtaggactggttccggcgggctggtgaggaatggagccggtaggctgctgcggcgagtgccgcggctcctccgtagacccgcggagcaccttcgtgttgagtaacctggcggaggtggtggagcgtgtgctcaccttcctgcccgccaaggcgttgctgcgggtggcctgcgtgtgccgcttatggagggagtgtgtgcgcagagtattgcggacccatcggagcgtaacctggatctccgcaggcctggcggaggccggccacctggaggggcattgcttggttcgcgtggtagcagaggagcttgagaatgttcgcatcttaccacatacagttctttacatggctgattcagaaactttcattagtctggaagagtgtcgtggccataagagagcaaggaaaagaactagtatggaaacagcacttgcccttgagaagctattccccaaacaatgccaagtccttgggattgtgaccccaggaattgtagtgactccaatgggatcaggtagcaatcgacctcaggaaatagaaattggagaatctggttttgctttattattccctcaaattgaaggaataaaaatacaaccctttcattttattaaggatccaaagaatttaacattagaaagacatcaactcactgaagtaggtcttttagataaccctgaacttcgtgtggtccttgtctttggttataattgctgtaaggtgggagccagtaattatctgcagcaagtagtcagcactttcagtgatatgaatatcatcttggctggaggccaggtggacaacctgtcatcactgacttctgaaaagaaccctctggatattgatgcctcgggtgtggttggactgtcatttagtggacaccgaatccagagtgccactgtgctcctcaacgaggacgtcagtgatgagaagactgctgaggctgcgatgcagcgcctcaaagcggccaacattccagagcataacaccattggcttcatgtttgcatgcgttggcaggggctttcagtattacagagccaaggggaatgttgaggctgatgcatttagaaagttttttcctagtgttcccttattcggcttctttggaaatggagaaattggatgtgatcggatagtcactgggaactttatattgaggaaatgtaatgaggtaaaagatgatgatctgtttcatagctatacaacaataatggcactcatacatctggggtcatctaaataataattaaagtggctttcataatatgtaacttttgggttctgcctttttcagaaaatggaaacttgggccatgtgtatttcaaacaaaaataactttagatatatcttttttgtagctttgattgatgctctaagatcacatgagggtagtatttaatatattagatgaaggacaactttggacataacactgactaggagttgagagcttttgcatcaggcagaagcaaactgattatagttgtgttgcaccagatcatgtagctgctgtgtaacatgaccttaaatagtcttcctgcataggaagagcaaaagggtattcatcaataggatatagatttaagacattccctgactaccccttgcgttgttaggtgatgtcttttagcagaatcatgaagaccttttttctcccttaataaaggagaaaaatatactgatggctggagaaatttttctctgcctttcagttttatgaattttttcagaagtaacaatattattattgactttttacttatttgataaaaattaaagaactatttttgttttggtcagataaattgacaagactaatcagtattttattataagtaaaagatttttcttctttccttaaaaatatttttttttcacctaggtctaaatagctaactaactggtagaccagagtattacatcatcttattttggttttataccaataaaacatagcgtggaactcattcaggtaatgttttgcatttcattgcttttggatgaacaaaggaagtaaactaatcctttataaatgaaaacccagaatagttggtatgtcagctagtcattcctgtcatattcccagtagaatgattttcaagtttgaatttctgtacaaatatctaaataagagatgtgcagagagcaccaattttccttcaatatccattctttacttttcacataatgatagaacctttgatttttcaagtgggtatgcctcctagaataaagactacatttcccag

SEQ ID NO: 86080 - DNA, 2711 bp, Homo sapiens
gggaagcttgcctggggacacgccgtgggcatgtcccaggctggcggggtggggggagagacccttgggacccaccagggccgtccccggctcgctcgccctacctgaggtgaccccctacccgcgagcgtgtgccgcttatggagggagtgtgtgcgcagagtattgcggacccatcggagcgtaacctggatctccgcaggcctggcggaggccggccacctggaggggcattgcttggttcgcgtggtagcagaggagcttgagaatgttcgcatcttaccacatacagttctttacatggctgattcagaaactttcattagtctggaagagtgtcgtggccataagagagcaaggaaaagaactagtatggaaacagcacttgcccttgagaagctattccccaaacaatgccaagtccttgggattgtgaccccaggaattgtagtgactccaatgggatcaggtagcaatcgacctcaggaaatagaaattggagaatctggttttgctttattattccctcaaattgaaggaataaaaatacaaccctttcattttattaaggatccaaagaatttaacattagaaagacatcaactcactgaagtaggtcttttagataaccctgaacttcgtgtggtccttgtctttggttataattgctgtaaggtgggagccagtaattatctgcagcaagtagtcagcactttcagtgatatgaatatcatcttggctggaggccaggtggacaacctgtcatcactgacttctgaaaagaaccctctggatattgatgcctcgggtgtggttggactgtcatttagtggacaccgaatccagagtgccactgtgctcctcaacgaggacgtcagtgatgagaagactgctgaggctgcgatgcagcgcctcaaagcggccaacattccagagcataacaccattggcttcatgtttgcatgcgttggcaggggctttcagtattacagagccaaggggaatgttgaggctgatgcatttagaaagttttttcctagtgttcccttattcggcttctttggaaatggagaaattggatgtgatcggatagtcactgggaactttatattgaggaaatgtaatgaggtaaaagatgatgatctgtttcatagctatacaacaataatggcactcatacatctggggtcatctaaataataattaaagtggctttcataatatgtaacttttgggttctgcctttttcagaaaatggaaacttgggccatgtgtatttcaaacaaaaataactttagatatatcttttttgtagctttgattgatgctctaagatcacatgagggtagtatttaatatattagatgaaggacaactttggacataacactgactaggagttgagagcttttgcatcaggcagaagcaaactgattatagttgtgttgcaccagatcatgtagctgctgtgtaacatgaccttaaatagtcttcctgcataggaagagcaaaagggtattcatcaataggatatagatttaagacattccctgactaccccttgcgttgttaggtgatgtcttttagcagaatcatgaagaccttttttctcccttaataaaggagaaaaatatactgatggctggagaaatttttctctgcctttcagttttatgaattttttcagaagtaacaatattattattgactttttacttatttgataaaaattaaagaactatttttgttttggtcagataaattgacaagactaatcagtattttattataagtaaaagatttttcttctttccttaaaaatatttttttttcacctaggtctaaatagctaactaactggtagaccagagtattacatcatcttattttggttttataccaataaaacatagcgtggaactcattcaggtaatgttttgcatttcattgcttttggatgaacaaaggaagtaaactaatcctttataaatgaaaacccagaatagttggtatgtcagctagtcattcctgtcatattcccagtagaatgattttcaagtttgaatttctgtacaaatatctaaataagagatgtgcagagagcaccaattttccttcaatatccattctttacttttcacataatgatagaacctttgatttttcaagtgggtatgcctcctagaataaagactacatttcccagtctcctgtgcaggtatgactgtgttctggacaatggaatgtgaggggaaacgattttttgtgtccttaaaatggcatgaccatttatttgcccctttctccatcctgttgcttggaatgtggatctggtagtgagccatcttggaccctgaagaggaggcaacacaccattgtagaagaaaaacaacagaaggatcctggtccctgtacgacctcattgaagaaacaccataagtggcgtggactatctacctccagactgttttacaagagagaaattagcatattccatctaatacagtatgatgtaactaatgttacttttgtaacagtcagtggtttgttctaacaggacagtagaacacttgcaaggtaagtaaaaccaaatgtattagcattattcctgcttttccttttttgtcacttttatcctttttttaaaactgaaaatatttttctcttgctatttatatatatatgataaaaatgcttggaagagtccttta

SEQ ID NO: 86081 - DNA, 2767 bp, Homo sapiens
agtggcgcggacgcctgctcagtgcgcgccggccgggcaaccctatgctggcgtaatcgggttcctccgagccgccgtaggactggttccggcgggctggtgaggaatggagccggtaggctgctgcggcgagtgccgcggctcctccgtagacccgcggagcaccttcgtgttgagtaacctggcggaggtggtggagcgtgtgctcaccttcctgcccgccaaggcgttgctgcgggtggcctgcgtgtgccgcttatggagggagtgtgtgcgcagagtattgcggacccatcggagcgtaacctggatctccgcaggcctggcggaggccggccacctggaggggcattgcttggttcgcgtggtagcagaggagcttgagaatgttcgcatcttaccacatacagttctttacatggctgattcagaaactttcattagtctggaagagtgtcgtggccataagagagcaaggaaaagaactagtatggaaacagcacttgcccttgagaagctattccccaaacaatgccaagtccttgggattgtgaccccaggaattgtagtgactccaatgggatcaggtagcaatcgacctcaggaaatagaaattggagaatctggttttgctttattattccctcaaattgaaggaataaaaatacaaccgtcttttagataaccctgaacttcgtgtggtccttgtctttggttataattgctgtaaggtgggagccagtaattatctgcagcaagtagtcagcactttcagtgatatgaatatcatcttggctggaggccaggtggacaacctgtcatcactgacttctgaaaagaaccctctggatattgatgcctcgggtgtggttggactgtcatttagtggacaccgaatccagagtgccactgtgctcctcaacgaggacgtcagtgatgagaagactgctgaggctgcgatgcagcgcctcaaagcggccaacattccagagcataacaccattggcttcatgtttgcatgcgttggcaggggctttcagtattacagagccaaggggaatgttgaggctgatgcatttagaaagttttttcctagtgttcccttattcggcttctttggaaatggagaaattggatgtgatcggatagtcactgggaactttatattgaggaaatgtaatgaggtaaaagatgatgatctgtttcatagctatacaacaataatggcactcatacatctggggtcatctaaataataattaaagtggctttcataatatgtaacttttgggttctgcctttttcagaaaatggaaacttgggccatgtgtatttcaaacaaaaataactttagatatatcttttttgtagctttgattgatgctctaagatcacatgagggtagtatttaatatattagatgaaggacaactttggacataacactgactaggagttgagagcttttgcatcaggcagaagcaaactgattatagttgtgttgcaccagatcatgtagctgctgtgtaacatgaccttaaatagtcttcctgcataggaagagcaaaagggtattcatcaataggatatagatttaagacattccctgactaccccttgcgttgttaggtgatgtcttttagcagaatcatgaagaccttttttctcccttaataaaggagaaaaatatactgatggctggagaaatttttctctgcctttcagttttatgaattttttcagaagtaacaatattattattgactttttacttatttgataaaaattaaagaactatttttgttttggtcagataaattgacaagactaatcagtattttattataagtaaaagatttttcttctttccttaaaaatatttttttttcacctaggtctaaatagctaactaactggtagaccagagtattacatcatcttattttggttttataccaataaaacatagcgtggaactcattcaggtaatgttttgcatttcattgcttttggatgaacaaaggaagtaaactaatcctttataaatgaaaacccagaatagttggtatgtcagctagtcattcctgtcatattcccagtagaatgattttcaagtttgaatttctgtacaaatatctaaataagagatgtgcagagagcaccaattttccttcaatatccattctttacttttcacataatgatagaacctttgatttttcaagtgggtatgcctcctagaataaagactacatttcccagtctcctgtgcaggtatgactgtgttctggacaatggaatgtgaggggaaacgattttttgtgtccttaaaatggcatgaccatttatttgcccctttctccatcctgttgcttggaatgtggatctggtagtgagccatcttggaccctgaagaggaggcaacacaccattgtagaagaaaaacaacagaaggatcctggtccctgtacgacctcattgaagaaacaccataagtggcgtggactatctacctccagactgttttacaagagagaaattagcatattccatctaatacagtatgatgtaactaatgttacttttgtaacagtcagtggtttgttctaacaggacagtagaacacttgcaaggtaagtaaaaccaaatgtattagcattattcctgcttttccttttttgtcacttttatcctttttttaaaactgaaaatatttttctcttgctatttatatatatatgataaaaatgcttggaagagtccttta

SEQ ID NO: 86082 - DNA, 2664 bp, Homo sapiens
agtggcgcggacgcctgctcagtgcgcgccggccgggcaaccctatgctggcgtaatcgggttcctccgagccgccgtaggactggttccggcgggctggtgaggaatggagccggtaggctgctgcggcgagtgccgcggctcctccgtagacccgcggagcaccttcgtgttgagtaacctggcggaggtggtggagcgtgtgctcaccttcctgcccgccaaggcgttgctgcgggtggcctgcgtgtgccgcttatggagggagtgtgtgcgcagagtattgcggacccatcggagcgtaacctggatctccgcaggcctggcggaggccggccacctggaggggcattgcttggttcgcgtggtagcagaggagcttgagaatgttcgcatcttaccacatacagttctttacatggctgattcagaaactttcattagtctggaagagtgtcgtggccataagagagcaaggaaaagaactagtatggaaacagcacttgcccttgagaagctattccccaaacaatgccaagtccttgggattgtgaccccaggaattgtaggtcttttagataaccctgaacttcgtgtggtccttgtctttggttataattgctgtaaggtgggagccagtaattatctgcagcaagtagtcagcactttcagtgatatgaatatcatcttggctggaggccaggtggacaacctgtcatcactgacttctgaaaagaaccctctggatattgatgcctcgggtgtggttggactgtcatttagtggacaccgaatccagagtgccactgtgctcctcaacgaggacgtcagtgatgagaagactgctgaggctgcgatgcagcgcctcaaagcggccaacattccagagcataacaccattggcttcatgtttgcatgcgttggcaggggctttcagtattacagagccaaggggaatgttgaggctgatgcatttagaaagttttttcctagtgttcccttattcggcttctttggaaatggagaaattggatgtgatcggatagtcactgggaactttatattgaggaaatgtaatgaggtaaaagatgatgatctgtttcatagctatacaacaataatggcactcatacatctggggtcatctaaataataattaaagtggctttcataatatgtaacttttgggttctgcctttttcagaaaatggaaacttgggccatgtgtatttcaaacaaaaataactttagatatatcttttttgtagctttgattgatgctctaagatcacatgagggtagtatttaatatattagatgaaggacaactttggacataacactgactaggagttgagagcttttgcatcaggcagaagcaaactgattatagttgtgttgcaccagatcatgtagctgctgtgtaacatgaccttaaatagtcttcctgcataggaagagcaaaagggtattcatcaataggatatagatttaagacattccctgactaccccttgcgttgttaggtgatgtcttttagcagaatcatgaagaccttttttctcccttaataaaggagaaaaatatactgatggctggagaaatttttctctgcctttcagttttatgaattttttcagaagtaacaatattattattgactttttacttatttgataaaaattaaagaactatttttgttttggtcagataaattgacaagactaatcagtattttattataagtaaaagatttttcttctttccttaaaaatatttttttttcacctaggtctaaatagctaactaactggtagaccagagtattacatcatcttattttggttttataccaataaaacatagcgtggaactcattcaggtaatgttttgcatttcattgcttttggatgaacaaaggaagtaaactaatcctttataaatgaaaacccagaatagttggtatgtcagctagtcattcctgtcatattcccagtagaatgattttcaagtttgaatttctgtacaaatatctaaataagagatgtgcagagagcaccaattttccttcaatatccattctttacttttcacataatgatagaacctttgatttttcaagtgggtatgcctcctagaataaagactacatttcccagtctcctgtgcaggtatgactgtgttctggacaatggaatgtgaggggaaacgattttttgtgtccttaaaatggcatgaccatttatttgcccctttctccatcctgttgcttggaatgtggatctggtagtgagccatcttggaccctgaagaggaggcaacacaccattgtagaagaaaaacaacagaaggatcctggtccctgtacgacctcattgaagaaacaccataagtggcgtggactatctacctccagactgttttacaagagagaaattagcatattccatctaatacagtatgatgtaactaatgttacttttgtaacagtcagtggtttgttctaacaggacagtagaacacttgcaaggtaagtaaaaccaaatgtattagcattattcctgcttttccttttttgtcacttttatcctttttttaaaactgaaaatatttttctcttgctatttatatatatatgataaaaatgcttggaagagtccttta

SEQ ID NO: 86083 - DNA, 2663 bp, Homo sapiens
agtggcgcggacgcctgctcagtgcgcgccggccgggcaaccctatgctggcgtaatcgggttcctccgagccgccgtaggactggttccggcgggctggtgaggaatggagccggtaggctgctgcggcgagtgccgcggctcctccgtagacccgcggagcaccttcgtgttgagtaacctggcggaggtggtggagcgtgtgctcaccttcctgcccgccaaggcgttgctgcgggtggcctgcgtgtgccgcttatggagggagtgtgtgcgcagagtattgcggacccatcggagcgtaacctggatctccgcaggcctggcggaggccggccacctggaggggcattgcttggttcgcgtggtagcagaggagcttgagaatgttcgcatcttaccacatacagttctttacatggctgattcagaaactttcattagtctggaagagtgtcgtggccataagagagcaaggaaaagaactagtatggaaacagcacttgcccttgagaagctattccccaaacaatgccaagtccttgggattgtgaccccaggaattgtagtgactccaatgggatcaggtagcaatcgacctcaggaaatagaaattggagaatctggttttgctttattattccctcaaattgaaggaataaaaatacaaccctttcattttattaaggatccaaagaatttaacattagaaagacatcaactcactgaagtaggaaccctctggatattgatgcctcgggtgtggttggactgtcatttagtggacaccgaatccagagtgccactgtgctcctcaacgaggacgtcagtgatgagaagactgctgaggctgcgatgcagcgcctcaaagcggccaacattccagagcataacaccattggcttcatgtttgcatgcgttggcaggggctttcagtattacagagccaaggggaatgttgaggctgatgcatttagaaagttttttcctagtgttcccttattcggcttctttggaaatggagaaattggatgtgatcggatagtcactgggaactttatattgaggaaatgtaatgaggtaaaagatgatgatctgtttcatagctatacaacaataatggcactcatacatctggggtcatctaaataataattaaagtggctttcataatatgtaacttttgggttctgcctttttcagaaaatggaaacttgggccatgtgtatttcaaacaaaaataactttagatatatcttttttgtagctttgattgatgctctaagatcacatgagggtagtatttaatatattagatgaaggacaactttggacataacactgactaggagttgagagcttttgcatcaggcagaagcaaactgattatagttgtgttgcaccagatcatgtagctgctgtgtaacatgaccttaaatagtcttcctgcataggaagagcaaaagggtattcatcaataggatatagatttaagacattccctgactaccccttgcgttgttaggtgatgtcttttagcagaatcatgaagaccttttttctcccttaataaaggagaaaaatatactgatggctggagaaatttttctctgcctttcagttttatgaattttttcagaagtaacaatattattattgactttttacttatttgataaaaattaaagaactatttttgttttggtcagataaattgacaagactaatcagtattttattataagtaaaagatttttcttctttccttaaaaatatttttttttcacctaggtctaaatagctaactaactggtagaccagagtattacatcatcttattttggttttataccaataaaacatagcgtggaactcattcaggtaatgttttgcatttcattgcttttggatgaacaaaggaagtaaactaatcctttataaatgaaaacccagaatagttggtatgtcagctagtcattcctgtcatattcccagtagaatgattttcaagtttgaatttctgtacaaatatctaaataagagatgtgcagagagcaccaattttccttcaatatccattctttacttttcacataatgatagaacctttgatttttcaagtgggtatgcctcctagaataaagactacatttcccagtctcctgtgcaggtatgactgtgttctggacaatggaatgtgaggggaaacgattttttgtgtccttaaaatggcatgaccatttatttgcccctttctccatcctgttgcttggaatgtggatctggtagtgagccatcttggaccctgaagaggaggcaacacaccattgtagaagaaaaacaacagaaggatcctggtccctgtacgacctcattgaagaaacaccataagtggcgtggactatctacctccagactgttttacaagagagaaattagcatattccatctaatacagtatgatgtaactaatgttacttttgtaacagtcagtggtttgttctaacaggacagtagaacacttgcaaggtaagtaaaaccaaatgtattagcattattcctgcttttccttttttgtcacttttatcctttttttaaaactgaaaatatttttctcttgctatttatatatatatgataaaaatgcttggaagagtccttta

SEQ ID NO: 86084 - DNA, 1633 bp, Homo sapiens
agtggcgcggacgcctgctcagtgcgcgccggccgggcaaccctatgctggcgtaatcgggttcctccgagccgccgtaggactggttccggcgggctggtgaggaatggagccggtaggctgctgcggcgagtgccgcggctcctccgtagacccgcggagcaccttcgtgttgagtaacctggcggaggtggtggagcgtgtgctcaccttcctgcccgccaaggcgttgctgcgggtggcctgaatgttcgcatcttaccacatacagttctttacatggctgattcagaaactttcattagtctggaagagtgtcgtggccataagagagcaaggaaaagaactagtatggaaacagcacttgcccttgagaagctattccccaaacaatgccaagtccttgggattgtgaccccaggaattgtagtgactccaatgggatcaggtagcaatcgacctcaggaaatagaaattggagaatctggttttgctttattattccctcaaattgaaggaataaaaatacaaccctttcattttattaaggatccaaagaatttaacattagaaagacatcaactcactgaagtaggtcttttagataaccctgaacttcgtgtggtccttgtctttggttataattgctgtaaggtgggagccagtaattatctgcagcaagtagtcagcactttcagtgatatgaatatcatcttggctggaggccaggtggacaacctgtcatcactgacttctgaaaagtctaaatagctaactaactggtagaccagagtattacatcatcttattttggttttataccaataaaacatagcgtggaactcattcaggtaatgttttgcatttcattgcttttggatgaacaaaggaagtaaactaatcctttataaatgaaaacccagaatagttggtatgtcagctagtcattcctgtcatattcccagtagaatgattttcaagtttgaatttctgtacaaatatctaaataagagatgtgcagagagcaccaattttccttcaatatccattctttacttttcacataatgatagaacctttgatttttcaagtgggtatgcctcctagaataaagactacatttcccagtctcctgtgcaggtatgactgtgttctggacaatggaatgtgaggggaaacgattttttgtgtccttaaaatggcatgaccatttatttgcccctttctccatcctgttgcttggaatgtggatctggtagtgagccatcttggaccctgaagaggaggcaacacaccattgtagaagaaaaacaacagaaggatcctggtccctgtacgacctcattgaagaaacaccataagtggcgtggactatctacctccagactgttttacaagagagaaattagcatattccatctaatacagtatgatgtaactaatgttacttttgtaacagtcagtggtttgttctaacaggacagtagaacacttgcaaggtaagtaaaaccaaatgtattagcattattcctgcttttccttttttgtcacttttatcctttttttaaaactgaaaatatttttctcttgctatttatatatatatgataaaaatgcttggaagagtccttta

SEQ ID NO: 86085 - DNA, 349 bp, Homo sapiens
caaggaaaagaactagtatggaaacagcacttgcccttgagaagctattccccaaacaatgccaagtccttgggattgtgaccccaggaattgtaggtgagataaattagcaacttgatgatttcttccttgcattaatgtggggtcctttggattggtgagttatttttagcttagaaccacatttctatttctgtccatctaaaatacaataaagtcagtcatatttaccatggcattatatttgccttatattaatgtttattaagttattgtacttctcatctcaaggttacctgtataaatatccagtagtcattcataagaggggaatgatctcattctgcct

SEQ ID NO: 86086 - DNA, 571 bp, Homo sapiens
agtggcgcggacgcctgctcagtgcgcgccggccgggcaaccctatgctggcgtaatcgggttcctccgagccgccgtaggactggttccggcgggctggtgaggaatggagccggtaggctgctgcggcgagtgccgcggctcctccgtagacccgcggagcaccttcgtgttgagtaacctggcggaggtggtggagcgtgtgctcaccttcctgcccgccaaggcgttgctgcgggtggcctgcgtgtgccgcttatggagggagtgtgtgcgcagagtattgcggacccatcggagcgtaacctggatctccgcaggcctggcggaggccggccacctggaggggcattgcttggttcgcgtggtagcagaggagcttgagactcggttcagattttgccagttgtcccagtaaggttcttcatggcaaaaagatctgttcccaattgcaatttgctctgaatccttgaggaatcaccacactgtcttccacaatggttgaactaatttgcactcctacaaacagtgtgaaagtgttcctgtttctccacatcctctccagcatctg

SEQ ID NO: 86087 - DNA, 2690 bp, Homo sapiens
agtggcgcggacgcctgctcagtgcgcgccggccgggcaaccctatgctggcgtaatcgggttcctccgagccgccgtaggactggttccggcgggctggtgaggaatggagccggtaggctgctgcggcgagtgccgcggctcctccgtagacccgcggagcaccttcgtgttgagtaacctggcggaggtggtggagcgtgtgctcaccttcctgcccgccaaggcgttgctgcgggtggcctgaatgttcgcatcttaccacatacagttctttacatggctgattcagaaactttcattagtctggaagagtgtcgtggccataagagagcaaggaaaagaactagtatggaaacagcacttgcccttgagaagctattccccaaacaatgccaagtccttgggattgtgaccccaggaattgtagtgactccaatgggatcaggtagcaatcgacctcaggaaatagaaattggagaatctggttttgctttattattccctcaaattgaaggaataaaaatacaaccctttcattttattaaggatccaaagaatttaacattagaaagacatcaactcactgaagtaggtcttttagataaccctgaacttcgtgtggtccttgtctttggttataattgctgtaaggtgggagccagtaattatctgcagcaagtagtcagcactttcagtgatatgaatatcatcttggctggaggccaggtggacaacctgtcatcactgacttctgaaaagaaccctctggatattgatgcctcgggtgtggttggactgtcatttagtggacaccgaatccagagtgccactgtgctcctcaacgaggacgtcagtgatgagaagactgctgaggctgcgatgcagcgcctcaaagcggccaacattccagagcataacaccattggcttcatgtttgcatgcgttggcaggggctttcagtattacagagccaaggggaatgttgaggctgatgcatttagaaagttttttcctagtgttcccttattcggcttctttggaaatggagaaattggatgtgatcggatagtcactgggaactttatattgaggaaatgtaatgaggtaaaagatgatgatctgtttcatagctatacaacaataatggcactcatacatctggggtcatctaaataataattaaagtggctttcataatatgtaacttttgggttctgcctttttcagaaaatggaaacttgggccatgtgtatttcaaacaaaaataactttagatatatcttttttgtagctttgattgatgctctaagatcacatgagggtagtatttaatatattagatgaaggacaactttggacataacactgactaggagttgagagcttttgcatcaggcagaagcaaactgattatagttgtgttgcaccagatcatgtagctgctgtgtaacatgaccttaaatagtcttcctgcataggaagagcaaaagggtattcatcaataggatatagatttaagacattccctgactaccccttgcgttgttaggtgatgtcttttagcagaatcatgaagaccttttttctcccttaataaaggagaaaaatatactgatggctggagaaatttttctctgcctttcagttttatgaattttttcagaagtaacaatattattattgactttttacttatttgataaaaattaaagaactatttttgttttggtcagataaattgacaagactaatcagtattttattataagtaaaagatttttcttctttccttaaaaatatttttttttcacctaggtctaaatagctaactaactggtagaccagagtattacatcatcttattttggttttataccaataaaacatagcgtggaactcattcaggtaatgttttgcatttcattgcttttggatgaacaaaggaagtaaactaatcctttataaatgaaaacccagaatagttggtatgtcagctagtcattcctgtcatattcccagtagaatgattttcaagtttgaatttctgtacaaatatctaaataagagatgtgcagagagcaccaattttccttcaatatccattctttacttttcacataatgatagaacctttgatttttcaagtgggtatgcctcctagaataaagactacatttcccagtctcctgtgcaggtatgactgtgttctggacaatggaatgtgaggggaaacgattttttgtgtccttaaaatggcatgaccatttatttgcccctttctccatcctgttgcttggaatgtggatctggtagtgagccatcttggaccctgaagaggaggcaacacaccattgtagaagaaaaacaacagaaggatcctggtccctgtacgacctcattgaagaaacaccataagtggcgtggactatctacctccagactgttttacaagagagaaattagcatattccatctaatacagtatgatgtaactaatgttacttttgtaacagtcagtggtttgttctaacaggacagtagaacacttgcaaggtaagtaaaaccaaatgtattagcattattcctgcttttccttttttgtcacttttatcctttttttaaaactgaaaatatttttctcttgctatttatatatatatgataaaaatgcttggaagagtccttta

SEQ ID NO: 86088 - DNA, 2909 bp, Homo sapiens
agtggcgcggacgcctgctcagtgcgcgccggccgggcaaccctatgctggcgtaatcgggttcctccgagccgccgtaggactggttccggcgggctggtgaggaatggagccggtaggctgctgcggcgagtgccgcggctcctccgtagacccgcggagcaccttcgtgttgagtaacctggcggaggtggtggagcgtgtgctcaccttcctgcccgccaaggcgttgctgcgggtggcctgcgtgtgccgcttatggagggagtgtgtgcgcagagtattgcggacccatcggagcgtaacctggatctccgcaggcctggcggaggccggccacctggaggggcattgcttggttcgcgtggtagcagaggagcttgagactcggttcagattttgccagttgtcccagtaaggttcttcatggcaaaaagatctgttcccaattgcaatttgctctgaaatgttcgcatcttaccacatacagttctttacatggctgattcagaaactttcattagtctggaagagtgtcgtggccataagagagcaaggaaaagaactagtatggaaacagcacttgcccttgagaagctattccccaaacaatgccaagtccttgggattgtgaccccaggaattgtagtgactccaatgggatcaggtagcaatcgacctcaggaaatagaaattggagaatctggttttgctttattattccctcaaattgaaggaataaaaatacaaccctttcattttattaaggatccaaagaatttaacattagaaagacatcaactcactgaagtaggtcttttagataaccctgaacttcgtgtggtccttgtctttggttataattgctgtaaggtgggagccagtaattatctgcagcaagtagtcagcactttcagtgatatgaatatcatcttggctggaggccaggtggacaacctgtcatcactgacttctgaaaagaaccctctggatattgatgcctcgggtgtggttggactgtcatttagtggacaccgaatccagagtgccactgtgctcctcaacgaggacgtcagtgatgagaagactgctgaggctgcgatgcagcgcctcaaagcggccaacattccagagcataacaccattggcttcatgtttgcatgcgttggcaggggctttcagtattacagagccaaggggaatgttgaggctgatgcatttagaaagttttttcctagtgttcccttattcggcttctttggaaatggagaaattggatgtgatcggatagtcactgggaactttatattgaggaaatgtaatgaggtaaaagatgatgatctgtttcatagctatacaacaataatggcactcatacatctggggtcatctaaataataattaaagtggctttcataatatgtaacttttgggttctgcctttttcagaaaatggaaacttgggccatgtgtatttcaaacaaaaataactttagatatatcttttttgtagctttgattgatgctctaagatcacatgagggtagtatttaatatattagatgaaggacaactttggacataacactgactaggagttgagagcttttgcatcaggcagaagcaaactgattatagttgtgttgcaccagatcatgtagctgctgtgtaacatgaccttaaatagtcttcctgcataggaagagcaaaagggtattcatcaataggatatagatttaagacattccctgactaccccttgcgttgttaggtgatgtcttttagcagaatcatgaagaccttttttctcccttaataaaggagaaaaatatactgatggctggagaaatttttctctgcctttcagttttatgaattttttcagaagtaacaatattattattgactttttacttatttgataaaaattaaagaactatttttgttttggtcagataaattgacaagactaatcagtattttattataagtaaaagatttttcttctttccttaaaaatatttttttttcacctaggtctaaatagctaactaactggtagaccagagtattacatcatcttattttggttttataccaataaaacatagcgtggaactcattcaggtaatgttttgcatttcattgcttttggatgaacaaaggaagtaaactaatcctttataaatgaaaacccagaatagttggtatgtcagctagtcattcctgtcatattcccagtagaatgattttcaagtttgaatttctgtacaaatatctaaataagagatgtgcagagagcaccaattttccttcaatatccattctttacttttcacataatgatagaacctttgatttttcaagtgggtatgcctcctagaataaagactacatttcccagtctcctgtgcaggtatgactgtgttctggacaatggaatgtgaggggaaacgattttttgtgtccttaaaatggcatgaccatttatttgcccctttctccatcctgttgcttggaatgtggatctggtagtgagccatcttggaccctgaagaggaggcaacacaccattgtagaagaaaaacaacagaaggatcctggtccctgtacgacctcattgaagaaacaccataagtggcgtggactatctacctccagactgttttacaagagagaaattagcatattccatctaatacagtatgatgtaactaatgttacttttgtaacagtcagtggtttgttctaacaggacagtagaacacttgcaaggtaagtaaaaccaaatgtattagcattattcctgcttttccttttttgtcacttttatcctttttttaaaactgaaaatatttttctcttgctatttatatatatatgataaaaatgcttggaagagtccttta

SEQ ID NO: 86089 - DNA, 2406 bp, Homo sapiens
agcgttctcgaggatccccgtcggatgcaagtgtcgtggccgtaagagagcaaggaaaagaactagtatggaaacagcacttgcccttgagaagctattccccaaacaatgccaagtccttgggattgtgaccccaggaattgtagtgactccaatgggatcaggtagcaatcgacctcaggaaatagaaattggagaatctggttttgctttattattccctcaaattgaaggaataaaaatacaaccctttcattttattaaggatccaaagaatttaacattagaaagacatcaactcactgaagtaggtcttttagataaccctgaacttcgtgtggtccttgtctttggttataattgctgtaaggtgggagccagtaattatctgcagcaagtagtcagcactttcagtgatatgaatatcatcttggctggaggccaggtggacaacctgtcatcactgacttctgaaaagaaccctctggatattgatgcctcgggtgtggttggactgtcatttagtggacaccgaatccagagtgccactgtgctcctcaacgaggacgtcagtgatgagaagactgctgaggctgcgatgcagcgcctcaaagcggccaacattccagagcataacaccattggcttcatgtttgcatgcgttggcaggggctttcagtattacagagccaaggggaatgttgaggctgatgcatttagaaagttttttcctagtgttcccttattcggcttctttggaaatggagaaattggatgtgatcggatagtcactgggaactttatattgaggaaatgtaatgaggtaaaagatgatgatctgtttcatagctatacaacaataatggcactcatacatctggggtcatctaaataataattaaagtggctttcataatatgtaacttttgggttctgcctttttcagaaaatggaaacttgggccatgtgtatttcaaacaaaaataactttagatatatcttttttgtagctttgattgatgctctaagatcacatgagggtagtatttaatatattagatgaaggacaactttggacataacactgactaggagttgagagcttttgcatcaggcagaagcaaactgattatagttgtgttgcaccagatcatgtagctgctgtgtaacatgaccttaaatagtcttcctgcataggaagagcaaaagggtattcatcaataggatatagatttaagacattccctgactaccccttgcgttgttaggtgatgtcttttagcagaatcatgaagaccttttttctcccttaataaaggagaaaaatatactgatggctggagaaatttttctctgcctttcagttttatgaattttttcagaagtaacaatattattattgactttttacttatttgataaaaattaaagaactatttttgttttggtcagataaattgacaagactaatcagtattttattataagtaaaagatttttcttctttccttaaaaatatttttttttcacctaggtctaaatagctaactaactggtagaccagagtattacatcatcttattttggttttataccaataaaacatagcgtggaactcattcaggtaatgttttgcatttcattgcttttggatgaacaaaggaagtaaactaatcctttataaatgaaaacccagaatagttggtatgtcagctagtcattcctgtcatattcccagtagaatgattttcaagtttgaatttctgtacaaatatctaaataagagatgtgcagagagcaccaattttccttcaatatccattctttacttttcacataatgatagaacctttgatttttcaagtgggtatgcctcctagaataaagactacatttcccagtctcctgtgcaggtatgactgtgttctggacaatggaatgtgaggggaaacgattttttgtgtccttaaaatggcatgaccatttatttgcccctttctccatcctgttgcttggaatgtggatctggtagtgagccatcttggaccctgaagaggaggcaacacaccattgtagaagaaaaacaacagaaggatcctggtccctgtacgacctcattgaagaaacaccataagtggcgtggactatctacctccagactgttttacaagagagaaattagcatattccatctaatacagtatgatgtaactaatgttacttttgtaacagtcagtggtttgttctaacaggacagtagaacacttgcaaggtaagtaaaaccaaatgtattagcattattcctgcttttccttttttgtcacttttatcctttttttaaaactgaaaatatttttctcttgctatttatatatatatgataaaaatgcttggaagagtccttta

SEQ ID NO: 86090 - DNA, 2118 bp, Homo sapiens
agtggcgcggacgcctgctcagtgcgcgccggccgggcaaccctatgctggcgtaatcgggttcctccgagccgccgtaggactggttccggcgggctggtgaggaatggagccggtaggctgctgcggcgagtgccgcggctcctccgtagacccgcggagcaccttcgtgttgagtaacctggcggaggtggtggagcgtgtgctcaccttcctgcccgccaaggcgttgctgcgggtggcctgcgtgtgccgcttatggagggagtgtgtgcgcagagtattgcggacccatcggagcgtaacctggatctccgcaggcctggcggaggccggccacctggaggggcattgcttggttcgcgtggtagcagaggagcttgagaatgttcgcatcttaccacatacagttctttacatggctgattcagaaactttcattagtctggaagagtgtcgtggccataagagagcaaggaaaagaactagtatggaaacagcacttgcccttgagaagctattccccaaacaatgccaagtccttgggattgtgaccccaggaattgtagtgactccaatgggatcaggtagcaatcgacctcaggaaatagaaattggagaatctggttttgctttattattccctcaaattgaaggaataaaaatacaaccctttcattttattaaggatccaaagaatttaacattagaaagacatcaactcactgaagtaggtcttttagataaccctgaacttcgtgtggtccttgtctttggttataattgctgtaaggtgggagccagtaattatctgcagcaagtagtcagcactttcagtgatatgaatatcatcttggctggaggccaggtggacaacctgtcatcactgacttctgaaaagaaccctctggatattgatgcctcgggtgtggttggactgtcatttagtggacaccgaatccagagtgccactgtgctcctcaacgaggacgtcagtgatgagaagactgctgaggctgcgatgcagcgcctcaaagcggccaacattccagagcataacaccattggcttcatgtttgcatgcgttggcaggggctttcagtattacagagccaaggggaatgttgaggctgatgcatttagaaagttttttcctagtgttcccttattcggcttctttggaaatggagaaattggatgtgatcggatagtcactgggaactttatattgaggaaatgtaatgaggtctaaatagctaactaactggtagaccagagtattacatcatcttattttggttttataccaataaaacatagcgtggaactcattcaggtaatgttttgcatttcattgcttttggatgaacaaaggaagtaaactaatcctttataaatgaaaacccagaatagttggtatgtcagctagtcattcctgtcatattcccagtagaatgattttcaagtttgaatttctgtacaaatatctaaataagagatgtgcagagagcaccaattttccttcaatatccattctttacttttcacataatgatagaacctttgatttttcaagtgggtatgcctcctagaataaagactacatttcccagtctcctgtgcaggtatgactgtgttctggacaatggaatgtgaggggaaacgattttttgtgtccttaaaatggcatgaccatttatttgcccctttctccatcctgttgcttggaatgtggatctggtagtgagccatcttggaccctgaagaggaggcaacacaccattgtagaagaaaaacaacagaaggatcctggtccctgtacgacctcattgaagaaacaccataagtggcgtggactatctacctccagactgttttacaagagagaaattagcatattccatctaatacagtatgatgtaactaatgttacttttgtaacagtcagtggtttgttctaacaggacagtagaacacttgcaaggtaagtaaaaccaaatgtattagcattattcctgcttttccttttttgtcacttttatcctttttttaaaactgaaaatatttttctcttgctatttatatatatatgataaaaatgcttggaagagtccttta

SEQ ID NO: 86091 - DNA, 1495 bp, Homo sapiens
agtggcgcggacgcctgctcagtgcgcgccggccgggcaaccctatgctggcgtaatcgggttcctccgagccgccgtaggactggttccggcgggctggtgaggaatggagccggtaggctgctgcggcgagtgccgcggctcctccgtagacccgcggagcaccttcgtgttgagtaacctggcggaggtggtggagcgtgtgctcaccttcctgcccgccaaggcgttgctgcgggtggcctgcgtgtgccgcttatggagggagtgtgtgcgcagagtattgcggacccatcggagcgtaacctggatctccgcaggcctggcggaggccggccacctggaggggcattgcttggttcgcgtggtagcagaggagcttgagaatgttcgcatcttaccacatacagttctttacatggctgattcagaaactttcattagtctggaagagtgtcgtggccataagagagcaaggaaaagaactagtatggaaacagcacttgcccttgagaagctattccccaaacaatgccaagtccttgggattgtgaccccaggaattgtagtgactccaatgggatcaggtagcaatcgacctcaggaaatagaaattggagaatctggttttgctttattattccctcaaattgaaggaataaaaatacaaccctttcattttattaaggatccaaagaatttaacattagaaagacatcaactcactgaagtaggtcttttagataaccctgaacttcgtgtggtccttgtctttggttataattgctgtaaggtgggagccagtaattatctgcagcaagtagtcagcactttcagtgatatgaatatcatcttggctggaggccaggtggacaacctgtcatcactgacttctgaaaagtctaaatagctaactaactggtagaccagagtattacatcatcttattttggttttataccaataaaacatagcgtggaactcattcagtctcctgtgcaggtatgactgtgttctggacaatggaatgtgaggggaaacgattttttgtgtccttaaaatggcatgaccatttatttgcccctttctccatcctgttgcttggaatgtggatctggtagtgagccatcttggaccctgaagaggaggcaacacaccattgtagaagaaaaacaacagaaggatcctggtccctgtacgacctcattgaagaaacaccataagtggcgtggactatctacctccagactgttttacaagagagaaattagcatattccatctaatacagtatgatgtaactaatgttacttttgtaacagtcagtggtttgttctaacaggacagtagaacacttgcaaggtaagtaaaaccaaatgtattagcattattcctgcttttccttttttgtcacttttatcctttttttaaaactgaaaatatttttctcttgctatttatatatatatgataaaaatgcttggaagagtccttta

SEQ ID NO: 86092 - DNA, 494 bp, Homo sapiens
ggtattcataaattatatcgtctcttaaagatgccctgttctaactggctgagagagatagtaagttcttatataaaatatttctaaaattcctagataataaataattttaacttacaatattttaaatatgctacactgaaaatattctacttataattttgagaatgtgagttcatataattaggataaatctgtagcaaatgagactaacttaataattccagttattaaggaaacccaaaagccaggtatgatgacgtgtacctataatgctagctacttgggattataggcatgtgtcaccatgcccagctaattttttatttttagtagaggtggggttttgccatgttggccaggctggtcttgaactcctggcctcaagcaatctgcccaccttgggctcccaaagtgctgggattataggcatgagccaacgtgcccagccaattacttttaaatattctaaggctacatggctctagacttac

SEQ ID NO: 86093 - DNA, 352 bp, Homo sapiens
gaaaacaaggccactgggttcaagaagtaataggaaactttgagaaggtgatattcatgaaatgatgggatgagcaaagaattcaagaatgagtggtggccaggcatggtggctcacgtctgtaatcccagcactttgggaggctgaggcggggggatcacctgaggtcaggaattcgagaatagcctggccaacatggtaaaaccccatctctactaaaaatacaaaaattatctagttatggtgggaggctgaggcaggagaatcgcttgaacccaggagtcggaggttacagtgagccaagattgcaccactgcactccagcctgggcgacagagcaagactctgtctc

SEQ ID NO: 86094 - DNA, 195 bp, Homo sapiens
cagggggaggaggacgggaacggatggagttggtttttttttttggagcttctgagacccaagcttcaggccatgctcccccaagcacctccccaccaccaccccccaagatgtagtcttgctctgtttcccaggctggagtgcaatggcgtgatctcagctaaacggaacttctgcctcccgggctcaagcaat

SEQ ID NO: 86095 - DNA, 341 bp, Homo sapiens
atacaaaacatcgcagacaaactacctaagagtaccttgattattccttctgcattgttctcactgttatttatctgaagaaaggggcatcctagacgttatagctatattttcataataaactatctatgctaattatgttgaactagacttatcaggaggatattaacttggggtacttaagaattagttgtggtggctcatgcctgtaatcccaaaacattgagaagcctagcggggtggatcacttgaggtcaggagtttgagaccagcctggccaacatggtgaaaccctgtctctactaaaaacacaaaaattagcgggtgtggtggcatgtgcc

SEQ ID NO: 86096 - DNA, 619 bp, Homo sapiens
cggccgcggcccagagagggtggtgagggcgggggaagccggcgctcgcgctccgccccggcccagggcggctccgcccccgcgcctccgccaccgcccactcacacagtgcagcacgagggcttcctactgcgcaagcgcgagctcgacgctaaccgcaagtcgtccaaccggtgagcgtgtgggcggggctttggaaggcgggtctcaggctcagggtgaccattgcgtggagcggtgggactgaggagggggtgtggctcaacttcaggccctccagcaggtggcggtagtaggtggggccagagctggggggtggtggtggcttaaatcaagaaagccaaccaatgagcaggagggggtgtggtttaacgtcaggccctccaacccgtgggggtagtaggtggggccagatgaggggtggggctcaactttgatgattccaaccaatgaacaggaaggggcaggacctaaggttagtgcatctaatggatgatgggtagagcttaggtgggaacagaaggaaaatgttctgaaagtgagtaaattggaacctaacctcttagcaaccaacccaggagttgatcagctaaatagcaaagagggaggcatctagttg

SEQ ID NO: 86097 - DNA, 2061 bp, Homo sapiens
cggccgcggcccagagagggtggtgagggcgggggaagccggcgctcgcgctccgccccggcccagggcggctccgcccccgcgcctccgccaccgcccactcacacagtgcagcacgagggcttcctactgcgcaagcgcgagctcgacgctaaccgcaagtcgtccaaccggtgagcgtgtgggcggggctttggaaggcgggtctcaggctcagggtgaccattgcgtggagcggtgggactgaggagggggtgtggctcaacttcaggccctccagcaggtggcggtagtaggtggggccagagctggggggtggtggtggcttaaatcaagaaagccaaccaatgagcaggagggggtgtggtttaacgtcaggccctccaacccgtgggggtagtaggtggggccagatgaggggtggggctcaactttgatgattccaaccaatgaacaggaaggggcaggacctaaggttagtgcatctaatggatgatgggtagagcttaggtgggaacagaaggaaaatgttctgaaagtcgtgggtgagcctgtactgtgtgcttagtaagggggaactgggcttctacaaggactccaagggcccggcatccgggagcacacacggtggggaaccgctgctcagcctgcacaaggccaccagcgaggtggctagtgactacaagaaaaagaagcatgtcttcaagctccagacccaggatggcagtgagtttttgctccaggcaaaagatgaggtgagatctggtcctttcctccctctgtgtggacctcagtaatgacctggctgtctggctcctgacccagagtgatggggctgtgagaagggacactcacaggccagagttatcagggctgtaatgggaaagcccacaggcactgagagcccaaaggaggttcctaacccagtggggagtgggaagggcttcagggagggctgcctgcagatcctgatgacaaagtccaacatctttgccgtggtcactcaggaggagatgaacggctggctggaggctgtagcttcctcggtggcggaacacgcagagatcgcccgctggggccagacactacccactacttcatccacagatgagggcaaccctaagagggaaggcggagatcgcagggccagcgggcgcaggaagtgacttcccacccccaggacctgacacatctcgtctcccctcttttccgcactgtgggcacaaagacactttttcttccgcaggggcgggagcccctagttccaacactgaggacgcgtgacatggtgggcaccggaaaggaggggacttctcctgcaccccaagaagtggtggggagattgctgcccctatagccatatctcggccccttcccactcaccacccccaccccaggtgctgggggtcccttatttttatgcaataactgagcttgatgggggtgggcagggggccagttgagccaagcccccagccccgatctgcagatcctgccccaagaagctggggtggtgggggcagtaattcctgcccccctctctgccctagggatgggcacgggggcgctggtgaggtcccctggaccatccagggtgctagggggcagggaggggacaccccctccccgcctttacctcacttccaatgctgccttgatctctgtctgggaggggggagtgaaggggccctagccccctgcactccgccgcctcagagccatgcggttaattcctgacttagtttatttttgcaaaacgtcgatctcctcctcccccgccccgcatccgcgaaggcttttaatgggaggggcgtcaaagctcaaaactgttttcctctctcctcccccctccagttgtaaatgccacttcatgaggggaggggcgaggggaagcccacccctgcatgcttctggctggagcacctccctggggagtcgggggattgggttgtgggcagtccccatggccgcctggagaagccgctggggcccgggggtgtggggcggtgtggcgggcgcacactgtatgtacctataataaaccctttggctttgacggtc

SEQ ID NO: 86098 - DNA, 1650 bp, Homo sapiens
ggagagacaggaattctttattccagacagtagaccaatagactttccttgagaaagctccatgagtggggaggattgagtggagcaaaggcttatggaggagacagcttaagacttaccttcaggaaattcagtatgggaggggataaggaagggaaatctcagcctgggcaaaggcttgatactgagagacttaaatgctcccctcagggcagcaacagccttaaggaagagcattttaggtccaactagggcgcaactagggcgcaaaggtccagaggtaggaaggctcagacatattcagaccttgaggatgttaatgaagagttattaggcagagtgctgcggctctgccttgagccccatcttgtcgctccaggtcgtgggtgagcctgtactgtgtgcttagtaagggggaactgggcttctacaaggactccaagggcccggcatccgggagcacacacggtggggaaccgctgctcagcctgcacaaggccaccagcgaggtggctagtgactacaagaaaaagaagcatgtcttcaagctccagacccaggatggcagtgagtttttgctccaggcaaaagatgaggaggagatgaacggctggctggaggctgtagcttcctcggtggcggaacacgcagagatcgcccgctggggccagacactacccactacttcatccacagatgagggcaaccctaagagggaaggcggagatcgcagggccagcgggcgcaggaagtgacttcccacccccaggacctgacacatctcgtctcccctcttttccgcactgtgggcacaaagacactttttcttccgcaggggcgggagcccctagttccaacactgaggacgcgtgacatggtgggcaccggaaaggaggggacttctcctgcaccccaagaagtggtggggagattgctgcccctatagccatatctcggccccttcccactcaccacccccaccccaggtgctgggggtcccttatttttatgcaataactgagcttgatgggggtgggcagggggccagttgagccaagcccccagccccgatctgcagatcctgccccaagaagctggggtggtgggggcagtaattcctgcccccctctctgccctagggatgggcacgggggcgctggtgaggtcccctggaccatccagggtgctagggggcagggaggggacaccccctccccgcctttacctcacttccaatgctgccttgatctctgtctgggaggggggagtgaaggggccctagccccctgcactccgccgcctcagagccatgcggttaattcctgacttagtttatttttgcaaaacgtcgatctcctcctcccccgccccgcatccgcgaaggcttttaatgggaggggcgtcaaagctcaaaactgttttcctctctcctcccccctccagttgtaaatgccacttcatgaggggaggggcgaggggaagcccacccctgcatgcttctggctggagcacctccctggggagtcgggggattgggttgtgggcagtccccatggccgcctggagaagccgctggggcccgggggtgtggggcggtgtggcgggcgcacactgtatgtacctataataaaccctttggctttgacggtc

SEQ ID NO: 86099 - DNA, 163 bp, Homo sapiens
ccatctgtctacttgtccatccatcagtgaagcagccaaggtggatactgggttccccagaagcagagcctgagacatagatttttgggaaagtgacctattggaggagggctctgaggagaaggacagagggtcaaggcaggggaaggagccaagcaaggct

SEQ ID NO: 86100 - DNA, 520 bp, Homo sapiens
ggagatgcaggatcagacgtagagatggtattgactggagataagtttacaggtaaaagaaaattacaattcagcatgagaacattcttcataagttttacctatggccccaatgataattaggccaactgtatcttgaatgtatatcatatgctgtgtcactcatatttcaaccaatgatcagatgagtcacagtccgatgagtatctttggagcctaaagaaaggctggttagtgctctctttgcatatcctcactttgggtggaaatcatgacctaaggggaagaatttttctttcctccaaatacagtgaaagatagatgtcataaaaaattatggcccttctggttcccctttagatcctcttcctagtaaagtgaaactcagtgactaaaatacacacacacacacacacacacacacacacacacccctaagacaacccactgaattcaagttaatcctttctaccccaaagctataagttgctcagcaagttcagagtcattgggaagccag

SEQ ID NO: 86101 - DNA, 420 bp, Homo sapiens
ggcgagtccgatcggaccaggaagtagctcaggggagcctgacctcgacccgcctttctcctcacacgagctgaggaggcagggaagtaccgagggcagtcaagcctcccctgggggtggttcctgggactagatggagctcagtctctggattctccctctttctcggccctatgcttcctgacagacctggccgccaaaccctgtaatcgccctcctttaacccaagaaagcaagtctttctgccgtttctgagctggcttgagccttaagactaccttaaggaggtacttggataaatagcggtctgaatttctgtaccaggcctcagataagagacaggcagtgaaggggaagttttgtaaaagaaaacgggactagaaaagccgagcaagttgagggctgggcggggtttctttt

SEQ ID NO: 86102 - DNA, 542 bp, Homo sapiens
tagtcacctcgcgaccggcattctggacttctggggacagctgctgcgcattcacatcaggagctagaagatctgggggtcagccgcattggccatcaggaactgatcttggaggcggttgaccttctgtgtgcattgaattatggcttggaaacagaaaatctaaaaaccctttctcacaagttgaatgcatctgccaaaaatctgcagaattttataacaggaaggagaaggagtggccattatgatgggaggaccagccgaaaattgccaaacgactttctgacctcagttgtggatctgattggagcagccaagagtctgcttgcctggttggacaggtcaccatttgctgctgtgacagactattcagttacaagaaataatgtcatacaactctgcctggagttaacaacaattgtgcaacaggattgtactgtatatgaaacagagaataaaattcttcacgtggtgagtatacttggatttattttaatctttattagaggatatttccttgttcaactagaagaggtgaacca

SEQ ID NO: 86103 - DNA, 546 bp, Homo sapiens
tagtcacctcgcgaccggcattctggacttctggggacagctgctgcgcattcacatcaggagctagaagatctgggggtcagccgcattggccatcaggaactgatcttggaggcggttgaccttctgtgtgcattgaattatggcttggaaacagaaaatctaaaaaccctttctcacaagttgaatgcatctgccaaaaatctgcagaattttataacaggaaggagaaggagtggccattatgatgggaggaccagccgaaaattgccaaacgactttctgacctcagttgtggatctgattggagcagccaagagtctgcttgcctggttggacaggtcaccatttgctgctgtgacagactattcagttacaagaaataatgtcatacaactctgcctggagttaacaacaattgtgcaacaggattgtactgtatatgaaacagagaataaaattcttcacgtgtgtaaaactctttctggagtctgtgaccacatcatatccctgtcgtcagatcctctggtttcacagtctgctcac

SEQ ID NO: 86104 - DNA, 491 bp, Homo sapiens
gaagagtagcttctacccacatgcagctgtttaaaatcaaatacaattaaaaatttagttcctcagtcatactagccgcatttcaaatgcttagtagctatatgtgtctatttaaatttaaataaaattaaaaatttattcagctgtactagccacatttcaagggctcagcaatcacaataaacatatagaacatttccaccattgcagaaagttcttttggaaagtgctgctctagacaaactcatggatcatgctagccttgctataagcctcattatcaaagccaaatacattgtgaagatttgactagctatcctgaggttctgtgattctatgtctatttagagttttaatcattgagcttttcttctccacactcttagatgggcaaatactgttttaaagcattcatatttcatatattaaaacatttattttctgctcaaaacattcttatctaaatgggtggtttatatatcttgaaaatg

SEQ ID NO: 86105 - DNA, 537 bp, Homo sapiens
gtgacttaagcgccaacagtttatcatttctcccagttctctgggtcgactgagtttcagctgagtggttcttctgctgctgtcacctgggcttagtgaggtgcctgcattcaactgggagctctgctggcattcaaggtggcttcagacctctatccagtgacttctctcaacagcagggtattcagacttcttatacggtggctggcttccaagagagaagcagcagaagctgccattcctcttaaggcatgaactcagaagaagtccaccacattctatggatcaaagcaagtggcaaggcccgatttaagaagtggggaaatctattaaagtgggagcaacacacatgtacagggaggggagaaattactagagcctcttttgactctttatcacattaactcaccagaaactaagtttcagagaaggaactcccaccaggagggaactactgctgtgatagatcctggccttatgggatcaggatttttaggaactcttactacctccccctaagggcagaattccacagag

SEQ ID NO: 86106 - DNA, 627 bp, Homo sapiens
gtcctctccttttaatttcctaccgctggtctgctagcaggcagctcggcatgtctgttagaattgtgtgttaaggaagagtaagtatgtaatgaggagggactgaaatcctcttataagaataaagtatgtggggctgggcatggtggcccactcctgtaatcccagccctttgggaggccgaggccggcagatcacctgaggtcaggagttcgagaccagcctggccaacatggtgaaaccccctctctaaaaaaaaatacaaaaaaattagccaggcgtggtggcacactcttacaatcccagctactcaggaggctgaggcgggagaattgcttgaacccaggagacggaggttgcagtgggccaaggatcacaccactgcattccagcctgggtgacaagagcgagactccatctcaaataaagaaagaaagaaagaataaaatgtgcggatttcagtgcagggagagtgcagtggctgctctgacctgctggttcttctgcatgctccaggtgagtaagctggtacatttgagtctgggagaggtgtgacatatgcatgggagttatttatggctcaaggtggaagaaaagcaataagccttgttaccggcccttgcagtc

SEQ ID NO: 86107 - DNA, 253 bp, Homo sapiens
tgaaatgaaatgaaataatgaaatgaaatgaaaagatgctatgaattgatgagatgaaatgaaatcatgagatgaaatgatgagatgaaatcatgagatgatgagacgaagtgaaatgatgaaatgatgagatgaaatgatgaaatgaaataatgaaaggatgaaatgatgagatgaaatgatgaaatgatgaaatggaatgaaatgaaatgaaatggtgaaatgaaatgaggaaatgaaatgaagaaatgaa

SEQ ID NO: 86108 - DNA, 615 bp, Homo sapiens
gaggttagcccttcctgtcccctggtgtttgttgtatgtgtctgtggtatggctcagcagatggtgtcatgggatgggaatagaggagtgggtattagataggcagactttctttggtttccatgtatttgagctctacagggtaaagtggtagagtgggtgggttgacagaggaagaacaatgctcaggctggcattccgaggaagaggatacttcccacaatggagtgaggtcaggctcacttttcagagataagttcattcattccttattttcaagctcctaatcaacagttttcctggtggcctagaatttggagatttcatcctctggattttcagttacctttgtttttgcaaacatttcattcatcctaggggctgtgaaaatgataagctttcataagacttattttaattaaggaagcatttctgcattttcccctatgaagaaaaggaaaactgaccgggcatggtggctcatgcttctaatcccagcactttgggaggccaaggcgggcggatgacttgaggtcaggagttcgagaccacgttggccaacatggtgaaaccctgtctctaccaaaaatattaaaaaaaaaaaaaaaaaaaaac

SEQ ID NO: 86109 - DNA, 368 bp, Homo sapiens
tgagacagtctcactgttgccgaggctggagtgcagtgacatgatctcaactcactgcaacctccgcctctgaggttcaagcaattctccctgcctcagcctcccaagtagctgggattacaggcacctgccaccacgccgagctaaatttttatatttttagtagagaagtggttttgccatgttggccatgctggtcttgaactcctgacctcaggttaaaatctataaaattttgttccaaaattaagatgtcacaaaaagatggatttttttataatgtgccagttcaagaaataagcttaatgaaacaatcctacattaaacagtatttacatttagagctaaaattcaaatctatctaaaag

SEQ ID NO: 86110 - DNA, 366 bp, Homo sapiens
tgcttttggctctgcttgcccttcatgggagtcagctccttttctggaagttctatattgtagggaagaagtagacttttaaaaataaaacccttgtggagttgtcagggttcttgggcagtaactgagtcaagatgctgcagaatctgctggcactgtcaggttgcccagaggaccatgagcattgcttcatgcaggcattttgaaaataaaggtccagaaaacacaagctgtttcaggagaagaatggaattccagtgcatctaaagggtggtagagctgatgacctcctgtatagagccaccatggttctcagttagtgaaacagcatatgccatgcatcagctggctgtggtttcatttccc

SEQ ID NO: 86111 - DNA, 206 bp, Homo sapiens
gcgccgtgtttgtccctccgtttggtgatgggcacctgggctgcctctgcctttttgctactgtggatcgagctggtgtgaacacagcggagtggtcgtcgtccgcagtcgagctggtgtgaacacggtggggtggttgtcgtccgcaatcaagctggtgtgaacacggcggggtgctcgtccgtccttgttttcatttctttggg

SEQ ID NO: 86112 - DNA, 335 bp, Homo sapiens
agacaacctgagctatgacctgtaaggatgaatgtataccatatgtgctcatttccagtcactgtccacaatgacccacagacaaaatgggcaggtggatacagacaaagactactatgtgtcctggggtaaaagcacaggagtaaaactggagatcacagcctactctcagctttacactcagaggcccagtgccaactgagacaagccaggaaggtcaacatcaccttcatacttacctcagagaaatgccaggaagagagacgacaatcccggttgaggacttatggaagcaagggcctatatacgcatcttcattttgaagttttcttctg

SEQ ID NO: 86113 - DNA, 323 bp, Homo sapiens
aatgcaatatttataaataaaacataggatatctgggatttgttttgaaattacctgggttggggaagagagaaaacaaaattggctgtgagttgataatccctgaaactggataagggtacatcgagtttattataccagaattttgcaagccaaactaaagcagaatcctagatttttacgattatggcattcaactgtgcacaggtatcttacctagcctaaatttgacagcaactaaaaaaaaaatattctgtccaatctgcactgtaactaagcctttccaacataagtttccacagagactattcttttcttttatt

SEQ ID NO: 86114 - DNA, 3017 bp, Homo sapiens
cgctgccactggttagcgataatactggcagcgcgaccggtttctgagggttgttcaccttgctgctcagacgctccgagaagcttcaggcagcataacacttacagtagagacagggtttcaccatgttagccaggatggtcttgatctcctgacctcgtgatccacctgcctcggcctcccaaagtgctgggattacaggcgtgagccactgcgcctggccgcaatttacttcattgaatctccaacaagagtcctgtgagctgctgactggagacggtgcacgtctggatacgagagcatttccactatgggactggatacaaacacacacccggcagacttcaagagtctcagactgaggagaaagcctttccttctgctgctactgctgctgccgctgcttttgaaagtccactcctttcatggtttttcctgccaaaccagaggcacctttgctgctgccgctgttctctttggtgtcattcagcggctggccagaggatgagactccccaaactcctcactttcttgctttggtacctggcttggctggacctggaattcatctgcactgtgttgggtgcccctgacttgggccagagaccccaggggaccaggccaggattggccaaagcagaggccaaggagaggccccccctggcccggaacgtcttcaggccagggggtcacagctatggtgggggggccaccaatgccaatgccagggcaaagggaggcaccgggcagacaggaggcctgacacagcccaagaaggatgaacccaaaaagctgccccccagaccgggcggccctgaacccaagccaggacaccctccccaaacaaggcaggctacagcccggactgtgaccccaaaaggacagcttcccggaggcaaggcacccccaaaagcaggatctgtccccagctccttcctgctgaagaaggccagggagcccgggcccccacgagagcccaaggagccgtttcgcccaccccccatcacaccccacgagtacatgctctcgctgtacaggacgctgtccgatgctgacagaaagggaggcaacagcagcgtgaagttggaggctggcctggccaacaccatcaccagctttattgacaaagggcaagatgaccgaggtcccgtggtcaggaagcagaggtacgtgtttgacattagtgccctggagaaggatgggctgctgggggccgagctgcggatcttgcggaagaagccctcggacacggccaagccagcggcccccggaggcgggcgggctgcccagctgaagctgtccagctgccccagcggccggcagccggccgccttgctggatgtgcgctccgtgccaggcctggacggatctggctgggaggtgttcgacatctggaagctcttccgaaactttaagaactcggcccagctgtgcctggagctggaggcctgggaacggggcagggccgtggacctccgtggcctgggcttcgaccgcgccgcccggcaggtccacgagaaggccctgttcctggtgtttggccgcaccaagaaacgggacctgttctttaatgagattaaggcccgctctggccaggacgataagaccgtgtatgagtacctgttcagccagcggcgaaaacggcgggccccactggccactcgccagggcaagcgacccagcaagaaccttaaggctcgctgcagtcggaaggcactgcatgtcaacttcaaggacatgggctgggacgactggatcatcgcaccccttgagtacgaggctttccactgcgaggggctgtgcgagttcccattgcgctcccacctggagcccacgaatcatgcagtcatccagaccctgatgaactccatggaccccgagtccacaccacccacctgctgtgtgcccacgcggctgagtcccatcagcatcctcttcattgactctgccaacaacgtggtgtataagcagtatgaggacatggtcgtggagtcgtgtggctgcaggtagcagcactggccctctgtcttcctgggtggcacatcccaagagccccttcctgcactcctggaatcacagaggggtcaggaagctgtggcaggagcatctacacagcttgggtgaaaggggattccaataagcttgctcgctctctgagtgtgacttgggctaaaggcccccttttatccacaagttcccctggctgaggattgctgcccgtctgctgatgtgaccagtggcaggcacaggtccagggagacagactctgaatgggactgagtcccaggaaacagtgctttccgatgagactcagcccaccatttctcctcacctgggccttctcagcctctggactctcctaagcacctctcaggagagccacaggtgccactgcctcctcaaatcacatttgtgcctggtgacttcctgtccctgggacagttgagaagctgactgggcaagagtgggagagaagaggagagggcttggatagagttgaggagtgtgaggctgttagactgttagatttaaatgtatattgatgagataaaaagcaaaactgtgcctaaaaaaaaaaaaaaaaaaaaaaaaaaaaaaaaaaaaaaaacaaaaagaggggcgagcacgcccacgaaaaatcaccagcggagggggccacccacagctatgacagctaccaccatatttttggacagcaagcggggctacccccaataagagggaggctcgatattatctaaagccaagcaaccgaggcgcgcgcctagttatcaacgacgctgccggacgtgggccaaacacgggctcacgcggaggaccattctggtaacacgggaaaaccactaccacttgtggggcggggtgacacacagtcgagcgacaatcaacccccaacgaagatgtgaagcccgcaggagacaactgacaacactgcagccgtcaacgtggcgcacaccaagcgccaatgaccggcgcagacaaattggctacacgagatgcattgacaattttaacag

SEQ ID NO: 86115 - DNA, 2832 bp, Homo sapiens
ctccttcaagccctcagtcagttgtgcaggagaaagggggcggttggctttctcctttcaagaacgagttattttcagctgctgactggagacggtgcacgtctggatacgagagcatttccactatgggactggatacaaacacacacccggcagacttcaagagtctcagactgaggagaaagcctttccttctgctgctactgctgctgccgctgcttttgaaagtccactcctttcatggtttttcctgccaaaccagaggcacctttgctgctgccgctgttctctttggtgtcattcagcggctggccagaggatgagactccccaaactcctcactttcttgctttggtacctggcttggctggacctggaattcatctgcactgtgttgggtgcccctgacttgggccagagaccccaggggaccaggccaggattggccaaagcagaggccaaggagaggccccccctggcccggaacgtcttcaggccagggggtcacagctatggtgggggggccaccaatgccaatgccagggcaaagggaggcaccgggcagacaggaggcctgacacagcccaagaaggatgaacccaaaaagctgccccccagaccgggcggccctgaacccaagccaggacaccctccccaaacaaggcaggctacagcccggactgtgaccccaaaaggacagcttcccggaggcaaggcacccccaaaagcaggatctgtccccagctccttcctgctgaagaaggccagggagcccgggcccccacgagagcccaaggagccgtttcgcccaccccccatcacaccccacgagtacatgctctcgctgtacaggacgctgtccgatgctgacagaaagggaggcaacagcagcgtgaagttggaggctggcctggccaacaccatcaccagctttattgacaaagggcaagatgaccgaggtcccgtggtcaggaagcagaggtacgtgtttgacattagtgccctggagaaggatgggctgctgggggccgagctgcggatcttgcggaagaagccctcggacacggccaagccagcggcccccggaggcgggcgggctgcccagctgaagctgtccagctgccccagcggccggcagccggccgccttgctggatgtgcgctccgtgccaggcctggacggatctggctgggaggtgttcgacatctggaagctcttccgaaactttaagaactcggcccagctgtgcctggagctggaggcctgggaacggggcagggccgtggacctccgtggcctgggcttcgaccgcgccgcccggcaggtccacgagaaggccctgttcctggtgtttggccgcaccaagaaacgggacctgttctttaatgagattaaggcccgctctggccaggacgataagaccgtgtatgagtacctgttcagccagcggcgaaaacggcgggccccactggccactcgccagggcaagcgacccagcaagaaccttaaggctcgctgcagtcggaaggcactgcatgtcaacttcaaggacatgggctgggacgactggatcatcgcaccccttgagtacgaggctttccactgcgaggggctgtgcgagttcccattgcgctcccacctggagcccacgaatcatgcagtcatccagaccctgatgaactccatggaccccgagtccacaccacccacctgctgtgtgcccacgcggctgagtcccatcagcatcctcttcattgactctgccaacaacgtggtgtataagcagtatgaggacatggtcgtggagtcgtgtggctgcaggtagcagcactggccctctgtcttcctgggtggcacatcccaagagccccttcctgcactcctggaatcacagaggggtcaggaagctgtggcaggagcatctacacagcttgggtgaaaggggattccaataagcttgctcgctctctgagtgtgacttgggctaaaggcccccttttatccacaagttcccctggctgaggattgctgcccgtctgctgatgtgaccagtggcaggcacaggtccagggagacagactctgaatgggactgagtcccaggaaacagtgctttccgatgagactcagcccaccatttctcctcacctgggccttctcagcctctggactctcctaagcacctctcaggagagccacaggtgccactgcctcctcaaatcacatttgtgcctggtgacttcctgtccctgggacagttgagaagctgactgggcaagagtgggagagaagaggagagggcttggatagagttgaggagtgtgaggctgttagactgttagatttaaatgtatattgatgagataaaaagcaaaactgtgcctaaaaaaaaaaaaaaaaaaaaaaaaaaaaaaaaaaaaaaaacaaaaagaggggcgagcacgcccacgaaaaatcaccagcggagggggccacccacagctatgacagctaccaccatatttttggacagcaagcggggctacccccaataagagggaggctcgatattatctaaagccaagcaaccgaggcgcgcgcctagttatcaacgacgctgccggacgtgggccaaacacgggctcacgcggaggaccattctggtaacacgggaaaaccactaccacttgtggggcggggtgacacacagtcgagcgacaatcaacccccaacgaagatgtgaagcccgcaggagacaactgacaacactgcagccgtcaacgtggcgcacaccaagcgccaatgaccggcgcagacaaattggctacacgagatgcattgacaattttaacag

SEQ ID NO: 86116 - DNA, 571 bp, Homo sapiens
gagaaacgccttcagcactatttaattactacagaagctaagatgtaataggattcagtttaacttttaacagtctggagagaccagcctacatgctcttttggcaagatcagtagttcttggcatcacccaataccaggcatcagagccttcttgacactgagtgtcagcctcaaagcacgcttggtggactgagagcatggttgggtaggaagatcaaggagcaaggataagaacaaccaggcagaaggaaggcagagattactggaaagaggagaaaggagaaaaggggagaagggaagaggcagcttgatagagaaagaacgggagtggaaacagaggagagagctatgtatggcttgaatgtgtccctccaaggtcatgtgttggaaacttaatcctcaatgcaatgttgagaggtgggacttttaagaggtgattaggtcatgaaggttctgccttcatgaatagattagtgctgttatcatgggagttggctagttgtcttgggagagggttcctgataaaaaagatgagttcagtcctcttccctcttctttctctctccact

SEQ ID NO: 86117 - DNA, 620 bp, Homo sapiens
tatccatgcatttacttaattctttccttcactgctgatttttgatctgaccattatcagatactgctaaggtgtctgcatcgggctttctagtctagtaattgctctgtcacgtgctgcttctcatactgctttaattattaaagcttcaccatacattttagcatatgacaaggaagtcttttctcatcactctcccttttcaacatttcttatgtattgttgcaggtctattcctccagatgatccttagaactgcgtatttcaagataagttctttgaggattataattagatatacagaattcttggaaaaatcagcttctttaaaataatcatttttccttctggggctatgatatttttctggatttatctcagtgaccttgagattctcagttaggttttgtagttatttttatatatgtctctcattttttcttaggttttcaaaataattatttatctccaaataatatttttgtacttctcattccaataatggtatatttcccttgattcactccctgttatatttagttttctatttatttatcatgaattcaatcttaaactctcctgagtttttgcaacttttttttgactctatgcaaacttga

SEQ ID NO: 86118 - DNA, 340 bp, Homo sapiens
aaaacagaaaatcacaagtgttggtgaggaagtggagcagttagaacccttgtacacttggtggaaatgtaaaatgctgcagctgctataaaacaacaccatagtaacgaaataatttacactcaaaatcaccgtatgatccagcaatttcacatcttggtatgttgcaaaagatgtgaaagcgaagacacaaaataatacacgtacacctaagctcatagcagcatgactcacttcactcaaaatgtttttgaattacctgtgttgtttgaattatcgtcaatgaataaatagataaaatgtgatttatacatacagtgggatattattcagttatgaa

SEQ ID NO: 86119 - DNA, 2968 bp, Homo sapiens
agagagcagtggtataggtgtgcagtttccatgatgcaggttccatttttaatatattgttccacttatcctttcttctgagtaaattgctaattgtgccaaatttatgtaatagtttttgtaatgtggaataagaattatgatggaaccattgcacatttttttctgaaacagccagtcaaggcagaacattaatctccaaatgcaagggctgatctatttattcattttggaggttgggtactttattctttctttccgtcatccttttcattgtttcccccggattctaattagtttttattttttttagataactccaatataatcattacagtttatgctttaaatactatgtgctttaaaaaggaaaatgggaccaatttgtctgctaagaatttgattttaggtactataagagtattaggaaaatatatacaactggtgttaatttctagatattttctagaaatcacttgtgttcctatttaataaaaggtaatttagaatactacttgtcctttgcagtagtttagtaatgggcattaagctgtgtcctcgaaggatgtacctattactaggtgcattttagaatgaaatattgatattttattagcatataattgtggccatatatctcagattttctgaggcagatctaattttagataattctgttggtagaccatgtgatccttctttttggttttggaaatataatcattgttaatgttttccctccaaatagaatactgttttatccatacaaatcataacagcatctatcccatgctagggttggaaactgatattggtattacttgtgttttttcttagtgtgttttatttcccagtttcatcttcttttaaaaatgaaaatatggtgccttccctccctccaggaagactggcaaatatttccttttatttactgctgctgtggagtgatgagatatgcactttactctttaagattcagcaaaaagcttttcacttctcagtatatccagaatacatcatatctgggacttaggaaaatttgccaagcaatctttgtttttatagatactaatgttgaccctctccagcgttcaatgttataaatagaacaagtcaagctagtgtttatctcctccccctccccaaaactgtggcacagcatataaaaatgtacctcaataatgttctattaaaaatgggacaggggccttatgttttcataatttcccaacaatgtgccgccatatttttgcctcaaggtaaaggttttaacagatgaaaaagtacttcccaattcccccgtgctattcctaacctataatgcccaaatgttttgtgcaatgtgtagtgtgtgtgtataaatacatatattcttgaaatagacataccatcagagacatcattcacaagtaactgatgtattggcatctcattcatatttctgatgtgtgaggtatatggtactaattaccttttccttgatgtttgccaaatttgaataaaggcattggtacgaaattacagaatgtaaagaaaatgtttttggcttgaaaaattaacatattttatgacgtaccacagtatactctgcccaaaccagcaccctatctatctttcctgttctttacatccctgttccccatccctacttcctcatttttggtataacacagttcttttgtagcatcattataattgcagttctatggcaattggacagttatagcatggaaacagactggtataaatagtacagtagtcaccagtgtgccacatttgcattagtaatgcaaaatatacattttataaaggacaaactttgtgttatgttttattttcattacattgtataatattgtaagactattgtatgtcctaatttgcattataaatgtttttttcctacgtaaaggcataaatatagcaactttgtataaaggtagcttattagatttttaattttttcttttataaaaaattgtccaacagtgggactaccattgccaaattgtatatgaaatatgaattttacccccatggttaatttcttttataaacattccatatttctctaataaaaagacataagtgatactgtactatgcatacattgtatcttaatgctgtttcagatcagcattttaaattttggtttgcatttttaatattggcaaaacgtaaccactgttaattaaaataaaaccttgttgtatatgtaacaacataattttccctctatcccttcccaccctttgttctctatttctccctatcagtgccaacttcatacattttgtagcatggcaataaaatataacttttacactgaggccgagtgtggctttttggaggaagtggggatgggacgattgccctctagttgtcctttgcatatgactgttttttgccatataagccatgtcatcaggcatgaaaagttttctcatatatgatgtaaacttgcttttaaggacaagtgtgaatgtgctttttaagcttaatttttgtcatgacaactaattttttttatctttggagaagtcagagttctttacaatcaaacgtttattaactggagtacttagaataagctagtaattgaatttagttcaagggctaagcaacacatttttaaatccttatttattgtagagtattagtatactgtcctacaaattatgtaaaatatggtttaatattagatgactttggattttgcaatgccttactgttgtcattctagcataaatatccataatgaggtactcaagttgatactggaagctgagctgatcatacactgacctgaagcattcatgaaaagctgctttattgaataaagtctgattggagttcttttcatgctcactttccccttattgctgaaagtagattgcaataaaaccccaataaaacgtttggtcggatatctacttaaaagttttattgtatttatatttcacatact

SEQ ID NO: 86120 - DNA, 255 bp, Homo sapiens
tgccgcccccaaccccttccctgcatctgtggaaaaactgtcttccatgaaaccagtccctggtgccaaaaaggttggagactgctgctctaagccacctgtacgtgagaagcgttttattctaagagtgactgagaataaacaaactcagcatgcaaagaaaacacaaactaatcaggaggaatatcttgggtagaaagtattagttatttcttaaaatctgtaaatctgtaaaatatgtataaatcctgggtc

SEQ ID NO: 86121 - DNA, 176 bp, Homo sapiens
ggcttttacaaggattagaagtaatacatgtaatacaccaggcacatagtatgtacccatgggtaacatcatggcaaccctttattattattaattattattattattttagagacaggtctcaccctctcacccaggctggagtgcagtggtgcaaacacggctcaagtaactcg

SEQ ID NO: 86122 - DNA, 1895 bp, Homo sapiens
gggggacttgaccctgagcaggtagaagccactgaagggatcggagcaggaagtgacctgagcatgtgctgcgtgccatgtggtctccaacaatggctggtgggctgtttgctgtgagtaagaaatattttgaatatctggggtcttatgatacaggaatggaagtttggggaggagaaaacctcgaattttcctttaggatctggcagtgtggtggggttctggaaacacacccatgttcccatgttggccatgttttccccaagcaagctccctactcccgcaacaaggctctggccaacagtgttcgtgcagctgaagtatggatggatgaatttaaagagctctactaccatcgcaacccccgtgcccgcttggaaccttttggggatgtgacagagaggaagcagctccgggacaagctccagtgtaaagacttcaagtggttcttggagactgtgtatccagaactgcatgtgcctgaggacaggcctggcttcttcgggatgctccagaacaaaggactaacagactactgctttgactataaccctcccgatgaaaaccagattgtgggacaccaggtcattctgtacctctgtcatgggatgggccagaatcagtttttcgagtacacgtcccagaaagaaatacgctataacacccaccagcctgagggctgcattgctgtggaagcaggaatggatacccttatcatgcatctctgcgaagaaactgccccagagaatcagaagttcatcttgcaggaggatggatctttatttcacgaacagtccaagaaatgtgtccaggctgcgaggaaggagtcgagtgacagtttcgttccactcttacgagactgcaccaactcggatcatcagaaatggttcttcaaagagcgcatgttatgaagcctcgtgtatcaaggagcccatcgaaggagactgtggagccaggactctgcccaacaaagacttagctaagcagtgaccagaacccaccaaaaactaggctgcattgctttgaagaggcaatcattttgccatttgtgaaagttgtgttggatttagtaaaaatgtgaataagctttgtacttattttgagaactttttaaatgttccaaaataccctattttcaaagggtaatcgtaagatgttaacccttggtatttagaaaattaaaaccttataatatttttctatcaagatgtatattttacagtcgtgccttttactctcattagcaaaaaagataaagattttattttggtatttacaagaattcccaggtacgaagatatctgcatgggtggaaatcaggttcaagcaacgtactttgcattaactgataatacctcagctgcggggttaaagttttcccagtatagagagactgtcactaggaacattgtattgatttattcaggtcattgagatcttctagatgtattttaaaaagaatgctttttggttatgtgttgctaccacagttaacactccataatgttcatgtcagccaaagaggactaaccaaagctgaaatctcagagaacaatttgctttactaagctgagtcaacttgagagcgaacttctaacaatgccgcactgtagtgtggctggttctaccactatgactttaaaacatgtttatatcatttttaatttttatgatacggtagtgtcagggagaaatgtaatgttctatatgaaattcctttttcaagtttgttcattaataacagttattaatttaaatcagcgttagagtttgtgctgctgcaactgctgtgaaaatttctctgagtaattctgatttgtgaatgatcccagaccaaccctgagattttgtcaacctgattaagtcaatatgaatgattaaaaagatgtgagaac

SEQ ID NO: 86123 - DNA, 1215 bp, Homo sapiens
tgtacaagcctggtgctgtgtccccgggacagtcctgagttgctgcgttacacggaagacacttacccctcaataaatatttctgaaatggatggatctttatttcacgaacagtccaagaaatgtgtccaggctgcgaggaaggagtcgagtgacagtttcgttccactcttacgagactgcaccaactcggatcatcagaaatggttcttcaaagagcgcatgttatgaagcctcgtgtatcaaggagcccatcgaaggagactgtggagccaggactctgcccaacaaagacttagctaagcagtgaccagaacccaccaaaaactaggctgcattgctttgaagaggcaatcattttgccatttgtgaaagttgtgttggatttagtaaaaatgtgaataagctttgtacttattttgagaactttttaaatgttccaaaataccctattttcaaagggtaatcgtaagatgttaacccttggtatttagaaaattaaaaccttataatatttttctatcaagatgtatattttacagtcgtgccttttactctcattagcaaaaaagataaagattttattttggtatttacaagaattcccaggtacgaagatatctgcatgggtggaaatcaggttcaagcaacgtactttgcattaactgataatacctcagctgcggggttaaagttttcccagtatagagagactgtcactaggaacattgtattgatttattcaggtcattgagatcttctagatgtattttaaaaagaatgctttttggttatgtgttgctaccacagttaacactccataatgttcatgtcagccaaagaggactaaccaaagctgaaatctcagagaacaatttgctttactaagctgagtcaacttgagagcgaacttctaacaatgccgcactgtagtgtggctggttctaccactatgactttaaaacatgtttatatcatttttaatttttatgatacggtagtgtcagggagaaatgtaatgttctatatgaaattcctttttcaagtttgttcattaataacagttattaatttaaatcagcgttagagtttgtgctgctgcaactgctgtgaaaatttctctgagtaattctgatttgtgaatgatcccagaccaaccctgagattttgtcaacctgattaagtcaatatgaatgattaaaaagatgtgagaac

SEQ ID NO: 86124 - DNA, 2749 bp, Homo sapiens
gcggccgccggtgccggcgaacgcgctgggcgcgcggggcgaggcggtgcggctgcagctgcagggcgaggagctgcggctgcaggaggagagcgtgcggctgcaccagattaacatctacctcagcgaccgcatctcactgcaccgccgcctgcccgtgcgctggaacccgctgtgcaaagagaagaaatatgattatgataatttgcccaggacatctgttatcatagcattttataatgaagcctggtcaactctccttcggacagtttacagtgtccttgagacatccccggatatcctgctagaagaagtgatccttgtagatgactacagtgatagagagcacctgaaggagcgcttggccaatgagctttcgggactgcccaaggtgcgcctgatccgcgccaacaagagagagggcctggtgcgagcccggctgctgggggcgtctgcggcgaggggcgatgttctgaccttcctggactgtcactgtgagtgccacgaagggtggctggagccgctgctgcagaggatccatgaagaggagtcggcagtggtgtgcccggtgattgatgtgatcgactggaacaccttcgaatacctggggaactccggggagccccagatcggcggtttcgactggaggctggtgttcacgtggcacacagttcctgagagggagaggatacggatgcaatcccccgtcgatgtcatcaggtctccaacaatggctggtgggctgtttgctgtgagtaagaaatattttgaatatctggggtcttatgatacaggaatggaagtttggggaggagaaaacctcgaattttcctttaggatctggcagtgtggtggggttctggaaacacacccatgttcccatgttggccatgttttccccaagcaagctccctactcccgcaacaaggctctggccaacagtgttcgtgcagctgaagtatggatggatgaatttaaagagctctactaccatcgcaacccccgtgcccgcttggaaccttttggggatgtgacagagaggaagcagctccgggacaagctccagtgtaaagacttcaagtggttcttggagactgtgtatccagaactgcatgtgcctgaggacaggcctggcttcttcgggatgctccagaacaaaggactaacagactactgctttgactataaccctcccgatgaaaaccagattgtgggacaccaggtcattctgtacctctgtcatgggatgggccagaatcagtttttcgagtacacgtcccagaaagaaatacgctataacacccaccagcctgagggctgcattgctgtggaagcaggaatggatacccttatcatgcatctctgcgaagaaactgccccagagaatcagaagttcatcttgcaggaggatggatctttatttcacgaacagtccaagaaatgtgtccaggctgcgaggaaggagtcgagtgacagtttcgttccactcttacgagactgcaccaactcggatcatcagaaatggttcttcaaagagcgcatgttatgaagcctcgtgtatcaaggagcccatcgaaggagactgtggagccaggactctgcccaacaaagacttagctaagcagtgaccagaacccaccaaaaactaggctgcattgctttgaagaggcaatcattttgccatttgtgaaagttgtgttggatttagtaaaaatgtgaataagctttgtacttattttgagaactttttaaatgttccaaaataccctattttcaaagggtaatcgtaagatgttaacccttggtatttagaaaattaaaaccttataatatttttctatcaagatgtatattttacagtcgtgccttttactctcattagcaaaaaagataaagattttattttggtatttacaagaattcccaggtacgaagatatctgcatgggtggaaatcaggttcaagcaacgtactttgcattaactgataatacctcagctgcggggttaaagttttcccagtatagagagactgtcactaggaacattgtattgatttattcaggtcattgagatcttctagatgtattttaaaaagaatgctttttggttatgtgttgctaccacagttaacactccataatgttcatgtcagccaaagaggactaaccaaagctgaaatctcagagaacaatttgctttactaagctgagtcaacttgagagcgaacttctaacaatgccgcactgtagtgtggctggttctaccactatgactttaaaacatgtttatatcatttttaatttttatgatacggtagtgtcagggagaaatgtaatgttctatatgaaattcctttttcaagtttgttcattaataacagttattaatttaaatcagcgttagagtttgtgctgctgcaactgctgtgaaaatttctctgagtaattctgatttgtgaatgatcccagaccaaccctgagattttgtcaacctgattaagtcaatatgaatgattaaaaagatgtgagaaccaaaaacacacacccacacaccacagcaaccaaccattgttgtgacccgcctcgcggccctggaaggaagtgctagtacacaccattcgtttggagcccggggcacctgtaggatgacgtaacgtggaccacggggtacgagagggacctcgggacggactaggccggagacccaccaataaaacggcgagggaaacgaggcttctgacaactcag

SEQ ID NO: 86125 - DNA, 1880 bp, Homo sapiens
  misc_feature (1758)..(1758): n is a, c, g, or t
gcggccgccggtgccggcgaacgcgctgggcgcgcggggcgaggcggtgcggctgcagctgcagggcgaggagctgcggctgcaggaggagagcgtgcggctgcaccagattaacatctacctcagcgaccgcatctcactgcaccgccgcctgcccgtgcgctggaacccgctgtgcaaagagaagaaatatgattatgataatttgcccaggacatctgttatcatagcattttataatgaagcctggtcaactctccttcggacagtttacagtgtccttgagacatccccggatatcctgctagaagaagtgatccttgtagatgactacagtgatagagagcacctgaaggagcgcttggccaatgagctttcgggactgcccaaggtgcgcctgatccgcgccaacaagagagagggcctggtgcgagcccggctgctgggggcgtctgcggcgaggggcgatgttctgaccttcctggactgtcactgtgagtgccacgaagggtggctggagccgctgctgcagaggatccatgaagaggagtcggcagtggtgtgcccggtgattgatgtgatcgactggaacaccttcgaatacctggggaactccggggagccccagatcggcggtttcgactggaggctggtgttcacgtggcacacagttcctgagagggagaggatacggatgcaatcccccgtcgatgtcatcaggtctccaacaatggctggtgggctgtttgctgtgagtaagaaatattttgaatatctggggtcttatgatacaggaatggaagtttggggaggagaaaacctcgaattttcctttaggatctggcagtgtggtggggttctggaaacacacccatgttcccatgttggccatgttttccccaagcaagctccctactcccgcaacaaggctctggccaacagtgttcgtgcagctgaagtatggatggatgaatttaaagagctctactaccatcgcaacccccgtgcccgcttggaaccttttggggatgtgacagagaggaagcagctccgggacaagctccagtgtaaagacttcaagtggttcttggagactgtgtatccagaactgcatgtgcctgaggacaggcctggcttcttcgggatgctccagaacaaaggactaacagactactgctttgactataaccctcccgatgaaaaccagattgtgggacaccaggtcattctgtacctctgtcatgggatgggccagaatcagtttttcgagtacacgtcccagaaagaaatacgctataacacccaccagcctgagggctgcattgctgtggaagcaggaatggatacccttatcatgcatctctgcgaagaaactgccccagagaatcagaagttcatcttgcaggaggatggatctttatttcacgaacagtccaagaaatgtgtccaggctgcgaggaaggagtcgagtgacagtttcgttccactcttaccaacgagacttgcaccaaaatttccggggaattcccaattccagggaaacaacactgtgggggttttccccttttttcccaaaaaaaaagggggaaaaagggggccctgcgtgcgccccaaaaaatttgtcgtctgcggggcttctatcctagaaaaaacactttttttctctgcggcgggcaacaaaaacaatagataaggccggggggcggccccccacgcacacaccaccatttttttttttcccccgcggggggggaaganatattagacgagggggggcagggggtgttattatctagaacaaacgtgtttttttcttctccccccacaacacacaaacaagcaacaacagcaggggcggggcgggcggcgagggagacaca

SEQ ID NO: 86126 - DNA, 2533 bp, Homo sapiens
gcggccgccggtgccggcgaacgcgctgggcgcgcggggcgaggcggtgcggctgcagctgcagggcgaggagctgcggctgcaggaggagagcgtgcggctgcaccagattaacatctacctcagcgaccgcatctcactgcaccgccgcctgcccgtgcgctggaacccgctgtgcaaagagaagaaatatgattatgataatttgcccaggacatctgttatcatagcattttataatgaagcctggtcaactctccttcggacagtttacagtgtccttgagacatccccggatatcctgctagaagaagtgatccttgtagatgactacagtgatagagagcacctgaaggagcgcttggccaatgagctttcgggactgcccaaggtgcgcctgatccgcgccaacaagagagagggcctggtgcgagcccggctgctgggggcgtctgcggcgaggggcgatgttctgaccttcctggactgtcactgtgagtgccacgaagggtggctggagccgctgctgcagaggatccatgaagaggagtcggcagtggtgtgcccggtgattgatgtgatcgactggaacaccttcgaatacctggggaactccggggagccccagatcggcggtttcgactggaggctggtgttcacgtggcacacagttcctgagagggagaggatacggatgcaatcccccgtcgatgtcatcaggtctccaacaatggctggtgggctgtttgctgtgagtaagaaatattttgaatatctggggtcttatgatacaggaatggaagtttggggaggagaaaacctcgaattttcctttaggatctggcagtgtggtggggttctggaaacacacccatgttcccatgttggccatgttttccccaagcaagctccctactcccgcaacaaggctctggccaacagtgttcgtgcagctgaagtatggatggatgaatttaaagagctctactaccatcgcaacccccgtgcccgcttggaaccttttggggatgtgacagagaggaagcagctccgggacaagctccagtgtaaagacttcaagtggttcttggagactgtgtatccagaactgcatgtgcctgaggacaggcctggcttcttcgggatgctccagaacaaaggactaacagactactgctttgactataaccctcccgatgaaaaccagattgtgggacaccaggtcattctgtacctctgtcatgggatgggccagaatcagtttttcgagtacacgtcccagaaagaaatacgctataacacccaccagcctgagggctgcattgctgtggaagcaggaatggatacccttatcatgcatctctgcgaagaaactgccccagagaatcagaagttcatcttgcaggaggatggatctttatttcacgaacagtccaagaaatgtgtccaggctgcgaggaaggagtcgagtgacagtttcgttccactcttacgagactgcaccaactcggatcatcagaaatggttcttcaaagagcgcatgttatgaagcctcgtgtatcaaggagcccatcgaaggagactgtggagccaggactctgcccaacaaagacttagctaagcagtgaccagaacccaccaaaaactaggctgcattgctttgaagaggcaatcattttgccatttgtgaaagttgtgttggatttagtaaaaatgtgaataagctttgtacttattttgagaactttttaaatgttccaaaataccctattttcaaagggtaatcgtaagatgttaacccttggtatttagaaaattaaaaccttataatatttttctatcaagatgtatattttacagtcgtgccttttactctcattagcaaaaaagataaagattttattttggtatttacaagaattcccaggtacgaagatatctgcatgggtggaaatcaggttcaagcaacgtactttgcattaactgataatacctcagctgcggggttaaagttttcccagtatagagagactgtcactaggaacattgtattgatttattcaggtcattgagatcttctagatgtattttaaaaagaatgctttttggttatgtgttgctaccacagttaacactccataatgttcatgtcagccaaagaggactaaccaaagctgaaatctcagagaacaatttgctttactaagctgagtcaacttgagagcgaacttctaacaatgccgcactgtagtgtggctggttctaccactatgactttaaaacatgtttatatcatttttaatttttatgatacggtagtgtcagggagaaatgtaatgttctatatgaaattcctttttcaagtttgttcattaataacagttattaatttaaatcagcgttagagtttgtgctgctgcaactgctgtgaaaatttctctgagtaattctgatttgtgaatgatcccagaccaaccctgagattttgtcaacctgattaagtcaatatgaatgattaaaaagatgtgagaac

SEQ ID NO: 86127 - DNA, 2513 bp, Homo sapiens
agccttcctactgatgctactctacatggcccgtgaaaaccgtattggaaaactcctagcatttcagtagattttccagttaatgaagtcttacattttaagcatcaaaactttgtgtaaatgttggtgcttttcagtggaaaattaagatttttaataatattttatatggtgttctgccctcataaaaactgaataaacaagaatttggccttctaccgaggactcacgccctctgtaataagtaccagatgctgtgcttggttgtcccatctttgggaaaatgagatattcaaggctgtcagtcccagtgtgagatgggctcagatgccttcgcctgttgagtctttgggtgtgcttttaatggtctctctgcctcttccttaggtgtcaggctgctctacctgtttctagacgctcttcctttcccccttccaaacctcttttcttccttgctgctttcctatcttctgtggctaggagatcaggtaatcaagcctgtgtttactgtaatgagtaagtgggttgccagcgaggtctctgtggatgctcctgtgagtcaagtgcatgagctttagtgcatggactttggggtcttggttcccacagcttatatgttttgggggctgctttcttgctctttacccacattctgtgtcatgagtgtgccgggtaggtggcctcctgcccgatggaggctgagcatcttggcagtgtccatcatgccttgcgtgtgcctggcctctttgctgcagatactatggacccgcagctcatcccctgctcaccacctggcctctccttttctctgtgtgcagatctggcagtgtggtggggttctggaaacacacccatgttcccatgttggccatgttttccccaagcaagctccctactcccgcaacaaggctctggccaacagtgttcgtgcagctgaagtatggatggatgaatttaaagagctctactaccatcgcaacccccgtgcccgcttggaaccttttggggatgtgacagagaggaagcagctccgggacaagctccagtgtaaagacttcaagtggttcttggagactgtgtatccagaactgcatgtgcctgaggacaggcctggcttcttcgggatgctccagaacaaaggactaacagactactgctttgactataaccctcccgatgaaaaccagattgtgggacaccaggtcattctgtacctctgtcatgggatgggccagaatcagtttttcgagtacacgtcccagaaagaaatacgctataacacccaccagcctgagggctgcattgctgtggaagcaggaatggatacccttatcatgcatctctgcgaagaaactgccccagagaatcagaagttcatcttgcaggaggatggatctttatttcacgaacagtccaagaaatgtgtccaggctgcgaggaaggagtcgagtgacagtttcgttccactcttacgagactgcaccaactcggatcatcagaaatggttcttcaaagagcgcatgttatgaagcctcgtgtatcaaggagcccatcgaaggagactgtggagccaggactctgcccaacaaagacttagctaagcagtgaccagaacccaccaaaaactaggctgcattgctttgaagaggcaatcattttgccatttgtgaaagttgtgttggatttagtaaaaatgtgaataagctttgtacttattttgagaactttttaaatgttccaaaataccctattttcaaagggtaatcgtaagatgttaacccttggtatttagaaaattaaaaccttataatatttttctatcaagatgtatattttacagtcgtgccttttactctcattagcaaaaaagataaagattttattttggtatttacaagaattcccaggtacgaagatatctgcatgggtggaaatcaggttcaagcaacgtactttgcattaactgataatacctcagctgcggggttaaagttttcccagtatagagagactgtcactaggaacattgtattgatttattcaggtcattgagatcttctagatgtattttaaaaagaatgctttttggttatgtgttgctaccacagttaacactccataatgttcatgtcagccaaagaggactaaccaaagctgaaatctcagagaacaatttgctttactaagctgagtcaacttgagagcgaacttctaacaatgccgcactgtagtgtggctggttctaccactatgactttaaaacatgtttatatcatttttaatttttatgatacggtagtgtcagggagaaatgtaatgttctatatgaaattcctttttcaagtttgttcattaataacagttattaatttaaatcagcgttagagtttgtgctgctgcaactgctgtgaaaatttctctgagtaattctgatttgtgaatgatcccagaccaaccctgagattttgtcaacctgattaagtcaatatgaatgattaaaaagatgtgagaac

SEQ ID NO: 86128 - DNA, 1168 bp, Homo sapiens
aaggatccctatgccgaagagtacagaagttcatctgcaggaggatggatctttatttcacgaacagtccaagaaatgtgtccaggctgcgaggaaggagtcgagtgacagtttcgttccactcttacgagactgcaccaactcggatcatcagaaatggttcttcaaagagcgcatgttatgaagcctcgtgtatcaaggagcccatcgaaggagactgtggagccaggactctgcccaacaaagacttagctaagcagtgaccagaacccaccaaaaactaggctgcattgctttgaagaggcaatcattttgccatttgtgaaagttgtgttggatttagtaaaaatgtgaataagctttgtacttattttgagaactttttaaatgttccaaaataccctattttcaaagggtaatcgtaagatgttaacccttggtatttagaaaattaaaaccttataatatttttctatcaagatgtatattttacagtcgtgccttttactctcattagcaaaaaagataaagattttattttggtatttacaagaattcccaggtacgaagatatctgcatgggtggaaatcaggttcaagcaacgtactttgcattaactgataatacctcagctgcggggttaaagttttcccagtatagagagactgtcactaggaacattgtattgatttattcaggtcattgagatcttctagatgtattttaaaaagaatgctttttggttatgtgttgctaccacagttaacactccataatgttcatgtcagccaaagaggactaaccaaagctgaaatctcagagaacaatttgctttactaagctgagtcaacttgagagcgaacttctaacaatgccgcactgtagtgtggctggttctaccactatgactttaaaacatgtttatatcatttttaatttttatgatacggtagtgtcagggagaaatgtaatgttctatatgaaattcctttttcaagtttgttcattaataacagttattaatttaaatcagcgttagagtttgtgctgctgcaactgctgtgaaaatttctctgagtaattctgatttgtgaatgatcccagaccaaccctgagattttgtcaacctgattaagtcaatatgaatgattaaaaagatgtgagaac

SEQ ID NO: 86129 - DNA, 493 bp, Homo sapiens
tattaataaaatttctaatttagttgtagctagattcttaaagtactcagcaattatggtggctattttgaaactgtgcattgtttatcaagcttgtttttcatgtaaaaggatctgggcattgatatattttcattatatttgtagttaatagtaaaaatgtttaaatatataagtagctggtgaaatttgtatttggcatgccccaaagccccttttccttcaaaagctttaatcctgacagcatctcttgaaatataaaacaaatttgaagttccctaagaaaaatacatgtttttctttgaggatactactgttgctttgctgccctctacagtcatctaaaatagtcactctagatttttctccattcagatacttagaatactttttccctgacctgtgtatgagctttatatttcaggaatgggttaagtaatatttactgttacggaagtaaagtttagtcacagttaatctatatatgtcatgc

SEQ ID NO: 86130 - DNA, 449 bp, Homo sapiens
tattaataaaatttctaatttagttgtagctagattcttaaagtactcagcaattatggtggctattttgaaactgtgcattgtttatcaagcttgtttttcatgtaaaaggatctgggcattgatatattttcattatatttgtagttaatagtaaaaatgtttaaatgtcctttcattatagactcagattccctactaatttgatttagagataatcattcatggctatacatttaatttaatactaagcctgacaataaactgcctagtttttaaaacctgcttagagataccatacctactttattttaaatgcaaaataaaaaagtccttctccattcctttaattttttggaagagaatcaagtggaagaaggcatatagctaacagttctatacttctctttaagggcacaggactaaaacatgatagcagcatttctcac

SEQ ID NO: 86131 - DNA, 1043 bp, Homo sapiens
tggatgaagagtgagctaggagaacttcgtaaggtgaaactgtggggatccaatgggcaacacaaagcatcttggttaaggaggttaggggccggtctaggacttgcctcaggaggaaggacagcctcagagcatgctcagaggtgggaagggaaggaggagaaagcaggcgaagcggggccatctgctttatctgaagattttcagctgatgaagaactaggaggctcaaacactatcttacctgagtccaggacaagtgacttggagagtgtgctcttctgtggcaggatcaggtctgtctagggcaggatggcccaggatctcagcgagaaggacctgttgaagatggaggtggagcagctgaagaaagaagtgaaaaacacaagaattccgatttccaaagcgggaaaggaaatcaaggagtacgtggaggcccaagcaggaaacgatccttttctcaaaggcatccctgaggacaagaatcccttcaaggagaaaggtggctgtctgataagctgatggcatggagccctgccctgagtgtctgtccctcttcagccaagcccaagtctcctagacccccagggagccagtgaactgtcaccttctcttcatcacagaatgagtaaagatccctgaacaaatgcattgtgaacccattccccactcccaccttcaactcttttctcccattatttcctccacctgctgggtctctgctgaccttgctgggaacactctgaggacagtgtggctggccgagcggttggccccatgggtggtggggtgtgagaagcctgcaataccccaagaccccagagggcagtccttaggaagcacttacaccacctgggaacccctccgtcttttccctctactctcatcctaggaataaagcatttccacgccagagtagtttgggctgggggccagggttgggtggtcctgtccctccatatcatgtcctaccctatggtcctgttcctagtcatttagatcaccccagatggcctgatgacaacaagagtttgtgaagttatg

SEQ ID NO: 86132 - DNA, 803 bp, Homo sapiens
gaggccaagattcggcacgaggcttggagagtgtgctcttctgtggcaggatcaggtctgtctagggcaggatggcccaggatctcagcgagaaggacctgttgaagatggaggtggagcagctgaagaaagaagtgaaaaacacaagaattccgatttccaaagcgggaaaggaaatcaaggagtacgtggaggcccaagcaggaaacgatccttttctcaaaggcatccctgaggacaagaatcccttcaaggagaaaggtggctgtctgataagctgatggcatggagccctgccctgagtgtctgtccctcttcagccaagcccaagtctcctagacccccagggagccagtgaactgtcaccttctcttcatcacagaatgagtaaagatccctgaacaaatgcattgtgaacccattccccactcccaccttcaactcttttctcccattatttcctccacctgctgggtctctgctgaccttgctgggaacactctgaggacagtgtggctggccgagcggttggccccatgggtggtggggtgtgagaagcctgcaataccccaagaccccagagggcagtccttaggaagcacttacaccacctgggaacccctccgtcttttccctctactctcatcctaggaataaagcatttccacgccagagtagtttgggctgggggccagggttgggtggtcctgtccctccatatcatgtcctaccctatggtcctgttcctagtcatttagatcaccccagatggcctgatgacaacaagagtttgtgaagttatg

SEQ ID NO: 86133 - DNA, 649 bp, Homo sapiens
tggatgaagagtgagctaggagaacttcgtaaggtgaaactgtggggatccaatgggcaacacaaagcatcttggttaaggaggttaggggccggtctaggacttgcctcaggaggaaggacagcctcagagcatgctcagaggtgggaagggaaggaggagaaagcaggcgaagcggggccatctgctttatctgaagattttcagctgatgaagaactaggaggctcaaacactatcttacctgagtccaggacaagtgacttggagagtgtgctcttctgtggcaggatcaggtctgtctagggcaggatggcccaggatctcagcgagaaggacctgttgaagatggaggtggagcagctgaagaaagaagtgaaaaacacaagaattccgatttccaaagcgggaaaggaaatcaaggagtacgtggaggcccaagcaggaaacgatccttttctcaaaggcatccctgaggacaagaatcccttcaaggagaaaggtggctgtctgataagctgatggcatggagccctgccctgagtgtctgtccctcttcagccaagcccaagtctcctagacccccagggagccagtgaactgtcaccttctcttcatcacagaatgagtaaagatccctgaacaaatgc

SEQ ID NO: 86134 - DNA, 341 bp, Homo sapiens
agtctctccttaactggttgattccccatatcacaccaaagttatcttcctaaaaacaaatttgatcatcgcattcacttgctttaaaaagtccgcttactctctgatgcctgtagattttcttattcaagaacctttacagtcgagtcctaacacatttcaccaatttcacatctagctactctgtttttacctgtctacattggcttctcactgttccttacaactctgttctttcctccacctagaatatttttttcttagaccaattcctaactatcctttaagaccaactcatacatcatctactcattaaagtcttctgtgacatcctcagttaa

SEQ ID NO: 86135 - DNA, 244 bp, Homo sapiens
cttgtcacctctgcatctttgtcgctgattgctgtctggcatacccctttctctactccccctcccattcgctcatttattactttttgttcagtgaacatttattaagcccctactaccttccaggcattgttcaatgttctgggaatataaaagagaacaagccatttgaagtccttgctctgatataggtgccactctagtaagatgacagccgataaaccaatacatatacgcttttcca

SEQ ID NO: 86136 - DNA, 175 bp, Homo sapiens
agtgtcctggctgccctgtggtgatggggatggcagggacctgcatttttgtgagttcctgcacgtgatgaaggggaaattgcaactgcccaggcagcctgtgcaaaaaggcagtgggtttcaagtgtggtcataaaccaaaagcctcaggttcacacgtcatgggggaggctga

SEQ ID NO: 86137 - DNA, 327 bp, Homo sapiens
catgcccccccctgctctgtggctaccagggagaaagacaagtgttatatgtgcgtgatgtccttcccattggcaaaagaatgcatcttttccatcccttatgtctgctgcagtcagaatgatcaaagatatggagtatttcccaaagaaaatgtctcagtgtccaaagatcgccccttccccatctcccaggaggtggggtgtgcataggcaatgacaggcggacttgctgcttgcaagccttgggttcactttggctaggctgcagttttccttacagcagcaaagatgggtggcagttagtacagagactaagaacacaaactt

SEQ ID NO: 86138 - DNA, 1120 bp, Homo sapiens
gcctatagttaaaaaaaaaaaaagcagttaacagaaaccaatccccctacaatgaaccagattctgtatttacaaagattctaaagcagctctacacgtgcccagtcaagacctttttaatgccattaacactgaggacattgagctgagacactagattgagaatcacattcccaggggtcagcaaacgacctataaagggcccagataagtattttaggttgtgtgggccacatgcagtttttgtttcatatttttgcttgttttttttttttttttaaacaactctttaaaaatataaaagccattcctggctttaagtgctgtacaaaaacaggccatcaacacatgtggcttgtgagccagaggttgccagtccctcccctagaataaggactactccaggcccgccttaacaacgtctaaagcaaaaccctgacccgatccacaagacggtcagagtttggaggttaagtcctgccaagtaagaggggcctgggagacacctgggacattgctcagtaaacagagcctaaagctaagcctacacagcccagcatggtacgtccagtaatggaactacaaactagaacgaaagtcaggatttttcagtggaagagcaccctgagtctccctcatttgttatttatcagtgttgaatatacactaaaaaaacaaaaatcactaaacatacaaagaaagaggaaaacgtaagccatagttaagaaaaaaaaaaagcagttaacagaaaccaatccccctacaatgaaccagattctgtatttacaaagattctaaagcagctctacatatgtccaaaggaggctgggcacggtggctcacacctgtaatcccagaaatttgggaggccgaggtgggcagatcacttgagcccaggagtttgagatcagcctggccaacatggtgaaaccccatctctactaaaaacacaaaaattagctgggtgtggtggcgcacgcctgtagccccagctactcggaaagctgaagcaggagaatcgcttgaatccgggaggtggaggttacagtgagccaagatagtgccactgcactccagcctgggtgacagagcaagactccatctcaaaataaataaaaat

SEQ ID NO: 86139 - DNA, 1463 bp, Homo sapiens
  misc_feature (1252)..(1252): n is a, c, g, or t
  misc_feature (1270)..(1270): n is a, c, g, or t
  misc_feature (1275)..(1275): n is a, c, g, or t
  misc_feature (1301)..(1301): n is a, c, g, or t
  misc_feature (1463)..(1463): n is a, c, g, or t
attccctcggcgggccgagcctcccctctctcccgcccctcctcctccctttcccacccctcggagtagagctgcacatgcggctgctccctgctccgtcccgcccagccactgtcgcgcaggaacgggtccctgcagcccccagccgatggcaggacagtagccgcctgtcagaggtcgtgaacggctgaggcagacgcagcggctcccgggcctcaagagagtggatgtctccggaggccatgggctacccggaggtggagcgcagggaactcctgcctgcagcagcgccgcgggagcgagggagccagggctgcgggtgtggcggggcccctgcccgggcgggcgaagggaacagctgcctgctcttcctgggtttctttggcctctcgctggccctccacctgctgacgttgtgctgctacctagagttgcgctcggagttgcggcgggaacgtggagccgagtcccgccttggcggctcgggcacccctggcacctctggcaccctaagcagcctcggtggcctcgaccctgacagccccatcaccagtcaccttgggcagccgtcacctaagcagcagccattggaaccgggagaagccgcactccactctgactcccaggacgggcaccagctccatgtttctttttcactgagaaaaaagaaagcaggacaccaatgagttgtgtcttccctctgtccactctcagcaccttcactctgaagatctgttaaaagcacacgagtcgtctcagtccctcagtgggagctgtttcacctggcgtcatctagtcagccatcttcaataataactgttaaatgaacatttatatccactgaaaccactaagtgaaataaagatgtgtttaggcaaagaactgagtttatgacttatagatcctcaccaaggaaacttccaaaagatgtacttcacagaagaagaaaatgatcccagaaggaaaatttgagatgtaagacagaagaacaagcaaagattgtttaaacatatggccctattgaatttcttcttccctgatgaaaagccatactctgaagaagaaagtaggcgtgttcgccgcaataaaagaagcaaaagcaatgaaggagcagatggtaagtctactcagttgatcctttatcacttctgaattatttgttagtaaaagtatccttttaagaactaccttcttggtagggcatggtggctcacgcctgtaatcctagcactttgggaggcccacgcgggcngatcacttgaggtgaggnattcnaaaccagcctggccaacatggtgaanccctgtctctactaaaaatacaaaaaaaattagccgggcctagtcccagctgcttgggagactaaggcaggagaatcgcttgaaactgggaggtagaggttgcagtgagctgagactgtgccactgcactccagcctgggtgacagtgcgagactccatctn

SEQ ID NO: 86140 - DNA, 840 bp, Homo sapiens
attccctcggcgggccgagcctcccctctctcccgcccctcctcctccctttcccacccctcggagtagagctgcacatgcggctgctccctgctccgtcccgcccagccactgtcgcgcaggaacgggtccctgcagcccccagccgatggcaggacagtagccgcctgtcagaggtcgtgaacggctgaggcagacgcagcggctcccgggcctcaagagagtggatgtctccggaggccatgggctacccggaggtggagcgcagggaactcctgcctgcagcagcgccgcgggagcgagggagccagggctgcgggtgtggcggggcccctgcccgggcgggcgaagggaacagctgcctgctcttcctgggtttctttggcctctcgctggccctccacctgctgacgttgtgctgctacctagagttgcgctcggagttgcggcgggaacgtggagccgagtcccgccttggcggctcgggcacccctggcacctctggcaccctaagcagcctcggtggcctcgaccctgacagccccatcaccagtcaccttgggcagccgtcacctaagcagcagccattggaaccgggagaagccgcactccactctgactcccaggacgggcaccagggacaccaatgagttgtgtcttccctctgtccactctcagcaccttcactctgaagatctgttaaaagcacacgagtcgtctcagtccctcagtgggagctgtttcacctggcgtcatctagtcagccatcttcaataataactgttaaatgaacatttatatccactgaaaccactaagtgaaataaagatgtgtttaggc

SEQ ID NO: 86141 - DNA, 924 bp, Homo sapiens
  misc_feature (713)..(713): n is a, c, g, or t
  misc_feature (731)..(731): n is a, c, g, or t
  misc_feature (736)..(736): n is a, c, g, or t
  misc_feature (762)..(762): n is a, c, g, or t
  misc_feature (924)..(924): n is a, c, g, or t
taaggctcttcgatcaagaacataactaggaatcattcgaggtgattcaaggactttgactacatcatttcattctcttatggcctacaaggtttctgctgagaaatccactgatattctaatggatattcctttggacaccaatgagttgtgtcttccctctgtccactctcagcaccttcactctgaagatctgttaaaagcacacgagtcgtctcagtccctcagtgggagctgtttcacctggcgtcatctagtcagccatcttcaataataactgttaaatgaacatttatatccactgaaaccactaagtgaaataaagatgtgtttaggcaaagaactgagtttatgacttatagatcctcaccaaggaaacttccaaaagatgtacttcacagaagaagaaaatgatcccagaaggaaaatttgagatgtaagacagaagaacaagcaaagattgtttaaacatatggccctattgaatttcttcttccctgatgaaaagccatactctgaagaagaaagtaggcgtgttcgccgcaataaaagaagcaaaagcaatgaaggagcagatggtaagtctactcagttgatcctttatcacttctgaattatttgttagtaaaagtatccttttaagaactaccttcttggtagggcatggtggctcacgcctgtaatcctagcactttgggaggcccacgcgggcngatcacttgaggtgaggnattcnaaaccagcctggccaacatggtgaanccctgtctctactaaaaatacaaaaaaaattagccgggcctagtcccagctgcttgggagactaaggcaggagaatcgcttgaaactgggaggtagaggttgcagtgagctgagactgtgccactgcactccagcctgggtgacagtgcgagactccatctn

SEQ ID NO: 86142 - DNA, 1427 bp, Homo sapiens
  misc_feature (1216)..(1216): n is a, c, g, or t
  misc_feature (1234)..(1234): n is a, c, g, or t
  misc_feature (1239)..(1239): n is a, c, g, or t
  misc_feature (1265)..(1265): n is a, c, g, or t
  misc_feature (1427)..(1427): n is a, c, g, or t
attccctcggcgggccgagcctcccctctctcccgcccctcctcctccctttcccacccctcggagtagagctgcacatgcggctgctccctgctccgtcccgcccagccactgtcgcgcaggaacgggtccctgcagcccccagccgatggcaggacagtagccgcctgtcagaggtcgtgaacggctgaggcagacgcagcggctcccgggcctcaagagagtggatgtctccggaggccatgggctacccggaggtggagcgcagggaactcctgcctgcagcagcgccgcgggagcgagggagccagggctgcgggtgtggcggggcccctgcccgggcgggcgaagggaacagctgcctgctcttcctgggtttctttggcctctcgctggccctccacctgctgacgttgtgctgctacctagagttgcgctcggagttgcggcgggaacgtggagccgagtcccgccttggcggctcgggcacccctggcacctctggcaccctaagcagcctcggtggcctcgaccctgacagccccatcaccagtcaccttgggcagccgtcacctaagcagcagccattggaaccgggagaagccgcactccactctgactcccaggacgggcaccagggacaccaatgagttgtgtcttccctctgtccactctcagcaccttcactctgaagatctgttaaaagcacacgagtcgtctcagtccctcagtgggagctgtttcacctggcgtcatctagtcagccatcttcaataataactgttaaatgaacatttatatccactgaaaccactaagtgaaataaagatgtgtttaggcaaagaactgagtttatgacttatagatcctcaccaaggaaacttccaaaagatgtacttcacagaagaagaaaatgatcccagaaggaaaatttgagatgtaagacagaagaacaagcaaagattgtttaaacatatggccctattgaatttcttcttccctgatgaaaagccatactctgaagaagaaagtaggcgtgttcgccgcaataaaagaagcaaaagcaatgaaggagcagatggtaagtctactcagttgatcctttatcacttctgaattatttgttagtaaaagtatccttttaagaactaccttcttggtagggcatggtggctcacgcctgtaatcctagcactttgggaggcccacgcgggcngatcacttgaggtgaggnattcnaaaccagcctggccaacatggtgaanccctgtctctactaaaaatacaaaaaaaattagccgggcctagtcccagctgcttgggagactaaggcaggagaatcgcttgaaactgggaggtagaggttgcagtgagctgagactgtgccactgcactccagcctgggtgacagtgcgagactccatctn

SEQ ID NO: 86143 - DNA, 926 bp, Homo sapiens
attccctcggcgggccgagcctcccctctctcccgcccctcctcctccctttcccacccctcggagtagagctgcacatgcggctgctccctgctccgtcccgcccagccactgtcgcgcaggaacgggtccctgcagcccccagccgatggcaggacagtagccgcctgtcagaggtcgtgaacggctgaggcagacgcagcggctcccgggcctcaagagagtggatgtctccggaggccatgggctacccggaggtggagcgcagggaactcctgcctgcagcagcgccgcgggagcgagggagccagggctgcgggtgtggcggggcccctgcccgggcgggcgaagggaacagctgcctgctcttcctgggtttctttggcctctcgctggccctccacctgctgacgttgtgctgctacctagagttgcgctcggagttgcggcgggaacgtggagccgagtcccgccttggcggctcgggcacccctggcacctctggcaccctaagcagcctcggtggcctcgaccctgacagccccatcaccagtcaccttgggcagccgtcacctaagcagcagccattggaaccgggagaagccgcactccactctgactcccaggacgggcaccagaggactttgactacatcatttcattctcttatggcctacaaggtttctgctgagaaatccactgatattctaatggatattcctttggacaccaatgagttgtgtcttccctctgtccactctcagcaccttcactctgaagatctgttaaaagcacacgagtcgtctcagtccctcagtgggagctgtttcacctggcgtcatctagtcagccatcttcaataataactgttaaatgaacatttatatccactgaaaccactaagtgaaataaagatgtgtttaggc

SEQ ID NO: 86144 - DNA, 485 bp, Homo sapiens
aggtactccggaggctgaggtgggagagtcacttgaacccaggagggagaggttgcagtgagctaacaccactgcactccagcctgggcaacagagtgagattctgaagaaaagaaaagaaaagaaaagagggaaagaaagagagaaagaaggaaagagagagagaaagagaaggaagagagagacagagaaagaaggaaggaaaaaggcataccatgggcgggaagccaagtgatagcttttcatgactggactgtcaaagttcaagacgagtgactggagaaggtaactggacataaaccagacttagaggatggaatagcaattatgaattgggagacaaggcaaatgttgacaattttaggcatcaggtagtaaaactgtcctcattcttttgaaaattaacctcgctgggcacagtggctcatgcctgtaatcccagcactttgggaggctgaggcaggtggaccacttgaagtcaggag

SEQ ID NO: 86145 - DNA, 634 bp, Homo sapiens
aaagaggtcagggtgtggcgatttttgccaatgactgcgatttccagaaggcacagcagaaggtttcccacagccttatgggaattactgtgcaggagaggaagggagcccagggtttcatatggtggctgacattctcaggggtaacagccataatgacattagtcctgaatgcctttaggcagaaagtggtgagaattctttgaataatattaggcagatcaggtggtggtcttgccagaagtgggcaaaaattctgaggatctcttttggcccctgataatgaatgcagtatcatgctagaaatctctgtatcggtattgtgcacagctgaattgttacctacttgtgtgtgccttgattttccagaaagactgtgaggtctcctatcactgtatcattgtgttttttgcattgtactttcttgctctacatgactatcatacgtgttatggattgaactgtctccactccccaaattcatatgcctcaatcctcagtacctcaccatgtgaccttatttgaagatagggttttttcaccttacttggagagaggataatcaagttaaagtgaggtcatgtgggtgggccctaatccaacatgactggtatccttatgtttaaaaaaaaaa

SEQ ID NO: 86146 - DNA, 246 bp, Homo sapiens
cagcatttcttcccatctctctgctcacacggcccccttgttcttgcatgctgtctactttttccattagagcctttggcctaccaatcattttcaatttcctgtatgataattgccatccatgttatctccatgttcctgcaaccattcagttgtctctctcagcctctggtgagattgttgttagaccttcttctgttctgcattcctaacactctcttgcatgtttctcatctccttttctcc

SEQ ID NO: 86147 - DNA, 226 bp, Homo sapiens
cttagtgggtagaggggagaggacagaactaagtggtagaaattttaacatgttgattagaagtcccttaactttcctaacccatttctttccaccctgtcacgaaaaatttggtgtggtagtgggaggccttaggcaagctattgactgttttctcaggaattgagggtgtgggagttttgatctttagggttcttggtcgatctgtaggcttaaaatcagcttg

SEQ ID NO: 86148 - DNA, 440 bp, Homo sapiens
gaacaaatgctgtgcctgttgatgcagatggagacaagtgcaggatagtttaccaccatagccacggcaactggatttccaggacggtgaactgttcttggtagtgtttcaaacaaaagaagtacagccttacctgccttacacagtagttacgttccaagaaaattctgtatattatgaaaaagtacatttgtgcttatgtgtaaaacaggctatagcctcggataattagtaaagggttttggcccatgagaatgtctggcaggacatcagagtggcatgcagatgcagggcaatccttggttgtacaggaccgctagcatccctggtcccccacacttagtgcctgtaaagtccgctagtctctgtgaccaccagaaaataccttcatcgatttctcaagcattccctggggagctgtgctctccctacggatacca

SEQ ID NO: 86149 - DNA, 800 bp, Homo sapiens
ctcatgggagccttctcagcacatatattccttgggaacctcacgggaccaaactgcttggattcaactcccatttcctaatcagttgtgtggccttgggcaaattacttaacctctcggtgcctcagttttctcatcagtaaaatgggcgtaaggtcattgtcttaataaatttacacacgtacagcactttgggccacagttggttcatggctagcactaaactaatgttagctgtcgccactcccacctaaggccagtccctccaggaacctgacacttttggtgttccatctcttcttctcaaccatattcctgtcatggtgggtagcacccctgttcatccagttgagccagccacaagcctagaggtcaccccactccccatccccacaaaccgtcatcaagtctcatcaaccttattaacttccttaaaaacttccagatctgttcccctctgtcctactctacaacttctccccagagctagcccagtagcccccaagtacaaccatcccagccactacccatttccaccctgcggccagagtcctgctttgaaatgcagacctgatcttgtcacccctccctggactcgccctgctgaaatctcttaatgactttccactcctcttggggtgaaaatcaaaaccctaacaccatgcagactgagtctgttagaatatttttgaccctgaggatcagaaaccctagcaaaccagatttaaattacaggcagtttattagcttcctcacaggtagactggatagggtgggcttcaggcattgtatgattaagg

SEQ ID NO: 86150 - DNA, 408 bp, Homo sapiens
cacacagcccgggtccacttgcatgttgtaatcaaaggtgagctcctcgcctgcccggatggttcttgtggcaaagaaagcgatgcgacgcagccgctcgtcaaggttgtctatgatgaccttttacaccagcacgtggagcacaccctgtcagagaccgaacaggaagaactcgtcacagagcaaagatcctcccctttgcactgcgttcaagggagcgcaggtggccaggaaaccctgctcagcagctctgcgcccagtgcccccgccctccctccagcacctccccggcagcaggcctgcgttgggggtctgtgtgttttggagatgggggtctcatttttttgcccggggggagcgcagtggtactgcgcaggggtgacaggcacacacagccaagcctgatgc

SEQ ID NO: 86151 - DNA, 245 bp, Homo sapiens
ctctgaaggattgggtgcacttggggtgttgagggggcttgggtggagaaagaagggggcccccattttgggtctgtgccattcacccaggggaaaatgggtgtgacaaatggaagatgcaaggaggatgacgatggtgacaatgacagtgatgatgatgatgacgcggcatgattcctgagcgggccctaccctttccaccgcctttcctgcctcccattcctagtcccccacccatcacatgg

SEQ ID NO: 86152 - DNA, 166 bp, Homo sapiens
actaggatttgtataggctttgagagaggagaaagcatggtctattcagatatccgaaatggagagaacaagggaaagagtggcaaaaaatgtgacctgaaaggttagagcatggctaaaatacgcagggtcttgtatacaaggttaaggattttgacctaagggt

SEQ ID NO: 86153 - DNA, 304 bp, Homo sapiens
aagtgatttgcctcccttggcctcccaaagtgctgggattacaggtgtgagccaccatacccagctgaaatctccaaacttggaagcatatttttgtcatagatttttcacaatacaggcagtgatttgatgagtattgctcattggcttgtcatattgtccactggatggggtcagtagggcctctgattaattaggtttaagtttctcagagccccttctttttgtttttcttgactgattaaataacacctctatctaaatctctttacagcccacatatatatctatatggacacataga

SEQ ID NO: 86154 - DNA, 168 bp, Homo sapiens
  misc_feature (1)..(3): n is a, c, g, or t
  misc_feature (5)..(8): n is a, c, g, or t
  misc_feature (150)..(150): n is a, c, g, or t
  misc_feature (155)..(156): n is a, c, g, or t
  misc_feature (158)..(159): n is a, c, g, or t
  misc_feature (161)..(161): n is a, c, g, or t
  misc_feature (167)..(167): n is a, c, g, or t
nnntnnnnagaaaaaagaaagaaaggaaagaaggaaagaaagaaaagaaagaaagaaagaaaaagaaaagaaagaaagaaagaaagaaaaagaaaaagaaagaaagaaagaaagaaagaaagaaagaaagaaagaaagaaagaaagaaanaaagnnannangaaagnc

SEQ ID NO: 86155 - DNA, 2396 bp, Homo sapiens
gccacaaacagagatttacccacgtatttattaacagcaagccagtcattagcattgtttctatagatattaaattaactaaaagtatcccttatgggaaacgaagggatgggccgaattaaaggaataggttgggctagttaactgcagcaggagcatgtccttaaggcacagatcactcatgctattgtttgtggtttaagaatgcctttaagcggttttccaccccgggcaggccaggtgttctttgccctcattccagtaaacccacaaccttccagtatgggtgttagggccattatgaacatgttacagtgctgcagagattttatttatggccagtttatggccagattttggggggcctgctcccaacactctacatatgctccatcttgcagaggcttcattcttggttctctagctaaaaacagtagaaattttgcacacctgggttagaaaaaaaaaatagccattaaacccacccctgttacaggtcactattggtattttgattttgccttcaatccatctgttattgtttacttttaagagtccttgatagttgctttttatgtccagagttttaatttcagtcagaaagagaaataggccttggtgagcatgctttgtcttggctggtgccagaagtctgtactcaaatatttttaaaataatttttagttgaataacaagttagacctgtgtttagctttctcattgttttcctaaaaatagaagaaaaggttttaaatactttaaccacgaaatactttaaagcaggtttaaaataaactccttcattttgcctgttctattactctgttctcacactgctaataaagacatacccaagactggtaatttataaagtaaagaggtttaattgactcacagttccacatggctggggaggcctcccaatcatggcagaaggtgaatgaggagcaaagtcacatcttacatggtggcaggcaagagagagagcatgtgtgcaggggaattcccctttataaaaccgtccaatctcatgagacttatgcagtctcatgggagcagcatgagaaagactcacctccgtgattcagttacctcccactgtgtccctgccacaacatgtgggaattgtgggagctaaaaatcaagatgagatttgggtaggaacacagtcaaaccatatctcctatatacattcacactagcattttagttttagaactagttctatgttactatctgaattaatttttccacaattttgtaaggaaaaataatgcgttctttgaatttcatgtgtaaatgatatttttagttttgtgtcattttgtcaaataaattctgaaaatctttgtattgacagtgtgttatctctgcataaccatatatgtataagagtgctcaataaaaagaataaagaggaaacagcactggatctatacctatacaaaacaagctaccagcagagcccactgggaatggtcatgatataatcaggaatgttatattcacacgttgtagatctgcatatgagaggagggtttgcagatagcagattctagaaaagttgtctaatcagacagtaaatgaaggtgttgaagcactgaacaaaaataagctgctttaattactcataagagggaagtacaagtcattattccatctgccaatttacagactgtaagataccctttaaaagtagcagtaagtaaactcttcataaaagttagactgtatgacaaatccactgcctttcttcttttgcagcagggcctttctttttaatgactattttttgtttttggagatgaagtctgtcacccaggctggagttcagtggcctgattgatcactgcagcctcgacctccagctcacataatcctcctgcttcagcctcctgagtagctgggactacgggtgtgtgccaccatgcctggctttttaaaaaaaaaaattttgtggagttggtgtctcgctatgttgcccaagctgatgtcaaacttctggattcaagcacttctgcccaaagtgctaggattataggtgtgagccactgtgcccaagctagtgactgtttttgaaaaaaagaagcacattaccctcccttgttaatcacttatgtacaaaaatgcatgttttgctgttgatctgttttaactctttctacataaataacacatttgtacatgtatatgtgcagatatatttataatgttaaaattgtgtttaagtgatgtttactaaacaggataaaattttgtttggaaaattgcgatgtgaaattttatctagttaatctatagtcctttcccttatggtgtccagctctatgcaggctctgcctcactccagattatgtaaatatcaattcatattcaaatgaatttgaaatttagct

SEQ ID NO: 86156 - DNA, 1711 bp, Homo sapiens
  misc_feature (22)..(22): n is a, c, g, or t
  misc_feature (154)..(154): n is a, c, g, or t
  misc_feature (180)..(180): n is a, c, g, or t
  misc_feature (360)..(360): n is a, c, g, or t
aattgttgccccttagataagnagcccctgttagtttaagaaaagatggttagtttcccgaagttcaaggttggagtagttcctgtataaggaaggtagctggtcaacctgtcctgctcgggccttcgatataccagttccaagcagatgtagnaaaaaggaaggtaagagtcagaagcnttatgttgttaatgcggggaaacgcccatatcgggggcaccgattataaggggacatagtcagttcccaaagcctccgataatattggttattactatgaagaggattatacaaaatgcatgggctgtgacgatacgtttgtagatgtggtcgttacctagaaggttgcctggctggccnagctcggctcgaataaggaggcttagagctgtgcctaggactccagctcatgcgccgaataataggtatagtgttccaatgtctttgtggtttgtagagaatctcgtgccgaattcggcacgagcatgtgggaattgtgggagctaaaaatcaagatgagattagttttagaactagttctatgttactatctgaattaatttttccacaattttgtaaggaaaaataatgcgttctttgaatttcatgtgtaaatgatatttttagttttgtgtcattttgtcaaataaattctgaaaatctttgtattgacagtgtgttatctctgcataaccatatatgtataagagtgctcaataaaaagaataaagaggaaacagcactggatctatacctatacaaaacaagctaccagcagagcccactgggaatggtcatgatataatcaggaatgttatattcacacgttgtagatctgcatatgagaggagggtttgcagatagcagattctagaaaagttgtctaatcagacagtaaatgaaggtgttgaagcactgaacaaaaataagctgctttaattactcataagagggaagtacaagtcattattccatctgccaatttacagactgtaagataccctttaaaagtagcagtaagtaaactcttcataaaagttagactgtatgacaaatccactgcctttcttcttttgcagcagggcctttctttttaatgactattttttgtttttggagatgaagtctgtcacccaggctggagttcagtggcctgattgatcactgcagcctcgacctccagctcacataatcctcctgcttcagcctcctgagtagctgggactacgggtgtgtgccaccatgcctggctttttaaaaaaaaaaattttgtggagttggtgtctcgctatgttgcccaagctgatgtcaaacttctggattcaagcacttctgcccaaagtgctaggattataggtgtgagccactgtgcccaagctagtgactgtttttgaaaaaaagaagcacattaccctcccttgttaatcacttatgtacaaaaatgcatgttttgctgttgatctgttttaactctttctacataaataacacatttgtacatgtatatgtgcagatatatttataatgttaaaattgtgtttaagtgatgtttactaaacaggataaaattttgtttggaaaattgcgatgtgaaattttatctagttaatctatagtcctttcccttatggtgtccagctctatgcaggctctgcctcactccagattatgtaaatatcaattcatattcaaatgaatttgaaatttagct

SEQ ID NO: 86157 - DNA, 225 bp, Homo sapiens
gtcacttctcttgtggaagttacaagctattttacttaatgctaaaccattgtagctaaatttgacaagtgaaaaatctacgcacaaggccattttacttttggagtataatttttccttgaaatgcaaactgaaacttgagtaaaccaaggtaatacctagaatcagtgctttttaaacagttgcagatttgtttcatgtgacctatctttagataatgcatgt

SEQ ID NO: 86158 - DNA, 324 bp, Homo sapiens
tttccaagaaaaacagcattgagcagcataagatgtaagtaaaaagtattaaacggggagagatgcacactggccatgtagttcgtcagcaagaaagcaggaccttaacaaagcagatcctcagctagatgaccttttcatattttaacaaaatcatctccttttacttaaatgttgttataaagaagctttatagcaccaatgggaaaccagtaccttttgccatgaattgaagacaaatggaaacccaataaaaacataaccttattaaattctagctactgttacctgccaatgcttctagacttgaagcttgttctgttt

SEQ ID NO: 86159 - DNA, 274 bp, Homo sapiens
gctttgcctaactcaaattcttttctgaactctcttggtcaagtatctttttctcacatttacgagttatacaaaactttagtttgtgctgtgtatttgtatgaagattatgtttttaatatttaaaacattgtgctttgatacagttgatgttaacagcaatttggaagccatttagaatttgaccttttattcttgaccattgggtatatcaagatgtaaggtagattccttacagagttggatcatcattattccaatgatggaattggag

SEQ ID NO: 86160 - DNA, 119 bp, Homo sapiens
gatccagaaacttttcccaagaagcttggacatggattgctggtaaacacaaaaactgcatggagggcagagcagccggttgactcccccttgtcaatatcttaaagtggaaaagcttg

SEQ ID NO: 86161 - DNA, 673 bp, Homo sapiens
agtctgaaggcaggaaaaggcccctttcccggctcaagcagtgaaggagtttccttttactcagcctttctgttccattgcgcctccaacggactggatgaggcccacccacgagagggaggaaaatctgcatcattgggtgtgccaagttcaatgttaatctcatccagaaacacagtcagtcacacccagaatcatgttggaccagatatctgggcaccccatggcccagtcaagtcgacacatacagttaaccatcaccctcagcaattgaaaaaaaagatttcatctctgtcccagacaagtagattgctctgtccccagtgctcatgtccttggatttcagggatttcggcaattccttcttgggctccagcaccctcagctcacgtttgggaagtgcctggctcagaacagtgttttctaggtgggaaagaacacctgtgtctcttgagacattagtgagcattcccccgaagaagtgctcagtcaaatcagtgctcagtcaaatcagcacccagttttcagctctgcctgaaaacttctcacagcatgggggctggcgccacctccgagaagcccgtctgggtccctgaatgcttgcaacgaacagagcctctttaacccgcacgttgtgcacatgtaccctaaaacttaaagtataattagaaaa

SEQ ID NO: 86162 - DNA, 340 bp, Homo sapiens
gcacctgaattgaccccagcaagattgagattgatctggtttctttcagcctgttaaatgccaacccagtcatctgtaacagtacttagtgtttttgtaatttttctgtacaaattttctgtgtttgttctgtaaaacttacctatcacttgaaaatattttccttgatttagagatgaaaataaccacaaccacttattttattgcttgttttaaaaaattgttttgacagtcaatgtccatgctataatcacagggtttttgtgtgtgtgtgtataatcttaatgaaaagagtttacattttactaggaaaagatgatgaaacttaacatttgaaata

SEQ ID NO: 86163 - DNA, 161 bp, Homo sapiens
aagaaaaaaacataaataatattagaaatggaaaagttataaatcaactacagcaaggatttaaaactattatgaaacaaaccaagtagaaagtagatctgccaaacaaaaaaggaaagaaactgtttctttcataaataaatgacaatgggggaaaaaga

SEQ ID NO: 86164 - DNA, 276 bp, Homo sapiens
ctcctgccactaccaaataaaaaaaaaaaagaaacctcatctccatgacctgaaaggccctacaggcctccatctcctgtttgtgcccgacttgagccacattcatctgctagttcttcctcaaacctgccacgttctttgccgcctcggtgaattgttggcactgctccctctgcccgctgtcctctgcccccagatcaccaggagaccaactcctactcaaaatccaggtcctgtctcaagtttctaacttccagagaggccttccctgaccag

SEQ ID NO: 86165 - DNA, 275 bp, Homo sapiens
ggcaccaccctgagctggtcaccatgtttttattactttagtcattgacatcttgtcagcagtatcaccacctttgccccggggcctgtcagtatggcaattgttacctttttgattgacacttttgaaaatttgtcaacatgttatttattattttagggggatctctgtctaacttaaagtcatttcttgaagttaatttactgttttattctttgaacagactctttggtttgtatgcagtagaggctataatagtctacatgctattatat

SEQ ID NO: 86166 - DNA, 878 bp, Homo sapiens
ctgagaggcagagggcatgttgtgtctcccctcctcccaaacagatgctcggatctgattttaaaatagcatctgtgtgagtatgtgagatgtggctggtcacaatgaagtgggttcacctccttacaaacctttagtcataactgaggttttggacatcagcaggtaaaagtaaggaacagttgggagcttaagtaagaaataatgtgatgaattgtttttccagcaaggttgccatggagggggctgcactaaggaaagaggttatgggtcagcaactttacttttcattccctgctctatccccaggcccagggcactgcctgatgcatggtagcacttataaatgttcaatgaatggatgaaaattaatctgcctgaaaaactgtaggtattatgtaaaaaacaaatatgaggatattgtgacaaaagaaccagtgacatttattgattgatggatctgtgatataaaggtgagagaggaattctcctttctctttagcttggcctgtttcctttaggcgtctttactaacaaaacgacgttaaattgtgattttctcatcctatatccagggatttaatacactattggatctggataaggagtaattgctcttttctggagtaatctggatcttttgctctgtctctctaacttttctgaaattaaatccttcaaggaatgaccagtagccaattgttccattgaaaatttgagttcacctgtcttcctgctgtatttggttaatataattaatgtctagaaaaagctccacccccctgccccagtcagcttctaaactggagtgtaagctccatgacggcaggaattttctcttcactctatccctaggccttaaagtaagacagtgccca

SEQ ID NO: 86167 - DNA, 918 bp, Homo sapiens
cagggcaggcacccaacctccacaagccccctcctcactcggtgcagtggcagagggggagctggggctcagggcttaccatttacacagccaacgactataggagtccgagttgcagctctactgggtgtggagtcggtggttttccagaaagtgtagacctgccttttggtggttgtcgacatatctagggatggtgacacacagctgctttctcagccgggccccccacattgaactggagtccccaggagtgccagcccctggcagcttctgcttcagtgcctgaccctggccgtggggtcccaggggatgtattgaggcgggtagacacagatggagagaagctgggcctggggatggctttatacctgggcctggggagggggcttcactcccaagctgcaaaagagcctttgcccatctccttagggtcctctgggggtcctgatatgattcttttccaaacatacataagtcattttgtttttctgccagaacgtgtaagggctttgcctccttcagggatctgcccgccccaccggctgcccggatgtggcctcctctggctccagagccggtgccagccgttggcgttcattctcctgtctgggcagatggcagccttgcttcagccctgccccccagggaaagagcgacctccctagccgttggcacacctgagcctgggctgagggcatcacagtcacgcccagggaggtaggcagttctctgtccacacactgggtgtggcagtgaagactctggaggagttcgtgcgcctgctagaggtgaggcaggtgggaggggaggaggccaggctggcacccaggtcatgccccagccgccgcgtcctggaacgcagagtccaatttgcttttcaaatgtcagcctctgtttctttggctgtccctgtgt

SEQ ID NO: 86168 - DNA, 289 bp, Homo sapiens
tccatggtctggcggccaaaaatggaagggtcccagtgaggtgggtggcctgggggaaatgggcctgcgactttggaataagccttctggttgcccctgaaaccccaggcaggtgccacgagaaggcacggagggccgggctgtgtttgtgtacacatcagtgtgtgcgagggagggcggcgcggcagcacagcctgccagcaagcccattttggtcaccatctgccatggagagcccgcgcacctgtcagaagcagctgctgacggcagatcgtaggtgagggaggga

SEQ ID NO: 86169 - DNA, 1200 bp, Homo sapiens
  misc_feature (109)..(109): n is a, c, g, or t
  misc_feature (112)..(112): n is a, c, g, or t
  misc_feature (133)..(133): n is a, c, g, or t
  misc_feature (142)..(142): n is a, c, g, or t
gagaacagtcaataatgtgcatcaaatatattctgagttctagagaaattaatgaccaagcattagaactagaagcaaaaaaaaaaaaaaaaaaaaaaaaaaaaaaaanggncgggggtgggggaaaattttngttttccgngcccttttagatcacggaagattgggtggggggggccccggcccaaatttcattcgttgaacctccccctgattgttttgttgggaagggaccctgtgggtggcaaggttaatcggacactcaagggggggggcaaggtcttttcccaataggtgatccctcggtggaaaagtggaataagctcttcaacgaagaatcgaggagggttaaacaaaagaaggctattccccgtgaataagcatcctctcatccaattttgggccgtgccaaccaatccattgttaaaatgttgaatttgccccctcctcttgctttcacccaaccaagtggtatgtggagaaggggtcttcccctccagccctgttggtggacaactgtggtaaatgtccgcagcattaaaaaacacgtcttttcgttggtggaagaaaagtgggctcacagcccactgcggagatatgtcttttaaatcacaaccgggcaccaacaatggtggaggctctaatagcaactgggggggttttgcaaaacatgtttagccgctcctggaaatttagcaaaaaagaccagaggttgactcctggaagaaacagaagccccttttgacccctaaaggggggaacaaaaattttacgcgtacaccttctagtgcagattataacgccgttgagtaccctgtaggttggtaactggctgtgaaaacccttgacagaaccaataagaggttcaaccatgtattgtagtcccctatctggagaacccaacaaaggtgttgtttcaaccagggagctattttttcccaaagtggagtggacaatccttttgccaaacagtggttatgcagagacgaatataaccgctaaagaatttttgatcgtttgcccacaaataaaagaggtcatgagcgaagtgtctttcaagtagaaatactcaaccccatcgagacttatgaataggactgggcaatgtaagagaaagtgtaacacacacggaggatgtttgatcaaaatttcgaacttaattgtgttaagaggtaagggcttacctatgttactagagtg

SEQ ID NO: 86170 - DNA, 281 bp, Homo sapiens
atctatattccctgaagacattggagccaggcctccagtttcatccttgtcactaattccagcttttccaggtgacctgagtcttgggatcagagctcattctccttttcaaactgatatgacacagtatatgactaagagaggcatggtatatatgcttatgagtggattttctatatttttataagggtgcatattacctgaaagtattgatttacactttgaagcagagccacatgtcatcagatttggcatacatcaaatagttggaaaataagcaa

SEQ ID NO: 86171 - DNA, 654 bp, Homo sapiens
ttactttagcttatcctgactgttgcattttccatccaaataacagcagcatcataaacatttatataatttgtataacagtttgcttaggcttcttatgtacctatttaccctttcccaaaatccaaatttactcagtttcatcttcttgacaacagaatcccaacttcattccagctgcaatatgcccaaccccagcatgtgtccaactacagttcaattattctaagccaatcacagcaactcagttctcccttgaaagtcattggcctaggggttagcatatgagtcagttctgaacaatgagccttaaggagaatctgcctaagatttcaggagtatctttcttttctgataagagcagcatgcaaagtcagaaagccttttttgtcctcttcccatcactttcagctttaaaagccataatagaagaatgtggtgctcgagctctgaccatgaagataaacaccagtgtgccctgaaagcaatggagtcaaggatagaaagagctggatccttgacataactgaaccatccactcacccacaggactgcctacctggacttcacagtgaactgttaatgtctttatggtttaagccatatgtctgatttttctgtttcttgctgccaaaatcatcctaactgacaaaa

SEQ ID NO: 86172 - DNA, 467 bp, Homo sapiens
agtcactgctgcagtctgtgtgctggctggtgctgcagtctcagctccaggcttgactggggaaggatccactttcagactcactcaatggttgttggcaggacctagctcttcatgcgtctttggactggggggtctcacttcctgtctggctgttggcaggaagccccctcagtgttctgccacacaaagctggcctctccatcaggtggctcacaacagggcagcatgtttcatcaggcagagcacacaagaggagcccaggagggtgagcacgatctctgagtagctgctgtccctttatcacctagttgagggaatggtaatccacctgcttgcaagattcagcccagaggagcaaatcactggctccagcccacactcaaggacttggatgctaggaggtggagactgtttctaaacataggaagggattcccacagcaagtaacacacaaacattatgca

SEQ ID NO: 86173 - DNA, 635 bp, Homo sapiens
gtgaggacggggaggacgcgccgtcggccgggcagcggtggagaccggtacccatacaggtggggacggctagaggagcggaatctccatgagtttgagcagctcggttttcccaccacctccaaatcatggaagacacagggtgcaggcagagcccccggggccatggccagcccttccggcagctccgaagcccctggcaagccccgaggcagggatggccggcccaggagggaggaggacgacgtccctcccgaagagaagaggctgcggctcttgctggaggggggaagcgcacagccccaggactgcgaggacgggcaggacgcgccgcggtcggccaggaaggagaccggcacccagacaggtggcgacggcagaggatttctatgggaatactctctttgaagaacccatgaagcagtgtcaggctggtacgaggatcagcagtgatttctttgaggaggagatccgtttcttcactcacaggtcatgtctgagtggatcaagaagaacagagggcccttttatgagattttgtctgcgtagaccattagcttggtaaaaatgtcaaaaccatcctcattctttaatagcagattattttggacttttctctgccagaagcagcatgg

SEQ ID NO: 86174 - DNA, 403 bp, Homo sapiens
  misc_feature (398)..(400): n is a, c, g, or t
  misc_feature (402)..(403): n is a, c, g, or t
catttagtttaagcattttgagatgactatggttttataatgtgatgtgtgaaattaaatcaggaacatgcacatttgtgttttcataagaaggaaaaaaattgacacttttactatactcatacctaatttagggtataaaatgtggttcctgaaaatggaagttctatacaaatctgtgccatacgaggttattattgcatagtagctatggagatccatcatatttgaccaatcacttttctgttttacataaatcccctcatggagtgccctcagctagagttccctctagccacctttcatgggaattgttggttcatcctctgaggctgcagtagtaactttgatgttttctttttttttttttgagacagagtctcactctgtctcaaaannnann

SEQ ID NO: 86175 - DNA, 881 bp, Homo sapiens
ttagaatctaggtttaagcaaattgaaactaacacagcgatgaatcatatcagacggcaaattatggaagaacttgcaacttgcacctatataatatatactgttttatatactgttttattttaccagttagtttctatataaaagataagtaaattataaggcattttcaaggtaactggtacatagggtcaatggatctgcaagcaatgacttaactgtggttccatgtcacagtgatggacttctcagcatggttaaatctggaaagctttctatgactccatccttcccaccaccccaaattgcggcgacacaaagggtgaaatgtatctattaataaaaacaaaatactctaaacattgtataaaagaggggaaaaggagaagccgacttaatggtctaatgaggctatcttccagagacttcttgtgtgtgaggctcactttgacctttcgctttgctcaggagcccagcgcctcatttttcacattcttgcaattacgttaacgcttcaagcatttctgactccaagtcagctagcaacaccaggcataactcaacactgtgagtttttctcctctctgtagattcattaacaggtcaccaaggtcccaactgaaatttaaaactgactggttctgttgggttagttgagttatggcaagggagatagcaagaaagggccagagagaagaggaggtgggagaaagaagaacccaggttttggagtggggattacttgtaataacgagcaaagcataaagttttagcgtttcggttagttagttttgttttttaggaaagagaagaattctgagactgatatataggtaaaaacaatcacacaaacttctgtgctgtgggtagatgcacccact

SEQ ID NO: 86176 - DNA, 747 bp, Homo sapiens
gacgtttttaatctgtaaaaaatgaaaaaatattatatatgtgtttggattttatgaacatctggtacatggccatgtactttttaaaatagccaataattatattttaatattactggattgcaacatggatttggaatgtggaacctttaaattctcagaataactctcagaaaacaaataaatttgatgttaaaatacattatcaagcaaatgtaattaaaacagtattacctagatatatgaaaagcaaacacatagagattccataagtagactcaaatacacacgaaactttaatacataataaatgcggcattgcatattagtgggaatgaaaaagatttaataaatatgtggggaaaactggaaactgatctagaaaaaatagtgtttaaccaagataaacttcatatggatcaaatatttaaatataaaaataaaataataacaattacagcaggaggatgggaattattttagttataaattatttttgaagtatgaccccaaatccagaaaccatagaataaaatattaatatagtaggctacattaaaattttttaaaataattctgcatagcaaaaataccacaaagtaaaaaaaaatttttaatagcctaaatacttgcaattcatattattgataaaggattaattgccttcataattaaaaagctcctaaaataaaacagaaaaatactaacaaccaataggaaaagagcaaagaaggaagaatagcaaaa

SEQ ID NO: 86177 - DNA, 438 bp, Homo sapiens
ctagaggatcccggaaggttaagggctacccaatgaatataacaaacataatgtggaacaaagtcagacccaaaagagtgtatacagaattccaaactaaatagggtaggaatagctcatgtcagaacagcccttcttcaggtagcaattataactcttaacaaaatattacaaaaccaactacctggagacactggagaagaatgaaaatcaggcagaaactgaaggagagtctatacttggaggaggagaatggccttgagtacatttcctatttttatgactctttctctagggccagcccaagttggcaccaagtagcatgcctaaaagttggtagaaaacacgcagtcttactggcttgaagatccagaggaagagtttaggtaaaaagtgagtgaggaaatttcagaaaggagaaaaaccatacagaggtag

SEQ ID NO: 86178 - DNA, 347 bp, Homo sapiens
gttccagttcctttggcttccttaattaatgcttacgtgccaagacttttccaccccagagccccacatgcctgttcctgggcgatcttgaacggtgcgcttctgcatgagggctcacctccagtgccgtcttctccaggagaccaccgtgacccccggctcttctgcatcatacccgccgctttgcgtttcccagtcttaacgtgagaggctagcagaccccatctgccttgtcctgggacggcctggaacacagtaggtgtgaagaaatactgttaaatggatggacagcctccctttgatatttacctgcacaccgctttgccactgtccctgtcacattgcga

SEQ ID NO: 86179 - DNA, 369 bp, Homo sapiens
agttacagaggcctttgaacttcatctccacagagggcaactgcctccctgcaagggcaccttggtggtctacacaaacccacctggacaagaggacaagcgatgccagctttgaggctgctggcagtgggtgccttcagatcaagatattgcatggctaagcccaaaacattcagttctgattcctaccgacaacacagttgatttgccaggtaacttgggcacccagctcaatttctggtgatcttaaaagcgttttttcttagcataaacctcacttccagtgaaggtaatttcacagtacaaaaatggcagagaaattattttcctactgtttgaagtggtgacagataacagactcacattcct

SEQ ID NO: 86180 - DNA, 367 bp, Homo sapiens
tttagagggctccaaagttataaaataaatactggagatttggtgcttgttaaaattttgaccttttctattaaagcccattggagtgatgtacagagaaaaggctgtcttgtgttgtgatagggccatgctccatccacaggtcctgggaaggatgatgtaactgtggtctaacagcattgtctgaatttttggcctagggcaaagaggaggagggcgggtaaagaaacctgatcagaccatttgatgctaatttcacaggtgactggtcactgtgtgcctggctgttgttatttatagagctgtaagtggctggagctacacacaggaacctgaaaggatggtctgtattagagtgtggtggtag

SEQ ID NO: 86181 - DNA, 488 bp, Homo sapiens
tggagtcccggaaccaatctctctgctataatgagagacaactgtggctaacggtggaatctctgctagtggattattcaatccgcatcatctctgaacaatttttaatcctggactggcttctactctgattttcaggttattacaaaagaaaagaaaaaaagacattatgttttcccgctagagtctcaatatggtttatttgtccccaccaaaattcatgttgaaatctgatcccgaatgtgacagtgttgggaggtggcgcctagtaggtaggaagtgtttgggtcatgggggcagattcttcataaatggcttggtattgttcttgcagtagtaagttctcacagaaaataaagtagttctcacgtgcgtaggttgttataaagccaagacatccctcaggctctgccctctttaagtgtccacttccccttaccttctccactatgttgtcatgcagcataaaagccctatctggaagccag

SEQ ID NO: 86182 - DNA, 347 bp, Homo sapiens
actggattctgatgatggttgcacactgtgtgaaattactttaaaaatcaccaaactgcatagttataatggataaattttatgatatataaattataccttaataaaactattttaaaattcgaaagctctgaagatacacagatacacagagagagagagagaaaaaaacatatccactgttatttgctaatactacacttaggaagacaagacttgcaggtaaagtgtttaaaagacacaatttagaaaacaagacagtttcctaggatttcaaagatcccctattattgtggaaaagcagcatctagtcatatataccatttcttgtagtcttcctacaaagc

SEQ ID NO: 86183 - DNA, 454 bp, Homo sapiens
ctcctaagtctccgtggatacggctgggtggagcgggaggatgatcacagggtttagagacaaaaagctgagatattgagtccttgttcttttcttccttattatacaattgtcacgattataaaaaaattcctttagcctctttgaatacagggtctcgtaggtggtggccacagggaaacaggaatttaaactgaaaaagtaaactggaaatggccagctgctgatcaatgggcaaaacgttccagctaagcaggacttggaagctctagagatccctgtacaacactgtacctgtggttaataatgtattgtacacttaaaatttttaagagggtagatttcatgttaagagctctcactaaaataaaataacataacataaactgaatccatcagctgtacagcaaaagaagtcaatcggagcaaaatcttcacagcccagtttgccagg

SEQ ID NO: 86184 - DNA, 472 bp, Homo sapiens
tgaacctgggaggcagaggctgcagtgtgccaagatcacgcccactacactgcagcctgggtgacagagcaagactgtctcaaaaaaaagaaagaaaaaagagtgagtagttattggggccttgatttcagaccatgtaggagtctgccaaatctgctgccttcagaaatcaaaagatcaaggaaagagtaaaagaagattgaataaaatgaaaccaggacacattttagaccaaagagttccactggggacttactcataacccaggtatcttttcatataaaatgctaaccataggattaaagctgcaagtgtaatctgaaaggcattataggctgcttagatccacttattagcatttcctatcaattgaagcattttctctgctaaaatatcaatgaaaatgaaaaaaagccaaagccagtagagttcatatagttaggaacataagctctggaggtgaactggttca

SEQ ID NO: 86185 - DNA, 377 bp, Homo sapiens
cccaggctagagtgcaatggtgcgatctcagctcaccaaaacctctgcctcccgggttcaagcgattctcctgcctcagcttcccgagtagctgggattataggctcatgtcaccacgcctggctaattttgtatttttagtagagacagggtttctccatgttggtcaggctggtcgcgaactcccgatcttaggtgatctgcctactttggcctcccaaagtgctgggattacaggcgtgagccaccgcacctgacaaatgatgtagtttttctcccttaggttattagtaggcagaatagttttacatttgattattagttattcatatttcttttgtgacttgttggttcttaatatatctattcagccaaaa

SEQ ID NO: 86186 - DNA, 482 bp, Homo sapiens
caatttaactcaattctgacactatctacccaggtatagcatagaccccacaggttaagagctcagtcccacaagactgtccccctcttgagatgctagtcccaagttccaggttgtgacttacacttctgaccagctggctataaatcaaggattcccacatcttctaatctttgatcatttgctagaatagctcacagaacttcaagaaacacttaacatttactggtttgctataaaggatgttacaagaggtaaaagacgaacagccagatggaagaaatgcatagggaaaggtatgtgggaagggatgcagagcttctgtgctctctttaggagcatcaccttccactacctccaaatgttcagcaccctggaagctctaggaacattgcatttcagtgatttttatggaagcttcatcatataggtgtgatatttactaggtcaatctccacgacctccccacttctcagaggttg

SEQ ID NO: 86187 - DNA, 837 bp, Homo sapiens
  misc_feature (671)..(671): n is a, c, g, or t
  misc_feature (680)..(680): n is a, c, g, or t
  misc_feature (683)..(683): n is a, c, g, or t
  misc_feature (685)..(685): n is a, c, g, or t
tttggatccagttctgtaagggcagaggattcattatttccaggtaatttaagtatgttctggggagaagtgttacaagatggactggggactcggctgggatcctgatgggatctaaattattgatttcacctgactgaattgctatttgcgtcacacctcaggaccctggaaacaatacacaatttgcccattcattaatttattaattcactcaacaaacttgtacatctgccataagtctgacaccatcctagttatcagggatgtagatagtcaaaagaagatgtaaacctaacctcatgcatctgtgaatctccccatctaaaaagacacagccttgtaaagaagcttgtgtgaaagtgctaacgacagacatgccaagtgttaaggggatgcaggagaggcgtggtaaaatgggttgggaggcagctcagatgtctaaaggggtcaggcagacaatgcagataagtgaaagagggccagttgatgcagagtggggacatctggaaagcacccgccccatctaaaggaggcagcctctgagagtctggggatcagggatagaagggagatgtacttttcactgtacatccttttgtattttttaaattttgttacttaattcaaaaaaatgtaaaaataaagtgaggtaaccattaaaaaaaaanaaaaaaaanaananaaaaaaaaaaacgacgggggcacaatgtggggggggggaaaaaagaggatagaggggggagggcaaaaggggggcgagcccccatttgggagaaagggggaacaggggggcccccaaaaggggggagataaaaaggagacaggggaccgtag

SEQ ID NO: 86188 - DNA, 304 bp, Homo sapiens
tgcccagagccctggctgctgctactgccactcagcacagctgggccaggctgttgccccagagggcgtcagacgtgaactttgggaacatctttattctgttttaaagtgagcacaaattattagacactttccccaaaatccatgtgtttggggcgtcttccggccatgccacacatctgtgtttgcctggctgtttctgcaccgagttccgtccacagcccgggtttctgttgttttaagtcttgagccctgggccgggggccacttctcattggtggctggaggctcggccaagtgaggg

SEQ ID NO: 86189 - DNA, 288 bp, Homo sapiens
tctctctgtgtcgctcaggctggagtgcagtggctccatctcagcctactgcaacctctgcctcccacacttgggtgattctcccaccttagccacccaagtagctgggactacaagcacgtgccatcacgcctggctaatttttgtgttttttgtagaggaggggttttgccacattgtccaggctggtcttgaacccctgggcccaacttggcctcctaaagcgctgagattacaggcataagccaccacgtccaccccagtattcttttcttttcttccttcttt

SEQ ID NO: 86190 - DNA, 298 bp, Homo sapiens
ccccccaactagaagaatacaattaaaaaaagaggcagtacacatggttaataaacagatgaaaaaattaaaattcacttgtactataagacaggcagattaaattatttttacctatcaaattaaccagaacaaaggcatgcactttagtgaggatgaggaacatacagattcactggtgaaagtaaatgtacacacaacctttcaagttgatagtttggcagaagttgctaaaaacatttaaagctttcatactttttgataaggctttttattttagaaaacatataaataaaaa

SEQ ID NO: 86191 - DNA, 394 bp, Homo sapiens
taaatttgtatgtccctgatgactacctttttatatatttattggccatttggatatgctctttgtacagtgtctcatgtttgttgctaatttttctgctgtgttatttatctttttctcattgatttgcagttctttatacacacgtttattctggatatgagtcctttgttgtatattgtgaatatcattctctactctgtggatttcctttttactctcttcatcttttgatgtatatacagtataattttttttctctctcaaaaaacttagtactttatccatattgtatgtctggtatacagagcatcaattatgcaaagtgacctcattgttattaaatagttggaaatagatttagggatgttaattaaatgacaaaattggttgg

SEQ ID NO: 86192 - DNA, 564 bp, Homo sapiens
agcgctctagaggatcctcaaacaccgcaatcttatgtgatccacctgccttggcctcccaaaatgctaggattacaggtgtgagccactgtgcctggctgcatttgctttcatgaataaaatatactaacctaactcagaaattaacattgatttgttattatactattacctgatgtgtagaatttgtttgaaatttgccagttgttccagttacgccttttatagcaaaagaaaatctcagattatccaattcattatttccatgtcttactttggaacagttctttagtctctgtgttttatgacattgatatttttaaagagtacaaattagttacttatagagtcccctcagtttgggtttggctgatgtttcttcatgattagattcaggttatgcattttttggggggcagaaataatacagaaattatgtgttattaggcaacataagatgtgtttatttgaccacatacatgccttttgactcagcagtcccaaatctcagaatttacccagaagatgcacttcccacagtatgaaaatacacatgtacaaggt

SEQ ID NO: 86193 - DNA, 452 bp, Homo sapiens
tgctcggtggagctctctgaaactcttctggttctgagggctgcctgattcatgaatcgtttttcgctcagataaactctgctgaatttgcctaaagtttttcttttaagagtttcacatgagaagtcagatcttgaagcaaacttccagtgatcccaggagcactgagtgaccaagttaaggtacccagcatgcccagtgtactcactgctctttcgcagcaactggggtcatgggtgagatttttgaatctaagcttcatgaacttctgatttgagctgagtttgagcatttttgatctacactgggtttcaaagtcatgccaacaacaggactgggcccagtagggaggcctcaggtatttgactgggtcagacataaactcaactcagttagtaggtaggaaaggttaataaaagacatagaatcatgggtttatctggtcaaaggtt

SEQ ID NO: 86194 - DNA, 226 bp, Homo sapiens
tgtgtgtgtgtgtgtgtgtgtgtgtgtgtgtgtgtatttgtatcaagcagttaccatacaaagggagtcttactatgttgcccaggctggtctcaaactcctcacctcaagtgatcctcccaagtcagcctcccccagagtgctgggattagaggcacaagccattgtgcctggcctttttttttttttttttttttaaggcagagtctcgttctgtcacccaggc

SEQ ID NO: 86195 - DNA, 385 bp, Homo sapiens
gctttgtgacatgctggattgtatccattatgtgttcctaagaccctcagccctctccctccaccaagacccaataaaagtgtgttattgaaagtagtagctactggccgggcgtggtggctcacgcctgtaatcccagcactttgggaggccaaggtgggtggatcacaaggtcgggagttcgagttcagcctggccaatatggtgaaatcccgtctcaactaaaaatacaaaaattagtcgggcatggtggcgggcgcctgtaatcccagctacttgggaggctgaggcaggagaatcgctggaacccgggaggtggaggtggcagtgagcaaagattgcgccattgcactccagcctgggtgacagagagagactctgtctc

SEQ ID NO: 86196 - DNA, 394 bp, Homo sapiens
ccattttcttgactgggcatttaacaaactttttgttttaggaccctgtttgtgatctcagatttgaagctgaacatctgagatgttacgcagcctcatagggtttcagttaccaagactgacagatcaacagctaggttggcagtgcaaaaatccactatctgtttttgaagaaacggattttctgcctccatgtttttcatttccaggaataatacttctctcatgacaagcagacttgtaaaatgaggagaagcccttatcagaaaccagacttcctccctctccacacccagcacctctctttaaaaaatgtcccaaatcctgtctttattagaatttgaattttgtcatcttaaaggatactggtgatttcccatattatggctatacg

SEQ ID NO: 86197 - DNA, 565 bp, Homo sapiens
gatcccgcttccttcacactgggtcgccccaccagccgcctgggttccagtttagcactgccgacgacttgctgtgcctggcatgtccttgctcccaaatgtcacatctatgaagcctcaccctaaaaccctgtaagagcgattccctctttcacccacatgcccgttagcctttatttagcacaccttaaattgtattcattttgcatctcaatctagttcacagcctggtatataacaactaataaatgtgagttgactgataaagactataaaaaaaaaaaaaaaaaaaaaaaaaaaaacaaaaaaaaaaaaaaaaaaaaaaaaaaaaaaaaaaaaaaaaaaaaaaaagaaaaaaacacaaaaataaccaacaaaaaaaaaaatcatggggaatacaaaaacaaaaaacataaaaaaaacctggggccccctttcccccaatgttttttaaacttcggcaatttttaccccggggcccttattgggcgttattgggcccattgcccctatatgggggggctttacaaatcactggcccccgttttaaacaggtgcgcctggg

SEQ ID NO: 86198 - DNA, 273 bp, Homo sapiens
atttggagagaaaaatgatttataacattcttaacaatttgcacatatttctagttcttatttaatcaatgcagtggtgccatatcacctgtgtagtttctttcatgttctctttctggctttataatgcatagttacatattatatacatttgaaatggctacattttcctttattatttaaatattcagtgtatagtttggcttaatttatagtagtttactttctatacttccagggtgggtggatttgtacccagaaatccaccttaaa

SEQ ID NO: 86199 - DNA, 235 bp, Homo sapiens
agggggaatcccagagtgtgcccggcgctgacagcagcaagagacaggagctgggcagagcatccctggctaggggatctgccagagcctagctgacagcatcctctcttccctgccccctgaattcatcttcccctcctggccctgggcttccccatctctcttgctcctgcctgctgtgacagctaattgcaggatgcaattttctgcctcccatctccctatctgcatgtct

SEQ ID NO: 86200 - DNA, 410 bp, Homo sapiens
  misc_feature (313)..(313): n is a, c, g, or t
  misc_feature (404)..(404): n is a, c, g, or t
cacaacacactccagggtaaattcatttcagccacagtttctcacaccgtgcctctgcggacaacccctcagccctcaccacttcccctggctcagcttggtattgctaactgggcagcttgatgcagatgcctgagataccttcagttgtcccagacaattccatttgcccctccctttcatacctgcttctcactgactccacagtgtcccttaacacccggtgattgggactcaggcacaggtgcagggctgaaggacactcccagcctgcttgccctgtcacccgcagaagtcaaggcacgtcctgccntcagggcaccttctccagccaccctcccaggctctgtgcttcccaccagcccgtccattggtgtggaccctcgtgccttcctctgcacccnccagag

SEQ ID NO: 86201 - DNA, 506 bp, Homo sapiens
ccaaggaaggggcaatgggcacactgatttatagctggtgggtcagaagtataggtgacaacctactacttgcaattggtatgggagggcaggagggagtcttgtgggactgagcccgtaacctgtgggagctgacactatttgcctagagatggttccagaattgatggtgtctgctggagaattgcttgacgtgtggggaaaacccccccatacatctggtgtcagaagtgttgtgttgagtgttgtgggaggaaaaaaggaagctgtttcttccttcagaccaggtgaccaaggcctgacttggggccagaggcagtgaggttggagggtgagggaccagcagtggaggtatttgagacatggagttgacactgacgttgtcagcagaaccatggaggttgggtcagaagttacctgaggcttgcctgggcacggttggctcatgcttgtaatcccaacattttgggaggttgaggtgagaggattgcttgaggccagaagtt

SEQ ID NO: 86202 - DNA, 428 bp, Homo sapiens
aaaaacactagtggaaatagattatatgagtcttgcatttagaagtgccatctgttcaactttgcaccctcgcagtcagagtgttaatatctcccgtgcagagataccatttgtcagcattttccgctgtgtggagttaccaaacagttcactttttaatcctttggcctaagtcagctaaaattctctgagcgcacatgtcttgagctttgtgtgtctttactatcaccttcttgtttaagaaaatttcctttcaaaactctattaggagaagggacagaatttggagctaactctgcctatggcagcccaaggcatttgggggaaagggggagaactcagaggagtagattcccctggagaatagctagtatctatctttctgattaacttctgcaagacttaaatgagttttaaaggccctcata

SEQ ID NO: 86203 - DNA, 321 bp, Homo sapiens
acacatatatacatacatatatgtatacatgtataaacacatacctattttatagccttttacagttaaaaaacaatttatatttagcctttgtgtaaatgttttaatattattcccatattttggaagaagaaagtgaagctcagaagagttaagtgacttagacaagattactattctagtaaacaaaataggactgtaatagatggtttaagtgtattttaaattttacctcttggtcaggattcttggcattaagctctgttgactggtatataggaatagaagctttcttgtataatttattcttctcttgttata

SEQ ID NO: 86204 - DNA, 569 bp, Homo sapiens
ctggggtcctgggtgctgttgccgtgacttcagcttctcctgagacaggttgaagcccagtctcttaatgcaggtcatattcttgtgtgtagcctgtgggcctcctatgtcggaatcaccgaggcatcttgttgaaatgcagatttctgagctcccttcagtccctgaagtggataagtcagtccctggtgacttatccaaccagaatttccaggatcagggacctggaatctgttgttaggcacactgaagtttgagaaccactgaatcagtgatttcagtatttcctaaaatgcttttgtgccatcatatgaaatatcagttttccaactggtcctagtgagttttgttttagatgtttgttttacagtggaaagggaaatgatagtctgtggcggttatttgttgcccactgatatcgccccaggacctacaaatggagcctccttgttaggaggcaactggagatagtgatcttactgtcttcttccagttacttcagaccatatgctgtcctccacatttagttgatctccagttctgcctgggtgtttgctgtttgctaccct

SEQ ID NO: 86205 - DNA, 715 bp, Homo sapiens
cagagagataatcctgggggtgcacagagggtcccccaacagtatccaacataatattgaccagcacaagtctatgaggagactgcctgaggccagccgaaaaaccacctgaaaatccttgcaggaggagtgtgcagtgctgacccagggcaggggatgaagcctgttctcgtcagccaggtgctaaaccttatattcacagtgccttcagcagagcactcagaaggcctcaacttaatagcagagaataattagtaataggctgaatattactcagctactgcctagcaaatgtaaaaagctagaccatatcatactatttccaagtaacttaactgcttccaagaggaaagctcaaaaatatttctagaaatgcaaacatatccagcacccagaaggtaaaatttacaatgtctgggattacattaaaattttccaggcatgaaaagaagcagaaaaataaaatccacagtgaggagaaaaatcaatcaatctaaccattgcagaactgacaccactgttagaattataaggacaatacaaataattattataattgtattttatatattcaaagagttaagtgaagacaggagatattttaaaaaattaaatcaaattctaacaaatgaaagctctaatatctgagatgaaaatgcactgtacatgattaatgacatattagaccttgcagaaagaaatacgagtgaatttg

SEQ ID NO: 86206 - DNA, 338 bp, Homo sapiens
tctttaacaaccacttgtagtcttccgtaatataacatgtttaagtataagcacatcagtttatttctccagacattgtaaattgtgaagcttatgttgatttttttcccattagcatactccactggcatttatgtttttcttagactttttttcctccatttctcttttggttttgctaaatttttctacctgaaaaactcttaaaattctgaaaattttatattactggaagatataacagcagcataaattgaattttctaaattatcaagaaacatgaggtatacaatatacataggatagtaccatacctagcactggtgaggtatggaaat

SEQ ID NO: 86207 - DNA, 416 bp, Homo sapiens
atctctcttgcccgctgccacaagcactgttgtaaacacactgaaaaacaaaagagttatgtccccgagtaacagcttatctgccagccattactcttaagcaccatttactggatcacagctcaatttaaaacatctgcctatatatttgagactgtacctcactctgttacccaggctagagcgcagagaagcaatcgtagctcactgcagcctcaagctcctaggctcaagccattctcccacctcagccttctgagtagctgggactacaggcacacaccactacacttggctaatatgtgttattttctgtaaagacagggttttccatgttgcccaggctgatctcaaacttctggcctcaagtgatcctcccaccttagcctggcaaagtgctggaattacaggcttga

SEQ ID NO: 86208 - DNA, 854 bp, Homo sapiens
ggtggggggtgcctcttaaagatttcttattcgaaattgaagtctgagaatgacaaaagtgtgcccccacaagtgagctagagggaataaaaacctgggaacccgggactcaggtgaatgggggcccacgagctcaaaatataccacctgatggaggctggtgcaggtgggatactcacactgcctaggcaaccacccactccagatctttgctcaggctctttcctctgctggggacaccccctcctctgcctggcttattctgacttttccttgtgtctcagcttctacacaacactcccggacaccttcctcaaacatgctgcattgcttcaaatcctttcctgaccagttacgctccgcacatgaattgcctggcaacccataaccagatcatagactctttcaaggaggaatctgtgccttgtcccggtgctcagcccacccagtgcctggtagaccgtaggtgctcttaaatctttgtggaatcaatacatggattcagagtcatagataaactcttttcttccctggacagagctgactcccttagcaccaattttagggagcccataaaaaatgtacagtcgtgtgatgaggctaaatggaaagagaatatagcttggcaagcaaggaaacctcattagaataattaaagggactattaacccaaaccaacctagacgtaacttaaaatgtgttatgaactactgtggaacatttatttgatggctcaaacattaagttagtaacctcaatatggttctacacctcaatttaaagcgttctcatttatgtgcatgtgtgtttcaaatccctaattggaattctgaaaggaatgcttcagaaatgac

SEQ ID NO: 86209 - DNA, 367 bp, Homo sapiens
catgcctaaaaacatctctggatggatacacagtgaaacagtggtacctatttatgtgtaggtagcaaagaactgggcagatggtagacagggatgggatgaagactttttgttatatctcttttaatatttagtttttaaaccatgtgaatatattgcctgttcaggatatcaaaaatagcaagtttactagagtttaaacaatagctgttatatctgacacacacttgaaaccttgctaaattcacatttatttttctttttatggtgtattagtgcaagcctgtctttgtattgtaaaatctaatgatacggtatttatattatttttgtttggcattttttgcattaaatgaattattttgca

SEQ ID NO: 86210 - DNA, 423 bp, Homo sapiens
tagaggaacccccgctacctggcattttcagataattaaggagaaaatttgttgtattcatagctgctttacaaggaaaggaaaaaaacggtcttcagactcaagggaaataatagcaacaaatctaaaactaaatttctatggaaatataaaagactactttgtgttataattttattaaattattagacatattttttcataatattttactaaacagcattgccttctaaggattatgaagtatatagatttcatacctgcaacaaatatagaactaagaattgaggaatgataagtaggctgctatagttataaggtttctacagtttacacaaaattgtacggtataaactttaattaggccatgaaaagtaaaatatgtatgttataatgctaataggaaccactaaaaggaaataa

SEQ ID NO: 86211 - DNA, 857 bp, Homo sapiens
ttttttttgagacagggtcacactctgccacccaggctcaagtacagtggcgcgatctcggttcaccacagcttcctgggctcaagcaatcttcccatctcaccctcctaagtaactgggactacaggcatgcaccaccacacccagctaatattttgtattttttgtagacatgggtttcaccatgttgcctaggctggtcttgaactcttgagctcaagtgatctgcccaccttggcctcccaaagtgctgagattactggcatgagccactgggcctgcccttaaaaattatttaattatgcatttgatttatcagctatagggatatttagacttactatctgttcttgtgtccattttggtgacatatctttcaaagaatttgtccatttgatctaaaatgttaaagttattggcataaatataccctttattatccttttaatgtctataaaatatacagtgatgtccctctttttttctctataggtttaattactaagggttgttaatattattaaagtttaccaaaaatttatcttctagctttgggcgctccattgtttcttttccacttcactgagttctgcttttatttatttcctttcttgtacttactttaggtttaataacttgcctttttctagcatctgaatgtaaaagcagagatcactgattttatctttcctatattctcatctacttctttaaaacaaaagtttcccgctgaagactactttagttaaatcccacaaattgtgatatgtggtgttttaattattattcaaaataaaatatttcctgatttttcttgtaacttcttttttgagcaatggtaatgatgtggtgtaagt

SEQ ID NO: 86212 - DNA, 392 bp, Homo sapiens
cattagttaatatatgaattttatagatgaaatgggcatgtatttataggtatatgaataaaaaggttttattgtaattaaatattcttagttttaaaatttatttactaaattatgataccaaaagtataggcaacagaagaaaaatagataaactagactttatcaaagttaatgactgttgtatatcaaaagactcatcaacagattgaaaagacaacatggaatgggagaaaatatttccgaatcatatatctcataagggattaatatctagaatatatacaataaagaactcttacaactcaacaacaaccaaaaaaacttgattaaaaaatgggctaaggacttgaatagacatttctacaaagaagaaaatacataaacggcaa

SEQ ID NO: 86213 - DNA, 539 bp, Homo sapiens
agataaatattatgaaggaccctgtctcattgtgccatcagtatatcatggctgagactatctcagataagataatgtattagtcgtctgcttcctaggaaaatgaacactaaaatgaaatatggaagaaatggattctgagtgttaaatgtgagaaacaaggtttatactgaacattctaagccattgccaaatgtcaactttaaacttcagatcaagagattcagaattctacagtgtcaggtatggtagatgttctcacaccaaggtgaacacaagaatcaaccgagtgatttatttaaaagagagtcctgagtgccacccccagaaattcagatttttaaatttttaaataaatctgagtgtgtcttttaaacttacattttgtaccagcaactccaagttattctaatataggtaatccacagataaaaaatatttgttagaacgtattttttaaaaatattgtttagaccataaatattttagccttttcttttttttaacaaaatataaatttatactttttagacagcaaa

SEQ ID NO: 86214 - DNA, 285 bp, Homo sapiens
cttttaatctacccaacatttcattattttttccctgagtagctttattttccccctaaaagttcacacaaatcaaattaacatattgaatcataaaccatgaaactttctataagttatctgctcacctaactgcctcaatctatactgcacaccatcctaaaccgtgttttcctctccttcctaaaaaaagatggagacttatacttccatttttgtcccgatttactgcagggattttaactaactagtcagacttggttggttctgtttctgagaaatttg

SEQ ID NO: 86215 - DNA, 361 bp, Homo sapiens
gccatttaaaggtagatttctatcatgtaaaaataatctatctgaaaaacaaatgtaaagaacacacattaattactataattcatctttcaattttttcatggaatggaagttaattaagaagagtgtattggataactactttaatattggccaaaaagctagatatggcatcaggtagactagtggaaagttacaaaaattaataaaaaattgactaacattttaagttgtgcatcttttctccttcctgtccacctattgttctttttttcacttttccatttcaatttcttccttatgtattcttgatctacttttctttatatccttctatcctttccttgcgctctcagtattt

SEQ ID NO: 86216 - DNA, 2674 bp, Homo sapiens
ccgcgacttcggcttcgcgagtagcattggttccttgggtttatttcgttttcctctctcttctccaccttagtcgcccctttcgcgctgcgctgtagcgtgctctcacagcctttttgccttgaactgaatgcaggtgggaaacaggtcggcgtgccgaaagacaccgagtaggtagaaataaggcaaactcacagaggcgcaacaggtccggtcctccgtggccagggcgagccgcggccccgcgtggcgcctcggccgttgccctcggaccctgagcggccactgttggggccctcgaaagaggtgtcggtcctctgggagtcggaagagctgtctgggtgggtttcgtcttgctttttaccccaccgccacccagtccccggacggagggtgcttttcacttccagctgggaggagagaagaaagcggggatggtgcacgcctgcgggtctggacgctgagcaaggcaggggattatttgaggtgtagagggtgggaagcgaagccgagacggccgaccccgccacgatgctgctgaagaagcacgcagggaaaggagggggccgggagcccagatccgaggacccgacccctgccgaacagcattgttcccggaccatgcccccgtgtgccgtcctggcggccctcctgtcagtggtggccgtggtgtcttgcctgtacctgggtgtgaaaaccaacgacctccaggcgaggatcgccgctctcgaatccgccaaaggggccccctccattcatctgctgcctgataccctggatcacctcaagactatggtgcaagagaaagtggagcgacttctggctcagaaatcctatgaacatatggctaaaataagaatcgcaagagaagcaccttcagaatgtaactgcccagcaggccctccagggaaacgaggtaagagaggccgaagaggagaatctggtcctcctggacagcctggtcctcagggccctcctggtccaaaaggcgataagggagaacaaggtgatcagggacctaggatggtgtttcctaaaatcaatcatgggtttctctctgctgatcagcagctcattaaacgccgcctgattaagggtgaccaaggacaggcagggcctccaggaccccctggccctccaggcccaagagggccacctggggacacagggaaagatggcccccgtggaatgccaggagtacccggtgaaccaggaaagccaggagaacaaggcttgatgggtcctctagggcctccgggacaaaagggttctattggagcacctggaattccagggatgaatgggcaaaagggtgagcccgggttgcctggagcagtaggacagaatggaataccaggacctaagggagaacctggagaacaaggtgaaaagagggagacgctggagagaacggccccaagggtgacacaggcgaaaagggtgaccctggatcatctgctgcaggaattaagggagaacctggggaatctggtcgtccagggcaaaagggtgaaccagggcttcctgggcttcctggacttccggggataaagggagaaccaggtttcattggtcctcaaggagaaccaggcttaccaggtttaccaggaacaaaaggtgaacggggggaagcagggcctcctggaagaggtgagcgaggggaacctggagcccccggaccaaaggggaaacaaggtgaatcaggaactagaggcccaaaggggtcaaagggggatcgtggagaaaaaggggactctggagctcagggaccaaggggtccacctggtcaaaaaggggatcaaggagccactaagatcatagactacaacggcaacctccacgaagccttacagaggattaccaccttaactgtcacgggtccccctggacctcctggacctcaaggactacaagggccaaagggagagcagggatctccaggaatcccaggaatggatggagagcagggactcaaaggctcaaagggagacatgggggacccaggtatgacaggtgaaaaaggaggaattggacttcctggattaccgggagccaatggaatgaaaggagaaaaaggagattctggaatgccgggtccacagggtccttctatcataggcccaccaggcccaccaggtccccatggcccacctggccccatgggacctcatggacttcctggaccaaagggtacagatggtcctatgggaccccatggccctgcaggtcccaaaggagaaagaggtgaaaaaggagctatgggagagcctggaccaagagggccctatgggctgcctgggaaagatggagagcctggtcttgatggcttccctggtccacggggtgagaagggtgatctaggagaaaagggagaaaaggtgacctctccatcccagcatgtaccttgtttgattcttctcctgctgtctgctttgctgttcagcttgtgtgattccatttgacacttaatctttctccatcctgtgctccaaaaacatactgatgcctgatttaaggaatcaggtcttcagagaggaatgaagaaggctgtactgccagatataagggcactgcctggcatagaagaaaaaattattatcaccagatattctagctacagtttttcaaccacctgacaccaatttatggaaaaataaaggatttttgaaaaaaa

SEQ ID NO: 86217 - DNA, 863 bp, Homo sapiens
  misc_feature (482)..(482): n is a, c, g, or t
  misc_feature (796)..(797): n is a, c, g, or t
  misc_feature (803)..(803): n is a, c, g, or t
  misc_feature (807)..(807): n is a, c, g, or t
  misc_feature (810)..(810): n is a, c, g, or t
  misc_feature (814)..(814): n is a, c, g, or t
  misc_feature (829)..(829): n is a, c, g, or t
  misc_feature (834)..(834): n is a, c, g, or t
agatggtagtacgaggcggtgtatgtatctacacgaaggcctcaggtaaacgaggtagagaggcgaagaggagaatctggtcctcctggccctcctggtccaaaaggcgataagggagaacaaggtgatcagggacctaggggcctgccaggcttccccacagttgctgccctgcacagtaatcagatcctcaccgtcaagggtgaccaaggacaggcagggcctccaggaccccctggccctccaggcccaagagggccacctggggacacagggaaagatggcccccgtggaatgccaggagtacccggtgaaccaggaaagccaggagaacaaggcttgatgggtcctctagggcctccgggacaaaagggttctattggagcacctggaattccagggatgaatgggcaaaagggtgagcccgggttgcctggagcagtaggacagaatggaataccaggacctaagggagaacctgnagaacaaggtgaaaagggagacgctggagagaacggccccaagggtgacacaggcgaaaagggtgaccctggatcatctgctgcaggaattaagggagaacctggggaatctggtcgtccagggcaaaagggagaaccaggtttcattggtcctcaaggagaaccaggcttaccaggtttaccaggaacaaaaggtgaacggggggaagcagggcctcctggaagaggtgagcgaggggaacctggagcccccggaccaaaggggatcgtgacgaacaagggactctggagctcagggacaaagggtcacctgnncaaacngggncangagncctggatcttaatanacgcnacttcccaaaactccaagatacccttttg

SEQ ID NO: 86218 - DNA, 695 bp, Homo sapiens
ggtttggttgtcaggtcagctgaacacttagctgatagctagcattagctgctggccaggtgcataagccatcttagatgtccagcccaggttcatagaatgggatgcccactgatgacaatgccaggccctccagggaaacgaggtaagagaggccgaagaggagaatctggtcctcctggacagcctggtcctcagggccctcctggtccaaaaggcgataagggagaacaaggtgatcagggacctaggggcctgccaggcttccccacagttgctgccctgcacagtaatcagatcctcaccgtcaagggtgaccaaggacaggcagggcctccaggaccccctggccctccaggcccaagagggccacctggggacacagggaaagatggcccccgtggaatgccaggagtacccggtgaaccaggaaagccaggagaacaaggcttgatgggtcctctagggcctccgggacaaaagggttctattggagcacctggaattccagggatgaatgggcaaaagggtgagcccgggttgcctggagcagtaggacagaatggaataccaggacctaagggagaacctggagaacaaggtgaaaagggagacgctggagagaacggcccaagggtgacacaggcgaaaaagggtgacctggatcatctgctgcaggaattaagggagaaccg

SEQ ID NO: 86219 - DNA, 560 bp, Homo sapiens
tacatttctaagaattttgagggcttggactattcctgctgctctacagttgaggtaatgccaccatcaatgaaacttcagataaatttcctattgcattgaaaaaagagagagagctgggtttgccctgcccctgaccttcagcgctgccaacctgttccagctggctgctgtccacttcagcactgagtgttaaaatgcctatacctacagatgaacttttccttagaggcttccctggtccacggggtgagaagggtgatctaggagaaaagggagaaaaggggccagatggcttacccatgcctggctgttggcaaaagtgatgaatctaacctttcaagcatgaagttgtgtatataagggtccatttttaatatttatagttgaaaactgaattgcagattttacaagtctgagatatgtttacatagggctgcttcttcctgttggcagtagtatacatgtccatttttactccacttacatctgaaattgggcaatttgtgaaaccagtgagaatcctgcaaaaaatatagatcagtatctccttaaaaaaa

SEQ ID NO: 86220 - DNA, 223 bp, Homo sapiens
ggcctagggagggagataggcaagtaaaggtacaattattaatagagtaagtgcatagaaggtccctctaagtcttaagagccaagggtggctttgaggctgcttcttcctgttggcagtagtatacatgtccatttttactccacttacatctgaaattgggcaatttgtgaaaccagtgagaatcctgcaaaaaatatagatcagtatctccttaaaaaaa

SEQ ID NO: 86221 - DNA, 2765 bp, Homo sapiens
  misc_feature (1469)..(1469): n is a, c, g, or t
ccgcgacttcggcttcgcgagtagcattggttccttgggtttatttcgttttcctctctcttctccaccttagtcgcccctttcgcgctgcgctgtagcgtgctctcacagcctttttgccttgaactgaatgcaggtgggaaacaggtcggcgtgccgaaagacaccgagtaggtagaaataaggcaaactcacagaggcgcaacaggtccggtcctccgtggccagggcgagccgcggccccgcgtggcgcctcggccgttgccctcggaccctgagcggccactgttggggccctcgaaagaggtgtcggtcctctgggagtcggaagagctgtctgggtgggtttcgtcttgctttttaccccaccgccacccagtccccggacggagggtgcttttcacttccagctgggaggagagaagaaagcggggatggtgcacgcctgcgggtctggacgctgagcaaggcaggggtccgtatccgctcgtgggcttgactccaccaactagttgtgcagccacagggactgaactttggaggaatcgacctttttctttccttttaggattatttgaggtgtagagggtgggaagcgaagccgagacggccgaccccgccacgatgctgctgaagaagcacgcagggaaaggagggggccgggagcccagatccgaggacccgacccctgccgaacagcattgttcccggaccatgcccccgtgtgccgtcctggcggccctcctgtcagtggtggccgtggtgtcttgcctgtacctgggtgtgaaaaccaacgacctccaggcgaggatcgccgctctcgaatccgccaaaggggccccctccattcatctgctgcctgataccctggatcacctcaagactatggtgcaagagaaagtggagcgacttctggctcagaaatcctatgaacatatggctaaaataagaatcgcaagagaagcaccttcagaatgtaactgcccagcaggccctccagggaaacgaggtaagagaggccgaagaggagaatctggtcctcctggacagcctggtcctcagggccctcctggtccaaaaggcgataagggagaacaaggtgatcagggacctaggatggtgtttcctaaaatcaatcatgggtttctctctgctgatcagcagctcattaaacgccgcctgattaagggtgaccaaggacaggcagggcctccaggaccccctggccctccaggcccaagagggccacctggggacacagggaaagatggcccccgtggaatgccaggagtacccggtgaaccaggaaagccaggagaacaaggcttgatgggtcctctagggcctccgggacaaaagggttctattggagcacctggaattccagggatgaatgggcaaaagggtgagcccgggttgcctggagcagtaggacagaatggaataccaggacctaagggagaacctgnagaacaaggtgaaaagggagacgctggagagaacggccccaagggtgacacaggcgaaaagggtgaccctggatcatctgctgcaggaattaagggagaacctggggaatctggtcgtccagggcaaaagggtgaaccagggcttcctgggcttcctggacttccggggataaagggagaaccaggtttcattggtcctcaaggagaaccaggcttaccaggtttaccaggaacaaaaggtgaacggggggaagcagggcctcctggaagaggtgagcgaggggaacctggagcccccggaccaaaggggaaacaaggtgaatcaggaactagaggcccaaaggggtcaaagggggatcgtggagaaaaaggggactctggagctcagggaccaaggggtccacctggtcaaaaaggggatcaaggagccactaagatcatagactacaacggcaacctccacgaagccttacagaggattaccaccttaactgtcacgggtccccctggacctcctggacctcaaggactacaagggccaaagggagagcagggatctccaggaatcccaggaatggatggagagcagggactcaaaggctcaaagggagacatgggggacccaggtatgacaggtgaaaaaggaggaattggacttcctggattaccgggagccaatggaatgaaaggagaaaaaggagattctggaatgccgggtccacagggtccttctatcataggcccaccaggcccaccaggtccccatggcccacctggccccatgggacctcatggacttcctggaccaaagggtacagatggtcctatgggaccccatggccctgcaggtcccaaaggagaaagaggtgaaaaaggagctatgggagagcctggaccaagagggccctatgggctgcctgggaaagatggagagcctggtcttgatggcttccctggtccacggggtgagaagggtgatctaggagaaaagggagaaaaggtgacctctccatcccagcatgtaccttgtttgattcttctcctgctgtctgctttgctgttcagcttgtgtgattccatttgacacttaatctttctccatcctgtgctccaaaaacatactgatgcctgatttaaggaatcaggtcttcagagaggaatgaagaaggctgtactgccagatataagggcactgcctggcatagaagaaaaaattattatcaccagatattctagctacagtttttcaaccacctgacaccaatttatggaaaaataaaggatttttgaaaaaaa

SEQ ID NO: 86222 - DNA, 2730 bp, Homo sapiens
  misc_feature (1376)..(1376): n is a, c, g, or t
ccgcgacttcggcttcgcgagtagcattggttccttgggtttatttcgttttcctctctcttctccaccttagtcgcccctttcgcgctgcgctgtagcgtgctctcacagcctttttgccttgaactgaatgcaggtgggaaacaggtcggcgtgccgaaagacaccgagtaggtagaaataaggcaaactcacagaggcgcaacaggtccggtcctccgtggccagggcgagccgcggccccgcgtggcgcctcggccgttgccctcggaccctgagcggccactgttggggccctcgaaagaggtgtcggtcctctgggagtcggaagagctgtctgggtgggtttcgtcttgctttttaccccaccgccacccagtccccggacggagggtgcttttcacttccagctgggaggagagaagaaagcggggatggtgcacgcctgcgggtctggacgctgagcaaggcaggggattatttgaggtgtagagggtgggaagcgaagccgagacggccgaccccgccacgatgctgctgaagaagcacgcagggaaaggagggggccgggagcccagatccgaggacccgacccctgccgaacagcattgttcccggaccatgcccccgtgtgccgtcctggcggccctcctgtcagtggtggccgtggtgtcttgcctgtacctgggtgtgaaaaccaacgacctccaggcgaggatcgccgctctcgaatccgccaaaggggccccctccattcatctgctgcctgataccctggatcacctcaagactatggtgcaagagaaagtggagcgacttctggctcagaaatcctatgaacatatggctaaaataagaatcgcaagagaagcaccttcagaatgtaactgcccagcaggccctccagggaaacgaggtaagagaggccgaagaggagaatctggtcctcctggacagcctggtcctcagggccctcctggtccaaaaggcgataagggagaacaaggtgatcagggacctaggatggtgtttcctaaaatcaatcatgggtttctctctgctgatcagcagctcattaaacgccgcctgattaagggtgaccaaggacaggcagggcctccaggaccccctggccctccaggcccaagagggccacctggggacacagggaaagatggcccccgtggaatgccaggagtacccggtgaaccaggaaagccaggagaacaaggcttgatgggtcctctagggcctccgggacaaaagggttctattggagcacctggaattccagggatgaatgggcaaaagggtgagcccgggttgcctggagcagtaggacagaatggaataccaggacctaagggagaacctgnagaacaaggtgaaaagggagacgctggagagaacggccccaagggtgacacaggcgaaaagggtgaccctggatcatctgctgcaggaattaagggagaacctggggaatctggtcgtccagggcaaaagggtgaaccagggcttcctgggcttcctggacttccggggataaagggagaaccaggtttcattggtcctcaaggagaaccaggcttaccaggtttaccaggaacaaaaggtgaacggggggaagcagggcctcctggaagaggtgagcgaggggaacctggagcccccggaccaaaggggaaacaaggtgaatcaggaactagaggcccaaaggggtcaaagggggatcgtggagaaaaaggggactctggagctcagggaccaaggggtccacctggtcaaaaaggggatcaaggagccactaagatcatagactacaacggcaacctccacgaagccttacagaggattaccaccttaactgtcacgggtccccctggacctcctggacctcaaggactacaagggccaaagggagagcagggatctccaggaatcccaggaatggatggagagcagggactcaaaggctcaaagggagacatgggggacccaggtatgacaggtgaaaaaggaggaattggacttcctggattaccgggagccaatggaatgaaaggagaaaaaggagattctggaatgccgggtccacagggtccttctatcataggcccaccaggcccaccaggtccccatggcccacctggccccatgggacctcatggacttcctggaccaaagggtacagatggtcctatgggaccccatggccctgcaggtcccaaaggagaaagaggtgaaaaaggagctatgggagagcctggaccaagagggccctatgggctgcctgggaaagatggagagcctggtcttgatggcttccctggtccacggggtgagaagggtgatctaggagaaaagggagaaaagggattccgtggcgttaagggggaaaaaggggagccaggccagcctggcctggatgggctggatgccccttgccaattggggccagatggcttacccatgcctggctgttggcaaaagtgatgaatctaacctttcaagcatgaagttgtgtatataagggtccatttttaatatttatagttgaaaactgaattgcagattttacaagtctgagatatgtttacatagggctgcttcttcctgttggcagtagtatacatgtccatttttactccacttacatctgaaattgggcaatttgtgaaaccagtgagaatcctgcaaaaaatatagatcagtatctccttaaaaaaa

SEQ ID NO: 86223 - DNA, 925 bp, Homo sapiens
ccgcgacttcggcttcgcgagtagcattggttccttgggtttatttcgttttcctctctcttctccaccttagtcgcccctttcgcgctgcgctgtagcgtgctctcacagcctttttgccttgaactgaatgcaggtgggaaacaggtcggcgtgccgaaagacaccgagtaggtagaaataaggcaaactcacagaggcgcaacaggtccggtcctccgtggccagggcgagccgcggccccgcgtggcgcctcggccgttgccctcggaccctgagcggccactgttggggccctcgaaagaggtgtcggtcctctgggagtcggaagagctgtctgggattatttgaggtgtagagggtgggaagcgaagccgagacggccgaccccgccacgatgctgctgaagaagcacgcagggaaaggagggggccgggagcccagatccgaggacccgacccctgccgaacagcattgttcccggaccatgcccccgtgtgccgtcctggcggccctcctgtcagtggtggccgtggtgtcttgcctgtacctgggtgtgaaaaccaacgacctccaggcgaggatcgccgctctcgaatccgccaaaggggccccctccattcatctgctgcctgataccctggatcacctcaagactatggtgcaagagaaagtggagcgacttctggctcagaaatcctatgaacatatggctaaaataagaatcgcaagagaagcaccttcagaatgtaactgcccagcaggccctccagggaaacgaggtaagagaggccgaagaggagaatctggtcctcctggacagcctggtcctcagggccctcctggtccaaaaggcgataagggagaacaaggtgatcagggacctagggggtctctagggcctccgggacgaaagggtctattg

SEQ ID NO: 86224 - DNA, 1645 bp, Homo sapiens
ccgcgacttcggcttcgcgagtagcattggttccttgggtttatttcgttttcctctctcttctccaccttagtcgcccctttcgcgctgcgctgtagcgtgctctcacagcctttttgccttgaactgaatgcaggtgggaaacaggtcggcgtgccgaaagacaccgagtaggtagaaataaggcaaactcacagaggcgcaacaggtccggtcctccgtggccagggcgagccgcggccccgcgtggcgcctcggccgttgccctcggaccctgagcggccactgttggggccctcgaaagaggtgtcggtcctctgggagtcggaagagctgtctgggtgggtttcgtcttgctttttaccccaccgccacccagtccccggacggagggtgcttttcacttccagctgggaggagagaagaaagcggggatggtgcacgcctgcgggtctggacgctgagcaaggcaggggtccgtatccgctcgtgggcttgactccaccaactagttgtgcagccacagggactgaactttggaggaatcgacctttttctttccttttaggattatttgaggtgtagagggtgggaagcgaagccgagacggccgaccccgccacgatgctgctgaagaagcacgcagggaaaggagggggccgggagcccagatccgaggacccgacccctgccgaacagcattgttcccggaccatgcccccgtgtgccgtcctggcggccctcctgtcagtggtggccgtggtgtcttgcctgtacctgggtgtgaaaaccaacgacctccaggcgaggatcgccgctctcgaatccgccaaaggggccccctccattcatctgctgcctgataccctggatcacctcaagactatggtgcaagagaaagtggagcgacttctggctcagaaatcctatgaacatatggctaaaataagaatcgcaagagaagcaccttcagaatgtaactgcccagcaggccctccagggaaacgaggtaagagaggccgaagaggagaatctggtcctcctggacagcctggtcctcagggccctcctggtccaaaaggcgataagggagaacaaggtgatcagggacctaggaattaatacacgtattgtatgtcctgagttgtaaacagaatgtcaattgagggaaattacagtgtggttttcgtaacagtgtctatagttatctccattttgtactaacattttgtaattaagatgttgtaattttgtaagtaagattccagaaatgcttcgtgtagcaaactctttacaccgtgtagacacagatcccattgtacctgccccaggctcagtgacaatgagctctcagtttccctattccatgctttaagaaattattggtttgactgggcatggtggttcacgcctgtaatcccagcactttgggaggccgaggcagtcagatcccttgaggtcaggagtttgagaccagcctggccaacatagtgaaacccagtctctactacaaatacaaaaattagctgggcgtggtggtgcacacctgtaatcccagctactgggcaggctgagacagagaatcacttgaaccctggaggcagaggcttcagtgagctgagattgtaaccactgcactgcggcc

SEQ ID NO: 86225 - DNA, 355 bp, Homo sapiens
attaactggctctgactctgtgttgttcattatgggacagtgaggtatgatgtaatggaagggcatcaggctagaaaactacatggtcttaaggtcattggataatctcttggggcattgttttccttggtgtgtgatgaagctaatataatgaggtacttgtccagcctacctcacagggatgttgtgaggataaaatgagataatagatatgaaactggcttggaaaaaaaagaaaagcattatacacatgcaaggttaccacctttttattttcactgttgcctcatgggcaacttatgttcatggactctaaaaattttagagtccttgcatattagaaatgtaaaaatgg

SEQ ID NO: 86226 - DNA, 264 bp, Homo sapiens
aagatcacaccactgcactccagcctgggtgacagagcgagactccatctcaaaaaaaaaaaaatgtcctgccccttcctgaaatatggagtaggagatattcttaactacaaccacaggtagcagggctgctaagggagtataagggtggcaggagtttcaatggatgaagacagctcagtaaaggaaagacaagaagattctcggaaatccatgccatctgacaactcagataagcctgccaacctgatccctgggagagag

SEQ ID NO: 86227 - DNA, 1748 bp, Homo sapiens
aacagaggtagcctgaaagaagcaggaactccaggatcccaaaccagagcagaccctatagtaaagtatttttacatcttttcctttccccagaagagatccctaacctattgttttattgacagccttgctgttagaggctctttcccagaagttggacgaagaggctcaggcgttgctgtttcttgtcttccaagtcaagtggttactctggtaatggattgcctctctccgagctttcaccctggtgagactgtccagatctagtctgtaaacccagcttagaagcactgttgtaaaaatgactgaagagcccatcaaggagatcctgggagccccaaaggctcacatggcagcgacgatggagaagagccccaagagtgaagttgtgatcaccacagtccctctggtcagtgagattcagttgatggctgctacagggggtaccgagctctcctgctaccgctgcatcatcccctttgctgtggttgtcttcatcgccggcatcgtggtcaccgcggtggcttacagcttcaattcccatgggtctattatctccatctttggcctggttgttctgtcatctggactttttttactagcctccagtgccttgtgctggaaagtgagacaaaggagcaagaaagccaagagacgggagagtcaaacagctctcgtggcaaatcagagaagcttgtttgcttgagactgaatacgaccaaatgggccattgggcctggaaaacgtgctctgactttgtcacccaattcacccagaaccatggtgggagagaacagacttggcgttggagcagactggaagaatgggggtgggagggtggaggggcttctcctttgtgaggaatgactcatgtcttctttaacgacaaacttaaccctaagggctacttctgagactgaaaaatcagctttctatttacatgaaacactttgggggtcatgggagtgcacagcattagacagtatttggttcaccctgtaaagtagccaagaaaagatgagaaaaatcaagataggcctggcacactagacatttgcctccaaaagaaataacctacagtcttaagatgtatcataaaaatgttctgccaaggatctaaattaccttgggtttcgcatatgtctatgaaattctgtgataatttttttcaatacattgattcactggcgtctgttttcattttatacttttaataactcatcactggtggtactttatcttgaaaagtaatattttttatattttaacattggacagtgttagccagttgtaatgatgtatcagaagtaaagaaaaacccattaaagttatagctaatagatgctgttgggggttaaattaatagtaaaataatccaatatagcacttttgatgatttttatataaaagtcaactgtacatttcattcagaataataaatacttattgctgctaaaacttcttaaatggttgtttctgctatagttatttctattgcagttccaaattgccatcttcccttgtctcatttgcaagttctcaattgtatttctctcaaatggacaggttccttctttactggaggatttttgtttttatcatattggtttttcattacttctgaatagtcttaattacgtttactaaattctaaaggatttctgtgctattataattaggaaatcaacgtctttggtcaggaactttataatgtgctattaaatgtatattacatttttgtggaatca

SEQ ID NO: 86228 - DNA, 334 bp, Homo sapiens
aacagaggtagcctgaaagaagcaggaactccaggatcccaaaccagagcagaccctatagtaaagtatttttacatcttttcctttccccagaagagatccctaacctattgttttattgacagccttgctgttagaggctctttcccagaagttggacgaagaggctcaggcgttgctgtttcttgtcttccaagtcaagtggttactctggtaatggattgcctctctccgaggtgagtgtaagtaatttggggacagatcttgattttcaggttagctcaatctcagctttggggtgaagttatttttttcagacataatctcaaatatc

SEQ ID NO: 86229 - DNA, 1464 bp, Homo sapiens
aacagaggtagcctgaaagaagcaggaactccaggatcccaaaccagagcagaccctatagtaaagtatttttacatcttttcctttccccagaagagatccctaacctattgttttattgacagccttgctgttagaggctctttcccagaagttggacgaagaggctcaggcgttgctgtttcttgtcttccaagtcaagtggttactctggtaatggattgcctctctccgagctttcaccctggtgagactgtccagatctagtctgtaaacccagcttagaagcactgttgtaaaaatgactgaagagcccatcaaggagatcctgggagccccaaaggctcacatggcagcgacgatggagaagagccccaagagtgaagttgtgatcaccacagtccctctggtcagtgagattcagttgatggctgctacagggggtaccgagctctcctgctaccgctgcatcatcccctttgctgtggttgtcttcatcgccggcatcgtggtcaccgcggtggcttacagcttcaattcccatgggtctattatctccatctttggcctggttgttctgtcatctggactttttttactagcctccagtgccttgtgctggaaagtgagacaaaggagcaagaaagccaagagacgggagagtcaaacagctctcgtggcaaatcagagaagcttgtttgcttgagactgaatacgaccaaatgggccattgggcctggaaaacgtgctctgactttgtcacccaattcacccagaaccatggtgggagagaacagacttggcgttggagcagactggaagaatgggggtgggagggtggaggggcttctcctttgtgaggaatgactcatgtcttctttaacgacaaacttaaccctaagggctacttctgagactgaaaaatcagctttctatttacatgaaacactttgggggtcatgggagtgcacagcattagacagtatttggttcaccctgtaaagtagccaagaaaagatgagaaaaatcaagataggcctggcacactagacatttgcctccaaaagaaataacctacagtcttaagatgtatcataaaaatgttctgccaaggatctaaattaccttgggtttcgcatatgtctatgaaattctgtgataatttttttcaatacattgattcactggcgtctgttttcattttatacttttaataactcatcactggtggtactttatcttgaaaagtaatattttttatattttaacattggacagtgttagccagttgtaatgatgtatcagaagtaaagaaaaacccattaaagttatagctaatagatgctgttgggggttaaattaatagtaaaataatccaatatagcacttttgatgatttttatataaaagtcaactgtacatttcattcagaataataaatacttattgctgctaaaacttctt

SEQ ID NO: 86230 - DNA, 1647 bp, Homo sapiens
agcggctaactctggctgggaaagccttgctgttagaggctctttcccagaagttggacgaagaggctcaggcgttgctgtttcttgtcttccaagtcaagtggttactctggtaatggattgcctctctccgagctttcaccctggtgagactgtccagatctagtctgtaaacccagcttagaagcactgttgtaaaaatgactgaagagcccatcaaggagatcctgggagccccaaaggctcacatggcagcgacgatggagaagagccccaagagtgaagttgtgatcaccacagtccctctggtcagtgagattcagttgatggctgctacagggggtaccgagctctcctgctaccgctgcatcatcccctttgctgtggttgtcttcatcgccggcatcgtggtcaccgcggtggcttacagcttcaattcccatgggtctattatctccatctttggcctggttgttctgtcatctggactttttttactagcctccagtgccttgtgctggaaagtgagacaaaggagcaagaaagccaagagacgggagagtcaaacagctctcgtggcaaatcagagaagcttgtttgcttgagactgaatacgaccaaatgggccattgggcctggaaaacgtgctctgactttgtcacccaattcacccagaaccatggtgggagagaacagacttggcgttggagcagactggaagaatgggggtgggagggtggaggggcttctcctttgtgaggaatgactcatgtcttctttaacgacaaacttaaccctaagggctacttctgagactgaaaaatcagctttctatttacatgaaacactttgggggtcatgggagtgcacagcattagacagtatttggttcaccctgtaaagtagccaagaaaagatgagaaaaatcaagataggcctggcacactagacatttgcctccaaaagaaataacctacagtcttaagatgtatcataaaaatgttctgccaaggatctaaattaccttgggtttcgcatatgtctatgaaattctgtgataatttttttcaatacattgattcactggcgtctgttttcattttatacttttaataactcatcactggtggtactttatcttgaaaagtaatattttttatattttaacattggacagtgttagccagttgtaatgatgtatcagaagtaaagaaaaacccattaaagttatagctaatagatgctgttgggggttaaattaatagtaaaataatccaatatagcacttttgatgatttttatataaaagtcaactgtacatttcattcagaataataaatacttattgctgctaaaacttcttaaatggttgtttctgctatagttatttctattgcagttccaaattgccatcttcccttgtctcatttgcaagttctcaattgtatttctctcaaatggacaggttccttctttactggaggatttttgtttttatcatattggtttttcattacttctgaatagtcttaattacgtttactaaattctaaaggatttctgtgctattataattaggaaatcaacgtctttggtcaggaactttataatgtgctattaaatgtatattacatttttgtggaatca

SEQ ID NO: 86231 - DNA, 1779 bp, Homo sapiens
cacttcagaccacaaatccccacctcattttcaatgaattttttgctgaactgtccacctaaagtgggtaataaaaagatcccagggagcaggttgcactgtgtttaatagtaacacaataaagatttgttggctgtcattcaatggagaagaacatcatttgttgctggccacttgccttgacattgattttgtgggcagccaatgggtgatagtttgcaaagaatgcatgttatgcccagcaagattggcggagtctgagttgctctttcaccctggtgagactgtccagatctagtctgtaaacccagcttagaagcactgttgtaaaaatgactgaagagcccatcaaggagatcctgggagccccaaaggctcacatggcagcgacgatggagaagagccccaagagtgaagttgtgatcaccacagtccctctggtcagtgagattcagttgatggctgctacagggggtaccgagctctcctgctaccgctgcatcatcccctttgctgtggttgtcttcatcgccggcatcgtggtcaccgcggtggcttacagcttcaattcccatgggtctattatctccatctttggcctggttgttctgtcatctggactttttttactagcctccagtgccttgtgctggaaagtgagacaaaggagcaagaaagccaagagacgggagagtcaaacagctctcgtggcaaatcagagaagcttgtttgcttgagactgaatacgaccaaatgggccattgggcctggaaaacgtgctctgactttgtcacccaattcacccagaaccatggtgggagagaacagacttggcgttggagcagactggaagaatgggggtgggagggtggaggggcttctcctttgtgaggaatgactcatgtcttctttaacgacaaacttaaccctaagggctacttctgagactgaaaaatcagctttctatttacatgaaacactttgggggtcatgggagtgcacagcattagacagtatttggttcaccctgtaaagtagccaagaaaagatgagaaaaatcaagataggcctggcacactagacatttgcctccaaaagaaataacctacagtcttaagatgtatcataaaaatgttctgccaaggatctaaattaccttgggtttcgcatatgtctatgaaattctgtgataatttttttcaatacattgattcactggcgtctgttttcattttatacttttaataactcatcactggtggtactttatcttgaaaagtaatattttttatattttaacattggacagtgttagccagttgtaatgatgtatcagaagtaaagaaaaacccattaaagttatagctaatagatgctgttgggggttaaattaatagtaaaataatccaatatagcacttttgatgatttttatataaaagtcaactgtacatttcattcagaataataaatacttattgctgctaaaacttcttaaatggttgtttctgctatagttatttctattgcagttccaaattgccatcttcccttgtctcatttgcaagttctcaattgtatttctctcaaatggacaggttccttctttactggaggatttttgtttttatcatattggtttttcattacttctgaatagtcttaattacgtttactaaattctaaaggatttctgtgctattataattaggaaatcaacgtctttggtcaggaactttataatgtgctattaaatgtatattacatttttgtggaatca

SEQ ID NO: 86232 - DNA, 1224 bp, Homo sapiens
gagtctaactctggctgggaaagccttgctgttagaggctctttcccagaagttggacgaagaggctcacatggcagcgacgatggagaagagccccaagagtgaagttgtgatcaccacagtccctctggtcagtgagattcagttgatggctgctacagggggtaccgagctctcctgctaccgctgcatcatcccctttgctgtggttgtcttcatcgccggcatcgtggtcaccgcggtggcttacagcttcaattcccatgggtctattatctccatctttggcctggttgttctgtcatctggactttttttactagcctccagtgccttgtgctggaaagtgagacaaaggagcaagaaagccaagagacgggagagtcaaacagctctcgtggcaaatcagagaagcttgtttgcttgagactgaatacgaccaaatgggccattgggcctggaaaacgtgctctgactttgtcacccaattcacccagaaccatggtgggagagaacagacttggcgttggagcagactggaagaaataacctacagtcttaagatgtatcataaaaatgttctgccaaggatctaaattaccttgggtttcgcatatgtctatgaaattctgtgataatttttttcaatacattgattcactggcgtctgttttcattttatacttttaataactcatcactggtggtactttatcttgaaaagtaatattttttatattttaacattggacagtgttagccagttgtaatgatgtatcagaagtaaagaaaaacccattaaagttatagctaatagatgctgttgggggttaaattaatagtaaaataatccaatatagcacttttgatgatttttatataaaagtcaactgtacatttcattcagaataataaatacttattgctgctaaaacttcttaaatggttgtttctgctatagttatttctattgcagttccaaattgccatcttcccttgtctcatttgcaagttctcaattgtatttctctcaaatggacaggttccttctttactggaggatttttgtttttatcatattggtttttcattacttctgaatagtcttaattacgtttactaaattctaaaggatttctgtgctattataattaggaaatcaacgtctttggtcaggaactttataatgtgctattaaatgtatattacatttttgtggaatca

SEQ ID NO: 86233 - DNA, 1588 bp, Homo sapiens
agagagagagagagagagagagagagagagagagagagagagagagagagagagagagagagagagagagagagagagagagagagagagagagtgtccagatctagtctgtaaacccagcttagaagcactgttgtaaaaatgactgaagagcccatcaaggagatcctgggagccccaaaggctcacatggcagcgacgatggagaagagccccaagagtgaagttgtgatcaccacagtccctctggtcagtgagattcagttgatggctgctacagggggtaccgagctctcctgctaccgctgcatcatcccctttgctgtggttgtcttcatcgccggcatcgtggtcaccgcggtggcttacagcttcaattcccatgggtctattatctccatctttggcctggttgttctgtcatctggactttttttactagcctccagtgccttgtgctggaaagtgagacaaaggagcaagaaagccaagagacgggagagtcaaacagctctcgtggcaaatcagagaagcttgtttgcttgagactgaatacgaccaaatgggccattgggcctggaaaacgtgctctgactttgtcacccaattcacccagaaccatggtgggagagaacagacttggcgttggagcagactggaagaatgggggtgggagggtggaggggcttctcctttgtgaggaatgactcatgtcttctttaacgacaaacttaaccctaagggctacttctgagactgaaaaatcagctttctatttacatgaaacactttgggggtcatgggagtgcacagcattagacagtatttggttcaccctgtaaagtagccaagaaaagatgagaaaaatcaagataggcctggcacactagacatttgcctccaaaagaaataacctacagtcttaagatgtatcataaaaatgttctgccaaggatctaaattaccttgggtttcgcatatgtctatgaaattctgtgataatttttttcaatacattgattcactggcgtctgttttcattttatacttttaataactcatcactggtggtactttatcttgaaaagtaatattttttatattttaacattggacagtgttagccagttgtaatgatgtatcagaagtaaagaaaaacccattaaagttatagctaatagatgctgttgggggttaaattaatagtaaaataatccaatatagcacttttgatgatttttatataaaagtcaactgtacatttcattcagaataataaatacttattgctgctaaaacttcttaaatggttgtttctgctatagttatttctattgcagttccaaattgccatcttcccttgtctcatttgcaagttctcaattgtatttctctcaaatggacaggttccttctttactggaggatttttgtttttatcatattggtttttcattacttctgaatagtcttaattacgtttactaaattctaaaggatttctgtgctattataattaggaaatcaacgtctttggtcaggaactttataatgtgctattaaatgtatattacatttttgtggaatca

SEQ ID NO: 86234 - DNA, 446 bp, Homo sapiens
tttggctgacaaaggattgattctcagtggagccctgagatacaagtgctcatagttcacttagtttgaggaatggccctaaatgagtttcttagaaataggtggttttaaaaacttgtggattgtaattaaaatgtaattatgataatgattatgagcataagcagaattctcaggagataggaacaggtgaattagctggtaatgggacatttgaccccacagagctgtgcacagactgttcgaagttcagtgaatattaggtgaattgctttaaagtgatacccttgtgacctgttggagttaataatttttcaagtacctaatctactagtaggaaacaacttattccaatacatagtagtaaaaatacagactgtgaaagccagaagagattttaacaatcagtgatctggcctctccttcaataaatttaaagagtgatc

SEQ ID NO: 86235 - DNA, 322 bp, Homo sapiens
ctaaccccaggcacacacgtgagcacctcacatctgggctctaaggataaaaccaccagcaccttgtacagggctcttcctggtgatgccaaatacttagaagaaacctggtctagagaagactcgagttcaagttccagctctgacgattgttaacagggagaccttgggcaaaggtgctggtcacggaggcagctgtacaaccaggctcagtggtatccaccctccaagcaaggggaactgaggaaaaatgcctgagaaacgtgcagcgtctgttcaatctctgaaccacgttaatacaaccatcttcagggatgcagga

SEQ ID NO: 86236 - DNA, 352 bp, Homo sapiens
actcagtgtcttgaaatcagcacaacaaaatggtgcctgaggagcagtgtttactttgatcattcttcaacttctgtgccccagcctttcacagagcacaaattgctttaccagagttacggtgctgaagcccacgactgtttttgtagtctggttgctgtggtgatccttagccttccatgaaactcccatctctagggaaatagaaacctttgcagctgtctcggcctttttggttttgtatctggtggaggtcttcaccgagcttgttcaagcctgagagtgatcggtttgtgtcagagtaaaatacacacatggaaacagggcatccccttcaggatgtgttgtatta

SEQ ID NO: 86237 - DNA, 474 bp, Homo sapiens
tgtattagtctgttttcatgctgctgataaagacatacctgagactgggcaatttacaaaagaaagaggtttattggacttacagtttcacatgactgaggaagcctcataatcatggtggaaggcaaacagcacgtctcacatggtggtggcaagagggagaacgaaagccaagcgaaacagtttccccttatcaaaccatcaggtcttgtgagacttattcacaaccacaagaacagtatgggtgaaactgcccccatgattcaattatctcccactgtgtccctcccacaaaacggaattatgggagtacaattcaagatgacatatgggtggggacacagagccaaaccatatcagttggtttaacaacagacaatgtagttgaccaccttaagagaatatggaaaaagccatatgctcatttcagtaggtattggagaggaatttgacaaaatttaatattcacttatt

SEQ ID NO: 86238 - DNA, 574 bp, Homo sapiens
ggaatattaggataagtttttgtaggtcagaagaatttcaagtagtttttagacaaaacatatccatgagtgtgaaaaaagctgtgttgacgaatagattacatttcacatttaccagcaagtcagtaaaaaatagtgcttatttacatagtcaatataatttaatgttctaaaaataatatcttcgatctgcccaatatttaatgtatcatttgagatttttaaaaatgcatccgctccattatgtaaacattaagatatgcctatgtttctttaactatacagcctctttacaataaatttcttgatttttgtgcacaggatagtattgcaacctgctatttagcctttggtgccttagaattattataaatatttaacaatatgtacataatgtaaatactgccaagagatcagtaaggccaaatattttctctattcactttttattgctcttgctttctattgctactaaagcctcttttatccagctttgtaatagttccaacattgtagcgaatgtaaatgtttactttcaataaatctgaacttgttcaacaagtacggtatatgt

SEQ ID NO: 86239 - DNA, 741 bp, Homo sapiens
tgctttgtttgggccacttgttatttaaggtttataataatcgcactaaacacaatgaaaaacaaaggagaacattgagagatcactttaactttttataatcagtttatgtgtattttatggtagtaaatgataaaatagctagtatctacatatagtttatacatttgtggcatacctttctcttaatttttaaggtatttttaggctacttggctcatctgagtttttcaaagtgttgcgagtctccaaaaacttctcagtgtgtttactgaaaatttatgtgtcagtgggcctgagtggttgaaaacggtgttattcaaaggccgcctgtatttctaattcgtccctctttgtgattactgctggctaaattcagacctacattattagattattggatttatttcctaacatcctttctgcctacaagtttacttccctaattcctcctgctcagttttctgaaggatgtcatatatagctactcctctgcttattgcttattgacctcatctcctgtcacccccactacacccagaccctaaactctgcttttctcagaaaagatgtgcttttcctaactccgtcccacatcttcagtctggaatgttctgtgctcttcagtgtagccttcagcgctcacctacttaaaagtcctttctgctgaagcctgtcttcttctaggagacttagtggacatctgttggggctctcctggctcttattttcttcttagtt

SEQ ID NO: 86240 - DNA, 1278 bp, Homo sapiens
gtccgacggtccacccagtgcttgcggcctcgcggccgggccggcctgggctgcaatcaatgcggctttgtctgggacgcccacatcccagaggccattcccgggtcggcaaatcggagcgcggccggggcgcgcgggggtgagataagcggccatgtgatcccacctgggctggaaggggaggggcgccaggtgaggcggcggccggtggggcgcgggcggccacgcggggctcctgcagcatggctgtcagcaggaaggactggtccgcgctgtccagccttgcccggcagaggactctggaggatgaggaggaacaggagcgcgagcgcaggcggcggcaccgcaacctgagctccaccacggacgatgaggctcccaggctcagccagaatggagaccggcaggcctctgcttctgagagactaccgagcgtggaagaagcagaggtgcccaagccactgcccccagcctccaaagatgaggacgaggacatccagagcatcctcagaacacggcaggagcggaggcagaggcggcaggtggtggaggctgcacaggcccccatccaggagaggctggaggcagaggaggggaggaacagcttgagccctgtgcaggccacacagaaacccctagtctccaagaaggaactggaaatcccacctcgccggagactgagtcgggaacagcggggcccctgggccctggaggaggagagcttggtgggcagggagccagaagagaggaagaaaggggttccagaaaagtccccagtcttggagaagtcctccatgccaaagaagacggccaggagctaagtgcctttttgtgtgcaaccacttaccctttctctgaaaaacctgttctcaggaaggatctgataaactcatttactctcaggtgtaagagactgatgagaccttagaagcgaattcctctctggaggccttgctttctagcagagtcacctgaagtgtgtgaggaggatcatcattttcctcatcccccctcttctcacattaaggtggtggcttgccactcagcagtcctagcttggtgactgggaactgccacatacagggccaggcctaccctccttccccacaagccccctccaacccccacccccatgctctggacctcatggctcctatgagcttggagcatggtgaaccatcagagaatctagaaccaaccaagctaggaacatcagcctggtgcctgttaaccccttaaagctgtggtttacaacttttcaaaaatttaaatcattag

SEQ ID NO: 86241 - DNA, 2842 bp, Homo sapiens
  misc_feature (1906)..(1906): n is a, c, g, or t
  misc_feature (1910)..(1910): n is a, c, g, or t
gtccgacggtccacccagtgcttgcggcctcgcggccgggccggcctgggctgcaatcaatgcggctttgtctgggacgcccacatcccagaggccattcccgggtcggcaaatcggagcgcggccggggcgcgcgggggtgagataagcggccatgtgatcccacctgggctggaaggggaggggcgccaggtgaggcggcggccggtggggcgcgggcggccacgcggggctcctgcagcatggctgtcagcaggaaggactggtccgcgctgtccagccttgcccggcagaggactctggaggatgaggaggaacaggagcgcgagcgcaggcggcggcaccgcaacctgagctccaccacggacgatgaggctcccaggctcagccagaatggagaccggcaggcctctgcttctgagagactaccgagcgtggaagaagcagaggtgcccaagccactgcccccagcctccaaagatgaggacgaggacatccagagcatcctcagaacacggcaggagcggaggcagaggcggcaggtggtggaggctgcacaggcccccatccaggagaggctggaggcagaggaggggaggaacagcttgagccctgtgcaggccacacagaaacccctagtctccaagaaggaactggaaatcccacctcgccggagactgagtcgggaacagcggggcccctgggccctggaggaggagagcttggtgggcagggagccagaagagaggaagaaaggggttccagaaaagtccccagtcttggagaagtcctccatgccaaagaagacggcacctgaaaagagcctggtctccgataaaacctccatctctgagaaggtgctggcctcagagaagacatctctatcagagaagatagcagtgtcagagaaaagaaacagctcagagaagaagtctgttctagaaaaaaccagtgtctctgagaagtcgctggccccagggatggcactgggctcaggaaggaggctggtgtctgagaaagcttccatctttgagaaggcactggcctcagagaagagcccaactgcagatgctaagccggccccaaagagggccacagcctcagagcagcccctggcgcaggagccgccagcctctgggggaagcccagccaccaccaaggagcagagaggaagggccctccctgggaagaacctgccctctttggcaaagcagggggcttcagaccctccgactgtggcctcccgcctcccacccgtcacactccaggtgaaaatccccagcaaggaggaagaggcagatatgtcctcacccacacagcgaacctacagcagctccctcaaacgctccagccccaggaccatctcctttcggatgaaacccaagaaagaaaactcggaaacaaccctaactcgcagtgccagcatgaagctcccagacaacacagtgaagttgggagagaagctggagagataccacacggccatacggagatcagaatctgtcaagtctcggggtctgccttgcactgagttattcgtggctcctgtgggtgtagccagcaagcgccacctctttgagaaggaactggcgggccagagccgagcagaaccagcctccagccggaaggagaacttgaggctctcaggggttgtgacatcaaggctcaacctgtggatcagcaggacccaggaatctggagatcaggacccccaggaggcacagaaagcatcatctgcaaccgagaggactcagtggggacagaaatctgactcctcgctggacgctgaggtgtgacaagccccgccaagacagacctgcaagtcttcgtctcaagggacctccctcatgccaggcccctgcctctcacagcagcaccctttcctctcattgtccctgttcccttnttgnctgtggatctgtttggccagggtccctggggtcaggaatatttgcaagactcagccagctccttcccagcccagcctcttggggctgggactttctcaccctgcggcaggcacaacagatgctgggacccagtctctgcccaggtcacagcacaagtgcacatcagcactatggggcctatgtcctgcccagagacctctgctccttcctgctcacatccacagtcagggcacggcgcccctcaagaactccagagtcacctgtctcatcggctcccagcaagtgcctctttgtctatgatgtcccccttctctgaggcctggacccacccatctttgtccctggggcctgctcccagccactgaggcccgctctggccaggggagaaggagctgccgtgcgtcttccctgtgccccgtctccctgcttggttctcccctcccttccctggccggctgccatggccaggagctaagtgcctttttgtgtgcaaccacttaccctttctctgaaaaacctgttctcaggaaggatctgataaactcatttactctcaggtgtaagagactgatgagaccttagaagcgaattcctctctggaggccttgctttctagcagagtcacctgaagtgtgtgaggaggatcatcattttcctcatcccccctcttctcacattaaggtggtggcttgccactcagcagtcctagcttggtgactgggaactgccacatacagggccaggcctaccctccttccccacaagccccctccaacccccacccccatgctctggacctcatggctcctatgagcttggagcatggtgaaccatcagagaatctagaaccaaccaagctaggaacatcagcctggtgcctgttaaccccttaaagctgtggtttacaacttttcaaaaatttaaatcattag

SEQ ID NO: 86242 - DNA, 1139 bp, Homo sapiens
gtccgacggtccacccagtgcttgcggcctcgcggccgggccggcctgggctgcaatcaatgcggctttgtctgggacgaagcccaatttccgggggccatttccgggtttggaaattcgaacgtctgcccggggggctcaccttgcccggcagaggactctggaggatgaggaggaacaggagcgcgagcgcaggcggcggcaccgcaacctgagctccaccacggacgatgaggctcccaggctcagccagaatggagaccggcaggcctctgcttctgagagactaccgagcgtggaagaagcagaggtgcccaagccactgcccccagcctccaaagatgaggacgaggacatccagagcatcctcagaacacggcaggagcggaggcagaggcggcaggtggtggaggctgcacaggcccccatccaggagaggctggaggcagaggaggggaggaacagcttgagccctgtgcaggccacacagaaacccctagtctccaagaaggaactggaaatcccacctcgccggagactgagtcgggaacagcggggcccctgggccctggaggaggagagcttggtgggcagggagccagaagagaggaagaaaggggttccagaaaagtccccagtcttggagaagtcctccatgccaaagaagacggccaggagctaagtgcctttttgtgtgcaaccacttaccctttctctgaaaaacctgttctcaggaaggatctgataaactcatttactctcaggtgtaagagactgatgagaccttagaagcgaattcctctctggaggccttgctttctagcagagtcacctgaagtgtgtgaggaggatcatcattttcctcatcccccctcttctcacattaaggtggtggcttgccactcagcagtcctagcttggtgactgggaactgccacatacagggccaggcctaccctccttccccacaagccccctccaacccccacccccatgctctggacctcatggctcctatgagcttggagcatggtgaaccatcagagaatctagaaccaaccaagctaggaacatcagcctggtgcctgttaaccccttaaagctgtggtttacaacttttcaaaaatttaaatcattag

SEQ ID NO: 86243 - DNA, 296 bp, Homo sapiens
atgggtcagccgttggtgttcttggttcccagagatcagaatctgtcaagtctcggggtctgccttgcactgagttattcgtggctcctgtgggtgtagccagcaagcgccacctctttgagaaggaactggcgggccagagccgagcagaaccagcctccagccggaaggtgaggggctcaggccccacagggtccttagggtgattagccctgacgtctccaaaacccaaatcttggctgtggcaatgctagaaaactgttttcatgtgtcaattaatgttggcagaacctcca

SEQ ID NO: 86244 - DNA, 437 bp, Homo sapiens
ataatcatttaaagcaaccattaataactatgtacctattattgccattttgtttattgttttctgtttggcagttgttttctctttgatttgatgatgttttgtaatgattgtttttgggtatttttgtgtatatatcaattataggggttttggtagttatttcaaggcttgcataaaatatcttgtctattttaagttgataacaatttacctttgatcacacacaaaaaccatacttttaatcctcccacacattttgtgttcttgtaattagtttgcttctttgtacattgtgtgtctcttactaaatgtttatcttttaacttttatgttagggttaacagtaatttacatactacagtgttgcattattctgtatttgtctacatatttatctttaccaatgagatttatgctttcatttgttttcatgt

SEQ ID NO: 86245 - DNA, 163 bp, Homo sapiens
aaaaaaaaaagaatatatagacgggtcagaactgcattcacactttggttctatagaatatcaagctgttttttgatactttatttagtgatacagtggtattcccaggaggatttgtcagcacttttctgggaatgcttggaaatgactaattagcattaga

SEQ ID NO: 86246 - DNA, 814 bp, Homo sapiens
gcctcactcaggagctgctcggcagccgtgggacacagggtctcttggttttgcatccagttccagcgctcggtagcgctaagagggtctcgttcaaaaatgcagctggattttgatttggcgattcagattttcaggcctgtgtctccaggatttcaggggtgtgtttcctggagctgcaaaccaaatgaccacacacgaagtggcttaaagcagcagaggttcattctcacagctctggaggccagaagtccgaactcaaggtgtggccggggctggttccttccggaggctctgagggagcctcggtcccaggcccctcccggcgcccgctggtggccgggctcccgggtgctgccagcctcgtggacacacggctccaatctctgctctctcctgcccatctgcatgttttccttttcctgtcaggaaagcagctagtggacttagggcccccctggctcatcctggatgcattcgtcccaggacccttgacctgtttatctaccaagacctttttccaaatgaggtcacgttcacaggctctgagggctgggacctggccgcatcttcccgcggtcacctttcagctcccgacaggaagcgtggccccagaaccctgggggtttcagagcccgtgcccatgggtggttctggaattctgaggccgatcctttggctggtgtcccggaattccctggtccggcccctcgtccatgcaggcaccctaggggctccccggcaggaccccagaacgccaatatcctactccacgggtccaggcgggctcccgggagctgatgccgaggtctct

SEQ ID NO: 86247 - DNA, 249 bp, Homo sapiens
attatggttttgatttgtatttctcccatggctaataatattcaggacctctttatgtgcttattggccatttgtatatcttttttaaagaaatatctattcagatcctttgcttatttttgaattgggctatttgtctttttattcttgagttgtaattgttctttatatattctagatacaagcaacttattatgtttatagtttgcaaacaattttttcccattctttgggttgtcttttcactgt

SEQ ID NO: 86248 - DNA, 361 bp, Homo sapiens
taaagataagttaccttgcatttgagcaaagcttggccaaaagattctcagcatggcaaactgtgattctgatctctaattcttagggaagtgcgactgaattttcatattttttccaaacaagcctttaacaatttcacttcctgaagctaaccctattgttatagaatcacttagactttcagaattcagtaggaaaaaattaatttttagttttcctatttgcaatttttgtagctaaagaacaggggcaatccgagaaaattcaaaactttaaaaaatgtaatttcaattcaaatatctttgtatgtagggcataagtgaatgaaagcatcgactttggggttagagagtcatatct

SEQ ID NO: 86249 - DNA, 353 bp, Homo sapiens
tattttttgtgagtaaaccatggtattattgctttcaattcatttatttttttctattgaattcaggtgtctagaaatgggctaaagacccaatctctaacttaaaggagcccatttttgtgtgaatacagacttagaaatgccttatgtttgttgtatattttaataattttcttgagaggttgaggtgcctatatggaaaatatattaaaggaggatgcttgaagaataataaagagagtggctatttgggtaactacaaggcttatcttttgcagaatgaaaaatccaaaggccttagcttaatgtctggggctacagaggcaatttttagagagcatgtatacagaaaa

SEQ ID NO: 86250 - DNA, 357 bp, Homo sapiens
gaggacagagaccatgtcatcatttttctactcttaacacagtgtctagcaatagttggtattccctgagtggctttttagttgaatacacagtgagggcatgtatccgtgaaagaatgaagcagaagctatactgtataatgaaattatgttcattgtaaataatttctgacccactattaacactataggaaggaatacccaaatggacattcttatattccaagaggaactgatcattagtgctgaacttccacttggtctttgaagagagtcatcacacttttccaacctcagcatccagttccctaaggatacattgagcacaaatactaaccaaaagtctgttactcaaag

SEQ ID NO: 86251 - DNA, 358 bp, Homo sapiens
agcgacagggtcttgctattttgcgcaggctggcctcctggctgtaagcaatcctccaacatcagcctctagagtagctgggacaactggcacaagtgaccacaccgagttttctcttaatacacccacctttctctttctacaaagctaagctatgtagactccaaaggaaaaaaaaaagcctactaaataacttctctgttcctcttcctgcttaaaatgtacaccagatcctttctttgccagactaagaaagttataaccccaaatctacattccatagtgggcaaaacttttttttaaaaaaatactgactttatatctagatactataccttaaaagcatacttttaaaaac

SEQ ID NO: 86252 - DNA, 126 bp, Homo sapiens
aaggcacagcaaccttaggtttatacccgagagcaaaccatcactctacgcactcgcacacatatccatgtcactatctgtacattcttactcacgctgcttgacaccatggggctatttcgtaaa

SEQ ID NO: 86253 - DNA, 378 bp, Homo sapiens
catgaaaccccacaattgttgctgggtttcttggtaaggcactatgccttttttaaatgccagtacctggtgagaagatggggatactctgaatgtttaacaactgagtacatttcatactggtagaagtaaactggaaaaaatctagaactttagagttgggtgcaatcccgtgtttgagtcttccaattttaaaaggtggaaatggaaggtcaaagaggttaagtgattcttcccaaagtcataaagccagtctgcctaaagacagtggggcagaggagttggcattgaccaagtagggcaggcctggagggagagagaaactggggatctggaaaggtccaggagtgtgaggcctggtgggacatggagtgagga

SEQ ID NO: 86254 - DNA, 213 bp, Homo sapiens
gcgtgagccaccgcatccggccgggagttgggatacattctaaacattcttctgcatggtagtagttcaagtatttgaagagaaccatctccccccatatctcttttcttgacaaaaaacttcatttcctcatgatatggtttccagatttgtctccatcctgttggcctttcctctggtgacctggttaagatctggatccagaactgaacc

SEQ ID NO: 86255 - DNA, 291 bp, Homo sapiens
  misc_feature (29)..(29): n is a, c, g, or t
  misc_feature (50)..(50): n is a, c, g, or t
agtaccagctttgggacctgttgcctgtntgattgtggaaaacacttcanctctcaggggggcttcttagctggaaagtgggggtaaaacagtaacccctgtcagatgagaagatgccagccttgagcaagataaagcacgttatgaatggctgttggtggtggttctctgtttcactcttctgcctccctcattccctgctcctcctgggcttgaaaatcagtcattgtgatctcctcctctgctgcccagcccagtcctgctgtcgtgcctggaacgtaactcccacaa

SEQ ID NO: 86256 - DNA, 459 bp, Homo sapiens
tcttgctctgtcgcccagattggagtgcagtggcgcaatctcagctcactacaaccttcgcctcccaggttcaagcaattctcatggtgcctcagcttccttggtagctgagactgcagatgtgtaccaccatgcctggctaatttttgtatttttagtagagatggggtcttgccatgttggccaggctagtctcaaactcctgacctcatgtgatctgctcaggttggtggatcaaagtgctgagattacagacatgagccatcatggctgtccaaaacctagtctatttctaatgccattttttaaattctgagatttatttctatgaaaatatttctaagtgtatcaggttgtatacaccagggtttgaatatgattgattttttaaatgttttggaaatatttgaaaacagtatgtaatccttgtcatagacttatttggatatagttctatca

SEQ ID NO: 86257 - DNA, 516 bp, Homo sapiens
atttccaaacgttgtttggtaatatatagaaatatgattgattttgtttattgagtttgcatataaccacattactaaactcgcatattgagcattttaataggttattttgaatacttttacatagactgttgtctgaaaatagaaacaggtttatttcttcctttctgatgtggatgtcactgatttttttccctacattactgatctggctaggactatcactataaagttgaatataagtggtaaaagagctgacttcttgccttggacccagtttttaaatcagttggagagtcaccattaagtgtaatttagtggtagttttgtttgttttttttttgtttgttttgtagatgccctctatcaggataagttcccttttctcattttgctgagagtttttataaagaatagctattgaattttgtcaaatgcttttgctgcatctgctgaaatgacacgtttattcttcatctacctaataatgttgcaatttatatctgttgagctttg

SEQ ID NO: 86258 - DNA, 410 bp, Homo sapiens
tttgcggtgagccgagattgtgccattgcactccagcctgggtaacgagaggaaaatccggctaaaaaaaaaacaaaaaacctaaaatttgccaaaagactaatattttattttctcttctttctgacctgatgacgcctctccccagtgtgttgagttgcattccccatccacccccttactttaccactaggaaaaagatctgatgtgtgagggtcagagtcctgtagacagctagaaattgacttttaagtttgaactctaggttaaatattgattgattttgatctctcaacctaacacagtctttgggagaaattatttgtgtttaaccactcttatggccataagactattgcttaaatttaaccccaatccctccagcagctgaacaagtttatctccattat

SEQ ID NO: 86259 - DNA, 446 bp, Homo sapiens
ttccacatggcctaccaggccctgtgtgatgtggcccagactcacagatctcaccccctcttcttctccccctcactcaccatggctgagccacgctggcttcctatgattctttgatctaggtagatgtacaatagagaaaaaaagaatgtgaaaattattgaaggatatagaaggagatcagttctcaaaattagcaggagagctcggttttatgtaatgattctgccacacaaatgtgggcgtatacgtaggaagcatggtttgatttcaaggacctctgggaaggaaccttttgtatctcaaaacttagctctttcaccagcttcattaaattattttccaggacaatatacttcataaattcccacctatgaggaagtacagttagtatttactctgtgccaggtacagtgctaggtacaagagctatgatgatgaaaaaa

SEQ ID NO: 86260 - DNA, 439 bp, Homo sapiens
  misc_feature (81)..(81): n is a, c, g, or t
  misc_feature (120)..(120): n is a, c, g, or t
  misc_feature (150)..(150): n is a, c, g, or t
cgaatcgagctcggtaccagacgtcattctgcatagacgtcattctgcatagacgtcattcttgcatgagctcggcttccngcttcattcctctcctcattagtgtcaggagcacagttngtcctgtatgtcgcaatacctctactgctngctgattagtaaaaccctgattcatccatttcttcctggaactcttaacttagccaaaattttaggttgtattcaattaggaaaaatcatacaaaatacctattcccactcaattctagattaatcgaaatcttcctgttgagttggttatgcaggtaaaactacaccaccggctttggatatataaaaaaaaaaaaacactcgagatagtcaaagccttccatatctagcctaaactaccattttcttctcatttcccacaatatccaccaataaatttacagttcag

SEQ ID NO: 86261 - DNA, 494 bp, Homo sapiens
ctcagcctcctgagtagctgggattacaggtgcctgtcaccgcacccagctagttgttgtattttagtagagaacgaggtttcaccatcttggccaggctggtcttgaactcctgacctcgtgatccacccgccttggcttcccgaagtgctgggattacaggtgtgagccaccacacccggccctgttttggttttttaattagaacattgcactagatctctaaggatgcttccagctgtaacatctgtctataggctctctgatctcagatttactcagattttgaaattaaaaaaaaaaaaaaaaaaacaaaaacaaaaaaaaaaacaaaaaaaaaaaggggggccgcacaccaaaggaaattccccaggaggggcccgtgtggcgggaccccccttggcgcaaaagagggcgccccaagacgagaggaggcccgcgagagaagcgcggatgacgcgccgacggaacgcgcgacgtcatacgacaggcgc

SEQ ID NO: 86262 - DNA, 286 bp, Homo sapiens
tccaccacacctcataactttataaaatgttttctttaatagagtttgataaagatgtctgctctgcatatgagtcacgcataagtttgtctttcgatctcaattatctgagttctttgttagtaaacatccatctccatagtaaaaccacaaatcaggacaaacaaactcaggggtgaaccagatctttctaggctctttgatttgatgactcagaagcaaggaaaggttatctattaggtatagccttcaagttttggaacaagaatagtcagcaatctggaaa

SEQ ID NO: 86263 - DNA, 207 bp, Homo sapiens
tgccactgtgtggcctcacagggaacatggaaaggctcttggggtgaggaaactgaggctcaaagaggacacaaggcaagccctagattccagaatcagtgatgaagtaacagggcctcttgggtggtgggcagggttcaaggccggatcccactcttggagtcccctccttgttgctctgtaggaggccctgagtcaatttctcta

SEQ ID NO: 86264 - DNA, 467 bp, Homo sapiens
gcatctgtgctcagacctgccagtacagcctaatatttttctgaatcttgaggcagtcaagttgcccatatgcactgaggcccactttatgtagagtgtgcttgggacacttccagagatgtgcacaattagctaaaacagttttgtcctttcagaatttagctgagaaaatgacagtccacataataagatcattaatgatataaggcaggagattgtacagatgatgctgtgggattttttgtatttcttcttgaggagctcatcttactaagttcaaattatcaaattgtgtttaaggaaaaaaggttcattatttcatcatcctcatttttttttaaccatttgtgggtcattcctcccaggttgtaagtatttttattcagatgcatgtaggtgttcgatatttacccttgtaatgttaaagatgacaggatactgctctcactttgctctgttatataagc

SEQ ID NO: 86265 - DNA, 242 bp, Homo sapiens
cggggcgacggggaatctgtgtacccgagtgagtgtctaactcttatgtgtgtctccctgtgtctgtctgcctgagtctctctgcaacccactgaggtgaccagcctgtgactctgtgaaaccatgttcagactccatcctctcatgtcacttgtggtcactaggctgtagaaaaaagagcttggtcaaggtgcagtagctcatgcctgtaatcctagcactttgggaggtcgaggcaggtg

SEQ ID NO: 86266 - DNA, 227 bp, Homo sapiens
gtgatccacccacctcggcctcccaaagtgttgagattacaggcatgagctaccacacctggccgcatgtttagttttttaactcttattaatgtcaacttttaaaagtaaaaatttcatattgtgttacattggttgccatcaagatgaagatagggaagttaagagttggggaaggtggagatgaatgaagtcaattgatgaagactagtagattgcggtgtttg

SEQ ID NO: 86267 - DNA, 921 bp, Homo sapiens
gcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttattcaaatagccatggcccttatgactccaaccagccacataggaaaaccaaaatcacatttgaggaagacaaagtcgactcagctctcattggctcatcctctcatgttgaatgggaggatgctgtacacattattccaggtagctcaatgatctacattctgaagttgtctgaaaatgtcttcatgattaaattcagcctaaacgttttgccgggaacactgcagagacaatgctgtgagtttccaacctcagcccatctgcgggcagagaaggtctagtttgtccatcaccattatgatatcaggactggttacttggttaaggaggggtctaggagatctgtcccttttagagacaccttacttataatgaagtacttgggaaagcagttttcaagagtataaatatcctgtattctaatgatcatcctctaaacattttatcatttattaatcctccctgcctgtgtctattattatattcatatctctacactgcaaattttgggtctcaatttttactgtgcctttgtttttactagtgtctgctgttgcaaaaagaagaaaacattctctgcctgagttttaatttttgtccaaagttaattttaatctatacaattaaaaccttttgcctatcac

SEQ ID NO: 86268 - DNA, 766 bp, Homo sapiens
  misc_feature (396)..(396): n is a, c, g, or t
ctcatctattgtttttaccatatgagttataggaaaggagaaggccctgactccagtgaaaatttgctattaggtggcagtaagcagtttttctctcatttctgagaagtaagtaaacaatttttgcatactgttgtcaatagagatctaattccatttattttttaattagggttactaagaccctagaaagagaagaagaaagcttttcacagaacagtttctaatgtgtctggtatcaaaaagaatacacaattgatcggcattaagttgtataatttgaacagtgcccaccctgctcgctaactgcttacctcatacaactgaaatactgtatgagtagttcatatatttgatcctggagatacagaattgtacatgattatacatatatcngagttttatactgtcttcagagagagagctatgtgtatgtgtgcgtttgtagaacaagcattctagagtccagaattgtattttttagaattatgacagcattgaatttcatcagactaggaaataattgttctctttgtatttttacaatgaaatttgatttaaaagttaggtagcaataattttaacagtgacgctgagagttctgaagaattgcagtaaactgaagagtacttactgatctttgtagttggaacagaatggtagtgaattaggtacccttcagtgttgcagaaaaagtatcataggttgttccctatttcatgtgtttcaaagggatagggcagtgtgtaggttaaaaattaaagta

SEQ ID NO: 86269 - DNA, 428 bp, Homo sapiens
taagattcatgcagtgaaagctaacttactgagtgataaatttgcttagtgatctgtttattaggttttccaaatttgctaattgggctttgaacagctgtaaaagttctgactgtaaaagaaagcttcaacttttggcattcatgatgcttttctgagtattaaactaagatagatgttttacctgaaggatcggccaccaatctttaaatggctaaacaaaagggttgctaaaacataatccaaattgacataagaaataccatttttccaaccaaaattttggcattcatatggctacttttacgtatttcagctgcatttgaacatctttttcaaactttagggtggttggtgtatcactgaggtcttggatgacactttagctttgattttgtttttatgaattaaaattgtcataccaaaat

SEQ ID NO: 86270 - DNA, 680 bp, Homo sapiens
tgcaccctttttactccacagggggagaagcactacacctaatcctcttacctgctacaggcaatgtggcagagaattctccacctgggacttcagtgcacaagttttctgtgaagttatcagcatcattgtcacctgtgatcccaggatttccccagatagtcaactcaaatcccctcactgaagcttttagggtgaattggctgtcaggcacctactttgaggttgtcaccactgggatggaacaactagattttgaaacaggaccaaacatatttgatttgcagatttatgtgaaggatgaggttggtgtcacagacctgcaagtcctgactgtccaggtaacagatgtgaacgagccacctcagtttcaaggcaacttggcagaagactggtctaggtctacacctctacatagtagaaagagcaaaccctggattcatttaccaggttgaggccttcgatccagaagacacaagccgaaacattcccctcagttatttcctgatttctcccccaaagagcttcagaatgtctgctaatggcaccctcttctccacaacagaattggactttgaagcaggacacagaagtttccatctcatcgtggaggtgagggacagtggaggcctcaaagcctccacagagctccaggtgaacatcgtgaacctcaacgacga

SEQ ID NO: 86271 - DNA, 694 bp, Homo sapiens
tgtttccagtgtcctctgggctgtttccaagagcaacaagaaacgaataaatctctgacggagattcactcttgttgcccaggctggagtgcaatggcacaatttcggctctccacaatctctgcctcccagattcaagctattctcctgcctctgtctcccgaggagctgggattacaggctggtgtgcaatggtgcgatttccgctcactgcacttccaccttccgggattcaagccattatcctgcctcagcctccggagtagctaggactacaggcatgtgccaccatgcccggctaatttttgtatttttagtagaggcagggattcaccacattggtcaggctggtctcgaactcctgacctcaagtgatctgcccgcctctgcctcccaaagtgctgggaatacaggcatgagcaaccgcacccggcatggattaattgaaaattttcttctgtagattgtaatatattactattgttatctattttattgccccaattttctcaaatttggctatggaagtttattcaaagtggatctgtttccctttcacattttccccattttgtgagcatttccttacttcctaacatgacaaaatatttcaaactaatcttgtattttccctgcccgatcctgatatcaaatatgtccacaaggagccttggttcctttaattggagagtgg

SEQ ID NO: 86272 - DNA, 857 bp, Homo sapiens
catttatcttattattagtaatgttaactttgatcacttggctaagttgacatctccactttgaagttactattctataattatcttgtgggaagatactttcatattatgcaaatatgttctttcccaacatatattcaccactaatcttagcatccctccaaggttctttcttgcaacaattattactatgatatttgcaaagtgatgattcttatattttatgtctcctacatttaatgaaatcttactgtaataaaatactacccattctcaatctttggtttattatttatgtcaatatggatttttttttgagttggagtcttgttttgtcatccaggctggtgtgcaatggtgcgatttccgctcactgcacttccaccttccgggattcaagccattatcctgcctcagcctccggagtagctaggactacaggcatgtgccaccatgcccggctaatttttgtatttttagtagaggcagggattcaccacattggtcaggctggtctcgaactcctgacctcaagtgatctgcccgcctctgcctcccaaagtgctgggaatacaggcatgagcaaccgcacccggcatggattaattgaaaattttcttctgtagattgtaatatattactattgttatctattttattgccccaattttctcaaatttggctatggaagtttattcaaagtggatctgtttccctttcacattttccccattttgtgagcatttccttacttcctaacatgacaaaatatttcaaactaatcttgtattttccctgcccgatcctgatatcaaatatgtccacaaggagccttggttcctttaattggagagtgg

SEQ ID NO: 86273 - DNA, 918 bp, Homo sapiens
caggtgaataaaattgattaaactgatctttcaaataataaattaactttgcaaacttgctagaaatttaatttgttcacagtttattatccattctatgtactgctacattcaactggttattatgttttaaggacttttgagtctatgtttatgagggataaacatcaaagttatataatgcctttgtctcgatttggaatcggcaatactgggttcataaaataagataggaaatgtccctttaaattttcttttttttttttttttttttttttgagacggagattcactcttgttgcccaggctggagtgcaatggcacaatttcggctctccacaatctctgcctcccagattcaagctattctcctgcctctgtctcccgaggagctgggattacaggctggtgtgcaatggtgcgatttccgctcactgcacttccaccttccgggattcaagccattatcctgcctcagcctccggagtagctaggactacaggcatgtgccaccatgcccggctaatttttgtatttttagtagaggcagggattcaccacattggtcaggctggtctcgaactcctgacctcaagtgatctgcccgcctctgcctcccaaagtgctgggaatacaggcatgagcaaccgcacccggcatggattaattgaaaattttcttctgtagattgtaatatattactattgttatctattttattgccccaattttctcaaatttggctatggaagtttattcaaagtggatctgtttccctttcacattttccccattttgtgagcatttccttacttcctaacatgacaaaatatttcaaactaatcttgtattttccctgcccgatcctgatatcaaatatgtccacaaggagccttggttcctttaattggagagtgg

SEQ ID NO: 86274 - DNA, 513 bp, Homo sapiens
cgttttttaaaaaaactacatagaataaatccagtctgtttacatggcacacaatgtcctacctgatttggttgctgaatatttctccgatatttttttcctgctactcttccctcttttcattctgttccacacgtattagttttcttgctcttccataaacatttcaaactcatttctacctcatagcctctgtttttactattaccattgcaaggattattcttttctaagatatttctatggaaactctgtccccctatttcattcagtctttgttcctgtgtcaccatctcagagaggctttccatgattattgaataaattctaaaataaaattgatatcgaaaagggcatgctccctgcagcaagttgctaatatcagaaatcaataacaataagatatattcccaaattcatacatagagatattcaaacacaacacattcctacataacacttgggctaaggcatacataaaaatgaatacaaaataattagatctgaaaaaac

SEQ ID NO: 86275 - DNA, 369 bp, Homo sapiens
caattataatattaatttttatcagacaccatcaaatccagccacttttagatctccaatattggttataagtgccaacatttagactgaaagaactgtttaacagatggagcatttccttcttccagtatttaggagtgaggccatctgactgaagtcttatttccctgcttataaactaaggcctttgcccaggagactatttcaaaaatgtaccaaaggttaatatgtttgcatatattacaaatgctaagcaaaatggaatgttaatatattctcttattaattacaaaggaaatggcaggaatgactgcacataaaggacattttaccagttgttcttactctgattaccttttaggtccctgc

SEQ ID NO: 86276 - DNA, 281 bp, Homo sapiens
ggaatgacatggtcattccgacttaaaagaaacattttaggttcacacttgccaagttaggaagaaaaccaaccttagatcccttcccccccaccaatactcctttccccaaacaccgtccccacccgcctctatgtttaattgaatttttatttgtgatatatagaaaacctaacccatggctgtcatgctgagtgtcatttggcttcaagctcgaaccagggcacagcttggcctggaaccctgagacaagatgctggcctcagaaggtggggctcacg

SEQ ID NO: 86277 - DNA, 436 bp, Homo sapiens
aactcttttttcaagtgactttgttaccaggtaccgttgttgcagaggagtgatttgattattctttctctgtagaaatggtgatgatgtggggcaaatctacctcaaactgtaaactatactcactttttccacagatggggtcttgttatgttgcctaggctagacttgaattcctggacccgggtgaccctcctgcctcagcctcccaagtagctgggactacaggcacatgccaccacacacccagctatattcacattaaaaaaaaaaaatcatctgtaattctaagagctccctgtgtggagccttccaagtggcccacctgtgtgggaaagctgccctgcaatatgggcccaaaaattttccttggttttcatgtatctgagcaagttgcttaaaggtgcctggttctgtgtgtttgagattatttatt

SEQ ID NO: 86278 - DNA, 385 bp, Homo sapiens
cctggattttgcagaacccaggtagggtctcacagacttaccttcagacaccactgagttttccacaagtttatattgccatttatattagacaatactcacaaaacatttttatggagtacatttggggccatctgaacgactgccttctaactgcactgccatttggcgtcagtgcggccctctcagatgccccagagacacttcaaactctcgaccttgactcccctgcccccaggcttcctctagtgttccctctctccatccagtcatgtaggccagaaacctcagtgatactcttgaccctaccttccccgccatctcacatacctaaatctatcactagttctagagattttaaaaaagagcagctttattgtaccta

SEQ ID NO: 86279 - DNA, 1300 bp, Homo sapiens
  misc_feature (1211)..(1211): n is a, c, g, or t
  misc_feature (1255)..(1255): n is a, c, g, or t
  misc_feature (1272)..(1272): n is a, c, g, or t
  misc_feature (1287)..(1287): n is a, c, g, or t
ccgcatcgtgaaggaatctggaggaaagctgaccaggcggcttgtgaacagtcagtgcgaatttgaaagaagaaaaccagatggaacaacgacgttgggacttctccatcctgtggatcccattgtaggagagccaggctactgccctgtgagactgggaatgacaactggaagacttcagtctggagtgaatactttgcaggggttcaaagaggataaaaggaacaaagtcactccagtgttatatttgaattatgggccctacagttcttatgcaccgcattatgactccacatttgcaaatatcagcaaggatgattctgatttaatctattcaacctatggggaagactctgatcttccaagtgatttcagcatccatgagtttttggccacgtgccaagattatccgtatgtcatggcagatagtttactggatgttttaacaaaaggagggcattccaggaccctacaagagatggagatgtcattgcctgaagatgaaggccatactaggacacttgacacagcaaaagaaatggagcagattacagaagtagagccaccagggcgtttggactccagtactcaagacaggctcatagcgctgaaagcagtaacaaattttggcgttccagttgaagtttttgactctgaagaagctgaaatattccagaagaaacttgatgagaccaccagattgctcagggaactccaggaagcccagaatgaacgtttgagcaccagaccccctccgaacatgatctgtctcttgggtccctcatacagagaaatgcatcttgctgaacaagtgaccaataatcttaaagaacttgcacagcaagtaactccaggtgatatcgtaagcacgtatggagttcgaaaagcaatggggatttccattccttcccccgtcatggaaaacaactttgtggatttgacagaagacactgaagaacctaaaaagacggatgttgctgagtgtggacctggtggaagttgaggctgcctggtatttgattatatattatgtacatactttttcattcttaacttagaaatgcttttcagaagatattaaatatttgtaaattgtgtttttaattaaactttggaacagcgaatttggatgttccagaggttggacttgtattaggtaataaagctggacctgggactcgtgaggaaggaatgtgcttggggctgttgcnataccctgtgcagcattctttcaaaatagtgcccttccaatgcntcctccttaatgtcccnccagacaggatcacncctaagaagccgt

SEQ ID NO: 86280 - DNA, 497 bp, Homo sapiens
taggaatttagcgagagcagttccttgcttctagtgagggagagaaggtggtaaattctaggccagcccccacattcccctggccaccctagagatcctgccatcaatacccattctccatgtggggcagccctagagttccactcatgttccaggctcattgctcactgcaatccgttctgtgagactggaatcacctatcatgtgcatcagcagacccagaggggaaactgggatctaagactaaaagaaacatattatcaagcacctactatgtgctaggctgagccggattctgggcagcaagagcatgaagccaatcacctcagccctctcaccttcccctccttcccaggtaccaggaggaacctccaaatgcacacaacagtcatactatctgtcccagagtgagcaagagttaggtcttgaacccacagctgactccccagtctgtccagaggcctgatttgggaaggagggtgcgatcttgctgggca

SEQ ID NO: 86281 - DNA, 372 bp, Homo sapiens
gagtggaagcccgcagccacgcagaagcccgtgcgcagacgccgccgtggactccagcagccggacggtggctacaacccagatggccgtcagcagaggaggaggcgtagtgtggccctccatgcactggaacacaacccagccatgaaaaggaagaagctctgactcaggccacggcgtggacgcaccttcaggacgccaggctcaatgagacactccaggctcaatgagacacgccagacacagaggacatgccgtgtgtgatcccatttctatgaaatgtccagggcaggcccagccacagagacagggagtaacgtggtggtttattataaatttttcatgaaaataaaatatacagtactctcgtga

SEQ ID NO: 86282 - DNA, 381 bp, Homo sapiens
atcacccctagaccccctcctttccaacacctccccccagcatgctcagatctgttcctgttgctctctcatgaggagcattcagaactggacgtcattaattatgaatcagaagaatcagaagaacgtgtgtgaattgtacattactatctctaacatatgtaggaattgccacttagttaatttacagttttcaacagatatcaacaactagagatctgttgacccaaattactagaaacagaatcaggaagagatttccttcaatggtttgaagtctgattttttccctgtgcttctgagattaaaagtaatacaaacagattcgtttttaaacttcagttagttgaaaagacaaaaatgaaagacagaaaaatattt

SEQ ID NO: 86283 - DNA, 414 bp, Homo sapiens
tcaaaagttctgacacagcctaggtgatcacaagaattactggagcactccctagaatagttttgccccagcctctctgctgtagatcttaattcagtggagctggcaggggcccaagaatctgtattttgaacaagctccctggcagttgttatgatcagataagcctggggacccacaagtgtaataaaatggtatattcacatatcatcattgcagtcacagcttctgaaatattatgtttttaatttgtatgtacatcattgtatctcaaccatcattcgattgtaagctccaagagggaaaggaccttgtctcattcactgggatgttctcagtatggaaaagaatgcaagcaagtggtggggattctgcagatatttgttgaataaataaatgaatttctgttttgta

SEQ ID NO: 86284 - DNA, 219 bp, Homo sapiens
atccgcctgcctcggcctcccaaagtgctgggattacacaagtatattttttaaaggcacggttcctctcctgaaatttggcttctattctatcattccactaaacctgcctttactatattcaccagcgtctatttcaaagatgcaatatagcatggctattaggagaatggattctgaagcttgactacttgggttcaattcccactctactcatta

SEQ ID NO: 86285 - DNA, 438 bp, Homo sapiens
aaaaagtgtcctgagcaatttaagctaaaagaatatgttgtttcttttgtgtgtatagcaagaagattatatatatttataaatttttttccagcaagtgtacttaaaagcatgtacttaaaattaaggacttaaaaaaactaagctgtacttaacaaaataatctttagaaagctttaaggccgggcgcggtggctcacgcctgtaatcccagcatcacgaggtcaggagatccagaccatcctggctaacacggtgaaaccctgtctctactaaaaatacaaaaaaaattagccggttgtggtggcgggcacctatagtcccagctactcgggaggctgaggcaggagaatggcgtgaacccaggaggaggagcttgcagtgagctgagattgcgccactgcactccagcctgggtgacagagcgagactccatct

SEQ ID NO: 86286 - DNA, 288 bp, Homo sapiens
gatcagactgtgctttctaattctaaaaaattgagcagtgttggtattctttcagtatttttactctcacctggaaaactacctggaagttgtcaggcatttgcttactggtagtggaggttacagctgtacatgaagcatgtactgactgtacttttaaattggtttgtcaagtatactttgaatcatatacctgatggatgtccaaaaatatttaagactctttgaaaagaagatagttacttttaaattagttaccctaaatttcatatcttaatacatgtacat

SEQ ID NO: 86287 - DNA, 330 bp, Homo sapiens
acccccggggcaagtgcctctgagcaacgtgccttgcaggttttgcatttgttggctttacctgcttcaggcgtgggaattttccttctttctcattttcctctctttctgcagtgccattgctggccatggggctgggggtggctgttggtggctagtggtgtcaacgatgttcctctttgagctccctctgttaggcaatccccatccagctctgtgacccatgagctgtcctcagcagaggctggcatgagctttttgcaaaattttttttttttttttttgcgacagggtctcactctgttgcccaggctggagtgcaatggtgtg

SEQ ID NO: 86288 - DNA, 330 bp, Homo sapiens
  misc_feature (277)..(277): n is a, c, g, or t
  misc_feature (317)..(317): n is a, c, g, or t
  misc_feature (320)..(320): n is a, c, g, or t
tctgcatgtcagggagggagagtgctgtgattgagaccctccattgaactcagtgctgttctgtcgaaggggaaagcaaaactgggctaaacttagccaatgaccacgaggtcaggagttcgagaccggcctggccaatatggtgaaaccccgtctctacttaaagtacaaaaaattggctgggtgtggtggcgcgtgcctatagttccagctcttcaggaggctgaggcgggagaatcgcttgagcccaggaggcggtggttgcagtgagcatagntcacgccactgcactccaggcctcggtgaccgagtgaaanctnaatctcaatg

SEQ ID NO: 86289 - DNA, 325 bp, Homo sapiens
aaatatacattgtgggcatcccagaagaaggagagagagaaaagggcagaaagactatttgaggaaattatggccccaaactccccaaatttgatgaaagacattaatctacatatccaagaagctcaccaaactccgcggaggataaattctaagagatcacatcgtaacacattatagtcaatttgtcaaaagacaaagagaatcttgaaagtggcaagagaaaaaagactcatcaagtacacaagggcctcaacaagatacaagtggatttctcatcagaaaccatgaaggccagaggtgctgacatgaaatatttgaaatg

SEQ ID NO: 86290 - DNA, 397 bp, Homo sapiens
gattaaagactgtgttaagtaaatgctgaaagcttaaataagccttaagttgtctagtttaaaacaattcagtcaatgaatactgctccctcttttgaatggtaatagcctttgcagttattctatagctgttttatatttgttaaggtattttaattcttagataagtttcatttgcatgatattttaagatgttatataggaaacatcttttctggtcatgggattgatagtttttgagtaccaacttgggagattcttaaatggcaaactgacaaacgtgtgttttccttacacctaaaatgtctcatttagtttttaaactctgctgggacataaaatggatatttgtgaggtaaatttaggtgttagaaccaatgcaaatattgcaatgaag

SEQ ID NO: 86291 - DNA, 518 bp, Homo sapiens
gcatgagccactgcaccaggacttgtctctttaccgtcctttccctgccctctgcagagggccttgggtcatttctgtggaaccgtggagtcggaaacactgctctcgagaagccaaaatagagtatccttgcaagtctggtctgtttaccttgttaaagtaaatttaagcttgcctaactcatttaaccaactgtgaacttaataccccagtattctgtattttgaatagaactccacggatgatttcagaggcccctttgggacctctccatttccacttggttctgcattgtgattggagtcatgctattttccaaaatcgtgcagggtttctattctgtagagcttccatgttgaggacagatagcatatttatatatgttgatcaaatacagttttaccctcatagaattctactttgccagagttgtcaatatagaaaatcagcttctatttttatcaaggagtggtacccatgtccaagtcatatggaccttttgttctcaaataaacttt

SEQ ID NO: 86292 - DNA, 213 bp, Homo sapiens
ctaagtttaaagtgaaaagtcaagggaataaattttgccttaaaaaggaggaaatgcaaagttacatggcagaaagagtggatacaagcagaagagaattgtggacaataacttaatctacaagaaaaagaacagctctattttccagggacataaaaatcagtttaaaaaagcttataagccctgtcataatcctcagttcaaactttatgc

SEQ ID NO: 86293 - DNA, 386 bp, Homo sapiens
ggccgttttcatcacctgattagagcagtggtcctcaaatggtgttctttggaccatctgtatgaaatgttcataggtcaaggataaaatggaaaaacagagacaatgtcacagaaatgtgcccattgttgaaagaccacgagctgtcctttttggaggattgttctttattctaaaaatgtatctattctattctattaaaacatttttgtatttacatttttttctcttatgaaatgccattgggtagaaatttgtaatgtatccaattctcctgtctccatgcattgcagtgtggtgggggaggggatgtggcaagtactggccaacaggctgggggcagaggtgcagtgtgagacttctagcctggagcatttaattcttag

SEQ ID NO: 86294 - DNA, 312 bp, Homo sapiens
atggtgcctcccccccacccccactacacacacacaaacacacacacacacacacacacaccacttccatggcgccaggagagagtttggtccttcagcaagatcacactcttctccatatgaccccagccaatgagcgggcgagacctggccatctctgccccatgcgggactctctcatgggccgtgctggctccagcatcgcagtctaacagctccctgccgcatttcgttccctctgtgctccttccccagtgtcactcctccttcaaaccccaagaacccgtttgccctccgcagtccttctcagca

SEQ ID NO: 86295 - DNA, 526 bp, Homo sapiens
cactccagtccatgaattcttcctggaactggtagctcagttttcaggctttagactgtcctttcctcgaaggtcgagtttcaccaaggacccatccctgcctgcctaggagtttgtcttctgtcactatcagtaggactgcagtgggtcagacctgaaaccagcacagcagttgatcacacccaaggtgagctgtaaccactacctggtaccaccagtaattgctcaaggtcctggggctttataatttgtaggtggtatcctacaaagggcttgccagcgttgtatcctttccttcagagtagtgagttccctcaggctctcggcaagcccatcggtgccatccaggagccaggggctagtcaataaccttaggagtctacttcgttttctgttgtactgtggtagagctagcaattaaaccgtaagattcagttcttcccatttttccgtccttattccacaggcagaagagcctcatcccattgctaccatcaccacaggcccatggggaataccgccaggc

SEQ ID NO: 86296 - DNA, 404 bp, Homo sapiens
  misc_feature (322)..(322): n is a, c, g, or t
ttgtaatgttgtgccattgtatcaccaatatattgctttaatcaggaagagaggatcctgtattccagattccatcttgttctcagtttctcaacctttaaatgtatttgttatcttggtcatctctgaatctgatggctaaaatctaatctaacttaagatagttttttttagtatttgaattccgggtctagtgtgctttccttcacttgtgttcttcaggccgacagtggaagttccccagtctttgggtttgcttagtttgttctttataatgtgggttatttttctctaagcatgttgtagttttgtaatgtccttncttaagttaattatcaccttttcagcccaagattttgttccaggtatggaaaatttttagtagtatcctactgttaaaaaca

SEQ ID NO: 86297 - DNA, 679 bp, Homo sapiens
  misc_feature (6)..(6): n is a, c, g, or t
gctagncgtgcacgactctcttaatttccaccgctacacgcggtgtgtagcatgtatttggcttaagcttagaataataatttttgtgctagatttcccaagaaaacataggctgcctttccagaaaattctaccagccctcagatgggttcaccctcaccctccttcagccccaagatggtttgatcaagagctggagtccagaggaaagcaggtcttttgtagcatctgaaattctgtgggagataaaattcagcaaggagctccaatttcatgagcgtttggtctctgggatcgcaccaaacctttttgatcaaaggaacccaagactgtggacatgcatcgtgggacatctcttcattagtacctttggcctctgaatctcaaacagtgaatgactttagtcttttgaaaagagtggcatgtggactttttcagaaagtgaagaagaaaacattacaatttcctcctgttgggaacttggtcacagtcattccagtactgtgttctttgctgtactttttcacattattgtttttttccttgtgggatttcatcagagctctctattcacttgggtgtgacgttgtgaagttcaatcctgtcatagactatattgaatagggagctgctctggtagcctgaataaagcccatgactttgaagaagttatttaacc

SEQ ID NO: 86298 - DNA, 655 bp, Homo sapiens
  misc_feature (9)..(9): n is a, c, g, or t
  misc_feature (15)..(15): n is a, c, g, or t
  misc_feature (30)..(30): n is a, c, g, or t
  misc_feature (48)..(48): n is a, c, g, or t
  misc_feature (55)..(55): n is a, c, g, or t
ggtgcctgnaatccnagctacttgggaggntgaggcaggagaatcacntgaaccngggaggctgaggttgcagtgagccaaggttgagccactgcactccagcctgggtaacaaaggctctgtctcaaaacaaaacaaaacaaaaaattatcaaagacttcactaaatatcttcatatctttaagggactatcaataaatatctttaagggattacccaattttttcaaaagaaaggaatattctgtagctaataatctacagtctcctggaagattttttccaatttcttattttcattatctttaaacagatggaagcaataaaaggcatccggcatgcttcccattctaattactaaactatagcttttaaaatactactgtccctttatctttaaaacaaactgtgtttgtggattgcccaaagttcaaaatattaagtgctcttaagcatattacgaagtgtctacagaactaaaatccttgactgtattacaatacttaattagaaaataaaaaggattctgtaattaaggtactttacatgatggaaatgtgaaatgaagagcttaaaatgaaatgatttgacagactctaaagacaactctttctctcacaacttttgattgcctctctgaaatggaagactgtaac

SEQ ID NO: 86299 - DNA, 719 bp, Homo sapiens
agggttagccatggaatcatacttcaaggccacctggcctctgcttgagtgtctcctctggtttcagttcattgtcatgaagcaaagaagctgacaggaaatctgcttcaggcagagattgaaaccaggtttatggttagcttcttacatcaatggaaacaactttgcagtaactggaaagaatctttaagtgtagcctatcaaataaccaactgtcaagcccttttgtcaaatagctaatgaaataaattttcaggagttgcaaagaagccattattttgagaaaaactgtgtgctatgagggtctttgctgtggcaggcctgagccttctcagcttgctttggggaagactagctcaaggtgctctgttatgaccatgctctaataagtgtcccctcagtaacccacactgaaaggaaacaaatctactgttgtgagaagctcaaactcactaatatctcaaataatactttctttgctatgtttcttatgtaatatttcaataatcttatgtaatatttcttccatgttcctattacatgtattctaatatacatattaaatttcttcaatatattaaaatttcaaaacactactctgaactcattaatctgttttaggcctatttatggacaatggaaaaaatatctctgcaatgttactttatgatattcaaaggaatctgtctgaattcttccaaattaaagatataaacaga

SEQ ID NO: 86300 - DNA, 407 bp, Homo sapiens
gaaaaggctctgcatgtttaaaaatatatatttttattttcttataaatcttaaatatctacacttaagatttatttgatatgtgggatccattcatattttggattcaacagttctgtcaaaactgtggcagtgataggggattctttttttcccactgaactatcacaaaattggaaaaagagtaattggagaaccccactggcttagccggcccgaagcccgggagagggcaggcagtgctgtggatggggtcatcccagcgcaacgctgcccctgctacctgcggatctcgctgaggcctgcctttgtcctttgacccttggccatttgttagtgtctctgagagctggactgctgtaccctacttccccagggggcctaacttcacacagcctctgccgcag

SEQ ID NO: 86301 - DNA, 778 bp, Homo sapiens
gattgtggaaaggccttttgtagaggctctcaacttacacagcatcagagaattcatactggtgagaagccacatgaatgtaaagaatgtgggaagacttttaagcttcattcatatcttattcaacatcagataattcatactgatttgaagccatatgaatgtaagcaatgtgggaaagccttcagtcgtgttggagaccttaagacacatcaatcaattcatgctggggagaaaccctatgaatgtaaggaatgtggaaaaacctttagacttaattctcaactaatttatcatcagacaattcatactggtttgaaaccctatgtatgtaaagaatgtaagaaggcctttcgttctatctcaggtctttctcaacataagagaattcatactggtgaaaaaccctatgaatgtaaagaatgtgataaggcctttaatcgcagtgatcgacttactcaacatgagacaattcatactggtgtgaaaccacagaaatgcaaagaatgtggtaaggcctttagtcattgctatcaacttagtcaacatcaaagatttcaccatggtgagagactcttaatgtaatgagagggaaagcctttagccatggcacatttttactgttgtcactattatgatgctatagtgaagattaaactagttaatatagaatataaatacttggaaaggcatctggcacatcgtatttgcttactaaatacattatttttatgataattgttagaattactaaaaataaatcttatagaaggaagac

SEQ ID NO: 86302 - DNA, 526 bp, Homo sapiens
ttgtttgacagagtaatcttcatgtttggttgatacggtggagattacttattttaagtaacataattgttacttaaagattttgtaatagtggaacgtgcgcaatccctagtattataacagtgcttattttatggactggtgtgtacatagtactgtaggaggtgctatggagatttttaaaaatagcttaagaaaatatttgtcttttaagatatttaaaataaagctagagaggaaagtatgccaatgctagcaaacacaaactgctgattataaataagtttcatttatgtgtaatggaaaaaattagagcagtgatgcttatgtaatgaggtttgtcaaggacagcttcttgaagaaggtgaatcttcagtgtgtcttaaagcatagaatctgcgttgatgacgagaacaccgtccacccaggtgtatggcacagtttgcagagaagttatgtgccatacgtattttagtctgcatagaataagctagtatattttttggcatagaaattgaaccttcag

SEQ ID NO: 86303 - DNA, 447 bp, Homo sapiens
tttatgaattggttaagtatttgcaagtctgtctcctctactggttgtgatttttcctgtaatcagttgttcatctctgctcagtattcctagcatctaataccaaatccagagcatatatttaagccagacgcagtggctcacacctgtaatcccagcactttgggaggctgaggcggaagaatcacttgagttcagcagtttgagaccagcctgggcaacatagcgagaccctgtctctactaaaaaatataaaaattaagccaggcacagtggctcacacctgtaatcccagcactttgggaggtggaggcgggcgaatcacaagatcaggagatcgagaccatcctggctaacacagtgaaaccccatctctactaaaaacacaaaaaattagccaggcatggtggtgggtgcctgtagtcccagctactcaggaggctgagg

SEQ ID NO: 86304 - DNA, 415 bp, Homo sapiens
ctgggaactaagtacaaaggaatggttctgtttctaaccctttggcttagagtatcatagagttttaaatttggccagattttaatttgacagataaaaaaatgaggcacagataaaaaaatcgagaagttgaatgaattatgaaaactcactagaggcagagttgaggacgttgtccagtgctctgttgtatcattatgtcactgcctgccctactgttttcctgctctttccctcttcttcttcctccctctcagccctggtccacctaccttagtgcatgcacacacgtatggcaaagatcaacaaggatgctgggttcagggtccttttcccactggagtctggcaacactgttcctgccttgatatggttcttggttgttggccacttaaaacaatggcatattttgaag

SEQ ID NO: 86305 - DNA, 285 bp, Homo sapiens
ttggcatttatagagacagagagaaaatgtatgtaagaaagaaaatgagccttaggaatgttatatgaactgatattaaggttatagtcacattcatggagacaataacatatcaataatgagatgtatgtgggagagaatcatattgaagagactacattagtaataaatgtctcagtcctgataagggtaataaattcctgccaaattgggttaggcataagtattcccattttaaagatgagaaaattaaggtacaggggtgttcataaagctgatcaaggt

SEQ ID NO: 86306 - DNA, 795 bp, Homo sapiens
aagcccatgctgcccaggccctgtgccaggtacgaggacacgaagactacctcctgctacaatagtccgctgctctccaggagttcccggggaacagaagagtaggcagtgacctgacttacgattcagctacaagacaaagagtacatgagagtgaatgcagcacctggatcagaccaggttggcaactagctgagggaggggcctcctggaagagctgaggctttgcctggcctcccttggaaacctctgggatagccatttccacctgcctgtctatgagtggaatcacaagtctggctttctgggccagttgctaatggtcactgggtgaaggctaatttatgaagatatttggcatttttaataaaacctaaaattacacctctaggtgaggcatgcaagacaaacagatatcagactcacttcacaaccggaaatcaacttggagtttacttaaggaacacatgttaacacctgagtgcctagcatggccaggcactgtccttagcgctgaattcaatgcctccagtaagttccctgtgaacctggtagtgccctgcccatgccccatcgacaggcgtggaaccagcatagaggggctcaaataactggaccgcggcatgcaggggtgggctctgcaggatgtgtcctcacagctcctacgagaggtgaggcctatggaagaactgctgagctagaggcagaaaggcttgtcagtgacctaagggcaggctctgcaaactgttctcacttcccactacaaaaaaggtttgggggtttgaaagaaggaag

SEQ ID NO: 86307 - DNA, 593 bp, Homo sapiens
aatgctgagggttaggaacaccattcaaaagatgtgtaatttctaccaggaaatggatctgtcgtcatttttgtctaacagatgctgaaaatgaaaataacaaatttaaaagagaatttgcaagcaggaaaaatatgaagagtgagaagaactaaaaaacacttcaaatgggacattaaaagatgatcatttatttaattttatttaacaaagacaagaattctaaaagttgaatattttcaacatatttccttgtgggagaatggctgaaaacatcaagggcacaggaggatagactttatctcttactatgattaactgcacaagggctagtcattaagccattcttatcccagttgccaaattcatagccagtaatacccataggtcaggtgacaggctgatatttcccttaaactgagtgctactccctattatgccatgattttccttagtgacaatgggacatttaaactctctggaccccccttttgtttttttgagacagggtcttgttttgtcactcaggctagagtgcagtggccccatcacaactcaatgcaccctccacctcccaacctcgatcaatcctc

SEQ ID NO: 86308 - DNA, 411 bp, Homo sapiens
caggtgtgagccaccgcatccatccagaataaactttgtaaacagcattttatttatcgcagcatgtccaaggtcagatatttattagcactttatatatggtgtagccatctgctttcatagcaatattttgtctgtatttgaggacattgtaaatgtttgtacagttttctgagaatcacaggagtgcaaaatgttgggaaccaggaaatggatgatgcttcagttaaagaaaaaagaagagttctgtggcttgtacacataaaacataaagataaaattggaattctagagcagtttcttgagggaagcagcagaaaggtcaaaaacttctgatgacagcagaaaaaggtaatcccttttgtaagatccaaaagatgatccttgcatgcatgaatctcggttaacaga

SEQ ID NO: 86309 - DNA, 357 bp, Homo sapiens
gaaaggctttttgtcagatctctggtagagaacaaaatatgaaccagccaaaacatttctatcattatttaatttttctttccaaaatacaattaaacttttaaagcacaaaaattttaagatattggtaaaagatggggtgaaaaagtccgtacctttcttgatattctgtgggaaatatgaagctgtaggtagcctctttcttctttaataaattgtgcttgaaaactttcaggacgtgcgtaattatttagattggaggttgacaaattacaacccataggccaaatctggtcagctgtctgtttttgtaaataaaattatattggaacacagccacgcctattttttatatgt

SEQ ID NO: 86310 - DNA, 748 bp, Homo sapiens
cgactagcctgccctcccgcccttggaaacttgtggaccccagaatctcagctttccgcctaccaaaggtgccccgatcccctcccactgccctagcagcggcccagccccaacgcctttggctagagattgaaatcctctggaaccaaccactggacgctctggattggggcggaacgcgcttccactgtctcgaaagcagcaccttctcggatttgagcctttgcggcgcgcctgggctgagatctgagaaatgcgccctgggccacaggcagcagcggaggcggggaaggaacaactttccctccgccctctaaccacaagggcggggtggggcggcctcgctggggtcgggctcctccactttcccagctgggatcccctgccggagctggcgtgggggccggggagggggaccagaggggcttccttctctccccaagccccgccagatgttggaaaggcaaacaataggggaaacgcggagaaacaaaaggccattcgccacgatctcagtcggctgcgtagagagatctctgtggggagggttaggggagagggtcaggaaagagcgcgaggggggggatcccgagagatttagagtctctggtacttgccaggcaccaggggtcggcgctttaccctcccagcaggggtctgaaggtgggaaggggcaatcaaagaaaacttgaagggttttcaccttcttccccagttcagggaaagggaggggctgggattccagatg

SEQ ID NO: 86311 - DNA, 416 bp, Homo sapiens
tctgtttctatgagatagagttgaagctccccagagaagggctgtttatccccagtatttaggacagtgcctggcatgtattagaggctccagagatatttatggagtgagtgaatggaagctggaaggggtggaggaattttaggagtcaaaacaggcaaaaggctgggccataaagctccacttcaggtggcactcgggtgcaggtctaggtctctgggtacactacgatacacagtgagtgttttgaaaggcatgggtgcagcatttggggaggtgcccctcctccaccctggtgctctcatggcctccatagtttgtgtaccaagaacaagtgggctctaacactctcttctggagagtgacatttttctcttggtccatcttcctgctgctgacttggcctgggtgaagcc

SEQ ID NO: 86312 - DNA, 445 bp, Homo sapiens
cttgcctgctgaggaggaaactagacctgggaaccgaccagggttgcagggcccagggcccgagggcatcgttcataccctgggctggtggctatggaactaataaagtcctttttgtttctttgtttctttttttgcttaagctagtctgagttaaatttccccatgcccaagtgaaagctttgactgagagaaataaacctaggccaggatttgtacacagaccatttggtaacttgttcaattaacatgttgaacatctcatttttctctttctgtttataagcaagcatgtatgtattgaagagaactttgaaattaagaagaacagtgctcgctgtggcagcatatacactaaaactggaatgatacagagaagattagcattgcccctgcacaaggacgacacacaaatttgtgaagcgttccatacaaaaatatattt

SEQ ID NO: 86313 - DNA, 415 bp, Homo sapiens
aagaggtgaagctttttatacatcgttatatattacatactctgtttagctgatgtgaactacaaacacatgaagcttcacaccattctttccctagaactaggttaacctacagataaaaaatgattacaatgtaatagattctatagttaattaacaatttaaatcaactctgaagagaaaatatagatgcccacacaaaagagaaggggggaaaatcttttatgtaacaatggaaaaagaagtagaagacattaggatgtatgatggaaatattacatcattggcaaatccaaaattgatgagaatctaattgtaatctcaagtctaaaccattcagctgccaggattgtaaatagaaacgttttaaaggccttgtgccatttacctggaggaggggttggagtgtaatgtt

SEQ ID NO: 86314 - DNA, 568 bp, Homo sapiens
caaatgcaggctgaagtgactcctgccagctcctctgactcaggtgtgccttcctggcactctcttccccttccaccacaggatgtgtgtgaatggtggattagagacgaaaagaaggagatatagtctggacatcaataggcagtggaatgagaggagtatggaaggaagggtgtgaaggaggaaggagtagagaaagatgctcaaattcatcaccttcccaacaatgtggacgttgatgttgctaccagcatgacgatcaccgaaggagaaccgggatatcagttaatgtccaggcagaaatcctgggctgttattttgagtatgaatttctattacacaaggactttaaaaaatgtaaagctataatcacatccaatgaaataaaccatatttatggtaaaaaaaaaaaaaaaaaaaaaaaaaaaaaaaaaaaaaaaaaaaaaaaaaaaaaaaagaaaaaaaagagagaaagaaaaaaaagaagaaaagagaggaaaaaaaaaagagaagagggggggggggagcgatgtagcccgcggggggggggcccagaggtgaggcgcgt

SEQ ID NO: 86315 - DNA, 285 bp, Homo sapiens
caccggcatatacagggcttggagaaaacagaaatgatgtgggaaagatgtgggcaagagcagatcactctcctggatctcagaaattttagaaagaataatactgtgggatgcagtaggaacaattatccatttatggcaaggctgactgggcagtttttaaacaggtaagaatggattttcatattgcataggcccttaggataccatctagaaagtttagttggtggtaataacattaatttaaaggttttgcgcagttttgaagaactgagtacaaagact

SEQ ID NO: 86316 - DNA, 377 bp, Homo sapiens
taaaccaaaaatataaattaagtctataaattcatataaaataaaagtgcatacaaaactgcaatattacagtaaaataaccacaaaaagtgtatggaaatactcattattcaaaatagcaatgaaaagaaagtgaaaaaagaaccaactaaaatattcacaatggggcatgacaaagtacattattacaatggaatgctgtataaccattaaaatcctaacacctgttgtgagggttggatataaaaaaaggaaatctatgacataatataatttacttaaatgtaatacatatcatttatcttttagggacaaagagacatagtatcaaataaatatgctagctgcgaacagtggttcacactttttataccagt

SEQ ID NO: 86317 - DNA, 1806 bp, Homo sapiens
  misc_feature (157)..(157): n is a, c, g, or t
  misc_feature (832)..(832): n is a, c, g, or t
ggcgggcgcccctccccccgcctcgctgccgccttgcagtttgatctcagactgctgtgctagcaatcagcgagactccgtgggcgtaggaccctccgagccagagatgggatcttactacattgcccaggctgaagtgcagtggctattaacagcntgtaatcataatgcattgcagctttgaattcctgggcttgagcgacctccccaccttagcctcctgagtagctgagactacaggcactgtcctaggtactgtggggaccaaaacattcaagacctgcttctaaggagtgcaagtccatggaagagtcagaataacaaatcaacatttgtactacaccagaccagctctcttctaaggttgctatgacttcccagcaggcattctaatatatgcattcttcataacaactgtgtgaaacatattaatatcctcattgttaacgatgaagaaactaaatctcaggaagaaaaactaagtgaagacaaaagaaggatttgactgaggtttgtcagactctcgggaccatgctgttgaagccactaaccacgctgcctctggggtcacttgattaattctgggagattctggggagtctttttctccaacgctcccagtggcatctgactatactgatggccctttgcaggtgtgaccctgagctctgctggatttcttgtgaagaaaactccaaggaatggatgaatgcctggaaacttactgctggaagtcataaggcaatgacaagaaaatagcatatcattggaagacttgacccatgggatctataaattcctagggaagctccttactataatttgtttggtntctatggaatccaacaagaaaataaatagcgaaacatgtgggttgtctcctctttggcactaagcctgggagaatatgaagatatctgaaaacaaagaggcttccttcaggtgttcaggagggggctaacactgcctacttgtatgtcaagggcccatgggagtagacactcccagaatgctaccacttggattctccagggatcatatgtgataccaatcagctgacaaagaaaataacaacccatctaaggggattcagcagctagaaagaaaatgagtatgccaagcaaactgaatacacgaccagcaaaatagaacttcaaaaggagacaaaatacaacattctctctctctctgtgtgtgtgtgtgtgtgtgtgtgtgtgtgtgtgtgtttgcatgtaaataacaaaattcaagttctggacacaatttttagagctaaacacatgaccttccaactaaactttttattagatatcaaagaagctggtcactgttgaggtgaagatcaagtgcaagatacattttgaggcacagagcaaaaatgtaaagaatcagaaaaagacaagagacttgaggatttaatccaaacaactgaacagctaaaaacaagagctacaggggcagaagaagaaaaagtttaagaaagagacagtatattattttctctgagaagaggtaaagctggaaacctgttgtaagcaagatttattgaattttctcatcatagtcttaaaagagcagtactccaataggtcttgtttactaaaggaagatttgttgaaagaatcaaacaactgatggaggctgatgaaaagaatacatgacgatcaatgacacttggtacacacgttcacactcacagacacatacacaaacgttggataggaaaaggctggctggcaacatgtggcaacagtgctctgtaaggactcttgaagtagaataaatagtcttactgaaagaggaatt

SEQ ID NO: 86318 - DNA, 658 bp, Homo sapiens
aggaagttatactagaataggcagcccaggcttccggttctaggtgcttcaggagccgtggcttaaggtgcagacatggccaagtccacaccatacaccaccagtcccgaaaatggcacagaaatggtatcaagaaaccgcgatcacaaagatacaaatctcttaagggggtggactccaagttcctgaggaacatgcgctttgccaagaagcacaaaagaagggcctaaagaagatgcacaccaacaatgccaaggccatgagtccacgtgccgaggctctcaaggccctcgtaaagcccaaggaggttaagcccaagatcccaaagggtgtcagccataaacttgatcgacttgcctacattgcccaccccaaccttgggaagcttgctcgtgcccgcatggccaaggggctcaggctgtgccggcccaaggccaaggccaaggatcaaaccaaggcccaggctgcagctccagcttcagtttcagctcaggctcccaaagctgcccagtgccctacaaagacttcagagtagatatctctgtctgccaacgtgaggacagaaggacaggtgccacccaccccgggctgccgtctgcatggggctggggtcctcctgcgctattggtacaaataagcctgaggcagaaaaaaaaaa

SEQ ID NO: 86319 - DNA, 434 bp, Homo sapiens
tgaggaaaagtgacttccccaaagtcacctggctagtcaatggcagagccagggttcaaacccaagcaagcagtgctccagaacatatgctctcaaccacttcatgccactgtgccacttgaacaagcataaagtttgtctgctatagagagctgtgcctgctctgaacaagatgccttttagctgcccagaacccacccattccataagggcagaaatgatatttaacaacacacactacaaaggactctctcataattttccttgttctagaatttgatcatacaaagattgcctaaaaaaagccagggctgagatgacatcttactaaactctcatgaaaggtttattgtaacaataattgcaacctaatttgacgtattctgaaagacgctcctgcatgattagccgacagctgttcctccccaccacac

SEQ ID NO: 86320 - DNA, 398 bp, Homo sapiens
tcaaaggaggaactaaagaacagctcacatctcccaatgaaacggctggctctgaagtcaggttgagaagattcactccatgactagaggcaaggattaccacacatttcagggaagtatccagtataaaaagagaacaattcaaacttttttgtaaagggggaatttgatttggatataaaagacaaaaatagattaaaaaaaaaagcaccagaaaactttaaactaattgccctctgagagattagaggttttattgcatccataataaaaacgaaaggctatgaagaaataaaaattacagaatataaaggagctcttggaaattagaaatgattatcaaattaaaaataaatacaattgtactgtaaagtcaacaaaatttcccaaagtaagag

SEQ ID NO: 86321 - DNA, 816 bp, Homo sapiens
  misc_feature (798)..(799): n is a, c, g, or t
ggcacgagggagacatggccagacatgactcctgcttccccttaggaagtaaatcttacttatggttgtgaactgcttggagtccaggatgcccagatgtgaggggcagatgaagggaatgttgctggaaaggtgccttttaaggctgctgagaatttctggactgtgtcctgatggacgcagcaccatcaaagcccagaatttctgaaaacggtgacaaggttaacataaggacaacaaatactccaccctgtcatggtatgtgaggtgtgggtgtggcggtttctgtgtacgtttgctcatacacgcacatccaaaagcctgtgcctcattcctggccatgggtgaggacttggtctgtcacggctgatgaggactcccacaaccggccaagttatgtcttattatacacccccagaaagagagaaagctgccttctggaggactgattccacatgctatattcagctgagttgatttctgtgtctatttcaacccataacctgaagaatgatcaccttattccttattcattaattttcttgattaatagggaaacttgggaatagctataaagtaaaacttgggtggaacctggggccctggcatcacacaagtgtgattaggatggtcaaggtcatcaggagtacagcctattatattcccacatcctgagaaaggtcatttctcccacacacgacaaagtcacagacatcctgcacctgccactaggcatcctcatcctactgacatgcccatttctccagttttcttaatctgagactcccttcccagttnncccgggcgagctcgatc

SEQ ID NO: 86322 - DNA, 2129 bp, Homo sapiens
ggcacgagggagacatggccagacatgactcctgcttccccttaggaagtaaatcttacttatggttgtgaactgcttggagtccaggatgcccagatgtgaggggcagatgaagggaatgttgctggaaaggtgccttttaaggctgctgagaatttctggactgtgtcctgatggacgcagcaccatcaaagcccagaatttctgaaaacggtgacaaggttaacataaggacaacaaatactccaccctgtcatggtatgtgaggtgtgggtgtggcggtttctgtgtacgtttgctcatacacgcacatccaaaagcctgtgcctcattcctggccatgggtgaggacttggtctgtcacggctgatgaggactcccacaaccggccaagttatgtcttattatacacccccagaaagagagaaagctgccttctggaggactgattccacatgctatattcagctgagttgatttctgtgtctatttcaacccataacctgaagaatgatcaccttattccttattcattaattttcttgattaatagggaaacttgggaatagctataaagtaaaacttgggtggaacctggggccctggcatcacacaagtgtgattaggatggtcaaggtcatcaggagtacagcctattatattcccacatcctgagaaaggtcatttctcccacacacgacaaagtcacagacatcctgcacctgccactaggcatcctcatcctactgacatgcccatttctccagttttcttaatctgagactcccttcccttgttttttaaagataccgtgcttctccacatcctcatccttcaaggagcatattttgctcttaggatggtctttgggattcaagaatagaataataaatccaaacttggtcattcccattttgaagagatgcaagagggcccagtgaggacatccgcctccctgaaagtggtgctagacagagctgaggtcattgtatctgtgtatccacataggatttctcttaattcagcttgaattgatggggagggaggtaagagtagggtcagagttactcatcccttttcaaagaattgtgggtggaagtttgtaaaggccattcatttgattttcaaaatcaaagcgacagctctacttccacttggccttagatctctgctataccctgccatagccttgatgccactgggcacaagccacctgccaaatacaggagtggcctctcccagcctggcatgataggggggtctgtgccctcagatgtgttgacagctgctcttctgaattgccacacctgtgctacacttggaattctgtgctctgactctgcagggtaggaccacgtgccatctcacacagaggtcaaccgatgagcccactcactcgtacatgccttcttccacagtgggaagcatgatctggcaggggccgccctgtaggctggggatgggctgctgtgtgaatgttgacgttcgtttcatggagaaaggggaggtgaaagattgaagagcaggttcctgtcaatgttctgagttcgagctggaggtgtagattgaatagtctacatggtctgtgagtgtgtgagatgaacccttccatcctttgacacctggttgtatgtgtaggctaagaaggaaggaccctcctgtcagtgtgcaaagctgtaatctcatggactagaggagagggggccaaggggatggacaggagaagtcatgcagaatctaagcaggaatgcagatagaacacatctaggctcttttccccaggagagtgatgatggagcatatagatctggctcaaattcagcctccatcacttaccagtcaggaaccctggcgatatcactttaactttctgaacctcagagtcttcacctataagacggggaaaataataccaccctttcaagattgttgagataaataagtgatataaaacatgtaaagcttagttctggccacagtgtagctactcaataaatgataatactaccttctgggtcttatttttttcttctcaaaggaggtgactgtagggagggttggataccaagggctcacccaactcacttctgagagaaagatagagcctgctgcacacaaaacttacggca

SEQ ID NO: 86323 - DNA, 1783 bp, Homo sapiens
ggcacgagggagacatggccagacatgactcctgcttccccttaggaagtaaatcttacttatggttgtgaactgcttggagtccaggatgcccagatgtgaggggcagatgaagggaatgttgctggaaaggtgccttttaaggctgctgagaatttctggactgtgtcctgatggacgcagcaccatcaaagcccagaatttctgaaaacggtgacaaggttaacataaggacaacaaatactccaccctgtcatggtatgtgaggtgtgggtgtggcggtttctgtgtacgtttgctcatacacgcacatccaaaagcctgtgcctcattcctggccatgggtgaggacttggtctgtcacggctgatgaggactcccacaaccggccaagttatgtcttattatacacccccagaaagagagaaagctgccttctggaggactgattccacatgctatattcagctgagttgatttctgtgtctatttcaacccataacctgaagaatgatcaccttattccttattcattaattttcttgattaatagggaaacttgggaatagctataaagtaaaacttgggtggaacctggggccctggcatcacacaagtgtgattaggatggtcaaggtcatcaggagtacagcctattatattcccacatcctgagaaaggtcatttctcccacacacgacaaagtcacagacatcctgcacctgccactaggcatcctcatcctactgacatgcccatttctccagttttcttaatctgagactcccttcccttgttttttaaagataccgtgcttctccacatcctcatccttcaaggagcatattttgctcttaggatggtctttgggattcaagaatagaataataaatccaaacttggtcattcccattttgaagagatgcaagagggcccagtgaggacatccgcctccctgaaagtggtgctagacagagctgaggtcattgtatctgtgtatccacataggatttctcttaattcagcttgaattgatggggagggaggtaagagtagggtcagagttactcatcccttttcaaagaattgtgggtggaagtttgtaaaggccattcatttgattttcaaaatcaaagcgacagctctacttccacttggccttagatctctgctataccctgccatagccttgatgccactgggcacaagccacctgccaaatacaggagtggcctctcccagcctggcatgataggggggtctgtgccctcagatgtgttgacagctgctcttctgaattgccacacctgtgctacacttggaattctgtgctctgactctgcagggtaggaccacgtgccatctcacacagaggtcaaccgatgagcccactcactcgtacatgccttcttccacagtgggaagcatgatctggcaggggccgccctgtaggctggggatgggctgctgtgtgaatgttgacgttcgtttcatggagaagtcatgcagaatctaagcaggaatgcagatagaacacatctaggctcttttccccaggagagtgatgatggagcatatagatctggctcaaattcagcctccatcacttaccagtcaggaaccctggcgatatcactttaactttctgaacctcagagtcttcacctataagacggggaaaataataccaccctttcaagattgttgagataaataagtgatataaaacatgtaaagcttagttctggccacagtgtagctactcaataaatgataatactac

SEQ ID NO: 86324 - DNA, 1630 bp, Homo sapiens
ggcacgagggagacatggccagacatgactcctgcttccccttaggaagtaaatcttacttatggttgtgaactgcttggagtccaggatgcccagatgtgaggggcagatgaagggaatgttgctggaaaggtgccttttaaggctgctgagaatttctggactgtgtcctgatggacgcagcaccatcaaagcccagaatttctgaaaacggtgacaaggttaacataaggacaacaaatactccaccctgtcatggtatgtgaggtgtgggtgtggcggtttctgtgtacgtttgctcatacacgcacatccaaaagcctgtgcctcattcctggccatgggtgaggacttggtctgtcacggctgatgaggactcccacaaccggccaagttatgtcttattatacacccccagaaagagagaaagctgccttctggaggactgattccacatgctatattcagctgagttgatttctgtgtctatttcaacccataacctgaagaatgatcaccttattccttattcattaattttcttgattaatagggaaacttgggaatagctataaagtaaaacttgggtggaacctggggccctggcatcacacaagtgtgattaggatggtcaaggtcatcaggagtacagcctattatattcccacatcctgagaaaggtcatttctcccacacacgacaaagtcacagacatcctgcacctgccactaggcatcctcatcctactgacatgcccatttctccagttttcttaatctgagactcccttcccttgttttttaaagataccgtgcttctccacatcctcatccttcaaggagcatattttgctcttaggatggtctttgggattcaagaatagaataataaatccaaacttggtcattcccattttgaagagatgcaagagggcccagtgaggacatccgcctccctgaaagtggtgctagacagagctgaggtcattgtatctgtgtatccacataggatttctcttaattcagcttgaattgatggggagggaggtaagagtagggtcagagttactcatcccttttcaaagaattgtgggtggaagtttgtaaaggccattcatttgattttcaaaatcaaagcgacagctctacttccacttggccttagatctctgaaagctgtaatctcatggactagaggagagggggccaaggggatggacaggagaagtcatgcagaatctaagcaggaatgcagatagaacacatctaggctcttttccccaggagagtgatgatggagcatatagatctggctcaaattcagcctccatcacttaccagtcaggaaccctggcgatatcactttaactttctgaacctcagagtcttcacctataagacggggaaaataataccaccctttcaagattgttgagataaataagtgatataaaacatgtaaagcttagttctggccacagtgtagctactcaataaatgataatactaccttctgggtcttatttttttcttctcaaaggaggtgactgtagggagggttggataccaagggctcacccaactcacttctgagagaaagatagagcctgctgcacacaaaacttacggca

SEQ ID NO: 86325 - DNA, 2008 bp, Homo sapiens
ggcacgagggagacatggccagacatgactcctgcttccccttaggaagtaaatcttacttatggttgtgaactgcttggagtccaggatgcccagatgtgaggggcagatgaagggaatgttgctggaaaggtgccttttaaggctgctgagaatttctggactgtgtcctgatggacgcagcaccatcaaagcccagaatttctgaaaacggtgacaaggttaacataaggacaacaaatactccaccctgtcatggtatgtgaggtgtgggtgtggcggtttctgtgtacgtttgctcatacacgcacatccaaaagcctgtgcctcattcctggccatgggtgaggacttggtctgtcacggctgatgaggactcccacaaccggccaagttatgtcttattatacacccccagaaagagagaaagctgccttctggaggactgattccacatgctatattcagctgagttgatttctgtgtctatttcaacccataacctgaagaatgatcaccttattccttattcattaattttcttgattaatagggaaacttgggaatagctataaagtaaaacttgggtggaacctggggccctggcatcacacaagtgtgattaggatggtcaaggtcatcaggagtacagcctattatattcccacatcctgagaaaggtcatttctcccacacacgacaaagtcacagacatcctgcacctgccactaggcatcctcatcctactgacatgcccatttctccagttttcttaatctgagactcccttcccttgttttttaaagataccgtgcttctccacatcctcatccttcaaggagcatattttgctcttaggatggtctttgggattcaagaatagaataataaatccaaacttggtcattcccattttgaagagatgcaagagggcccagtgaggacatccgcctccctgaaagtggtgctagacagagctgaggtcattgtatctgtgtatccacataggatttctcttaattcagcttgaattgatggggagggaggtaagagtagggtcagagttactcatcccttttcaaagaattgtgggtggaagtttgtaaaggccattcatttgattttcaaaatcaaagcgacagctctacttccacttggccttagatctctgctataccctgccatagccttgatgccactgggcacaagccacctgccaaatacaggagtggcctctcccagcctggcatgataggggggtctgtgccctcagatgtgttgacagctgctcttctgaattgccacacctgtgctacacttggaattctgtgctctgactctgcagggtaggaccacgtgccatctcacacagaggtcaaccgatgagcccactcactcgtacatgccttcttccacagtgggaagcatgatctggcaggggccgccctgtaggctggggatgggctgctgtgtgaatgttgacgttcgtttcatggagaaaggggaggtgaaagattgaagagcaggttcctgtcaatgttctgagttcgagctggaggtgtagattgaatagtctacatggtctgtgagtgtgtgagatgaacccttccatcctttgacacctggttgtatgtgtaggctaagaaggaaggaccctcctgtcagtgtgcaaagctgtaatctcatggactagaggagagggggccaaggggatggacaggagaagtcatgcagaatctaagcaggaatgcagatagaacacatctaggctcttttccccaggagagtgatgatggagcatatagatctggctcaaattcagcctccatcacttaccagtcaggaaccctggcgatatcactttaactttctgaacctcagagtcttcacctataagacggggaaaataataccaccctttcaagattgttgagataaataagtgatataaaacatgtaaagcttagttctggccacagtgtagctactcaataaatgataatactac

SEQ ID NO: 86326 - DNA, 318 bp, Homo sapiens
actgaaagcctcaattcagaaccaaagctggtaggctacgtggaggtcatttctatatgaagtaaggaaacactttcaatgggttgtgtggaccaaaactgttgatgctgccttgggtgcagtgagcctcccatcacaaaaggcaataaagctgaggttgcacacccaccatacgtggttttccttcaagcatgagaagatgatcagataggacaattaataaagccttctttatgtgagagagtctggaattttatgaattctgcctgtggggaaccccaggcagcagccgcgtgccttttgaatatgttgcatttc

SEQ ID NO: 86327 - DNA, 349 bp, Homo sapiens
aaatcacatcccactgcagaaccagaattgtcattgatgaagctgggctactatcacctgcttccctggaatgtttggaggattgagtgggataatgtgtatcaaagcatctagcatagtctagcagaaagcctccatatacacgtccttctcccatggggcatagtcacaggtgggtgagagctgtatgatttgtccagggctatccttctggcagagatgggatctgaatttaatgcagggggacagtttttcatgatgctttcccccaagcgcagtggctcacacctgtaatcccagcactttggaaggccgaggcgggtgtatcacctgaggtcaggagttcaag

SEQ ID NO: 86328 - DNA, 238 bp, Homo sapiens
ctgtggaaaacaatctggcaaatcctcaaaaaattaaacacagaatgaccaaatgaggccgggagcagtgtctcacacctctaatcccagcactttgggaggccgaggtggacagataacctgaggtcaggagttcaagaccagcatggccaacatggtgaaaccccgtctctactaaaaatataaaaattagctacgcatgggccgggtgcggtggctcatgcctgtaatcccagca

SEQ ID NO: 86329 - DNA, 1448 bp, Homo sapiens
aagtttcctgagacctccccagaagctgagcggataccagaaccatgcctcctatacagcctgtggaatcatgagccagttaaacctcttgtctttataaattacccagtttcaggtatttcttcatagcaatgtgagaactaactaatacagagagcctcaagtttaaggctacctagcgcaaagacgagtacggcctccagttgccttgttcattggtcactatcctaagaaaatgtatacaatcatctttaaactattctctcctgaggaactaccctacagtggtgcattgtggtattagacatacaaagatgcagatcacacacatgggcctcagcctagtggtgaagataagactaaaaacagatgtatccaacaatgttgccagtgcaatggtaagcagggttctcaacagcggtgctattgacatttggggccaggtgcctctttgttggggctgtcctgtgtgctgtatgaaggatattaagcagcatccctggcttccaccaactagtagcgctcacctgtcatgacaatcaaaaatgtatcccaacattgccaaatgtccccttggagacaaaacagccctcagttgagaccactgggaaagacgcacaaggtatcacgagagtatagaagaggaattcttaagccagagaggcataatcaaagaatgcttctcagagaaactgtcatctgaactgagtcttaaaagatgagtctggtcaacgggagagggattccaggcagaggagagagcatgaatagtgaaggaaacagggtagtgtgatgccttccagactacaaacagctcgttgtaaggtgcaaggcagcagcaggggagatgagcctggagagggagatgggccccagatcacaaatgtcaggtttgggaatctgggctttattctagatgcaatcactcttcacatgattagagtagctatgccagccttgaatcttcataaattctcattaaatgtccctgatagcatttctatccaagacaatatttctgctatttcagcaatggtaatcttgctaaatttttggtcaattgccaatctctggtatcttctttttcttttctcctggctttttgtccttgaagcccatttttccttactcattgatcccttgacagacacaggaccagttctcctcatgccccatctacccatcttagccgagtcccgcagtcactcaatttccactattttcctcccaaaatattacatctcacatccagtaaacagttgtcatctcataagccataaaacaatcaatcaatcaactatcaattctgaaacttttgcttatttggaaggttagcctagggtaggtgtttataaaaaatttaaaaacaaagacaacaactggctacatggcctgaacgtccctgcagaggacatgtgttttcttgatctgacatacatgtccctcaa

SEQ ID NO: 86330 - DNA, 319 bp, Homo sapiens
ataattttcatttttccacaggagctcacaaatcaaaagttttcatattattatagagattctaacaaagtctgtggtttatgcataaatactctcctctgaaatatatcaagtgcagaggtgggaaaacccacagataatagctagcttttaaaattggcattttcatgctaagcattcattgagtctttcaatatgacagcatgttttgggttgtgtgaaagagaaattgtcttaaattagtctgtcttctcagtggaaaagaagacaaattgccaacttcctagtgcgtcaccacagtaagttatagaagttaagg

SEQ ID NO: 86331 - DNA, 428 bp, Homo sapiens
cagaatggccatgacgtgaaataggaatcgctgcgacgtgattgatgatgccctgggaactggaagttgaaaggactgcaggcttctgacgtgccacgcagacgactttatggaggcgaagcacgtgtcttctgctcagccactaactttggccagggctccagaggtatgtgtgctgctcatacattttagggatgtgctaaaaccagtgaaacctacagattttctctcctagacagcacgagtctcatcccacacgaggccgggaacccgtggtcatatttgcttcttcgtttagaaatttctctgggaatagacgcagttctgtttgagcagccatgagattaatgtctggctggcttttgatctccgacttcgtgccactttcatgtattaaaatgagaataaatggatagaattgtatgtat

SEQ ID NO: 86332 - DNA, 214 bp, Homo sapiens
ctgccttctgcacaggtaactcatgataacagtatgtggcctataattttcagctcactcgcgcttacctgcatgtatgtgcacagatgttagagagtgcttttcttcatttttgttagaaatgggataataaaacagacttttttttttttttttttttttttttttttttttttttctttttttttttttattcttgcgggggggggggggg

SEQ ID NO: 86333 - DNA, 347 bp, Homo sapiens
tcaatggaggatatgtaaggcagcaatctaacagcaatacaacactaaacgttccttgagaaaaacacaaacaacaggcagaactcatgtctgagtagaagcttcttagaagaactgagtagaacttggaagaaacatgtacctccttcacacacataatattgttttatactatgctatcttgttgtaggggtacgtgttgatatataaccccattttgcatgtgaagtcaatgggctcagtgggctcagagagatacagtgattgatttgttctagttcctttttttttttttttttgagacagagtctcactgtgtcacccaggctagagtgcggtggctcaat

SEQ ID NO: 86334 - DNA, 406 bp, Homo sapiens
ttacttctgtgcctctgtgtcctcatctttcaaataagagaaaaatactaactacatcacacggttgttggaaggattaaatgaaatatatgacacacttggtgcagagtagctatgaaaatgttagctgttacagtttgtaatacattgacacctcatatgaacaatggaagccattgttcccagcaaaggggaagccactgaaggtttttgaggagcacaatgtcattatcaagggagtaaggggaaacagcccagaacagatttagagtgcagaccctggactcagcctgtgtttgaagtttgactttagcacttactgcctgtgatgtcttgagaaagtaaaataaatcgctgatgtcttaggttccttccttatctagaaaatgattaacataatagtagt

SEQ ID NO: 86335 - DNA, 603 bp, Homo sapiens
tgcactccagcctgggccacagagcgagactccatctcaaaaaaaaaaaaaaaaaaaaaagtgaagtctttacataaatggattacgtgtgctgccctttgagaagtttgttgatgaaaggagaaaggaaatagtagcaccagaggaaaagatcagggatttaccctgttcttacaggataacagctccttgctcttttcagctagcttttcaaaggacagggataggacagccccctgccttatttcggatacttggatctataacctccagaaattcaagctgaagtagctggaggtcggagaggaatgagaactgcctgggtggggtctgccagccagacactgccaggatagccacaaggagacgacttggaagaacagacagcaaccacgttggactcaggcagtcctgggtttgaatcctgtctctgtcaccacctagcctgatgaccttgggcacatcctgagcaccctgtgccttatctgtaaaatggaaacaatcatgccgacctttcagggtggttttgaggattagagactagctcctgacacacagtaggtaatcgtaaatgggtgctattgtttggcccgacccacgtta

SEQ ID NO: 86336 - DNA, 732 bp, Homo sapiens
gagagggataagcatgtgagcaggaggtaagggagaggggttagttagatggtgggagaagtctctgctctggaagacattatctcttcctgttccctctacaatacctaaccatcctattcctttctatgcatttgcgtattttcgttattcacattgcagatgcattcctcatttttctcttccagccacactatgctcagctttccattccagctcaaatttttcttcccaaaagctcttccttgtaagccccgttcctggtgagttcctggtccaaggggactgttctcctcagttcatttacagccgtcactgaattgctctgctaatactttaaagcgtgttcagctttcctcacctggctgggtacctgctgaggaagatgtcccttcaatgtttggttggagtcttttgaagcagaacagacctaagacaaagctgtgaaagagggccccaaattatacccagtatctcctccttttaccactcattcttccagagttctctcctaccatatgtgcccacccagaatttgtccttgcaaggacccttcaacgctcacagcacagtctcatcttagcctgttctctcaggatgcaggtgcttactagctggaaaaccagttgatgctactgggtgtggactggtttaaaccagcggttctcaaccctggggctacacactggaattccctgggggttttgaaaaaaatgtgaatgtacagatgtc

SEQ ID NO: 86337 - DNA, 171 bp, Homo sapiens
gtacttccagccccgctcctgtgccaggaaccggcggccctccgagccctccggagccggcctccgggccccgagcgcggcgagtccgcttgcccgctcgcccgctcgctcgctcgctggtccatccgcctcctcaccttcaggacccggatccctcccggccggcggctc

SEQ ID NO: 86338 - DNA, 172 bp, Homo sapiens
ccagaaaattcatcatgactaacaaggagtcatgctctttggagagtggctgagctgtttataaatcaccacgttgagcacccgcccgggcaagacgctttggctgagaatttccacgtgtcctgtgtttatgagcgtgtgtgggggagagaaatggataggggaggggcga

SEQ ID NO: 86339 - DNA, 371 bp, Homo sapiens
atcgagctggttgtcttcttgcctgccctgtgttgtaaaatgggagtcccttactgcattatcaaggggaaggcaagactgggccgtctagtccacaggaagacctgcaccactgtcgccttcacacaggtgaacttggaagacaaaggcgctttggctaagctggtggaaggtatcaggaccaatgacaatgacagatacgatgagatctgctgtcactggggaggcaatatcttgggtcccaagtctgtggcttgcattgccaagctcgaaaaggcaaaggctaaagaacttgccactaaactgggttaaatgtatactgttgagttttctgtacataaaaataatgaaaataatacaaattttcctta

SEQ ID NO: 86340 - DNA, 637 bp, Homo sapiens
ctcactaaatatttgctcaatgaatagatataaattgaagcttaggattttgtaacctgtatttttactctaccaaaaaaacacgaaaatccactgaaatactgctagtcatatacaacaattacatgagaatagacaataagtgatttagccttagtagtgcatactacacacagctgtaaacagccttccaataaacctctagcactataatgtgtatacagagtttgggtcaccatgtcattatttataggccatttttaaatactgtaacacaaagctatagtcactttccaacaagttcatcacaaaaatatttatttagagaattaattattttaagatcattaaagttgagattccaagatattcattcactataagggatttgtagcgctggatcattctatttgtatacgcgttgtctactattggctctttacatgccagggactcagatagttttaatgattaacttcatatccaggccaaaaccttaaaaaaacactgcaaaaggctgggcgcggtggctcatgcctgtaatcccagcactttgggaggccaaggcgggtgaatcacctgaggtcgggagttggagaccagcctgaccaacatggagaaaccccatctctgctat

SEQ ID NO: 86341 - DNA, 396 bp, Homo sapiens
tttgtggagatggggtcttgccatgttgctcaggctggtctggtctcaaaactgctctgggctcaagtgattgtcccactttggcctcccagagtgctgggattaaggtgtgagatactgtgtccggctatgaaaattttatttttaattaacttgtatatatttatggggtacaatgtcctatttctgtacatgtacacattgtggaatcaaatcaggctaatatatccatcacttcatatcattagcatgaatgagaacatacaaagccactcttagaaaattttgaaatttatgttatttcagcccttttatgctggaggttgcaaatgttttgtgaataatcagaccaaaaataaaaacaaaaaatgattgacttcagtcattcagtaagaa

SEQ ID NO: 86342 - DNA, 325 bp, Homo sapiens
cctcttacatgtctcaaatcgtacagagatttatcttactgcagtcacacagctcagcatcccaactctgggtgatctcaggaaagaacatctcatttaaagcaataataaccagtttaaatgtaggcagcctcagtgctacatgaccaaccagatggatcagctgtttacttattgagtccactggttcttttggcgttgttttaaggtggcttcttgaatgttaaaggaacaatctaggctctatctgaacctccttttgcatctttcattggtgacatgaggagcatacataggccatgtgtcctcttgtccttcggtatct

SEQ ID NO: 86343 - DNA, 187 bp, Homo sapiens
tggcatctgcctaaccttctccaaagagtaaattccttcacagcaacaactgccctgaacactttggaaaatgctttacatatatttggtgttcacgtatttgctgaattgaataaaacttacttctagaaagttaagtaatattatcattcaaccttataacaccattgataaatataaatgccat

SEQ ID NO: 86344 - DNA, 514 bp, Homo sapiens
acttgtaattaggctgcctaggtttgattatgctcatcccttctgacctgtgtgaatcaaggagaattgcataatctctcagtatctcaatttctcatccgaaaatgatcatgacaacggtgcctatatcagatcaacctcataatcattgtattgtttaggataatacctaatatagtaagttactaattaaagttagctctaattattttctatactttcaaaagagaaagacacacagagcctttattggttcattttcacactgctaataaggacatacccgagactgagtaatttatgcagaaaaagaggtttaatgactcagttccacatgtctggggaggcctcacaatcatggcaaaaggtgaagaaagaaaaagacatgtcttacacagtggcaggcaagagagtttgtgcaggggaactcctatttatgaaaacatcagatcttgtgagacttattcaccaccatgagaacagtataggggaaactgcacccatggttcaatta

SEQ ID NO: 86345 - DNA, 199 bp, Homo sapiens
ccatcccttcctgccttaaatcctggtgcttacttcttttccttacaaattggattaatgtcctctatggcaatttttttccagaatggggcacttccatctaatggggcacttccatctggcatttagggccaggcacagtggctcacgcctgtaatcccaacagtttggaaggctgaggcgggtggatcacctgaga

SEQ ID NO: 86346 - DNA, 526 bp, Homo sapiens
atatctgctttcatgctgcttccattctagtggagtaatacacatcgcaaaggaatggtcatttattgattgagcgtcttttaacaattcttgtcttgaaaattaactgattttagtattcaggaaagtatccaaggaaataagagacatatttttcttctttagttcttttaaataaatttcagaatttttttttaaatgtaagaagttaatgttagaaccctgatactgtatctaaggaaggaggtcgtgtagaagtgtttctctccttttgtgtctttttcatttacaaatgtagggggtagagcttacacttccagagtaatcatcacgtgcaaacgaatgctcattgccaatcagattgcaagtggagtttcacaaatttggtatacaaaggtctatagaaaaattggccaggcacggtggttcacaaatcccagagctttgggaggcagaggcaggaagattgcttgaggccaggagctggagaccagcctgggcaacataccaaagtcctgtctctaca

SEQ ID NO: 86347 - DNA, 393 bp, Homo sapiens
tgaagctctgagtccagggccctcacccaggacatcttggtgcttgggccaagatctgaaccaggtctgcccaagaacacagcctgagttcttgaccaatatcgcctccctccttgcaaaaggtgttctttccagccacctcctccctcaagcatggcagtcctgaagtgcccatactcaagttggctttgattttggggatattcgccagtgctccagactgcagagttgtcactacccaggggagaccagcctgatgcctcctgacgtcccaggaggtggcaccgtctctgaccttatgctcaggaagttctcctaacccgctctgggtacctccagagctgtgtcagagccagtcgggatcaggtagaatgtggcttgcccagggaggct

SEQ ID NO: 86348 - DNA, 251 bp, Homo sapiens
aagaatcttctgttatttggatgtgtaactttatcgaattttttgaatttctaaaggtagcacagaatgaatctctcttttctcaccttatgccagaaccacccccatcccccaccaaggttaaatttgacttatatcccaagaaatttttcatttttatagtattatttgttacaacagaaattcgtatgaaatagataatcaaaataggacttaacccttagggattttaattatgagagcactataga

SEQ ID NO: 86349 - DNA, 324 bp, Homo sapiens
gaaatgcaggttcagctatttgctgcttgcagagtccagttaataaaagtgagttctggtataaagaaagtgattttttttttttaaattattccaaagctagctgaggggaacaagtacaggcttcctgcctaggggtatcactttgcttttggagcaggaagtaagcacttttaaagggggcttaacatgaatggcacatggggtcgggggaagtaagcaagtgcagcatctacatgttagtttggtaccttatctactaggtagtcaaggtggtgactgcctgtgtctttgtgggcatgtgtactttgggttgtaaattga

SEQ ID NO: 86350 - DNA, 863 bp, Homo sapiens
gtttgttacccagctctcacgggtcactgttctttgttgcctgatgcccaatgtcttgaaaacattttttttttgtcttgtttttgtggtagtctcagataggagagtaaatttggtccctattactctttcttggctggaagtaaaagtctagctttaatgttttgatcttgttttatatttaattctttaatctatctggaattaattttctcgtatgccctggagtgccttttttccctcttgtcacactgttctaccttgcagctggacacgttattaggtaataaatgctggttaggtgatgtcttttcttgctagtgggttctgaattgggagcccacgaggtccctgacaagggcaggcagtgctcatggagtgttggtcacaccacccagtgcccctctatcatttaggactgaactatgcagcctctggatgatttctttggcctgactcttgatgtttttaatatctctgccctcctgattgggagagtgagtggcagggaattcaccttttttgagggaagcaaagaaaacataatttgttgggagattaacttagcgcctggacttttgaaaaatttcggaaattgttttgcagccaccatgctcaatttcaaatgagattgtaacttccctgctcagagcaggcagctccttttggaactgaggagccgatacctacctgcctagcaggaaactcccctgacggttccccctttctctctgtattagtccattctcacactgctataaagaaatacccagccagggctgggtgcggtggctcatgcctataatcccagcactttgggaggccgagacaggtggatcacgaggtgaagagattgagaccat

SEQ ID NO: 86351 - DNA, 230 bp, Homo sapiens
catatatttaataatgatgaaactcaactttcagtattatttaacaaatcatgtttttatctctctaaagtcatttgggaaataccataaaaatatcttgctatgaattgttcaattggttacttatttgccctgtcttaattcagttttaaattctcttaatctagataatgggcagctactgcaatctactgtcatggaaataaaataacattttgtggaaagatgaa

SEQ ID NO: 86352 - DNA, 276 bp, Homo sapiens
cgtctcccaggttcaagcgattcttgtgcctcagcctcctgagtagctgggattacaagcatgtgccaccacacctggctaatttttctatttttagcagagatggggttttgccatgctggccagggtgatcttgaactccagacctcaagtgatctgcccgcctcccagaatgctgggattacaggtgtgagccactgcacccggctgaggcctttttcttctgtgcgttcctgctgtcttccctccaggcagcagcaagctggtaggagctgt

SEQ ID NO: 86353 - DNA, 180 bp, Homo sapiens
cacgtcaaggacgaggtgccagctggtcattgaaggatggtggggctccattcagcagaggtgggggctgtgatgggggtggatgggtgtgtgaggtgattgggtttgtgtgtgatgagtgtgtgtgtgtgtggtgcatggtgtctgtgtgatggcccagtgtgtgtggctctgtgtgca

SEQ ID NO: 86354 - DNA, 315 bp, Homo sapiens
accccaacagggaagagagatcccatagatgtggacgctctttagtacgcatcgtggcatcctcctcccagtgtgtgtagaggggtttgggctcactgtgaatgtcctaggaaaaccaactctggggtccaaagccctgaccactcccttcttcttaacagctccctgggtctctcagatttcaagggcttaacctgtacagaggggcttaccctttgtatccctgtccatgcagatcataggtgggcctccctggggtgggtgcagctctgacatattaattcgtttaaaaaaaaaatcagatttgtgttattg

SEQ ID NO: 86355 - DNA, 209 bp, Homo sapiens
ggagctgaaaagcataattccttaattttaatatttatttttttcctgtggactgctgatcataactagaatataagaaatgccattttaaaactctgagatttgagtttattatgattgactctgtgtaaataggattttgaatcaaatctagccttcattctcagtctcccttcatctattctgtctgtatcctccgatttcctaaa

SEQ ID NO: 86356 - DNA, 328 bp, Homo sapiens
  misc_feature (196)..(196): n is a, c, g, or t
  misc_feature (214)..(214): n is a, c, g, or t
  misc_feature (263)..(263): n is a, c, g, or t
gtaacaaaagatgccaaaatatgtattatttcagtaagaaacattcatttcttggtcatcctacatgaatagcattggttaaggtgtgaagattgccatgctcctcagcgtcagtaaggaaccaatgttatggaggcttcatcggtttttagtgacgtcatccctagaggttgctgtggggttagagccccacagnctacccgactgcattctnccctagagctttgagcagcagggcactgaagcgagccattccccctgtngcatgcccccagtagcgtcggacatctgtcagctctctaaacacttctagcattcctttcagatc

SEQ ID NO: 86357 - DNA, 384 bp, Homo sapiens
actcttaatattcctttaaaattaaataattgtttccacagctcttaaaatagaatttaggaacctagcaacatgccactcatccattaacagtgataaattatttaattttataaacttttcattaaagtaactgatatagtttggatatgtgtacctgcccaaatctcatgttgaattgtaatccccagtgttggaggtggggcctcacgggagttgactggatcatgggggcagctttctcatgaatggtttagcaccatccacttggtgctgttctcatgatagtgagttctcatggtgtctggtcatttaaaagcatgtggcatggctcacacctgtaaccccaacactttgggaagccaaggtgggcagattgcttga

SEQ ID NO: 86358 - DNA, 500 bp, Homo sapiens
caaatgcacccaatctgatggagggaatctttagtgggtggggaatcctaagtgaagtatggggagaaggaaatgaaccatggcaagggagggaaaggattacttggaggtcttagttgaagggttagcattgaggggcgaggaggggctctctcggtataggtaaatgacgctaggacaggcagctgagaagaactgctgctctccctacggcaaggaaatccaaatggtatctcctgagcctgatcggagttctcctctgagttcacgaaggcctgctctctttcttagaattagtctttcaccattgtaggtgcaagattgcggtgtttgcaaacaccgcaatcttctccaaattgtttcatgctaccactcccaattaatctttccattttcgtctgcgtttagtaaatgcgttaactaggctttaaatgacgcaattctccctgcgtcatggatttcaaggtcttctaatcaccttcggttcaatctcttcctaa

SEQ ID NO: 86359 - DNA, 1370 bp, Homo sapiens
gaagctgtcctgaaggcctggacccctgcacagaatgtggttatttatcagagagttggatcaagggtcaggtgctagaaagccccaactgtatctagtgtggcatgcaaagctctttggtcagtttcctaatccagttcctcagaaaactataacaaagcaagaacttaagtcagtgtcttgtgttctcagacttttcgatttgatatgaagggtgaaagatcctggctggggagttatgaatgaatgaatgaatgaatgaatgaatgatctttagcattggccttcaattccagcccccccaccacatctcttccactgccttctactactagtaactggtgactgctttttcaccacctctgactgacccgtaccttttctttgcctgttaaaatatgctaataaggaaacatacttccatttcttttgaattgaggggcccataacttttcatttagaacttctatccctgatgggaaaaatagctgtatatctattggttgttatcttggttacagtagcctgattggagttcccctgtacaaatataatcttgtgtgtgtgtgtgtgtgtttaattgataggaggatatgggaccagaaatgtatggagaacaatttcacttaaaggttattggattggggtaagaatatgggtgtacaccaaaaaggagggagtataacagatctaagagaaaagtgccctgagggataaacaaggagtaagagataaaggaagaaaaataggaagggaagcctggtcatgcctttggtgttggcacctgcattatatttccagtaagaagtatgcgctgtggtctgaagataagcggtgcttccaacagggttatttactcataccaaagaacaatagtcctttgctgtacagggattattaatgatcagagggaaacagctttaggaaaatccattactaccacaaagcaataaattcaccaacaggccacacatttctctcctattcagacaaagcttagcatagataaaagagacctcgttgttcttcctctgtttcctcctattcaggtaacatttgcctttgttaactctcagtgctaagtgatgttacatggattatttcatgaataatccttacgactctgaaaggggttctgctattaccccattgtacattctaagaaaccaagtctcaggcagttaataatttgcccaatggggtaaagtcaagattcaaacccagccttgtccgcccagagcccaaaataaatgttcatttattttgtattatatctgctattccttacaaatgggacagacattccctactctgctatacagggcaagaacatctggttgctctgacattagcaagagcatttcaattct

SEQ ID NO: 86360 - DNA, 637 bp, Homo sapiens
gttatgaatgaatgaatgaatgaatgaatgaatgatctttagcattggccttcaattccagcccccccaccacatctcttccactgccttctactactagtaactggtgactgctttttcaccacctctgactgacccgtaccttttctttgcctgttaaaatatgctaataaggaaacatacttccatttcttttgaattgaggggcccataacttttcatttagaacttctatccctgatgggaaaaatagctgtatatctattggttgttatcttggttacagtagcctgattggagttcccctgtacaaatataatcttgtgtgcgctccggtgctggtatgatatatttagaatgggtgtgcttgcctcctgtgatcttgtttgggatagacattttagaagtctttcagacattttttgttttggccccgtgttctaaaaacttcccatattacagggcctaaactaaattattttcccttaggtaaaataaaaatgccatccaccctctcctccctgccccctattgctgacagaccatattcttatcattttctgtgtaaaaagatgctgtttcataaaatagctgcggtatgattaagtataccacacaagcatatcctgaaatttgc

SEQ ID NO: 86361 - DNA, 303 bp, Homo sapiens
gattcagattcagtctcctgatgtgtcaattagctgcactttgttacatgccaaagataatacttaagtccatccagttagagtaacaagaacaaaatgaatggatgagtgtaagaattccaccactattggctgcgcgaggtggctcacgcctgtaatctcagcactttgggaggcctaggtcggtagatcatctgaggtcaagagttcaagaccagcctggccaacacggcaaaaccccatctctactaaaaatcaaaaaattagatgggcgtggtggcgggcacctgtaatcccagctac

SEQ ID NO: 86362 - DNA, 516 bp, Homo sapiens
agataataatacacacgaaaaatcatgttttactgtagctgaaaaatatatgaacaggatataaaaattgaataaaaaacatttgaaaattataggtgagatgagtagggattaaaaataatatgactataattatagaatgcctatggaacaattttatgaacatgccaaggatatgcctaaataattgagatttttgtaagtaatgatgagagaggaaaaagtaattgagatattatcttttatattctaaaaaaaagtaggaagagaagctggtggtggttgacaactttttccctggttaaacaatactcatttctctaagtcagtagttaaggaactttgtatttaataaatttctggaaaatcttccccaaaaccagtttagccattgtaatatttaaattaaacataaaacttgtgtcgttgttaacaaaaagccaaatcactaccaaaagaaaaaaatctgagtgtatgtgcacacatggttaagaataaagaaatctggtataccta

SEQ ID NO: 86363 - DNA, 379 bp, Homo sapiens
tgatgaccataagcccatgcttttcatagatgtttaagggttaaatgaggtaatgcatgtcgagtgctcagccaactgagattcaggaagcgctcaatagatgctggctgtcattattaactgagtaagtaatccttttcccacagaagcagtagaaggctgacgatgtgtgtgaaaaggatggatacaattccctgggccacaaataaaggtttttttggttgttgttgtttaaatgaactgaaatgagtttgggagattcatatattattttacaatacttcttaatgctagtttaaaaagttcaacattgtcattctactccacttccgtatgagataagtatatgaggagcttaattccagataaactaagcaag

SEQ ID NO: 86364 - DNA, 364 bp, Homo sapiens
taagagacaggaccttgctatgttgcctagtctggacttgaactactgggctcaagcaatcctcccacctcagcctcccaagtagctgggactacaggcacatataatcatgcttggctttttaaaaacattttgcaggcagtcaccaggttatgtttaacatgcaagtcctggcctacttttattggctatggttccaataatagttcaactttcataacttctgtggtgttattttcatctgcttgatttacctagttccactagagcttccagtaatccctactggtgccacctaagaggacagaaggagctgatctagaccaggcacatgtgaggagatacctacccccattggtgttgc

SEQ ID NO: 86365 - DNA, 230 bp, Homo sapiens
ttcaagaccagcctgggcaacatgagaccccatctctgcaaaaaaacaaacacacacacaaggagctctttaagactaaagctgactaaagggacctccactaaatgtgacccaggattctctgctgctgtgaagataactggaaaaactggccaaacctcatacgaaggcctatagattggataacagtgctgtaccaatgttcacctcctgtgtccgtcacctcggta

SEQ ID NO: 86366 - DNA, 282 bp, Homo sapiens
ctctaaaactgtctttctcctaagactagaaagagcaagggagagttttctctgacaggtgcattgtagaaacatcttttacctaatattttcctgattatttgggctctcttcttatggcagccatattttgtgccaaatttattaagtccttagtggctgctgtggattttgccttctgagtaccttctacatttgattactcctcatttcctatgtcaaggtttttcactattgattaaaacgtaatctgatttttggaagctgctctccactgtagtc

SEQ ID NO: 86367 - DNA, 731 bp, Homo sapiens
taaaataatgctacttttatatctctgcttcttgagaagatgacaggttgggttaaaaaatagggacaggttaattaactttaattaactggaaagttcagggcaaaacacacagagctcctatctacctctaccattttccatttacccttgtgcagaaatgctttccctttctttagtatcttttaaacataaaagactggaaaattttaaatataggatttttataaagtgattaaaacagccactttgcagagaatacgttttgtcaacctttagtttagcaaagtaaattcttaggggaaaaacatttttcactccatgaataatgcagtttttttctttatagaaaacaatgagacaaccaggccaacattttaaaattttctttggaaaataattcctgaatttgaagctctaacaatacagcttcaaaaattcagaagcaatacacaccaccttatgatacggtttttgctttgctctagcagaaatcctctgaagtctcaatccccagcataatgtctcccagatgtctcaactagttgccatgccaactaaagcagcttaaattaaatgagggcctgaaaagacacctgcatcactccaggtctgttgcacattaaataaagctctcttgacagggactcagaggtgccattaacttgaacagcatctatctgattattgtttctgagaaatttaatgagggtctccaaacaagagtgaaa

SEQ ID NO: 86368 - DNA, 696 bp, Homo sapiens
ctgagggagaaggaaagggaccaagagtaggacattgtcaaacatggttttagtctcattttttacaaagaacatgtattaatatgttgtttgtctaattgaaaatgtttatttcttctctttttttcattctgataaatgtctgtcaatgttttatcacattaagtcatttggggaaacatatagttttatattaatttatttgcctgtactctcagaagtgggtatttaaaaaaactattatgtattagtaaattcactatgcttctgtaagatacctgctgttcaacatgaatttatggaatatttcttgagttatatttttattatgtatttagattttaagatctgtttgtttttatctagagcttttatgtgacagtttctttaaaatacttatatacctaccataatcttctttaaattcttaattctagtacattcctaaggtatttctcattctaatctttgtaaccagtttctcctcctttaacaaaattagtccatactaaaaaaatattgctttcttgttgggactatcctgtctctggctttcttcaaggccttctatgggttgaaacttctctgttcagacttgtcaaactagtttcatttcaactacttgtaatttgtttccttatttctttgagccgtagacttctaatacatctagagatgtcatatagttgattagaa

SEQ ID NO: 86369 - DNA, 451 bp, Homo sapiens
tgttttctggcacaactgatgattttcatcctgtaaccttttttttttccagtttgctcaggtacttattatgctccccgatagagagtgtgacaacttggggtagtattaaagtatttgacaactgttgggagttatgggaacatgcccctttttgttaatagaggcgtaactgtaaccaaagaaatttaatttcttctttagcaaacactaacatttctgtttcagaatgagtgctagagaaagaggaaatatgacagttaccatgtatcatgaatacattgagttctctctgtaataactcaaaactgatctatagctaaaattaaaaccatataagcgtatcgtaaatcatcttgactatttctgtgttcgcttctaattctgtttggaataaggcttcaaatgctttccagaatgatgtgagttacaaataaatagaaaaagagtt

SEQ ID NO: 86370 - DNA, 319 bp, Homo sapiens
caaatgcaaaaatcaagacttgtcataaattgtatgtccatagcctatactgtttaaattactttaactttatagtaagtcttgatgtttaatacagcaaatgttaaaccaagctttcactacagaaataaacagaaatttataggcgctcattatccttttagacaaagttgtatttgctttgctattgtttttgtttaggatttttgcaactatttcacaaacagaaacaaaaatatttaaattgttaatagaaatttcagttttctttagtctctggctactccaagtactgttgctgtgaatgttcttttatgag

SEQ ID NO: 86371 - DNA, 950 bp, Homo sapiens
catttttctcttttaatctcttagtatgataatttacatttttggattttccagaaacatctttggattcctagaataagccagatttatcacaagtggattatctttatcagatatatggctgctcttgagttactaatcttttacacttttgtgtgtaaggaatgtttttaatctaggtgaaattttgaatctatgctcatgagtaagaatatcctttctcatactatccttatctggccttagtactgagctttagattatcttggaggtttcatttcccttcctgtaatgattctcatgcctcatggtgcacacaaagttcccctttgtaaattttgtaaatttcagcatgcgctcaattcaataattactttgtcaccaaaaattggcgtctcccattaaacagtgaatttgcttctattgacgttaaactctaaaatgaatcacttagatctaaaaataccttccttgttcaggttgtgtgtaataaatacttatttttgccaaagatatacagagctaaaaacagaagataatacctagggaggcttaaaaaacatgtaagctgaacatttggttaaatctcaacttttccctccttagattttttgtttctttgatattcttgattttaaaacttagtcaattcatgttctttccagtctactattgaaaatgttgttgaaaatgaagacagttaattttcctttgagtgcagccttggcagaattttttttgatgtttatggacacactactatttattgtcatttttcaatagtttgcaactgaaattctgaccttcttttattaaattgctcaatttttctgaagtgaaagaattatatattagaagtgtaatgtcgatatgtgaatttctacaaagcctgcatgcctaaggacaggtggcctgggtaaagagtcaaattggtagaaccaataaagaat

SEQ ID NO: 86372 - DNA, 905 bp, Homo sapiens
ccttcctctgtaacctgggatgactaatacccctccctgcggatatctgtggaattaaatgtatttatgaatgcagtgcctggcatacagtgggtacccaacaaatatcagctcctcactactcatggtcctcgctccagattcattcagatcactcctgactcctgacccttgacccaactgtgccttgcagattggagcatctctgatgtccagcaatgtgggcagtggcttgttcatcggcctggctgggacaggggctgccggaggccttgccgtaggtggcttcgagtggaacgtaaggaagctggcctggtttctccagaatactgagggtctaacccacctctgtctctggcattagtgctgggaggatccttagagatgcctgggaggctacatggtgaatcgagaatccatttcacaattgagaatccatttcacagatgaggaaatcaaggtctggaggagacagagggatccatccaaggtcacacgggaggactggggtcaggtcccaggtctcttatttctctgttcgggggcctcccacagcacagcactgcctctgggtgggaagccgcccctctgtctacatccaggacctggataccttcttcttctccccactctcccaggcaacctggctgctcctggcccttggctgggtcttcgtccctgtgtacatcgcagcaggtgtggtcacaatgccgcagtatctgaagaagcgatttgggggccagaggatccaggtgtacatgtctgtcctgtctctcatcctctacatcttcaccaagatctcggtaggtgtcactgcaatgtggtcactgtgtctggaaatgctaattagggaactgctgagtgcatcaccatgtgcgtgttgctgaggggaagctgacaatcac

SEQ ID NO: 86373 - DNA, 955 bp, Homo sapiens
cactaacagatgagcaaggagctggcagcaatggggcctggagcttcaggggacggggtcaggactgagacagctccacacatagcactggactccagagttggtctgcacgcctacgacatcagcgtggtggtcatctactttgtcttcgtcattgctgtggggatctggtcgtccatccgtgcaagtcgagggaccattggcggctatttcctggccgggaggtccatgagctggtggccaattggagcatctctgatgtccagcaatgtgggcagtggcttgttcatcggcctggctgggacaggggctgccggaggccttgccgtaggtggcttcgagtggaacgtaaggaagctggcctggtttctccagaatactgagggtctaacccacctctgtctctggcattagtgctgggaggatccttagagatgcctgggaggctacatggtgaatcgagaatccatttcacaattgagaatccatttcacagatgaggaaatcaaggtctggaggagacagagggatccatccaaggtcacacgggaggactggggtcaggtcccaggtctcttatttctctgttcgggggcctcccacagcacagcactgcctctgggtgggaagccgcccctctgtctacatccaggacctggataccttcttcttctccccactctcccaggcaacctggctgctcctggcccttggctgggtcttcgtccctgtgtacatcgcagcaggtgtggtcacaatgccgcagtatctgaagaagcgatttgggggccagaggatccaggtgtacatgtctgtcctgtctctcatcctctacatcttcaccaagatctcggtaggtgtcactgcaatgtggtcactgtgtctggaaatgctaattagggaactgctgagtgcatcaccatgtgcgtgttgctgaggggaagctgacaatcac

SEQ ID NO: 86374 - DNA, 764 bp, Homo sapiens
agcaacgactggtgttgattctcagtcaatttaaaggatgaaaagggctgtaaaactattttacggtaggaataatagctaccactttttaagcactatgttacagggattttaaatatattagctaatttaagcctaatggcagccttgtcaggtaggtacctttgtccccagtttatatacaactgcaaattctgagacaaaggatagttagacagttctgcctgatcccaaagccagtgctcttcaattcactgcagtaagccacctctctggagctgaaaggagacatgaaactagggacatgagataaatggattttttttctctaaagaattgccatttttctggatcttggatagagctttatcttgagaagtaaccacgcttgctcttcacagacaagatacagcaacatctaatatggagaaaaactgtgagcatttccacttctgattaatgaatcaaaactgaaccaataaagtctagcctttgtgacagttctttgtctcctccttggccaagaatttctgtacacactgagtcagagtgtcagcactctcttaacttggcgcacgcaacttgacatgagtcaccagaaggatttgaaacttcgggttggaaaaagccactgctgttaagttggtacagacaaaaatatttgggcgtcaactcttgtgttcctggatatagcttgttcgttcatctgtgtgttgattcattcaataaatattctaatgtacccaataaaatacaaaatactg

SEQ ID NO: 86375 - DNA, 2425 bp, Homo sapiens
cacctccgccgtgctaactcctcgctagctctccctctcacacacgctcacacccggctcgagatggcggcggcggcggcggcggcgggggactcggactcctgggacgccgacgctttctccgtggaagacccagtgcggaaggtggggggcggcggcactgccggcggggaccgctgggaaggcgaggacgaggacgaggacgtcaaggataactgggatgacgatgatgatgaaaaaaaagaggaagcagaagtaaaaccagaggtaaaaatttcagaaaagaaaaaaatagcagagaagataaaagagaaagaacggcaacagaagaaaaggcaagaagaaattaaaaagaggttagaagaacccgaagaacctaaagtgctaacaccagaagaacaattagcagataaactgcggctaaagaaattacaggaagagtcagacctcgaattagcaaaggaaacttttggtgttaataatgcagtttatggaatagatgctatgaacccatcttcaagagatgactttacagagtttggaaagttactaaaagataaaattacacaatatgaaaagtcactatattatgccagttttttggaagtcttagttcgagatgtgtgtatttcattggaaattgatgacttgaaaaaaattaccaattcactgactgtgctttgcagtgaaaaacagaagcaagaaaagcaaagcaaagccaaaaagaagaagaaaggtgtggttcctggagggggattaaaagccaccatgaaagatgatctggcagattatggtggttatgatggaggatatgtacaagactatgaagacttcatgtgacattttatcttttcttggtgtcatctttatgttgcccacaatcccttgaacatgtagcacaacttcctttcctttcagttctgccaaatgctacaatcagaagtgcagtatcttttgtgctggttaaaattgggaacctaagttgctactaaatcatagttcaaaacctaataatgttgtcgttgttgctatctgatttcatagcagcagtcactaaattggaaacaaaaggttgcaacgtgacaaaaaaaattgtgtagtatttaccagcaccattcagtaatacagccttaaccatacctccttgaactacttcataacttgtcaagaaaagcagtttgcagcaagggcatgtggtgtgcacctagtattaaaattgctttgtcttaaaattgaacatgaggatattaaaaatacattgtgaagaatactgcttatctcagagtgaagatactgcggctgaaaagcactagtttgatataaaattaaaatgaccaaaaccctccaactttgaagctaaagaaggtaaacctttccattattgcattacatgttgtggaatctctcgagtgcaaagactgtctagttatttatcaggctatttctactgatgaactgcttcaggtgggggagggaaacttatttttatttgcctgatttaagtgtctgagaaacaaatctttgttctcttaggctgcaatggaacaactttaccagggttttggcatttcctttcctttcctttataaaacatgctcagcaaactgcaccagttaactacagtttggtaaattgttatgttaacaattatgacatctgcaatgttttataaagcaactaatttaataaaatcactgttgtgaggacttaaattttgtgttacctcccaatatatactttttgagagtatagaacacagctcttgggagtacagttctctacgttctctactaaatcttaataaatgcttggacatagttacagctttaaaacatgagtgatttgccaggtccttatgttgtcaccatagagcaacaaaggtatagggctgccttcctcttatttatttggggacattattttgttatttagataccaaggcctaattaattaagtacctataagaactatttatttggagtaactgagcctgtaactcaggtttatggctgttaagtatagattggggaatctttattatgtcttctcctaagcagtttaaccaaatgtgtggttagtgtttttttattcccctaagacagaaagaacaaaaaatgttttaaatttctcttatataggaaataataggaacgtcaaagctctgtatacctactaagtggaaaacaagaccatcatctaagtgatttgagaaattaacaaaagtagtgactacacagcaataattacagtaaattaaataaagattcctttaaggcagacaagggctaagatttccttagcagtaataatgacatacactgaattgaaaatctattttattacagaaagatcagtttctaacaaatgaaaatgtatcacctgttccttaactgtgtaaataataattaaatttctttgaaactgg

SEQ ID NO: 86376 - DNA, 254 bp, Homo sapiens
atgaggaagctgacataaagaaagattacgtaattgtctaaggtcatacagcaaataactggcattcctggaacccaaattccaggtgtcttgttccaaagcccatgttctttattctattctgcctctgccaaacaaaacccaaaccaaaaatgtcttcttcaaaacgtcttcatagaatgtgaccaacagcatgtccccatctactattaggagtcaaactgcaaatagccccacacagagcatctttgcat

SEQ ID NO: 86377 - DNA, 407 bp, Homo sapiens
gttgtgaactgctgggatgtatgtcacagctgatcaacatgtgaagatactggtacttgatagcctgttaaggaaaatttgcttccaaattttaagctggaaagtcactggaataactttaaaaaagaattacaatacctggctttttagattttctttacgtgtgttaagaattgtgtacaaattgaaatgtctgtactgatcctcaactaataaaatctcaattatgaatgaaaaaataagtagttttgcaggaggcctgatgtgggctggagtcactctgtgttctcctcctacagcagggcctcactctcctccccctcagcagccgactctccagttggggtcttctctgttggggattcagtgtccctgggataagaataacagtgccaaggttttgattc

SEQ ID NO: 86378 - DNA, 454 bp, Homo sapiens
gagaaatctccaagctgctttccacagtggctgaactagtttgcattcccagcaacagtgtattttattttctccatagactgaggagaatcagttctggttttttcttttgttttgtttttttgttttgcctttttaattattgctattctgactggtgagagatggtatctcattgtggttttgatttgcatttctctgatgactagtgatgttcaacgtttttttcatgtttgttggcctcttgtataccttcttttgaaaagtgcctgttcatgtcttttgcccatttttatttagactgatttttagcttgttgatttgtttaagttccttgtagattccggctgttagacctttgtcagatgcatattttacaaatattctctcccattctgtaggttgtctttttatgctgttcataattttttttttttgttgtgcagaagctcga

SEQ ID NO: 86379 - DNA, 261 bp, Homo sapiens
gtttttttttttttttttgctttttgttttgtttttggtaaattagctgtcaacatgctaagctgaaatattccagcatctactgaaaaaaatgaaaggtatggcaacactgagtccttaattcccaagcggcaacaatgtgcaggacctgagtacccagctgccacctctcagctggcacatctgctgggccccattatcctctttgagacctgagggacagtcattatttgtaattcttacgctgttgcttttctcttt

SEQ ID NO: 86380 - DNA, 346 bp, Homo sapiens
gtcttcagtaggcttgaatttacctaatcgtcctagcatttggtcgaagtgtctccatctcatcctcatgctcacaaaatgccccatgactccctctctcctagggctggttgcccccacaatgtgcttccatcattaacagcccattgttttattttctgtccattgctttcgtctgtctccccagtagactaggtgcattctgagaacaagaactgaatcttatttaagtctttgaatttccagaacctacaaaaattgtccaaatatacacaaaggcataagaatgatataatagactgtggggactcaggggaaattggtgggaggggggtgagggataaaa

SEQ ID NO: 86381 - DNA, 448 bp, Homo sapiens
ctacaaacaattgttttgttatattaatatttctctgctgagtaacatttggccaagacttaactacaaccattggatggcagcctaaattgccacccgctgaggcaggagaatggtgtgaacccggggggcagagcttgcagtgagccgagatcgcaccactgcactccagcctgggtgacagagcgagactctgtctccaaaaaaaaaaagaagaagaagaagaagagtgaacatacgtgaattgagattggtgttgtgttaaatgaaacaaagaaataatttgacatatatgtaatatattttttcagctggatgaatgattactatacatagatgttaattgattcatgtaaatcaccagggttacagtttatgggagccttttaaaaataagtgcaattacataatgaccaagtctgtagggaggtcttaccgcctttagaaa

SEQ ID NO: 86382 - DNA, 323 bp, Homo sapiens
tgccctctcatgttcgaaatgatttttatctatatgtttagaaaagaatcctaagaatttcaaatggcaatatctttgtttccaaaagtaaatcagaaggttttgttgctgggttttgctttattttttaaaattttaaattagaatagagatgggatctctctatgttgcccaggctgctcttaaactcctgggttcaggcgatccttccgcatgggcctcctgaagtactgggattccgggcgtgagccaccgcacccagcctgctttgttttaatatacctgcctgtgataaacagatggcagcacaggggcctggagta

SEQ ID NO: 86383 - DNA, 480 bp, Homo sapiens
tactagcccatttttgtcacatcagacagcataatctttaaaaacataaatcatattactctgtgagttaaaaatgtgccaataatttctacagtcacatcagtattcttgttcttggaatactgcaaaatttaaattttgatgaaatccaacttatctgtttttccatttgttgcctaagcttctgataccatatccaagaatccactgccaaatcggagttcatgaagatttattcctgttttaagtgttttattttcctgtatctattgagatgattatgtggtttttgtatttttactattgatatggtctactacattaatagatttttggatgttaatctaaccttacattcctgggataaatccctcttggtcattgatatggtttggctctgtgtccccacacaaatctcatcttgaattatactcccataattcccacgtgttggagggactggtgggagataactgaatc

SEQ ID NO: 86384 - DNA, 375 bp, Homo sapiens
cttagtcacttcatggcagaggtgagaacatgcttgtggaagagaagtccgtggcttggtgattctgcctgacctgcagtctctccatctgtgcagggtactaatgtgtcggagctcagggttccagaattcgtctagagaccggcaggagctcctccaccagttgtcatttctgtcttgcccgtctgtcagggttggaaaagtccaaaccttaggacccagtttcctttctttcctgatgttttcctgccaggacaccggtaggctgttacttgccttgagctggaagaagtttgcatttacactgtaaatgtattcattgttttaattgatgtaaggtttttatgtacaattcttaattctttaagagatgac

SEQ ID NO: 86385 - DNA, 828 bp, Homo sapiens
  misc_feature (749)..(749): n is a, c, g, or t
  misc_feature (754)..(754): n is a, c, g, or t
  misc_feature (824)..(824): n is a, c, g, or t
actaagtggtgatgagcatgagtaacaattggaaatctcatacattgctggtagaaatacaaaatggtaaagccatttggaaaaacaataggcaatctcttataaacatactcgtccatttgacatagcaatcctatttttaggtatttatccaagagaaatgaaagcatatccatacaaacacccgaatgtgaatgctcatagtagcctaattcaaagtagccctaaactagaaacaatccaaaagtctaacaactggtgcatggataaacaaattgtggcccatccacataatggaaagctacccagcaatggaaaggaacaaacaagtgatacatgcaacaacatggatgaatctcaaaagcactgtggtcagttgaaaaaaaaaaaaggcaaacacaaaggagtacataccatatgattccacttatatgacattctagaaaaggcaaaactatagggacaggaaacatcaatggttgccagggactgtgggtgaggagaggagacttgactataaaggaacatgaggaaatttttcagggtgacagaaatgttctgtatcttgatatggtggtgtaaaagtgaggtataatttatatacagtaaaatgcacaagtcttaaatgtacaactcaattaatttttacgtatgtatacaccatgaaaccttcacccacttcaacatacagaccatttccttcaccctggaaggacccttgcaccttattgaatcaatacctagtcctncggangtaaccattattctgatttctaccccatagattagtttgcttgatttgatgtcatatgaatggaatcatntctt

SEQ ID NO: 86386 - DNA, 301 bp, Homo sapiens
catggaagagaggatagttctgtaaaaacacgtaaaataactttcaaagatgaaaattttacatatgtaaaaacatttgtcaatgaaagtaataataattccattcatgcatttgttcatgtataaccaataacttacttgtgatgccatagaaaaaattcaagcatcaaactgaaaagcaaattttaataggtaagaaactagtggcctttaagctgacaatatatttgtttgaataaaaaatattattattttaaaataatcaaattagcaaaatacaaaaaaaagaacatttcacatg

SEQ ID NO: 86387 - DNA, 336 bp, Homo sapiens
ggtttttttgtaacagctttgagatataattcacatactacataatttgcccatttaaaaaataaattcattggtttttagtgtattctgtgttgtgcatccatcatcacaattttagaaaacattttcatcacccccccagggaccctctactctttagcagccatgcaactccccttccttatttcctgcattgaacccagccccagatatccaccatctgtagaagtgcctgttgtggacatttcatataagtgaactcatacagtatgtgattctttgtgtctggcttctttcacttagcataagtttccaaggctcatccacattgtagca

SEQ ID NO: 86388 - DNA, 796 bp, Homo sapiens
tgcaaagagatgaacggacctgtgcagacggctggccagtgacgccgggatctctaggtaacatgacccagtcacggtgtcacagacaggcggaccaggaggaaaccagagacacagatggattccagggaaagccagcgttacagaattaagaaaagctggggaagaaaaaggaaaacgagaatttccaaaactgccgctttcccagcagaagggagatgaagttgtcactttggctgcgagggtgcagagatggaggaagggttgggggtggggggtggtaccgcaagggagaaaaatagctataggcttcatcgcaaaggggttcatgcagaatacgcgaggccggcggctaactctaagattgctctctcgttattctgtgcctggtgcaaaacccactactcaggggacaacacatcccagcataaagaatgaaatcatttcagcagcgagggctgggcccgctagaccgtgaggctccggcggcttccgcccgttgtctggtgcaccccaccttcagaagcacctgcccaagatgggagcgactgaagagagaggccccagagactctccgaggggcggcacccccagattcccggccggcggaccaagttcgcagctctcaaaagacatgtctcacaccaagggccccgggcggggagaggagagaagaggggaggggagcagggcgctgctccagggcacctgcctgagctcgggcgcgatccccggccacaggcgcgcggggtcaccgccgggggaccgggactcagccctcggaaagtccgcgcca

SEQ ID NO: 86389 - DNA, 396 bp, Homo sapiens
actgcttgtcccatctcttgctaggcatctctgatcagcttttcttcccagtcttcacaacaacagtttcatacctcttcccttctcttttccagactcctgctcagtcttggcagatgaactcttctcctactttacatgggaaatgaaaagtaacatatggaaactccctcatcttcctgataccaagcaaataaacctacctaaacccatccaagcttccttgcatcctaaggcaaatctcccactggtgctttgctttgtatcccatcacttctagtttattaagaaagttaactctattgattatcctcccttttcttttatattcagcctcatcttatcagtgggatgttttccatgtgtttttaaacagacccaggtttcccccattaa

SEQ ID NO: 86390 - DNA, 105 bp, Homo sapiens
gatcaaatattttttattaacctatataaagaatttgactgcttatgattcaatacatatgatttaataaaatagattgcattttttaaaataaagaatgatttg

SEQ ID NO: 86391 - DNA, 518 bp, Homo sapiens
ccgcatgtttcctcgcgcttcctatctatgctgcaactatatccattaaccaacctctcatcatcctccccgtcactggtacccttcccagactctgcacccacaattctaattttctatatccatgagctcattttttttcagccatcacatatggttgagatcatgtggtatttatcattccctggcttgcttatttcacttagtgtaatgtcctccaggcttatccatgttgttcaacaagccagagaatgataaataccatgcggtgtacgtatgatatactatttggccataagatagaatgaaaatggaatactatctggccataaaaaaagaaaaaaaagaatgaaatcctgtccgggcacagtggcgcacgcctgtaatcccagcactttgggaggccgaggtgggcagatcacttgaggtcaggagttgaagaccagcctggccaacatggtgaaaccccatctccactaaagacataaaaattagcctggcgtggtggcgtgcgcctg

SEQ ID NO: 86392 - DNA, 690 bp, Homo sapiens
ggttctagcgattctcctgacagcctccccagtagctgggattacaggtgtgcaccaccatgcccagctcatttttgtatttttagtagagacagggtttcaccatgttggccaggctggtaactcctgacctcaagtgatctgcccacctcggcctcccaaagtgctgggattacaggtgtgagccaccacgcccggcctaacctgtctttatagcaggatatgctcacagttggagtgttttcaatacattgtgtattccgtggatttgttttaagtaaaatcaggcacttgagttaactccttctgggtgttaaattagtgatttatacaggaaagttggaaaaggtggttagcagttaacacaggaagttcaagagtttatggtgactttggaatattatttgaattactaatttaaagtgatttagtatctgttacatattattgaataaagtagaaagtgttcttggagttttacttaagaatgtttaactgagtcagttaataccggagaaaatttaactgaatcattcagcttgcatataatactgtgcagctacatcgggatggcatatttgatttttaatattagatttgatatttaatattttaaaaattaggtggcaaaggagaaactaaaaaagtaggaaaggggttcctgtgccttcagtgtgttaaaaagccagc

SEQ ID NO: 86393 - DNA, 538 bp, Homo sapiens
gggtgcaggttatcaacactatttaatactggaagcactagccaatccaactgcacaagaagataaaggtacaaatatttcagaagaggtgagaaagtcatcattaactgcagatactatggccatcttcggaaaaaatactaaaatgctgtccaaaaaaaccagtaaattcacttaaggctgccatttacaaagtatgtgaagtcaatcactttttatatgcagataatatgcgacttataatggaaggtcacgtttcaatagcaaacaaaaaagctataagtaacaaagaataacaaaactataaatgtataggctctacataaagaaaactataattccataaaggatctaaaataaaacgagtaaatggaaagacaagatgtgttgtgagatacgaagaatccatgattaagttagaggattcttggatgacagtagagtagaaagcaccaagaatgagtctgtatacccagagaacacttacgctggtagaatctatctcatacaactattatgaagctctcaaagtatactg

SEQ ID NO: 86394 - DNA, 1309 bp, Homo sapiens
aatgctttggagtgggaatgagtgccagactgttttctaaagtttccctagcattttgcattccaattacaaatatgtgagagttccagtagctttgtatctttaccagtatttagtaattttgtattatacatatatatgtatgtaaatatatatatatattcatttaaattttaatcattgttagaatttgtaattccccaatgatatatggtattatcttttatttgtttataattgacacataattatttatgggatacattgtgatgtttcagtacatgtgtacattgtataatgatcaaatcaggatatcacctcaaaccttatgatgatcttacagttaaagatgatatattcttgcaaagtgtctgttcagatcttttgctcccctttttattggattattccttttcttactgtttttatatgttttttaatatattgatacaaatcctttgtcagatacattatttggaaatagattttcctagtctgtgacttgtcttttcattctttgaacactgacttttttagagcaaaaattttaattttgatacaattcactttatcaatttttttacttttgatgtgcaatgtaagaacacttgtctaacccaatgtcatgaagattatatattattttcatccaggaattttatagttttaagttttacatttatatctatgatactttttgaataaaggtttgtataaagttagctatgggtcaaggttcagtttttaaaatatggctatctaattgttctagtaccatttgttgaaaagattgtttcttttttattgcattgcttttgcacttctgtcaaaaaatcaattgattatatttgtttgggtctaattctgggctgcctattctgttccattgttatccattcacaaataccacactttcctaatcataggaagtcttaaaattagatagtgtgtacaacttcgtccgtctcaaaaatcgtgttgattactactttgcttttccagaaattttagaattgttgctttctataaaaaattctgctagtatatctgttgagttagaactatagatgaatttgaagaaaatttacatcctcacaatattttgtctttaggccacaaacatgatatagctgtatatttattttggtcttgcttttttttccactttcagcatacagatcctggacatattttatatttataccaaatattttatatattttctactgttgtcaatggtagtggtttttaaattttcaaacattcattactagtatatagaaataaaatcactttttaaaaatgtaat

SEQ ID NO: 86395 - DNA, 865 bp, Homo sapiens
aggagtttcccacaatgcagcgcggcgcgctgtccccggtgctgatgctcagcgctgccccggagcctccgccgcgcccgcctcccgccctctccccaccgggctcgggcccaggctcgggctcccgccatggctcggctcgtcccggtcctaccccagagccgtcggggagcctgggcgcggcgctcgacagcagcctgcgtgccgccgtggcgttcaaggcagagggccagcgctgctatcgagagaagaagttccgggaggccatcggcaagtaccaccgagcgctgctgcagctgaaggcggcgcagggggcccgccctagcggcctgcccgcccccggcccccgggcccaccagcagccccgggccggcgcgcctcagcgaggagcagcggcgcctggtggagagcacggaggtggagtgttacgactccctcacggcttgcctgctgcagtcggagctggtaaactacgagcgcgtgcgcgagtactgtctcaaggtactggagaagcagcagggcaacttcaaggccacctaccgtgccggcattgccttctaccacctgggcgactacgcacgcgcgctgcgctacctgcaggaggcccgcagccgggaacccacagacaccaatgtgctccgctacatccagctgactcagctgaagatgaatcgttgcagcctccagcgggaagacagtggggctgggtcccagactcgggatgtaattggctgaggccaatccagggggacctctctatccctcgccctcccacctcaccatgtaacttcccccgactcatgtgtttgttggtaaaacacttgtcactggtgatcataacttgtgtggtgttcttggggggacc

SEQ ID NO: 86396 - DNA, 653 bp, Homo sapiens
gagggcagacacaacactcagttttgtattaagagccaatgaagaaggaagagggattacaacaggtgcagggttgtgggagccgagacgagattagttttcctgttaagtggctcggagagaacagacttcttgcagatgtcgctggaggatgagaagtgtgacgggagcctctgcgaagaggcattcctggcagagggtgccgcaaatacaggcgcacagaggtgtgcgatggctccgctgtgactggggactgccgactgtgactggggctttggggaagggctctggctctactggctgtgtgagcgagctgctggatacttcggagaatggggtgtgagccagggaggtgtggaagtcacctgctgccccgggacacccagatgatgccctgcccacctcccctgcagacaccaatgtgctccgctacatccagctgactcagctgaagatgaatcgttgcagcctccagcgggaagacagtggggctgggtcccagactcgggatgtaattggctgaggccaatccagggggacctctctatccctcgccctcccacctcaccatgtaacttcccccgactcatgtgtttgttggtaaaacacttgtcactggtgatcataacttgtgtggtgttcttggggggacc

SEQ ID NO: 86397 - DNA, 807 bp, Homo sapiens
aatgcagcgcggcgcgctgtccccggtgctgatgctcagcgctgccccggagcctccgccgcgcccgcctcccgccctctccccaccgggctcgggcccaggctcgggctcccgccatggctcggctcgtcccggtcctaccccagagccgtcggggagcctgggcgcggcgctcgacagcagcctgcgtgccgccgtggcgttcaaggcagagggccagcgctgctatcgagagaagaagttccgggaggccatcggcaagtaccaccgagcgctgctgcagctgaaggcggcgcagggggcccgccctagcggcctgcccgcccccggcccccgggcccaccagcagccccgggccggcgcgcctcagcgaggagcagcggcgcctggtggagagcacggaggtggagtgttacgactccctcacgggtacgccgtcggggggtggggggatggggcacgaggggagggggcaatcgggagagcttggcgacttgggggccaggggccctggggctgaagggtccagggctgtgggcttctgggggagccttcagagcttgatcaaggaaagggattaggggtaggggatgacaggggtctgtggctggagggagctgggatgcaggaaatggtctttgggtcgggtattcagggcctcgcttcccctgagtcattctttccaccccctggccgcacgtggacccaaggtgaggaagtctgccctgagccaggctctcgaggtcccggccctcgcccccgcgcggggccttagtgctcttgcccaccgacagctctgggtggatc

SEQ ID NO: 86398 - DNA, 396 bp, Homo sapiens
tgatctagcaggatcttagttactggcatttgatcaacggagtttcgccattttggccaggccggtctcaaactcctaacctcaggtgatccacctgcctcggcctcccaaagtgctgggattacaggtgtgagccaccattcccagccaacttctgccatactctattgatcaaaatagtcaggactttctataatattatgaaaaggcagaaagggagattggatgggtactggggattgattagccacagtctttgccacagactcttttggactgagccgataggtcaaaggttagcttatgcagtagcatgggctgtaggttttttgcactgatcaacaccggaacttttagaagacttttagaagatttgttgctgctgtgagtgacatc

SEQ ID NO: 86399 - DNA, 378 bp, Homo sapiens
  misc_feature (38)..(38): n is a, c, g, or t
agaggatctcgtactggcatgatcatagagtcgcattnggcagccggtctcaaactcctaacctcaggtgatccacctgcctcggcctcccaaagtgctgggattacaggtgtgagccaccattcccagccaacttctgccatactctattgatcaaaatagtcaggactttctataatattatgaaaaggcagaaagggagattggatgggtactggggattgattagccacagtctttgccacagactcttttggactgagccgataggtcaaaggttagcttatgcagtagcatgggctgtaggttttttgcactgatcaacaccggaacttttagaagacttttagaagatttgttgctgctgtgagtgacatc

SEQ ID NO: 86400 - DNA, 772 bp, Homo sapiens
agcgggttctctgccccctcccagctctggtgtgggcggcctccgctatggctgcgtgtggcggaggcggcatggaggcggcggcggcgctggggggagctgagcgtggcggcggcggccggcggggggctggtcggcctggtatgctaccagctgtacggggaccccagggccggctcgccggcgaccgggcgaccctcaaagagcgcggccacggagcccgaggacccgccccgcggccgggggatgctgcccatcccagtggcggctgccaaggagacggttgctattggcagaacagacattgaagacttagacctttatgccacatctcgggagaggcgatttcgtttatttgcttctatagaatgtgaagggcagttattcatgactccgtatgattttattttggctgttacaacagatgagcccaaagttgccaaaacttggaagtcactttccaaacaggaattaaatcaaatgctcgcagaaacaccaccagtttggaaaggctcatcgaagctatttcgaaatcttaaagaaaaaggtgtgatttcttacacagaatatctttttcttttatgtattttaacaaagccacatgcagggttcagaatagctttcaacatgtttgacactgatggcaatgagatggtggataaaaaagagtttttggtgcttcaagagatattcaggaaaaaaaatgaaaagagagaaattaaaggagatgaagaaaagcgtgcaatgctggtaagaatactttatagtagct

SEQ ID NO: 86401 - DNA, 881 bp, Homo sapiens
agcgggttctctgccccctcccagctctggtgtgggcggcctccgctatggctgcgctgcgaaggctcttgtggccgccaccccgggtgtctcctccactctgcgctcaccagcccctccttgggccgtgggggcggcctgcggtgaccacccctcaaagagcgcggccacggagcccgaggacccgccccgcggccgggggatgctgcccatcccagtggcggctgccaaggagacggttgctattggcagaacagacattgaagacttagacctttatgccacatctcgggagaggcgatttcgtttatttgcttctatagaatgtgaagggcagttattcatgactccgtatgattttattttggctgttacaacagatgagcccaaaggaattaaatcaaatgctcgcagaaacaccaccagtttggaaaggctcatcgaagctatttcgaaatcttaaagaaaaaggtgtgatttcttacacagaatatctttttcttttatgtattttaacaaaagccacatgcagggttcagaataggctttccacatgtttggcctgtgggcctgggatgtggtcaccacacagtttgggggcttccagaaaattttcggggaacatgggacgcgaagaatttcggggatgaaaaaaccgtcacagcgggcctggggcacctgaagtatgacacccattgggcctggggccatagtagagttacctttgggcccacccacaaagttcgaaaaggagcagacacaccacacttagtcggacacagctaaatgtgacgtcagccggtatcgaaaaacccactaaccaaaggactaaaaacactctgagagcaataatcatatctacccttcattcgcctactggg

SEQ ID NO: 86402 - DNA, 918 bp, Homo sapiens
agcgggttctctgccccctcccagctctggtgtgggcggcctccgctatggctgcgctgcgaaggctcttgtggccgccaccccgggtgtctcctccactctgcgctcaccagcccctccttgggccgtgggggcggcctgcggtgaccaccctgggccttcctggccggcccttctcctcccgagaggatgaggagagggctgtggcggaggcggcatggaggcggcggcggcgctggggggagctgagcgtggcggcggcggccggcggggggctggtcggcctggtatgctaccagctgtacggggaccccagggccggctcgccggcgaccgggcgaccctcaaagagcgcggccacggagcccgaggacccgccccgcggccgggggatgctgcccatcccagtggcggctgccaaggagacggttgctattggcagaacagacattgaagacttagacctttatgccacatctcgggagaggcgatttcgtttatttgcttctatagaatgtgaagggcagttattcatgactccgtatgattttattttggctgttacaacagatgagcccaaagttgccaaaacttggaagtcactttccaaacaggaattaaatcaaatgctcgcagaaacaccaccagtttggaaaggctcatcgaagctatttcgaaatcttaaagaaaaaggtgtgatttcttacacagaatatctttttcttttatgtattttaacaaagccacatgcagggttcagaatagctttcaacatgtttgacactgatggcaatgagatggtggataaaaaagagtttttggtgcttcaagagatattcaggaaaaaaaatgaaaagagagaaattaaaggagatgaagaaaagcgtgcaatgctggtaagaatactttatagtagct

SEQ ID NO: 86403 - DNA, 273 bp, Homo sapiens
gtgtgatttcttacacagaatatctttttcttttatgtattttaacaagtaagtatacttattgcttttatttctggatgcagctttattttttaaacgaatcttggaaagcagatcttaggttctcttactcttgaaaatcaatatccatgctgttctgcaaaattcatgtttaatgctacagaaaaatgctaagcatagcactgtaaagagtcaaaaacataaatgctacagcttatggtatagtaataaatgctcataaattataaattt

SEQ ID NO: 86404 - DNA, 616 bp, Homo sapiens
acataaaagtttggttatgagttatggttgtagatggttagcaaatatggatatatattccatgaagtatttattatctaattatcttacatttgtttattttagttgccaaaacttggaagtcactttccaaacaggtgagttaaagctcttggtagatatacacaaattttatatgtgcatgcatatatacatatataattaaaatatatttcataaaatatattatgtatttttatatattttatgattttttggcaaatcaaatcacatcagagttcctttttttatcctccagattgtcagaaaataaaaaggtggacgtttctaagggctggtgaaaatgtagattactggtaaatctcatgtgttggtatactcactttggaaaacaatttggcattatctactaaaattggcgatatgcctaccctatacctagtaaatacatgcctgcatttaaattctgcagtagtgcatgcgcatgtaccttgtaaagttgaacttgaatagactctgtgatctagtaatttctactaaatacactggtatctagcatataccagtgtatatacctagggaaattcttgcttatatgcaggagaggttcacaaga

SEQ ID NO: 86405 - DNA, 757 bp, Homo sapiens
tcactaacgaggacgctgtatacgacatcgctaatgaggacgttgtatatgacatcgctaatgaggatgctttacaagacatagcgaatgaggttgctgtatatgacatcgctaatgaggacattgtatatgacatcgctaatgaggacgctctatacgacatcactaatgaggacgctgtatacaacatcgctaatgaggacgctgtatatggcatcgctaatgaggatgctgtatacgaattcgctaataaggacgctgtatatgacattgctaatgaggacactgtacaagacatctgtaaaaaagaagatgctgccaatgtaagacacttttctttgtcttgaacagaaatgttactttcctggcttctttccaatcagatgtagacatgaacatctgccagtgtgcattatcgatgtcatctgcagtttaatcaaatgtagacatgaacatctgccaatgtggactatttatgacatctgcaattcccttggtgtggtgctattgattggcagcctctcaccaacccatgccaggcacactggggtgtggtagatggcagcatccacgatccactgcaatgcagaggtgtttccctccacagcagttttcccccatggattaagagttgtgaaactgccaatctagatacactttaaagataaattctgtgggaaaaggtcttgtcttttccacaggtgtcttccgtgccagttttgggggactttgacctttgactcaatcactatacccc

SEQ ID NO: 86406 - DNA, 333 bp, Homo sapiens
gatctaattggcttttattagcaattcatgagcccggcagcatccagtctacaaaatagaaaggagtgccaataagctagacagaatggatgggttttatggcagaaaaaagtggaagcaagcaagaacaatgaacaaattaatggatggattgttttaagattacatttcttttatgggagtaaacaaaatcttgttagcctaatggaatttggcatcatctcctgatttctcagaaggtcatatcttgtaagtgaaccatttaggtttggtgacctggaaccttggcataagtgactccattttgggcctgctgccttttctttaaaaaag

SEQ ID NO: 86407 - DNA, 1329 bp, Homo sapiens
tttgttaactgttgatttatcaagagaaactattaggccacatgttcatgtttcatagttcaggaacacaagtcaaagacaaacttctgtgtattaatgattcagtccaaagaaattctttatattccaaaatcactttgcactctgaaacataatagcactcttcatctcagattctttcatggaatcataacttctgtagaaatcagcatgtcctttctgttttggttcagccacagcaaacagagagctgcaaccccagggatataaggaatgctcccacaatatgaaatcacagacacttggccagaagaccacatatctgaggttttgtcaaagcactgaaagccatattagttattgtctgctactttaatataaagcacatctataattacacaacaaatttgtttttaatattttgataactttcaataaaatggcttccttttgtaatcctttatattttaattttaacattttctaaaaatcacccataaggtttgggaattatatctcaatacagctattatttagagtagtctaatgaccagactgccaaagggatccatggcttacaaaaaggttaattgtattagttcgttctcacgctgctatgaagcaacacctgagactgggtcatttataaaggaaagaggtttaattgactcacagttccacatggctacagaggcctcaggaagcttacagtcatgtaagaagcaaacacgtccttcttcacatggtggcaggagagagaagtgcagagcaaagtggggaaaaaccccttataaaaccatcagatctcctgagaactcactatcaggagaacagcatgagggaactgcccccaccatctgatcacctcccacgaggtccctcccccaacacttggagattatcattcggattacaattcaagatgagattttgggtggggacacagccaaaccattatcagaacccctgagttaaatagtctttcatgttgtattctaagttctctgatatctccaaatccttattagccatgataccctctcttttagagtaattccactggcttttgttagttgttattcccttcctaaatattttgtttccagtttgtaaacatttttaagagaagtgaaacgcaggcttcatctaacctaaggagctctgcttgaagctcttcccttgattaatcaaaagaaaaaaatactagaaaagactaaacatcaatcacactgctttgttttaatgttacctaatcattaatggtttttcattcctcacgtatttcttgatggcctactatgtgccagataccatggattcacgtttcag

SEQ ID NO: 86408 - DNA, 492 bp, Homo sapiens
gtacctactgtatgctgggtacaaagctaggcacactggatacaaaggtgaacaagaatccctgccttaatgagtttttacaatctacgatatagactttgtcttatcaacagtggtactttcaagaatacagatttactaacataaaggcaagtaacagcaaagaagacagagtctgggaaattcaggtattagggctttcccattctttcctctaactcatctaaggtcccaccctcaatcattctgcttataaggactgtgactgtttctccaaagaatagtgcagattgcaaagggtcattgtcccaacaaagcagtcaactgaactctcagcactaaagttaatcagatgcctcagagtcaaggaatcttccacaatcttttaaaggaattaaattcttaattttgtgagaaaacagcgaaagcacacaatggcgactcgtcttttttgatcttgcatttgatttctggagtggcaggttaattcac

SEQ ID NO: 86409 - DNA, 400 bp, Homo sapiens
cgccctggtctctgtgcttgctcattcctccgtgtctgaagattatatagttgccttcacccagacccctgacaccagccccaaaccaggcattatggtggcattttggggcacttgcctcagtgatatttagaaaccaaaggcagttttgagacaggaacagttggaagggtatgtcattgccttcctgactctgtaaggcccatagtctcatataaagacagactcagttagtcggttcatgccagttttactactctcccattaggagggcacactgcatccttcagtgcagggttttcaaccttgccactactgacatgttgggctggataattctttgtagtgagggactgttctgcgctttgcaggatgctcagcaggatctgtagagtctacc

SEQ ID NO: 86410 - DNA, 360 bp, Homo sapiens
cactgaagataaatggttcatctggagtccaaccacgaccccccaaaatgcagtaagccttgtaggagttacagtgcctaaaataaccaaaaaattctaatagccttctgccaaaggtgctggcagttcttggcttgttttatagaaacagattttatgaagtaatttggtattatctattttaggtaatgaggctatgactgaatggagtttgctgtgagtacaagacttcactgtcaagttttgaagacatttgaataggttgctgaaatgtttaaatgcaagaaaacactgctgaaaactgaacttgagtaaaattaacattgctatttttagtttaaaaccatgcaaaattttctg

SEQ ID NO: 86411 - DNA, 286 bp, Homo sapiens
gataaaagagaaacagcgaagtttcaagagaaaaacttgaggtcttaataattgttgggcaacttgacagcagaacagggtaaaaatgagttagctacaaaggctcatcagaaaatggcaatagattccagagagatttaataactacttacaaactctgctataggtgacaaatctgaccatgataaaagcaccgtaaatgatataggtaacactgagcatatgaaaactcagactgtgcactagataaaaaggaaaccaacatacagtgttaacacatgtaaat

SEQ ID NO: 86412 - DNA, 151 bp, Homo sapiens
ggacactgtgatgtggctaggtgagagcacactggggcactatgatggggttaggtgagcgcacactgggacactatgatgaggctaggtgagcgaacactggggcactatgatgacgccagatgactgcacactggggtactatgatgag

SEQ ID NO: 86413 - DNA, 757 bp, Homo sapiens
aaaaaaaaaaaatcaatcccacccttcattcaggaagtagccacctacctaacagaagaaacacctcaaccctattcataagccccagagcttaagtgacaacttaagacatattaaagaaactcaccaacagttcaatatgctgagtttcaaaatcaaactaggaaattctatgccccacccaaccaaatactcaggaaccttctcttcaccataaagctcaaatcccatttgagaacactgaccagaagtcaggaaatgcctgattgaattcacgaagccccacccacctggtaggaaggtcaatcttatgctcagaagtcccacccaccacccgagaagtcttcactttccctcccagggcccatcacacacagtccaatgcccactcagttaccctgacatccaacccactcaagaagttccacctagctctcggtaggtcccactcatttacatcttccaggaagtttccatccccgttcccatcactctcagccagctcaggaagtctaacacctttctagataccacaacaggcaattcagaaagtctatgcaccttcccaggaagccaccccactcctgtacaagtcacaccttcgagccaattctgagactccactggtctgcttggttactatgatattcagctcaggaatttcccccaaaagctctaccttccacagccaaatgaagaagtctcctctccacttcaggaagtatccatcatcctaaagtcctaacttccatcaaga

SEQ ID NO: 86414 - DNA, 398 bp, Homo sapiens
aaaaaaaaaaaatcaatcccacccttcattcaggaagtagccacctacctaacagaagaaacacctcaaccctattcataagccccagagcttaagtgacaacttaagacatattaaagaaactcaccaacagttcaatatgctgagtttcaaaatcaaactaggaaattctatgccccacccaaccaaatactcaggaaccttctcttcaccataaagctcaaatcccatttgagaacactgaccagaagtcaggaaatgcctgattgaattcacgaagccccacccacctggtaggaaggtcaatcttatgctcagaagtcccacccaccacccgagatcgcaccactgctctccagtctgggtgacagagagagaccgtctccaaaaaaaaaaaa

SEQ ID NO: 86415 - DNA, 424 bp, Homo sapiens
gttcttatagaaactaataatttattacagagtaaacatccgataaatattgatataattggtgtattggtactgggaggccttggaattaacgtctgtcattatcatctgtcctggataagccaagcagagcactgaagctgtgatgtgggccctgagtccttgagtttaacttccagtctcatgttcttctaaggtgctttctgtgtatcctaactgagacaaggttagaataagtccaggcctatttttattgtactgggataaaggaagattgtattgatttcctgagcatcttcagggaacaatatttagggattcatatggaaactttttttggacattgctttgcaatgacaaataattaaattgtagcagattttaaagcactagtgttcagcctaaataaaaacaggtggtgtct

SEQ ID NO: 86416 - DNA, 620 bp, Homo sapiens
tccagtcatgcatttggtctttatttcatagagctggagataactgtgttccttaccttcagtttcctacgggtaaaatggaagtgattgctaccttgcaaagtacagacatacctcggaggtattgtgggtttagttccagactacaataaagcagttcatgaatttttttggcttcccagtgcatataaaagttgttggctgggcactatggctcatgcctgtaatcccaacactttgggaggccaaggcaggagtgcttgagcccaggaccagcctaggcaacatagcaagacactgtctacaaaaaaataaatagccaggtgtggtggtgcacacctgtagttctagctactgtggaggttgaggcaggaggatcactttgaacccaaggagttggggctgcagtgaactatgatcatgccactgcgctccaggttgggtaatagcaagaccccatctgtatctgtaaaacagtaatttttaaaatgtagcctttggtgcctgggacattaaatgatagctgctatttgattatggggcccttaaaagttatgtaactaataatttgtgtagggggtaatgttaaaagcacaaaataaattgcataccttttattg

SEQ ID NO: 86417 - DNA, 432 bp, Homo sapiens
  misc_feature (312)..(312): n is a, c, g, or t
agtagagacggggtttcaccatgttggtcaggctggtctcgaactcccgaccttgtgatccgcccacctcagcctcccaaagtgctgggattacaggcatgagccacggcgcctggccctcccttttttattctctttctctgaatgataatgtacaattccacagttttacatatggtctatattattagttttaattcgattccacattcaacaaatagttgtctaagccatcttgggcaagtaatttaacactgagtctcagtcatctcatctgtacaatgggaaataataatgggcatcaactatatnaaaattattcagaggaattcaataaagaagttaggaggcagagccagggcacagtcagcacttatacacttgtttatttattattaggcgtttttactattgcggttattccaaaattcc

SEQ ID NO: 86418 - DNA, 144 bp, Homo sapiens
gatcaattcaattagattaaaatgaagaaccttggggcagagtttgggttttgtaaaatgaaaagagttctggagttaagcatcgtgaacatgcttaacactactgaactgtacactcattttataataaaactattaaattgt

SEQ ID NO: 86419 - DNA, 136 bp, Homo sapiens
acacacaaaacatactttacggtgaatatctgtttgatgaatggcatgttttcttcatcagatgataagagcaagcacccaatttgccacctttatcatcatatcccaaatgtcaaaaacagtgccaggcacacaa

SEQ ID NO: 86420 - DNA, 260 bp, Homo sapiens
atggagcagaatgtgccttgaggagggtggcaggaggtgagctctgtgagtcactagtggggtcagatggtgtagggccttgtaagaactttggccgttaactctgagggagaggagagagctgtgtctgctctaatacattcaggaaagtggcagctctgaagaccgaagtgcctcctggcttgcctctctccctcccgcagcctcttcctcttcctcttcctcttcctcttcctcttcctctccctctccctgaccct

SEQ ID NO: 86421 - DNA, 564 bp, Homo sapiens
cttgaaagcagaacgttattttggtcattgtaactcacttcggagacaatgcagcagctcctctttgctctgtaaatcattccgtggcctttgaaatttgggaacacaaacctgatctgatataaatctcagaattgttggagagggaaatctgccccaaacctgtgtcaaactgtgagtactagagttaaatactcttccatgaggtccgctcccacttctcccagggtgctggctctaatagagtcagaccaaggttctagcccaggctctgctcccaacatcccatagaactttgggcaaatcagttgatgcctgtggtcatcagtcttcccatctatcaaatgagttcaataagacataccctgccagcctctcagcttccagggtttttgagatgagaagcaaatggaaaataaacataaaccttctgtaaggatagcaaagtgctgagcaaacaggaaagcaaacataaaccttctgtaaggatagcaaagtgctgagcaaacaggaaagctttaattatattatctctccaatggcccacgcccctctcttggctga

SEQ ID NO: 86422 - DNA, 526 bp, Homo sapiens
cagagctttgctcatattctaagagcacaggtaagttctgttcttttgactgtggttagtttgtaactagttcctggagcttatcccaaaacattccgagatgacaacatgccccaagacaccagtgtttagctgaggaatttggaaaactctgaaaatttgtaccaaagaaaaaaagaagaaagcgaagcaccaaggcggctcacagaccacaccaatcttaaagcaggaggtggagcctgcaggccagcacagtgggctgggtgggcatcagggggtgcggtccactcacagccacctgccccagcacagcgctgtgcccacagtgcagcctgattgggtcaggggcaggaaaatgtcccctaattccctggagctcacttctttttttttttttttgagacggagtctcgcactgtcacccaggctggagtgtagtggcgcaatctcggctcgctgcaagctccacctcccaggttcactccattctcctgcctcagcctcccgagtagctgggactacaggc

SEQ ID NO: 86423 - DNA, 710 bp, Homo sapiens
agaagattatgaaagattatttaaagtgtgacttgtgtgatttctaaagctgtgttcattgtgttgtcagccagaaagctagtctaaatcaactcctagatcaaagcaagggctcctttttggcaatagactgctagattgaggaagcctgacttggttgtctgtataactttctcaaagtactaggtggccttggagcagttaccacagttagtcattaccttcttgattatgtgattgtgtggttaatagctatttcctccacttggtcacaagcttcatgaaggcacaagccttgctgttgtttcgaaaatcagcattgtggctgagtgtggggactcatgcgtgtaatctcagcactttggagggccaaggtgagagaactgcctgagcccaggagtttgagaccagcctgagcaagatagtgagacatcctctcttaaaaaaaaaaaaaaattacctgggtatgatggtgcacctataatactagctatttgggaggctgaggtgagaaaataatttgagtccaggagttcgaggctgcagtgagccgtaatcgtgccactgtactccagcctgggagatagagcgagatcctgtctaaaaaagaaaagaaaagaaaagaaaagaaaagaaaatcagcattgtatccccagaacctgctacagtgtactgtacacttaataaatattggttgaatgaatgaactg

SEQ ID NO: 86424 - DNA, 172 bp, Homo sapiens
tctgcgaattctgcctgcaccaggagctcctgcatccatgaggtgcctgtgaccacaccagggacagaggaggctgtcagcagcaccaccctccctacctggccagccttgccctgggatggattggccagagcctgcactcggcaggtgtgttgaccatgagcacagtcat

SEQ ID NO: 86425 - DNA, 363 bp, Homo sapiens
gatacagcaagctggccatctgcaaaccaggaacagggccttcaccaggaaccccaccagctgacatcttggtcttggactccctaccttccaaaactgtgagaaataagtttctattgtttaagccacccagtcaatagcactttgctacagcagcctgagtgaattaaggcagtccaaaagctttgtcatacgctgcaagctgcacaagtctagcaggcctagaacaatgggtgtctgtgggggagcccaggagtcgatggcagagagcagataaaagcaagccatgccaactgctgtgggctgtaggagcctctgatgggcattaagcatgagatgatccaatttttatttagaaaggtt

SEQ ID NO: 86426 - DNA, 522 bp, Homo sapiens
ggtgtggccagccttgagggtaggagatcaggacaggcagctgggacaaggtgtggccccatagaccgaggccctgggtgagggccttgcttctctattccctcctctgaacacaggttgggggactgggagcaaggccacaaggaaggatcacactggcaggcctcacagcttgggcctccaacattcaggaagttgaaccctttaagtatggcatcatctggtagtcatagtggcctcttacaggccaggtttttggggtttggggcttctgaggagtcagacaattgtgccactcactggctttgttatttggagcaaacacctctgacctctgcctctccaagcccggctttcctcatcgcttcggggagaatcatttccagctacagggggtattagggggattaacggagacctcgtacatgctgctagaatgcctagcagtctgcctgctactgataagtggcaataaacgcagccattgctttttagatgtttattatcctgagggctagggat

SEQ ID NO: 86427 - DNA, 300 bp, Homo sapiens
ggccaagaaatttagaatttatgctgctgcttggtctttatctcctaaggattactggcttctttgtgagtataaataatgatcataataggtcagattgatactacagaatcaaagtataagaagaataaattgcttcaggctcatgccagaatagttagcataaattattggttttggtgaatttaatgtgtttataacagtatctcaaagtcaccattggtattttaatctttgtgaattattaaactatttttgtttttcttgagatatggtctaggtagagtgacctagtgtaca

SEQ ID NO: 86428 - DNA, 316 bp, Homo sapiens
ccgggatttcaggcagaagggtgctgactttaaggatgtggcccttgccacgcgtcaggggctcctgtgtcctccctgggtcaaccaggtaagctgcttctcccgccctttcctggcataaggggccctgagtctctgtatttcccctagcaccctcgtggctcagctcagtttcctcctcctgaaccccagtgtcataacttagaagccaccaacccctaacgtgtccagatgaggaaatagtctttttatttttttttttttgagacggagtcttgctctgtcgcccaggctggagtgcggtggcacgatcttg

SEQ ID NO: 86429 - DNA, 596 bp, Homo sapiens
tggaaagctgaggtgggcggatcacttgagctcaggagttcaatgccaggctaggcaacatggcaaaaccccatctctacaaaaaaaaaaaaatacaaaaatcagctgagcgtggtggcacaagcctgtagccgccgctactcaggaagctgaggtaggaagattccttgagccccaggaggtcaaggctgcaatgagccaagactgcgccactgcactccagcctgggtgacagagtgagactctgtctctgaaaataaaattaagttcatctgaatttaaaatgagacctaatagtgtgctttcatggctccatttgtagagccagaatttaccagataggcactgactttgccagcagagggagcagccagctctttctgtgggtgacttgttaaaccttacgcttcttagcactcagcaccccctgggctgtcaaaccctcacttatttacacaggaccttcatttgaaatgggtcattctggtttccgaccatctcttattctaacaatttgtcatctgcatgcattgggaagcacagattagggaattggagcagctagttctcatttttttgctctgtatccagaggcc

SEQ ID NO: 86430 - DNA, 280 bp, Homo sapiens
cctctctcccttcggttctccatttaccgagccacagtatttcttaaagctcgttggcagcctgcacctctgcttattcttgggagacacgtgtttgcatcctattacaacccatagtttttgcataaccatggtgagaggaaccatccttcccaatcccaacctcaaccaaagcttagaaaaagtgccattcttaacctttcagaatcactcataagtaaatcctatagcagtctctgctaatgcaaatttcaatgtgtgcccgatataggtaactttt

SEQ ID NO: 86431 - DNA, 283 bp, Homo sapiens
atattgaggattgggagcactgtcaagaaatgttcagaccatataaataggaggctcagggtcaggctgtggagccagaagataattatttttttccttagctattacttcttattctgttttcctaatctggaaatctgttttccaaatctttgtttgagtttgggtctccctcattatatcctaatctgtgttggtaatcaaattaacttttgtgtcaaatattttgatttagcattttcattcctttctccagcaaatactagctgtgggctgcctctaa

SEQ ID NO: 86432 - DNA, 340 bp, Homo sapiens
ccaacaggccaaggaagtgcaatccttccttacatgtgcttaaaagggaaatggaaacatttgttgaacagtactaatgactacaacaaggcccccagccttcacgagggtatgagtctcagagtaggccagtcgtgatcttacaccctcctgcatacaatgattggtccactagtggtcatataacataggcaggccaaccagcccttttatggaatgaatgtatgttacaggcagaaacatcttgtgattactgaataggaggatgggagactgggactgtcagaagccatcctatcagctttatggagagagcctgcatccagttgtgactgttcaa

SEQ ID NO: 86433 - DNA, 247 bp, Homo sapiens
attggtgcataggtcttagtttttaatagtttcttactccgtccccccccaaaaaaagtttcttactttgaatctaagtactcctttatgagacccttcaaggttgatcttgtgtgtgtgtgtgcatgtgagagagcgagagcaagagcgagagtgagcgagagcgagagtgagagcgagagcgagagagagagaaagagagagagtgaatatgatgggaaatgaggcagaaggggaggagaaaaag

SEQ ID NO: 86434 - DNA, 308 bp, Homo sapiens
tcaagttatgcagtctgtggtattctgttatagcaacacaaaacagactaagacacactccatatccaaactgtcagggagttgttggttgcaccctcaacatatatccaggatccctccacttctcacctctatagctacccaggctttggcctaagctactattatctggtgcctgggtcattgtggtagcttccaagtagtttccctgccgcttcccttctctattcttaaaacagaagccagcataggcctttagtaagagacattagctcatgtcacaccaatgccaactctctactggcttt

SEQ ID NO: 86435 - DNA, 2951 bp, Homo sapiens
tgggaacttaaatattaacgccagtattaccactggtagggtgcatgagatcgcacgatggtgccaaaggtgtctctccaccgcccagcccagcgacactgttcccctagaaggcattgtcgtaaaaacaaaaaaaaaaaaaaaaaacgaacaaacaaaacaccaaaacacggaaactaaaagcaaatacttaaaagacatgcaggaaaccagcccaaggaaaaatttatgtggagccacgtctgcgcctgcgcctgcgccaagcccacggcgcgccacttgcacatgcgcagtagctgtaggagggggtgggcgctccattgggcgtttctcttggtttttcctttccgcgcggcttgggcggacgtctcgtgagacgtgggacttctcgcgggaactgcattcaaatatcccaggcgcttactcgagagctagctgagcgaatgggccggcgactgtggagttagcgtcctcaatgtggacgccctgagctcccattaggagccgctggctgcggcagcaggggactagcgtgagagttggctaaaaaaaagaaaagaacatggaggcagatataatcacaaatcttcgatgcaggctcaaagaggctgaagaagagcgactaaaagctgcacagtatggtttacaactagtagagagtcaaaatgaattacagaatcaattggataaatgtcgtaatgaaatgatgaccatgactgagagttatgaacaagaaaaatatacccttcaaagagaagttgaactcaagagtcgaatgttagaaagtttgagctgcgaatgtgaagctattaaacaacaacaaaaaatgcacctggagaaattggaagaacaactaagcagaagccatggacaggaagtgaatgaactaaaaactaagatagaaaaactgaaagtggaattagatgaagccaggcttagtgaaaagcagctgaagcaccaagtagatcatcagaaggaactcctctcttgtaaatcagaggaactgcgcgtaatgtctgaacgtgtgcaggaaagcatgtcttcagagatgctggctcttcaaattgagctgacagaaatggagagtatgaagaccaccctcaaagaagaagtgaatgaactacaatacagacaagaacagctagaacttcttattactaacctaatgcgccaggtagaccggcttaaagaggaaaaagaggagcgagagaaagaagcagtttcttactataatgccctagagaaagctcgtgtagcaaatcaagatcttcaggtacagttggaccaggcactccagcaagccttggatcccaatagtaaaggcaactctttgtttgcagaggtggaagatcgaagggcagcaatggaacgtcagcttatcagtatgaaagtcaagtatcagtcactaaagaagcaaaatgtatttaacagagaacagatgcagagaatgaagttacaaattgccacgttgctacagatgaaagggtctcaaactgaatttgagcagcaggaacggttgcttgccatgttggagcagaagaatggtgaaataaaacatcttttaggtgaaattagaaatctggagaaatttaagaatttatatgacagtatggaatctaagccttcagtcgactctggtactctggaagataacacctattatacagatttacttcagatgaagctggataacttaaacaaagaaattgaaagcactaaaggtgaattgtccatacagcgaatgaaagcattatttgagagccagcgggctctagatattgagcgaaaactttttgcaaatgaaagatgcctccagctttcagaaagtgaaaatatgaaactgagagctaaactagatgaattgaaactaaaatatgaacctgaagagacagttgaagtgcctgtactgaaaaagaggcgtgaggtgctccctgtggatataaccaccgctaaagatgcatgtgtcaacaacagtgctctcgggggagaagtttatcgattaccgcctcagaaagaggagacacagtcctgccctaacagtttagaagataacaacttgcaattagaaaaatcagtttctatacacacaccagtagtcagtctctctcctcacaaaaatctgcccgtggatatgcagctgaagaaggaaaagaaatgtgtgaaactcataggagttcccgctgacgctgaggccttaagtgaaagaagtggaaacacccctaactctcccaggttagctgctgaatcaaagcttcaaacagaagttaaagaaggaaaagaaacttcaagcaaattggaaaaagaaacttgtaagaaatcacaccctattctatatgtgtcttctaaatctactccagagacccagtgccctcaacagtaaagacttttctttaataagagtacggtgccacttgcctcaaaagttactatggtgcttaagattgtcttgatctgacatatatcaccttctgggttatttactcattgtgccaggacctggcattttcatgtgcctttgaccaagtgttcagaatttgcttgactctaacctggagagcttcttaagtgatgccccttcatggagcttctatgacagtgaataaactattaattgaaggaaaatgttataattaatgtatctatttgctgcattgtatatggattaaatgataaaaaacaagtaatctaccctcagagccatgtatttgagaatgcttcaatcatattttcctatgtacttttttttataaacttagttttagactatgttgtaaaaatgggaaggttgtaaactatgttgtaaaaataggaaatgtggcttaaaatatatacattatattgtttcaggattttgtcagtgtttaaagaaccaatgttcatctttgtatttatatacatgatttaaattttgtctaaaattttaaataaaactgcagtgatttatccttaaa

SEQ ID NO: 86436 - DNA, 2661 bp, Homo sapiens
tgggaacttaaatattaacgccagtattaccactggtagggtgcatgagatcgcacgatggtgccaaaggtgtctctccaccgcccagcccagcgacactgttcccctagaaggcattgtcgtaaaaacaaaaaaaaaaaaaaaaaacgaacaaacaaaacaccaaaacacggaaactaaaagcaaatacttaaaagacatgcaggaaaccagcccaaggaaaaatttatgtggagccacgtctgcgcctgcgcctgcgccaagcccacggcgcgccacttgcacatgcgcagtagctgtaggagggggtgggcgctccattgggcgtttctcttggtttttcctttccgcgcggcttgggcggacgtctcgtgagacgtgggacttctcgcgggaactgcattcaaatatcccaggcgcttactcgagagctagctgagcgaatgggccggcgactgtggagttagcgtcctcaatgtggacgccctgagctcccattaggagccgctggctgcggcagcaggggactagcgtgagagttggctaaaaaaaagaaaagaacatggaggcagatataatcacaaatcttcgatgcaggctcaaagaggctgaagaagagcgactaaaagctgcacagtatggtttacaactagtagagagtcaaaatgaattacagaatcaattggataaatgtcgtaatgaaatgatgaccatgactgagagttatgaacaagaaaaatatacccttcaaagagaagttgaactcaagagtcgaatgttagaaagtttgagctgcgaatgtgaagctattaaacaacaacaaaaaatgcacctggagaaattggaagaacaactaagcagaagccatggacaggaagtgaatgaactaaaaactaagatagaaaaactgaaagtggaattagatgaagccaggcttagtgaaaagcagctgaagcaccaagtagatcatcagaaggaactcctctcttgtaaatcagaggaactgcgcgtaatgtctgaacgtgtgcaggaaagcatgtcttcagagatgctggctcttcaaattgagctgacagaaatggagagtatgaagtatgaaagtcaagtatcagtcactaaagaagcaaaatgtatttaacagagaacagatgcagagaatgaagttacaaattgccacgttgctacagatgaaagggtctcaaactgaatttgagcagcaggaacggttgcttgccatgttggagcagaagaatggtgaaataaaacatcttttaggtgaaattagaaatctggagaaatttaagaatttatatgacagtatggaatctaagccttcagtcgactctggtactctggaagataacacctattatacagatttacttcagatgaagctggataacttaaacaaagaaattgaaagcactaaaggtgaattgtccatacagcgaatgaaagcattatttgagagccagcgggctctagatattgagcgaaaactttttgcaaatgaaagatgcctccagctttcagaaagtgaaaatatgaaactgagagctaaactagatgaattgaaactaaaatatgaacctgaagagacagttgaagtgcctgtactgaaaaagaggcgtgaggtgctccctgtggatataaccaccgctaaagatgcatgtgtcaacaacagtgctctcgggggagaagtttatcgattaccgcctcagaaagaggagacacagtcctgccctaacagtttagaagataacaacttgcaattagaaaaatcagtttctatacacacaccagtagtcagtctctctcctcacaaaaatctgcccgtggatatgcagctgaagaaggaaaagaaatgtgtgaaactcataggagttcccgctgacgctgaggccttaagtgaaagaagtggaaacacccctaactctcccaggttagctgctgaatcaaagcttcaaacagaagttaaagaaggaaaagaaacttcaagcaaattggaaaaagaaacttgtaagaaatcacaccctattctatatgtgtcttctaaatctactccagagacccagtgccctcaacagtaaagacttttctttaataagagtacggtgccacttgcctcaaaagttactatggtgcttaagattgtcttgatctgacatatatcaccttctgggttatttactcattgtgccaggacctggcattttcatgtgcctttgaccaagtgttcagaatttgcttgactctaacctggagagcttcttaagtgatgccccttcatggagcttctatgacagtgaataaactattaattgaaggaaaatgttataattaatgtatctatttgctgcattgtatatggattaaatgataaaaaacaagtaatctaccctcagagccatgtatttgagaatgcttcaatcatattttcctatgtacttttttttataaacttagttttagactatgttgtaaaaatgggaaggttgtaaactatgttgtaaaaataggaaatgtggcttaaaatatatacattatattgtttcaggattttgtcagtgtttaaagaaccaatgttcatctttgtatttatatacatgatttaaattttgtctaaaattttaaataaaactgcagtgatttatccttaaa

SEQ ID NO: 86437 - DNA, 2927 bp, Homo sapiens
tgggaacttaaatattaacgccagtattaccactggtagggtgcatgagatcgcacgatggtgccaaaggtgtctctccaccgcccagcccagcgacactgttcccctagaaggcattgtcgtaaaaacaaaaaaaaaaaaaaaaaacgaacaaacaaaacaccaaaacacggaaactaaaagcaaatacttaaaagacatgcaggaaaccagcccaaggaaaaatttatgtggagccacgtctgcgcctgcgcctgcgccaagcccacggcgcgccacttgcacatgcgcagtagctgtaggagggggtgggcgctccattgggcgtttctcttggtttttcctttccgcgcggcttgggcggacgtctcgtgagacgtgggacttctcgcgggaactgcattcaaatatcccaggcgcttactcgagagctagctgagcgaatgggccggcgactgtggagttagcgtcctcaatgtggacgccctgagctcccattaggagccgctggctgcggcagcaggggactagcgtgagagttggctaaaaaaaagaaaagaacatggaggcagatataatcacaaatcttcgatgcaggctcaaagaggctgaagaagagcgactaaaagctgcacagtatggtttacaactagtagagagtcaaaatgaattacagaatcaattggataaatgtcgtaatgaaatgatgaccatgactgagagttatgaacaagaaaaatatacccttcaaagagaagttgaactcaagagtcgaatgttagaaagtttgagctgcgaatgtgaagctattaaacaacaacaaaaaatgcacctggagaaattggaagaacaactaagcagaagccatggacaggaagtgaatgaactaaaaactaagatagaaaaactgaaagtggaattagatgaagccaggcttagtgaaaagcagctgaagcaccaagtagatcatcagaaggaactcctctcttgtaaatcagaggaactgcgcgtaatgtctgaacgtgtgcaggaaagcatgtcttcagagatgctggctcttcaaattgagctgacagaaatggagagtatgaagaccaccctcaaagaagaagtgaatgaactacaatacagacaagaacagctagaacttcttattactaacctaatgcgccaggtagaccggcttaaagaggaaaaagaggagcgagagaaagaagcagtttcttactataatgccctagagaaagctcgtgtagcaaatcaagatcttcaggtacagttggaccaggcactccagcaagccttggatcccaatagtaaaggcaactctttgtttgcagaggtggaagatcgaagggcagcaatggaacgtcagcttatcagtatgaaagtcaagtatcagtcactaaagaagcaaaatgtatttaacagagaacagatgcagagaatgaagatgaaagggtctcaaactgaatttgagcagcaggaacggttgcttgccatgttggagcagaagaatggtgaaataaaacatcttttaggtgaaattagaaatctggagaaatttaagaatttatatgacagtatggaatctaagccttcagtcgactctggtactctggaagataacacctattatacagatttacttcagatgaagctggataacttaaacaaagaaattgaaagcactaaaggtgaattgtccatacagcgaatgaaagcattatttgagagccagcgggctctagatattgagcgaaaactttttgcaaatgaaagatgcctccagctttcagaaagtgaaaatatgaaactgagagctaaactagatgaattgaaactaaaatatgaacctgaagagacagttgaagtgcctgtactgaaaaagaggcgtgaggtgctccctgtggatataaccaccgctaaagatgcatgtgtcaacaacagtgctctcgggggagaagtttatcgattaccgcctcagaaagaggagacacagtcctgccctaacagtttagaagataacaacttgcaattagaaaaatcagtttctatacacacaccagtagtcagtctctctcctcacaaaaatctgcccgtggatatgcagctgaagaaggaaaagaaatgtgtgaaactcataggagttcccgctgacgctgaggccttaagtgaaagaagtggaaacacccctaactctcccaggttagctgctgaatcaaagcttcaaacagaagttaaagaaggaaaagaaacttcaagcaaattggaaaaagaaacttgtaagaaatcacaccctattctatatgtgtcttctaaatctactccagagacccagtgccctcaacagtaaagacttttctttaataagagtacggtgccacttgcctcaaaagttactatggtgcttaagattgtcttgatctgacatatatcaccttctgggttatttactcattgtgccaggacctggcattttcatgtgcctttgaccaagtgttcagaatttgcttgactctaacctggagagcttcttaagtgatgccccttcatggagcttctatgacagtgaataaactattaattgaaggaaaatgttataattaatgtatctatttgctgcattgtatatggattaaatgataaaaaacaagtaatctaccctcagagccatgtatttgagaatgcttcaatcatattttcctatgtacttttttttataaacttagttttagactatgttgtaaaaatgggaaggttgtaaactatgttgtaaaaataggaaatgtggcttaaaatatatacattatattgtttcaggattttgtcagtgtttaaagaaccaatgttcatctttgtatttatatacatgatttaaattttgtctaaaattttaaataaaactgcagtgatttatccttaaa

SEQ ID NO: 86438 - DNA, 1562 bp, Homo sapiens
aaatatggcttttattgggaacttcactattgcatgctttacaaaactaattggtgttcttgttaccgagaatctttacaggcctttaagaatctctctactgtttatcttttctttattctactagttgaaactcaattttttaatatgaaacaaatagacatctattcatgcagcccaagattccatgttatttttgtcttgccttttgtatgtcatgttaacattaaaatattgctgtaacatttcagtttttgtgttaggtgtgcttatcatgataggtgccctgtcatattttctttaatttagggcttgccatgactttttaaagatattctttagacttaaaaaataattggcccagcgtggtgcctcacacctgtaatcccggcactttgggaggctgaggcaggtggatcacgaggtcaagagatcaagaccatcctgaccaacgtggtgaaaccctgtctctactaaaaatacgaaaattagctgcatgtgggggtgcgcacctatagtcccagctactccggtggctgaggcaggagaatcgcttgaacccgggaggcggaggttgcagtgagccgagatcatgccactgcgctccagcctggtgacagagtgagactctgtctcaaaaagtaataataacaataattgagcctattgatataaaaagacttttagacagccagtgacttaatattcttacagtattagagtcaactatattttttttccttgaataccatgccttattggaggcccattatactgggggtttgtttcttcaatccttcataaccacatttgaattcagagtggatgctttaatgcctgtaggttagctgctgaatcaaagcttcaaacagaagttaaagaaggaaaagaaacttcaagcaaattggaaaaagaaacttgtaagaaatcacaccctattctatatgtgtcttctaaatctactccagagacccagtgccctcaacagtaaagacttttctttaataagagtacggtgccacttgcctcaaaagttactatggtgcttaagattgtcttgatctgacatatatcaccttctgggttatttactcattgtgccaggacctggcattttcatgtgcctttgaccaagtgttcagaatttgcttgactctaacctggagagcttcttaagtgatgccccttcatggagcttctatgacagtgaataaactattaattgaaggaaaatgttataattaatgtatctatttgctgcattgtatatggattaaatgataaaaaacaagtaatctaccctcagagccatgtatttgagaatgcttcaatcatattttcctatgtacttttttttataaacttagttttagactatgttgtaaaaatgggaaggttgtaaactatgttgtaaaaataggaaatgtggcttaaaatatatacattatattgtttcaggattttgtcagtgtttaaagaaccaatgttcatctttgtatttatatacatgatttaaattttgtctaaaattttaaataaaactgcagtgatttatccttaaa

SEQ ID NO: 86439 - DNA, 400 bp, Homo sapiens
accatacctgctactatgaggtttcttgattacttttttgttattcccttaattttgattatatggatagtggtccaattatgagaccaaacttaccttaacatattggaagcttagcatacaacaactgaacagttttctgatggtgaactgtttagaagcaaaattaaatgtattctattccactctttaatttttgatcccaaatcagtaacagaattgtcagaacagttcttgctcttggaacaagaatgcaaatttgactacttattagtcaggaagaaaattttaatgtttttatacgacagtagtattgagtagatatgtttcttctgttattgatattattgcatggagttttttgtataagcttaagtagttttatttcctctatttacag

SEQ ID NO: 86440 - DNA, 479 bp, Homo sapiens
gcattcaaatatcccaggcgcttactcgagagctagctgagcgaatgggccggcgactgtggagttagcgtcctcaatgtggacgccctgagctcccattaggagccgctggctgcggcagcaggggactagcgtgagaggtaggggcaaggggcctggtgggaggtgggtgtggagagcggcagtggggagagtcgaacaggccctaaagaaagctaggggccggggtctcggccgaggcctttagctgaaacatctccttccccggaaccctggggtcttatacactgggttccgagccggtcttatcttccgctggaccacctcgccgccctcagggattctggacaaatatggaaggttgggtcggttgccgggtcctcaaaattataaccgccactggatctgcgctgtgcggtacggtagcctctagcccgaactaagaaatggtgcagatgggagatacatattgggtttca

SEQ ID NO: 86441 - DNA, 3079 bp, Homo sapiens
tgggaacttaaatattaacgccagtattaccactggtagggtgcatgagatcgcacgatggtgccaaaggtgtctctccaccgcccagcccagcgacactgttcccctagaaggcattgtcgtaaaaacaaaaaaaaaaaaaaaaaacgaacaaacaaaacaccaaaacacggaaactaaaagcaaatacttaaaagacatgcaggaaaccagcccaaggaaaaatttatgtggagccacgtctgcgcctgcgcctgcgccaagcccacggcgcgccacttgcacatgcgcagtagctgtaggagggggtgggcgctccattgggcgtttctcttggtttttcctttccgcgcggcttgggcggacgtctcgtgagacgtgggacttctcgcgggaactgcattcaaatatcccaggcgcttactcgagagctagctgagcgaatgggccggcgactgtggagttagcgtcctcaatgtggacgccctgagctcccattaggagccgctggctgcggcagcaggggactagcgtgagagaatctgaactgcccagaatggaacctagtatataaggcattcaagaaatacttgttcagtgaatgactacattgacttgagacatgggggaacatcttgcaatgacctggtgccctttgaaggcaaagttggctaaaaaaaagaaaagaacatggaggcagatataatcacaaatcttcgatgcaggctcaaagaggctgaagaagagcgactaaaagctgcacagtatggtttacaactagtagagagtcaaaatgaattacagaatcaattggataaatgtcgtaatgaaatgatgaccatgactgagagttatgaacaagaaaaatatacccttcaaagagaagttgaactcaagagtcgaatgttagaaagtttgagctgcgaatgtgaagctattaaacaacaacaaaaaatgcacctggagaaattggaagaacaactaagcagaagccatggacaggaagtgaatgaactaaaaactaagatagaaaaactgaaagtggaattagatgaagccaggcttagtgaaaagcagctgaagcaccaagtagatcatcagaaggaactcctctcttgtaaatcagaggaactgcgcgtaatgtctgaacgtgtgcaggaaagcatgtcttcagagatgctggctcttcaaattgagctgacagaaatggagagtatgaagaccaccctcaaagaagaagtgaatgaactacaatacagacaagaacagctagaacttcttattactaacctaatgcgccaggtagaccggcttaaagaggaaaaagaggagcgagagaaagaagcagtttcttactataatgccctagagaaagctcgtgtagcaaatcaagatcttcaggtacagttggaccaggcactccagcaagccttggatcccaatagtaaaggcaactctttgtttgcagaggtggaagatcgaagggcagcaatggaacgtcagcttatcagtatgaaagtcaagtatcagtcactaaagaagcaaaatgtatttaacagagaacagatgcagagaatgaagttacaaattgccacgttgctacagatgaaagggtctcaaactgaatttgagcagcaggaacggttgcttgccatgttggagcagaagaatggtgaaataaaacatcttttaggtgaaattagaaatctggagaaatttaagaatttatatgacagtatggaatctaagccttcagtcgactctggtactctggaagataacacctattatacagatttacttcagatgaagctggataacttaaacaaagaaattgaaagcactaaaggtgaattgtccatacagcgaatgaaagcattatttgagagccagcgggctctagatattgagcgaaaactttttgcaaatgaaagatgcctccagctttcagaaagtgaaaatatgaaactgagagctaaactagatgaattgaaactaaaatatgaacctgaagagacagttgaagtgcctgtactgaaaaagaggcgtgaggtgctccctgtggatataaccaccgctaaagatgcatgtgtcaacaacagtgctctcgggggagaagtttatcgattaccgcctcagaaagaggagacacagtcctgccctaacagtttagaagataacaacttgcaattagaaaaatcagtttctatacacacaccagtagtcagtctctctcctcacaaaaatctgcccgtggatatgcagctgaagaaggaaaagaaatgtgtgaaactcataggagttcccgctgacgctgaggccttaagtgaaagaagtggaaacacccctaactctcccaggttagctgctgaatcaaagcttcaaacagaagttaaagaaggaaaagaaacttcaagcaaattggaaaaagaaacttgtaagaaatcacaccctattctatatgtgtcttctaaatctactccagagacccagtgccctcaacagtaaagacttttctttaataagagtacggtgccacttgcctcaaaagttactatggtgcttaagattgtcttgatctgacatatatcaccttctgggttatttactcattgtgccaggacctggcattttcatgtgcctttgaccaagtgttcagaatttgcttgactctaacctggagagcttcttaagtgatgccccttcatggagcttctatgacagtgaataaactattaattgaaggaaaatgttataattaatgtatctatttgctgcattgtatatggattaaatgataaaaaacaagtaatctaccctcagagccatgtatttgagaatgcttcaatcatattttcctatgtacttttttttataaacttagttttagactatgttgtaaaaatgggaaggttgtaaactatgttgtaaaaataggaaatgtggcttaaaatatatacattatattgtttcaggattttgtcagtgtttaaagaaccaatgttcatctttgtatttatatacatgatttaaattttgtctaaaattttaaataaaactgcagtgatttatccttaaa

SEQ ID NO: 86442 - DNA, 3755 bp, Homo sapiens
tgggaacttaaatattaacgccagtattaccactggtagggtgcatgagatcgcacgatggtgccaaaggtgtctctccaccgcccagcccagcgacactgttcccctagaaggcattgtcgtaaaaacaaaaaaaaaaaaaaaaaacgaacaaacaaaacaccaaaacacggaaactaaaagcaaatacttaaaagacatgcaggaaaccagcccaaggaaaaatttatgtggagccacgtctgcgcctgcgcctgcgccaagcccacggcgcgccacttgcacatgcgcagtagctgtaggagggggtgggcgctccattgggcgtttctcttggtttttcctttccgcgcggcttgggcggacgtctcgtgagacgtgggacttctcgcgggaactgcattcaaatatcccaggcgcttactcgagagctagctgagcgaatgggccggcgactgtggagttagcgtcctcaatgtggacgccctgagctcccattaggagccgctggctgcggcagcaggggactagcgtgagagttggctaaaaaaaagaaaagaacatggaggcagatataatcacaaatcttcgatgcaggctcaaagaggctgaagaagagcgactaaaagctgcacagtatggtttacaactagtagagagtcaaaatgaattacagaatcaattggataaatgtcgtaatgaaatgatgaccatgactgagagttatgaacaagaaaaatatacccttcaaagagaagttgaactcaagagtcgaatgttagaaagtttgagctgcgaatgtgaagctattaaacaacaacaaaaaatgcacctggagaaattggaagaacaactaagcagaagccatggacaggaagtgaatgaactaaaaactaagatagaaaaactgaaagtggaattagatgaagccaggcttagtgaaaagcagctgaagcaccaagtagatcatcagaaggaactcctctcttgtaaatcagaggaactgcgcgtaatgtctgaacgtgtgcaggaaagcatgtcttcagagatgctggctcttcaaattgagctgacagaaatggagagtatgaagaccaccctcaaagaagaagtgaatgaactacaatacagacaagaacagctagaacttcttattactaacctaatgcgccaggtagaccggcttaaagaggaaaaagaggagcgagagaaagaagcagtttcttactataatgccctagagaaagctcgtgtagcaaatcaagatcttcaggtacagttggaccaggcactccagcaagccttggatcccaatagtaaaggcaactctttgtttgcagaggtggaagatcgaagggcagcaatggaacgtcagcttatcagtatgaaagtcaagtatcagtcactaaagaagcaaaatgtatttaacagagaacagatgcagagaatgaagttacaaattgccacgttgctacagatgaaagggtctcaaactgaatttgagcagcaggaacggttgcttgccatgttggagcagaagaatggtgaaataaaacatcttttaggtgaaattagaaatctggagaaatttaagaatttatatgacagtatggaatctaagccttcagtcgactctggtactctggaagataacacctattatacagatttacttcagatgaagctggataacttaaacaaagaaattgaaagcactaaaggtgaattgtccatacagcgaatgaaagcattatttgagagccagcgggctctagatattgagcgaaaactttttgcaaatgaaagatgcctccagctttcagaaagtgaaaatatgaaactgagagctaaactagatgaattgaaactaaaatatgaacctgaagagacagttgaagtgcctgtactgaaaaagaggcgtgaggtgctccctgtggatataaccaccgctaaagatgcatgtgtcaacaacagtgctctcgggggagaagtttatcgattaccgcctcagaaagaggagacacagtcctgccctaacagtttagaagataacaacttgcaattagaaaaatcagtttctatacacacaccagtagtcagtctctctcctcacaaaaatctgcccgtggatatgcagctgaagaaggaaaagaaatgtgtgaaactcataggagttcccgctgacgctgaggccttaagtgaaagaagtggaaacacccctaactctcccaggttagctgctgaatcaaagcttcaaacagaagttaaagaaggaaaagaaacttcaagcaaattggaaaaagaaacttgtaagaaatcacaccctattctatatgtgtcttctaaatctactccagagacccagtgccctcaacagtaaagacttttctttaataagagtacggtgccacttgcctcaaaagttactatggtgcttaagattgtcttgatctgacatatatcaccttctgggttatttactcattgtgccaggacctggcattttcatgtgcctttgaccaagtgttcagaatttgcttgactctaacctggagagcttcttaagtgatgccccttcatggagcttctatgacagtgaataaactattaattgaaggaaaatgttataattaatgtatctatttgctgcattgtatatggattaaatgataaaaaacaagtaatctaccctcagagccatgtatttgagaatgcttcaatcatattttcctatgtacttttttttataaacttagttttagactatgttgtaaaaatgggaaggttgtaaactatgttgtaaaaataggaaatgtggcttaaaatatatacattatattgtttcaggattttgtcagtgtttaaagaaccaatgttcatctttgtatttatatacatgatttaaattttgtctaaaattttaaataaaactgcagtgatttatccttaaaaaaaaaaaaaaaaaaaaaaaaaaaaaaaaaaaaaaaaaaaaaaaaaaaaaaaaaaaaaaaaaaaaaaaagggggggacacccacaaaacaaaaccagggggggggggcgccaaaccccccccgggggggcacaggggggcccaggggggaaagggggcccccggggggaaacgcgcaggggaggaacagcgccacaaccagagcgcaaccgcttccaagaaaaaacacccaccaaccgcgccgtgaccacaccaaaccccccaccccccctgctgcacgacaaaaaaaaagccccaccacccgcaaacgaaccaactacagagccccaaagcagcacaaaccacaagcgcgacgacaacaacgacgcaaaacaaaagccgccacataccgcatacacaacagaacccctccacccgccaggcactcaagacaacaacacccacccgcacacggacccacttaaacaaccacccgccgccacccacacaacccacacacaccaacacaacaacaaacaagcgcacagcagaagaccaagcaacagaccgcaagcgcaacagacagcaaagcaaaacaaacgaaacagcagacaagcacaagcaccaccacgcaccccaaaacagccgaacaacccaccaagacgcgccacaccacacgcaacagaaaccaacccacacgcacccgagaaccacccaaccgcacaaacaagccagagccacgacaaagcaccccgaacgaccaaagcaccacaacagcagcaacacacccgaccaagaagcgcacagcaacacccacgccacccca

SEQ ID NO: 86443 - DNA, 123 bp, Homo sapiens
gtataaaacaagttctgtatgttctagttactttgcatggcaagtggtactgattgttttagtttactgtggcaatataacatttctttttggaataaatgttaataactaaacaaattaagt

SEQ ID NO: 86444 - DNA, 957 bp, Homo sapiens
aaagttaaccacagaaaatgagagaaaaaatgaaggatagagcaaattaaggatgcgagtccctcaatggttattggccttaatggtgttataaaaatgatgtcggcttttaccaggaataatttatattctgaattaaataaggatatgtatctataaatccattctataaaacttaattttccatctagataggctgattactttgggctcggcatacctttaccggttgttaattactgcgggatggtttaacactattttccaaatcagcatgcatgcataaaatgactgcaatccaatttgacacattattagtgatgattattgtcatagataaattagattgaacagaaaataaccttcatccttagcatgttttagctctcagaattaatgtgatttggtgaacacatataaataaaaatctgacgagtccctgctgactacagggcctgttggtgctgaagtgtatcaatttcatgcagatgatgaattccttaagcattcagtgataatcatgcttgatttgacaagactttctcatgctattttagggccttaattttctgtgaagttctgtcaagtgctcatcaagcacccacttatctccgtatcttaacctggcagccaatcacaaggttgcctaacagtacagctacggagtgccagcccattaatattcgggtcacgtgactgtccaaggagagaaaccaatcaatggctgattaacattcaggtcacatgactcccgaggagagtaaatgagttacacagtaagacatcaaacaaattttcatcttgaaagagtgattgctttttctgctgctgtgatgtttgtcaaattcgctctagccttgtccaattaagctccatgagctgaattaataatgaagagatgtaagcaccgagccagcatgagcgctgcgatctgtgccacgtaataagaactgctta

SEQ ID NO: 86445 - DNA, 372 bp, Homo sapiens
tggtgaaagaagagaaggaaaccttggtctgcatggcacttggtacttttgtattgcctccatgccctccactgcagctcctgccctgctctgtgtgcatccctcatgagactcaagacagataacctctccttgccctttcatgtcccagccctggatcttggactcaaccatccattgcatccccatggaggattctgccagtcctcaggactcaggagcaacccaaggatgtcccagggtcacaggaagacttgttgaggggacccacaggggtgcccacaaattatcagtccatggagaaaaagtagagagggaggctcaaggacctcagcacgtaagggacatttgaattctacagtcacggtggat

SEQ ID NO: 86446 - DNA, 248 bp, Homo sapiens
ggatcagcttggcctctggactctggactatgccatataattttccttgaccaatgagatatttaggagatatgatacaagcacagtatggaaatgtaacttcttcaacactggggctttcttttctatcaggagaagaatgacaaacatgtggccctagcaaagcccaccagtcaagcctactttagaatagagccccccaaaaatcaacagacgtatacataagctcagctggtacaagctgatgc

SEQ ID NO: 86447 - DNA, 407 bp, Homo sapiens
ggtgttctgaaaactaatatttgcatgttactctggagcaaggttccaacctcaatatgtcacattaacatttaataaccagtgtgttcaaggcctcctagtttatccatcaatgaaggctctcaaagctttaaagagacaatcttctaaaccacaaaacacagctatccttctctcctccatggccatcatatgcccattcctttttaatcctctaagcaatgtacaaggtctagaatttctatttctctggtctaaaacgtatacccatgtctggatttgagatgtttgcacatttgtttcttaggaatacaggatgtactcagactactgtagccttcttgtttctcatctttaatatgtctgaaatgtcttctataatatatgcaaataaacactgtaaaatg

SEQ ID NO: 86448 - DNA, 671 bp, Homo sapiens
cacaccacctctccttcattcacgtcctatggaagagaccataaaggcttcaaaactagaagtgcgcatgaaggatgcttcatgccctgttccccacacagagaagagatgaagagggggaggtacggtcagctttcaaaacaatatgccccccgcccatcccatgtgtgaggacatggtgactcggtgactgtaacagtaggacacatcccatcatgcggtcagagtgcagaaacccggtcagcgtgcagaaaccagctgtctgctgatgaacggcccatctgcacagcggcagcaaggattaccccaagggcaggaaaaaagtctttggaaatagattgaaaatcagtttctttatttttttcaaacactgttttattgagttctaaacccagtggattaaaaagtcatttgggtcctgggaagcactgggaaagaagggagagccggggaggatagggcaggagtctggccaggagcccaaggtcaagtctggctgtcaactgacaaagagaagagaagacaagtctgtggcccagacaggatgccaagtctgggggcagcagcagggtccttgagagaacaggggagcaagcctgccccagtacccaaaaaacaatggctatcatgtactggggttattctctgtgcctgacactttacctgtagta

SEQ ID NO: 86449 - DNA, 393 bp, Homo sapiens
aatttttttttctctaactggatttacctagcagccttagtgtaggagcagaagagactggtggtttgattgatttggggttgggcttttatcaggttagcgagtggagagtgcaaggataatggtaaggaactgatcaagaatatggattgtggggtctggcctctgaagaaaagaaacttaatagagaggactgatagaataagaggaaatggaggcattaaggaaggcttaggacatatccatgagttgatggatagatcccatttgaatcaacagagttcattctcagaaacataatgtggaatgaaaaaagaaagttgcgggattcatcagattcaagaggtggttacctttgggaagaaagggaaaggaatggacttggtgacaaat

SEQ ID NO: 86450 - DNA, 456 bp, Homo sapiens
  misc_feature (406)..(406): n is a, c, g, or t
  misc_feature (420)..(420): n is a, c, g, or t
  misc_feature (442)..(442): n is a, c, g, or t
gttgctgagaacctcgcctcttttagatttacacataagcaaaacaggaatggggaagcaagacgagcagccagcagttcgtttgaggggaatctcagagcaagtgaaattgtttaggctctggttcacacattgcttctgtctggtctacgaaggtgtctgatttggtcttgactgtccaaagcttctctaggtgtaccctgcctcagccttctcaggaattcattaaaatactgtcagcaaagtagtaccagaacaaggatttgagtttaaagaatagacttagttggccgggattacaggcgtgacagctggcgacctgcctatcctcacagcttttatcccacttggattaaatggcttccagttcagtggttgctttttgcccatggatgcttttttaaantaggtaaggattgnaattaaggttacacaattaggnggcgtatttcctat

SEQ ID NO: 86451 - DNA, 220 bp, Homo sapiens
gacaggacacctcgtgagaatttaagatggtatcaaaatatgaagggccgtgaatgtcaggatgttttgtcttgtgagaaattttaaagttttctgagctggagaagtaattaatccatgtagtgttcagacagttcagttttcttcaacaagattatgagaagaaaaaagagacagatggagggaaagccagtggattaaaagagactgaaaagatgca

SEQ ID NO: 86452 - DNA, 918 bp, Homo sapiens
tcgtcatcgccactctgcagatgggaaactgaggcccggaggtcccgccgctccggagcgaggagccgccggaccccagcgccgcaccgccgggcggacgcgctctgtgccgagctcccggcgattgggtccgctcccacggggctgggaacagaggggcagaggatgcttcccccgagccgctggcaggagtgcccttcccccttcagtctggagctcagagtttgtgcgtccctgggggtgaaggggcgtccacgctgtgatggtcgcctctgctcagtcctgggggccaagccagggtcggggtgatcgagcaggcccttttaccaggtgtccccagtaagttaactaagtaacttgagatgtgacttcagggtggaggacctgcacccagtggccacctacctggtgacctgacccttcccatcattaggggatggaggctggcccagaagccgggcactggggtggcggccgtgtgggagctgcctctcccacttcctcgaagcaggcactgtctgctgttcttagatctgagtatccgttaacttttgtcctcttttcccgttcctttcttcactccctgccccagattaggagttcctactctatcacagtatgaaagaaaagtcacttttcacattggactcaagccgtttttgcaaagtaaactaagaagtgtcttggagccctgagtgagtctcccagtgctgctgcagggctggactaggggattccagcctgcagtctctgagggctctgtagggtctgaggaagagagttgccctctggaaacgtctcttctctgctgttcgggaaaaaccttattaagatttcctccaaaacactcatgcgcagcaggcatggttcggttttcagccctcccacagggccagcagctgaggtttttctggaaga

SEQ ID NO: 86453 - DNA, 472 bp, Homo sapiens
cttatggccaattttggcagcaaaacgataggattaaaaatagcttgaagatgatctagtcttaaataatatatttcatgatgaactttccttgggaaagtgcatctttctgcctacaagaatcacatgacccctttcaataatttatgtagtagagaaaaacacactatttctcatagagttttcagtcatgtgctgtggtgtgattgtttctggacattcataaaattttatagttaactgaattctcttttctgtttttttgctatttaacgtccattgaaaacatggctttcttttgcgcattctgttactttcagctgtactttctaataagaatggattgccctttttagcaatctttgattgaactggtacatttcagattacttaaatgtcatcaggccacacagcataccaggtaacagaaagccataaattaaaaataaaaaaaaggcaagcaaaaaaaaaa

SEQ ID NO: 86454 - DNA, 356 bp, Homo sapiens
cagctttgcaaatcaaatagaattcattttgcctcctctgatcttacaactattctctggagtaggcaggctggttgaacttcaagagaagaggcgttcctgagagcctccttggtgagcttgcacacctgggggccagatgtgctttgccctccttgcaaagcctctctagtctggtgcccagagaatacagcttcagcagcagctcactttgcttttcagtttagatgagaaaaaacagcaaaatagtccatcaaggacaaattcttgccaatggatttgcttttgcaaggaagttcacctttgttcctcaagcatcatctttaagtgtgaatgcctgatgggaggtccaggtt

SEQ ID NO: 86455 - DNA, 159 bp, Homo sapiens
gatctaaatataagagcaaaaaccataaagcatctaaaagtaattgaaggagaaaatcttagtgccttttgttctggccaagattttttaaagaggacatagaagtcaggaactataaaagaaacaattttaaattttactttatcaaaattaaaagcc

SEQ ID NO: 86456 - DNA, 552 bp, Homo sapiens
ccatgtggcagcatgcagtttgaggcctctgtcctgcatatggaccttggctgtgggaaggtgttcctgctggggcctcatttgaccatttcctggtcattctgtctggctgtctcacctgctggtgtggtaggccatgagagtccagggaagcttctctgctgtgggcctcagctgggggatgggaacatggggcggggggttaatgtctctccctagaactctgcctttgcttggctggggcctctcctcacaccttccagggacacttccagggtttcccggatttggtgggtggagagaatggtgcctggtggggtctaggatcctgagtatttgttgaaattgtgtttcctgagggccttctcttcagcccttgttccttccatctctgtggatttaggatccacttgaaagctgagttccttggctgggcacggtggctcatgcctgtaatcacagcactacaggaggccaaggtggcaggatcacttgagcccaggagttagagacaagcctgggcaacatagatcctgtctctacaaaaaatta

SEQ ID NO: 86457 - DNA, 1043 bp, Homo sapiens
atagcaaaaactatctttaagaatggaaaataaaatgaatgttttagataaaatattgcaagccattatgtgtagagttaatgtatggaaatttgcatttgtttttctgaatcatggtgtacattaatcactcattgaattctatttctaagcaaataagagaatcaaacatttctaaaaggaacatatgtcttgctattaataacaaggagacaggtaaaatagtaaggtaatataagcaaaaaaaaaaatgtaatgaatttagctatcctaaattggaatttttacagattgcatgcatacttagaattttaaatttttaaaagatttacaattgagtatggtacccacagagagtgagtaccaagggaaggaagacctaatacaagtgatgttgcctgataaatcacatcttgccaaaaaaaatatattttagtaaatacagttctttaggaagaaaaatgttgccctttcacactcacagtgtaaatacattcataatattccttcaatcatctaaattaccgccaggtcatgaaaggacgcgatcaatgatgacctattgcactcacaggtaacattgactcaaattttggcaatattgctatattatctagataattcttgtgatgtttttatgtcactatcaacattaaaaatattttgttaaacaactatgaaactttcaaaagtttgcatataactgtatgggcactctcatttcactgcatacatacaatactttgtatacacatacttctcgtgtggatattttataattttatttaatctaacatttaacttttaggtttttgtggtactcatctgaaaggttggcatttgttttctttttatgttatatatgtattttagatgaatcaataatgtgtattcctagaaattttttctaggcataaatagatcattttatgttggcatttaagagatatcatttttgttttattgttctgtgtaaaccatattcattgtacactgtgtgtatatttttgtttaaataaatgatttttattttttaaaaaact

SEQ ID NO: 86458 - DNA, 829 bp, Homo sapiens
atttaaaagtctccacccctaagagaacatgggccatatgtaacacgttttttcagtacacatgcgttaggaccaccttcataaatattcatagcttctcctgtaactgttgagtatgtatacttggccaacccattcagcataaatccctgttctaccctcctgtccctcaaagtgcctgtcttttggttgaccctttataagaaatagtttcctctccagagttacagatcctatgatttttttgttgacacttctaattatccagcctatataattttcctatacatataatgctgtagttttaaatgacaaaacattctggaatcattgtcactaatccagtaattaggaacagtctctactgtcaacaactgaactgtgtttgaagtacaaattccccaaaatcctaaatcttaacttcctcaagtggatcatcttaaacaaaaattattcttaaagacaatagtgctcattaggagaataaaatgggcttggccctccctcgagaaagtatcagcaatccaaataacctctcaccatatccattcaccaatcagagtgggaaatgactctatcatcaaagcacaaaaaaagattttgcacttctgaacctttccgattggtgctgaacctacatacacggatgaatgggtggatgtgggatggatgaccagttatgtataattgatgagaaatttgtacatgactgccaaccttgaacaaaattttcagcgttcaggaaatttttttttgagacagagtttcactcgttacccaggctggagtgcaatggcgcgatctcggctcactgcaacctctgcctccc

SEQ ID NO: 86459 - DNA, 482 bp, Homo sapiens
aaagaattaaaggaatgtatgagcataatgtctcacgaaaaagagaatatcaataaaaaggcaaaatataaaaaagaactgaatagaaattcttgagttgaaaagtacaataaaggaaatggaaaattcattgaagggtctcaacaacatatgtgagccagcaaagaatcaacaaaagtgaacatatgtcagttgaaattgtctggtgggaggtacagaaaaaaaagaatgaagaaaaatgaaaagaccttttgagagctgtgaaaccccatcaattttaccaaaatatgcataatagaaatagaaatttcagaagggaaacagagagcaaacaagggacacaaagaatatttaaagaaataatgaccaaaaacatcccaactttgatgaaaaatattaatctatccattcaatgaattcaaattggatgaattcaaatccatacctagacacatcatagtcaaactgatgaaagacaaaga

SEQ ID NO: 86460 - DNA, 434 bp, Homo sapiens
agactgcagcagatgaactggcaaaagtgagccccctaggtcaaacgtcttgaatttttctgattttgatgaaacgctattgcctgtataattacacaagaaatgtttctgtcacttgtttgtgtgaagactgataataataccttcctttttgagtccccctgtgccagggatgatgcagagtacttttacaagcactcttgcctttatcaacccaaggagaaaggccgagttagcccatttatgaagtgaaaaaatgggggctctgtgaggttgggtagcttgtgtatgtgcctgtggttcatgaggccaagacagctgaggcgtgcctggccgtgtggctgtttctcatgatgccgcagccgttcttcagcagataccttatgctcagtaaccacacagaatttgaggtggccataatttttattcttcct

SEQ ID NO: 86461 - DNA, 448 bp, Homo sapiens
ggagttcgagatcaactggccaatatggtgaaaccccatctctactaaaaatacaaaaattagctgggcatggcggtgtgcgcctgtagtccgtgctactcgggaggctgaggcaggagaatcacttgaacccaggtggcggaggtttcagtgagctaagattgcgccattgcactccagcctgggcaacagagcaagattccgtctccgcctccaccccctgcaaaaaacaaaaacaaaaacaaaaacaaaaaagatcatacaaatgaatacaataaacaaagatgttggagactttactgttttgggggagttttcagtgccttggtaacatgcatttctttccagacaacaatccctattaagtatgtgtcttattcccagtttattaatgttgtccccatggacacctctatgaggcagctttctgttaggccagattgtcatc

SEQ ID NO: 86462 - DNA, 135 bp, Homo sapiens
cttgttgctatttgaaatttttcattaactagattttgtattttgagaccttaagagttaaataaaaggagctaagtttccagctttatgcaactgcttatttaacagttctccacacgtgactctggcatggtg

SEQ ID NO: 86463 - DNA, 463 bp, Homo sapiens
tggttctgggcccagacagagcctctcagcagggccggtcggggcatcagtgtttctcgttcctctctggggcctcctctgacctcctcccctgaatgctccattgcctttgcattgccatgactcccttgaactcaactcttgacttgggggtgtgaagtcagtgtttcctgaagccggctccccaccaacctgctaaaatggtgcagctagacttccccagaggcaaaatccttaggattcagagtcgtttttaaatgtattactttactttctcaatttttgtgtaaaaaggtattgattttgtgatcaaaaatagaaagggtagggccaggtgtggtggctcatgcctgtaatcccagcactttgggaggccgaggtgggtggatcacctgaggtcaggagtttgagaccagccttgccaacatggtgaaactgtgtccctaataaaaatacaaaaatt

SEQ ID NO: 86464 - DNA, 402 bp, Homo sapiens
aaccttccatgaccaactctttcttctcttaattcgtgcattctctctcagcaattatatattgagcatctccttctccagcttctacttatataagtgttattcactatgtgccaaatgtttctttaagcttttcatatgtattatctcatttaatccttaccacaactctagaagggaggcttttctcattttataaacttgaaaatcaaggctcagagaggttaaataacttgtctaaggttacacaattactaagtcaagatctaaacttccttgagacatttttgctaaaatctgaaagatgaatagaagtttttctccactcccatatgaaaaaaagagaccaagggcatatgttaggaggaactccttgaggctgaaacactgagaataagggaa

SEQ ID NO: 86465 - DNA, 1320 bp, Homo sapiens
  misc_feature (1)..(1): n is a, c, g, or t
  misc_feature (3)..(4): n is a, c, g, or t
  misc_feature (6)..(7): n is a, c, g, or t
  misc_feature (10)..(14): n is a, c, g, or t
  misc_feature (441)..(441): n is a, c, g, or t
  misc_feature (1313)..(1314): n is a, c, g, or t
  misc_feature (1319)..(1319): n is a, c, g, or t
nanncnncannnnnctcctatgctgaatgcttccttccctcgaacatcagactctgggttcttcagttttgggactcagactgctttcagcttgcagacagcctactgtggaaccttgtgatcgtgatctatttggaggtactaagaaaaataagacatcagtctgaaaagagctcctatcaaaacaccataaattctgctaaaaggcaagcaaggagaaacatcaaatttatggtgaagcttggggggaagaatgatgaaatcattgatactctatgaaaagtttatagggacaatggccccaaagaaatcagcagtttacaaatggataactctttttaggaagggactagaaaactgttgaaaatgaagcctgaagcagcagaccatccatgttaattttcaaggaaaaaattaatcttgctcattccctaaataaanaggactgataattgacagcaaagacaatagccaacaccatagccaactcaatggttcgacttacacaattctgactgaaaagttaaagttgagcatttccactcaaaggtacaaaaatttatgtgtccagatcagctgcagacaagagcagagctttcagtggaaatttcaaacaagtagaattgagatcctaaagcatttcttcaaagagttgcaacagaaggtgaaacatggctttaccagtaccatcctgaagacaaagcacaatcaaagcaatggctaccaagaggggcaagtggtccagtcaaagtaaaagcagactggtcaagagcaaaggtcatggcaacagttttttggaatgctcaaggtatttttcttgttgactttctggaaggccaaagaatgacatctgcttattatgagagtgttttgagaaagttagccaatgctttggcagaaaaatgcccaggaaagattcactagaaagtccttctccaccacgacaatgctcctgctcatttctctcatcaaacaaaggcaatcttaagttcctatgggaaatcattaggcatccaccttaccatcctgcttcggttccttctgacttgcttttgtttcctaatcttaaaaaatatttcaagggcactcatttttcttcagttaataatgtgaaaaagattacattagcatggttaaattccctggagcctcagttctttggggatagacaaaatggctggtatcatgtcttacaaaagtatcttaatcttgaatgagtttatgttttaaaaaaaaagtatattttttaaatttttatcttttatttccatttttcataaaatgtttgaaattccctcatgtacaatttaaannccaant

SEQ ID NO: 86466 - DNA, 609 bp, Homo sapiens
gctcaagagcgtgctttaagttcaataaaataatatcattgttcatattaatgttattaaggtaaacttattcattttgtgaccctgcatttccttcaatatttgttctaaaactgttttgtatgagagtataagcataaccataaaaacctggttgggtaatataataaaaataatgtggcaacaataagagggaacaagattttgacgttcctttaaaagtttctgtatattttacttaagtataaagaaaattgttatgaatgataggaggaaggatttttgtccacctattaaaaaaaaactgctgtgaagcataggaagtttcaagcataaaatcaagcagtagataaatgttctttgaacttatgaatttcaaattataaatttcaaccatgctattaaagatattcaacacagtggatattccttttgctttcaaatttatctaaatatatgagacaggcaaaagctcaatgcaaaaggcatgactttataaaatggatccattttgccaatagctcaaagaattatggtaatattgtgggaactgagtgaaaattcagagtaggttttgaaatgtgatacaagtagaattttaaaaagaaa

SEQ ID NO: 86467 - DNA, 179 bp, Homo sapiens
ctcacctcagcttcctgagtagctgagatgacaagtgtgcatcacgacgcccagctaagttttaaaattttttgtagagacagagtcttgccatgttgttcgagctggtcttgaactcctgggcagaagcaattatctcgccttggcctcccaaagtgctgggattatagctatgagcc

SEQ ID NO: 86468 - DNA, 276 bp, Homo sapiens
agccgaaggcagactctgttcagcttctcttctaagggcttccacctaatagtgcaaactgctctttcctcacatggtgagacctgggcttgctattccatgtttcataactaaacaatatgtggctcagatagaaatggatatactgggagtaaacctgcagagaaagggaagaggattatcaaaacaaagatccagttagtggatatggacatgtggatgagatgttctatttctttttttttttttttttttttgagactgagttttgctctt

SEQ ID NO: 86469 - DNA, 784 bp, Homo sapiens
gttgagcagtaccccacctatatgatcatatacagtggccctagtaagaaaaaggtgtttaaagcatttttaaaattatatataaataatatacaatggcccaaaccctggctgggtttggacagagtctcactctgtcgcccaggctggagtacagtggcacgatcttggctcactgcaaactctgcttcccaggttcaaacaattctcccacctcagcttcccgagtagctgggattactgggattaccggctcgtgccaccatgccccgctaatttttgtatttttagtagagacggggtttcaccatgttggccaggctggtctcgaactcccgacctcaggtgatccacctgccttggccttccaaagtgttgagattacaggcgtgagccaccgtgcctggctggtttggggattttcatattgcatgtgacagaaaacctatctgtaactagctaaatagccctttcccctactgccccccaaaaggcggggtttattgtatcatctgattcagaaatctacgctgggcttggtagtttggtttcgggaacatctggattccaggtctcaaatgacatcatcgctattcatttttctctttctctggttctgccctccaccacgtatcagctttgttctgtgttggcctcagccccattctcaagttcacattcagcatgaaaaggctgatcacctcttccagtcactcaagcaaaaagccccaggtttgctgcaatgggctagaatagtttgactgtaatcacatgaccacctcta

SEQ ID NO: 86470 - DNA, 370 bp, Homo sapiens
catataacttgcttttgggttcatgattgcttttcacctgtactttccatctgtcatgaacagggatccctgagatgttcatactctgcattctcatgtgcatgatccttagatttaaaaagggtgagtgggagaaagttgctttatagaaatataagttcacagcattcatgttttgtgtgttccactgcaaatattgcatgctgcatacttgtatgctgcatacttgtatttctctgaaaatgaagaacataggctcataagtacacaaaaaattagtttcgtttttgccaatagttggaacagatgaaggaatgttagatgtaataccttttctattttttctaaaatgaattctgtagtatttttc

SEQ ID NO: 86471 - DNA, 96 bp, Homo sapiens
gatctacataaggaaaggaagaatattaaagaagaaataaatgaagacgagataaaatcttttttcttaattatcaaataaaagtttgttaaaagt

SEQ ID NO: 86472 - DNA, 94 bp, Homo sapiens
gtgaagagaagcatagatgctgtggaaaaacagatgaaaggccccgacccatcacagtagtagtggtgagggatgcttcacaaaggagaagatc

SEQ ID NO: 86473 - DNA, 744 bp, Homo sapiens
ctatttctttgtcaagcaggaggagatagcttcagggtcacaagaaaattttgcagaaggaatgaatgtctttatgcctttaaggacattgcaatcaaactgctgacgcccagaagtctggttgttcaagatgttatctgagactgaagaaacacagatttttcccttggttcctggcaactccccctctcttattctctagctgcataaaaactccctgctgatttttgttgttattgttgttaagatggatttgagagttcttgccctcctgccctctcactttggccaaatccaatgaacctttcacatctccaaccacctgtgtgtcggtatttggtgtcaactgcacatcaggtacataagcctcaacttgggcttctataacaaagtcacaaactattactgcatttattcatcatcttctcccataatctacctttccatcatccatgaagactagaactcaatagatagtccaataaggtccagaggttctgatttggttccctgtcttcttgcttattctaatagatgatgcaactagtgcacaaagctaaatgtcttctttaagcttgcataaaatgcgtggctcagtgattggcatgctgttctccgcgcccccccttacatccacaaccaattctaaccagttaattcttcattttattttaatgacctatcccagataaaaagctaaagacaccccattcagcaccatataagaattaaaatgaaaaggaa

SEQ ID NO: 86474 - DNA, 153 bp, Homo sapiens
ggagttgaaggctgcagtgagttacgatcaagccattgcatgccagcctggaaatagtggaatgagcaagaccccatctctacaaaaaatagaaaattagctgggcttgttgatgcacacctgcagtcacaactactcgagaggctgagggag

SEQ ID NO: 86475 - DNA, 642 bp, Homo sapiens
aggctgaacagagaattaagcctggagtaaaataagacagccccagtgtcatgatatatggcagctgaccttcagtgtcagtgcctgggagtcattagggagaagtgagaactgtgggcatctaaagggcacatatcatttgatgacaccaaatcttcctatttttccaaagctagaaatctggatttttatatgaagtctcctgaattttatcctttggctacttattcaaatattgtatcagtgcgtgggccaaacaacccatgtttgtgagtctacaagcctctagactgcctgatttctaagccctctgaatgtagaaggggtgggcaagcaagtagaggaagtaagttacagcatggcagtggggatgggagagacagaaaaacattttgaattattacacaacgtcaaagtgcagttgtttagaatcacttagtagaggggaaaacatctctatgttcacattaaagacactatgttctctaatttgactatagtataataattaatgacacatgtcaactgatatgtcaggttctacgttgattttaacagtaaccttgaaagggaagaattcttgtcctgcttgtagataaggaaactgggcctcaagtttagtaagtacaaatcccctattta

SEQ ID NO: 86476 - DNA, 419 bp, Homo sapiens
tagagagagccgccccgccatttctcaggcacatactgtgagcccagcaaggccatggatgttacatctcattctgacagcgggcctgccatgcaggtggaagtgtcctgtttcacagagggctcacattcaccttgagctcacagctcacaaatggctgatgctggaagtccaggggggcctggggaagcaaatgaggcctccccactcgtacctggatctggcagcaactgtgcctggggactgctccaggccaaatggtagagtcattggtgtttgtgctcactgcctctacccccagcaaccccctctacctctcttctctctagctttgcccctccatcccttgcccagttctcttggaagaaggaatgagactggataaattcgattcaggacagagctgagcttacctggag

SEQ ID NO: 86477 - DNA, 485 bp, Homo sapiens
aacggcagtctcagtggttagcagcacaaggtagggtccttcccaggctggctcaagtttttcttctttctgacctttgatgaggatgtggtttccaggctggtgctggtgtactggaaattctaggggtggtacctgtgctaaaagacttagttctgagggaagggaaagtggaagataaaccaagtatataatttctgagaaactgatcttttgttttaaatgtggggacatcagcagtggaatgtaagtaaggcaacctataggtatttttttttttttttttttactttatagttcctagtgtcttcttgttgagaaatttccttttttaaaaatgtttacttagttgtttctgagggaccctttggggcttcttattttgttaggactttgcatatcttggggcttgaggccccatggtgatgcctcctgccccatccctacttagtgttgcctaggggacctggtggccctgcccctct

SEQ ID NO: 86478 - DNA, 758 bp, Homo sapiens
ccctgatgtgggcctattgattgttgatagaatcaccaccacacaaatcatgacaaacaaaaatattttggaattgccaaacatctcctgtggggcaaaattacactcccaccccgcctcctgcaaccctccatctcccattgataatcactgtcttagggcactgcagatactgagtgattggtgtgatgggatgccatacacacagaatggggagtccaggacttaggacactgaccttgggcaattcgcttaaactctatgggtttcggtttcgagtagaatgaagtagatatgcagaaaaatgagcaataaaggggaaaagttgccaggatagaaatacataaggaggccgctaggacaacgtaggaggtcaggaagctttcatgttgatagtgttgctttgtggagttccccagtcattgcgaacttcatatcttatttatctctaatctggtatttggcacatagtggatgcatagttccagatatttcagtcatggtgtctgcactcaagaccactttttaactaaaagaattcacccatagcccctgctgaatgcatagcctctctgaatgtgaaagtccctccacctctgccatagttgactggactaaaggtggtgcctgtgacgagggcaaccactctactggatggcagcaactgtgagaaggggtgagtggggccaatcaggttatctcccttaggaggatgaacttcaaaaacacaacccagggagagccagcagtagtaggag

SEQ ID NO: 86479 - DNA, 2666 bp, Homo sapiens
agaccactttcttcattcttttctaaactgctgcagattgccgtgaactctatcaatagtctcttttccgcaggcaaagtggcattttctaaacatgtttgcttactgccaggtggtttgaaatctatgatttactgcagtagtatgtgcttaaaacaactgttgaggtcttttaagcaggaaagttcaaaaggaagtgtcctgataatggtactggtttttctacaaatataagtagtcattagaagtttgcaaccaccaccaagtctgagagaactctgggatattctgtgggttttggcatattagatagagaaaatgacagatctagatgaagggagcttttggatgtgtgcctttaaaaactgattatgtataaatactgatatttcacatacggagatatttgaagacccaagtctgcctttcacagagccctccattccaagtttagtttttgtcaaaatatgaatcattttatttgactgtactatcagtacacaaatgcatgagtatgtttatacagtgttagactgatgtgaatttgcatttgttacattacattgccagcgcatatcatttagcaagttggcattaacatttatgctttaattaaatgccagtatacctatgtgtgcagcagtaaaaaattagtgagaaaaagcaactttttgtcactcttaggaaatattttgtcttattagtgttcttggcacatgtatattactaaagtagataattccaatgagaaatactaccagattattgttataaaattaatttacaatgtccctgatattgagctaactcttaaaaaaaccaaacaaaactcgtatctgagtgtaactttgccaatattttaaaagccaaaatattctctggacaacaaatttgtattgctcagggacagtttaccttgcctggtaaaccttcccaaacagaaatatagctatactatctttggttttgtttttttgttttttttgtttgtttgtattagatggaatttcactcttgtcgcccaggctggagtgtagtggcgcagtctcagctcactgcaacctccacctcccgggttcaagtgattctcctgtctcagctccctgagtaactggaattacaggtgcacgccaccacgcccggctaatttttgtgtttttagcagagacagggtttcaccacgttggccagggtggtcttggactcctgacctcaggtcatcctcctgcctcggcctcccaaagtgctgagactacaggtgtgagccaccgtgctcagccactagctttggttttttaaacatagattatattcctcaagatgaagggcttaacatatccacagcttcctcagtttgctaactccccatgcatctttgtgaaggacagtatctagtttatctgtaggtcagtgttccttgtgctgtcatttcccttatatctggaatttgtcagcattcctgaaaacctacacgtgtatatcagtaaccaaaatgctatgccttttttgcacctttgtacagcagccaaatcatgaactcaaaatgtatttgatcacagttctataatgtttttacctacctattatggaataatcagtttttacagagattattaatatggtagaaccctgttatgtaattccaaaacttaagaaccatatttacattgcttaacacagaattttacatctaagcaaggactggctttagaagcagtgtagttctacctctcattttacagatgagaaaaccgaagcccagaaaaactctcatttgctcaaagtcacagagaaaattagtggcaaagccaaaaagattcagatcttctgactcgaagttgagagttctttatactctattatgctgcctctccagtgtaatatttgcctttctgtaaatgggattaaatatgatttgtaaataaaggacatctgacctccttttttggtacattaaggcactttataaatggacttttattgtctcatttttcgtatataattatttccatcatattctttatggaagatgcaattaattttaacttttttactcttataaaaccagttcctgacattttaaaaaacaatatctgtaaaatggatccttttatgagtgaatttttctgctaattgcccaaggctaaatccaatttaaggattgcttagtttctttattttgtttatggtctctgaactggtatttttttataaaccaggctaattcacaggtcataccatttcattcttgtcgtgttggcttccagtcactggaaaagcttttgcattttaaagatttttagagccatgcaaaactgggcattaaatgttgcataaagcaaatcttttaagtaaggtaaaatgttgaagtcttaaccagaattcctacaactaattactaaaactgctatttctaactcttcatgaaagcattacctttggaaagttaaactttttttttcctttcatcaccgtctttgaaacaaattattttccaattcataagaactttggtaaaaaaaaaaataaaaggaaattatatgtttttctttggacattcattggaaggcttgttgaagacatgatcccccagaagccttagtgacccagatctcaaccagagactcaagatagcctcaaatacagtgaaagattatgtatccaaa

SEQ ID NO: 86480 - DNA, 1895 bp, Homo sapiens
tatccggtatgcatatttattcaatacctatatggctcaccatgctgattctctgctttcactatttcgtatgttttttgccaatattttaaaagccaaaatattctctggacaacaaatttgtattgctcagggacagtttaccttgcctggtaaaccttcccaaacagaaatatagctatactatctttggttttgtttttttgttttttttgtttgtttgtattagatggaatttcactcttgtcgcccaggctggagtgtagtggcgcagtctcagctcactgcaacctccacctcccgggttcaagtgattctcctgtctcagctccctgagtaactggaattacaggtgcacgccaccacgcccggctaatttttgtgtttttagcagagacagggtttcaccacgttggccagggtggtcttggactcctgacctcaggtcatcctcctgcctcggcctcccaaagtgctgagactacaggtgtgagccaccgtgctcagccactagctttggttttttaaacatagattatattcctcaagatgaagggcttaacatatccacagcttcctcagtttgctaactccccatgcatctttgtgaaggacagtatctagtttatctgtaggtcagtgttccttgtgctgtcatttcccttatatctggaatttgtcagcattcctgaaaacctacacgtgtatatcagtaaccaaaatgctatgccttttttgcacctttgtacagcagccaaatcatgaactcaaaatgtatttgatcacagttctataatgtttttacctacctattatggaataatcagtttttacagagattattaatatggtagaaccctgttatgtaattccaaaacttaagaaccatatttacattgcttaacacagaattttacatctaagcaaggactggctttagaagcagtgtagttctacctctcattttacagatgagaaaaccgaagcccagaaaaactctcatttgctcaaagtcacagagaaaattagtggcaaagccaaaaagattcagatcttctgactcgaagttgagagttctttatactctattatgctgcctctccagtgtaatatttgcctttctgtaaatgggattaaatatgatttgtaaataaaggacatctgacctccttttttggtacattaaggcactttataaatggacttttattgtctcatttttcgtatataattatttccatcatattctttatggaagatgcaattaattttaacttttttactcttataaaaccagttcctgacattttaaaaaacaatatctgtaaaatggatccttttatgagtgaatttttctgctaattgcccaaggctaaatccaatttaaggattgcttagtttctttattttgtttatggtctctgaactggtatttttttataaaccaggctaattcacaggtcataccatttcattcttgtcgtgttggcttccagtcactggaaaagcttttgcattttaaagatttttagagccatgcaaaactgggcattaaatgttgcataaagcaaatcttttaagtaaggtaaaatgttgaagtcttaaccagaattcctacaactaattactaaaactgctatttctaactcttcatgaaagcattacctttggaaagttaaactttttttttcctttcatcaccgtctttgaaacaaattattttccaattcataagaactttggtaaaaaaaaaaataaaaggaaattatatgtttttctttggacattcattggaaggcttgttgaagacatgatcccccagaagccttagtgacccagatctcaaccagagactcaagatagcctcaaatacagtgaaagattatgtatccaaa

SEQ ID NO: 86481 - DNA, 419 bp, Homo sapiens
ggccctgcctaagctatctctacctccccctacagcttcatctctgtttaccaggttctacccattctggcattcttatactttcttgatctaggacagctctttctcacccatgatctttgcctatgctactctccttttagtccttacctagctaacttctccttctggtcttcagttaaatctaactttcacagggaagtattccttgaccccataaatataaggatgtctccactgttatcctccctttaaaaagcactctatggctgggtgcagtggctcacaactgtaatcccaatcacttgaggtcaggagttccagaccaccctggccaacatggtgaaaccccatctctactaaaaatacaaaaattagccaggcattatggcatgcacctatagtcccagctacttggg

SEQ ID NO: 86482 - DNA, 554 bp, Homo sapiens
cagatgcaaaagacgaaagaaagctgtgatgtaactgatgggtccctgagtgtgaaagtgtgggctgcagagggagcctactgttcacacagggagttcaggaagaacaggaagcgtgcaggttaagtatggagaaagctgcttcacacgcggatacacagagatataatttattggaatggatagcagagtcacaaatatcacattaccttatattatcaaattgattttatattactatcgcaatcatcaattttctattgtcagttgtaaaatagttacagtcatccctcggtctacatgggggattggttccaggtcccccgtgtgctcccaaatcctcacacactcaagtcctacagaacccacatagtctgccctccatttgcctgggtttcacatcctggggggctgtatttttgatccgagtttggttgaaaaataatccatctataagtggacttgcacagttcaaacccttgttcaggggtcaactgtaatgaaataaaagaggattaatgtaagatgatataaaaacttttcatattgtattg

SEQ ID NO: 86483 - DNA, 644 bp, Homo sapiens
ggaagactagatttctgtacctttgtttcacatcagatcactttgtaaaacgacagaggaaaaaaagagaaattatatcatcttatatttgcaaatattttcatgttatctcatttaataaaaaaatcagtttgcagatgcacaaattgaagaagcaccagagattaattacgtctgaggctggaagctgggaaacccaataaatgaactcctttagtttattacaacaagaagacgttgtgatacaagagattcctttcttcttgtgacaaaacatctttcaaaacttaccttgtcaagtcaaaatttgttttagtacctgtttaaccattagaaatatttcatgtcaaggaggaaaacattagggaaaacaaaaatgatataaagccatatgaggttatattgaaatgtattgagcttatattgaaatttattgttccaattcacaggttacatgaaaaaaaatttactaagcttaactacatgtcacacattgtacatggaaacaagaacattaagaagtccactgacagtatcagtactgttttgcaaatactcagcatactttggatccatttcatgcaggattgtgttgttttaactgttgttgaggaaactaataaataattaaattgtaaaaagtc

SEQ ID NO: 86484 - DNA, 2055 bp, Homo sapiens
acagaaaggagcagcaactggaaaacaagcattgcattgcatcaggatgtctatgaaatggacttcagctcttctgctgatacagctgagctgttactttagctctgggagttgtggaaaggtgctggtgtggcccacagaattcagccactggatgaatataaagacaatcctggatgaacttgtccagagaggtcatgaggtgactgtattggcatcttcagcttccatttctttcgatcccaacagcccatctactcttaaatttgaagtttatcctgtatctttaactaaaactgagtttgaggatattatcaagcagctggttaagagatgggcagaacttcctaatgacatacttagaaagttctgtaaggatatagtttcaaataagaaacttatgaagaaactacaggagtcaagatttgatgttgttcttgcagatgctgttttcccctttggtgagctgctggccgagttacttaaaataccctttgtctacagcctccgcttctctcctggctacgcaattgaaaagcatagtggaggacttctgttccctccttcctatgtgcctgttgttatgtcagaactaagtgaccaaatgactttcatagagagggtaaaaaatatgatctatgtgctttattttgaattttggttccaaatatttgacatgaagaagtgggatcagttctacagtgaagttctaggaagacccactacgttatctgagacaatggcaaaagctgacatatggcttattcgaaactactgggattttcaatttcctcacccactcttaccaaatgttgagttcgttggaggactccactgcaaacctgccaaacccctaccgaaggaaatggaagagtttgtccagagctctggagaaaatggtgttgtggtgttttctctggggtcgatggtcagtaacacgtcagaagaaagggccaatgtaattgcatcagcccttgccaagatcccacaaaaggttctgtggagatttgatgggaataaaccagatactttaggactcaatactcggctgtacaagtggataccccagaatgatcttcttggtcacccaaaaaccagagcttttataactcatggtggagccaatggcatctatgaggcaatctaccatggaatccctatggtgggcgttccattgtttgcagatcaacctgataacattgcacacatgaaggccaagggagcagctgttagtttggacttccacacaatgtcgagtacagacttactcaatgcactgaagacagtaattaatgatcctttatataaagagaatgctatgaaattatcaagaattcatcatgatcaaccagtgaagccccttgatcgagcagtcttctggattgaatttgtcatgcgccataaaggagccaagcaccttcgggttgcagcccacgacctcacctggttccagtaccactctttggatgtgactgggttcctgctggcctgtgtggcaactgtgatattcatcatcacaaaatgtctgttttgtgtctggaagtttgttagaacaggaaagaaggggaaaagagattaattacgtctgaggctggaagctgggaaacccaataaatgaactcctttagtttattacaacaagaagacgttgtgatacaagagattcctttcttcttgtgacaaaacatctttcaaaacttaccttgtcaagtcaaaatttgttttagtacctgtttaaccattagaaatatttcatgtcaaggaggaaaacattagggaaaacaaaaatgatataaagccatatgaggttatattgaaatgtattgagcttatattgaaatttattgttccaattcacaggttacatgaaaaaaaatttactaagcttaactacatgtcacacattgtacatggaaacaagaacattaagaagtccactgacagtatcagtactgttttgcaaatactcagcatactttggatccatttcatgcaggattgtgttgttttaactgttgttgaggaaactaataaataattaaattgtaaaaagtc

SEQ ID NO: 86485 - DNA, 2109 bp, Homo sapiens
acagaaaggagcagcaactggaaaacaagcattgcattgcatcaggatgtctatgaaatggacttcagctcttctgctgatacagctgagctgttactttagctctgggagttgtggaaaggtgctggtgtggcccacagaattcagccactggatgaatataaagacaatcctggatgaacttgtccagagaggtcatgaggtgactgtattggcatcttcagcttccatttctttcgatcccaacagcccatctactcttaaatttgaagtttatcctgtatctttaactaaaactgagtttgaggatattatcaagcagctggttaagagatgggcagaacttccaaaagacacattttggtcatatttttcacaagtacaagaaatcatgtggacatttaatgacatacttagaaagttctgtaaggatatagtttcaaataagaaacttatgaagaaactacaggagtcaagatttgatgttgttcttgcagatgctgttttcccctttggtgagctgctggccgagttacttaaaataccctttgtctacagcctccgcttctctcctggctacgcaattgaaaagcatagtggaggacttctgttccctccttcctatgtgcctgttgttatgtcagaactaagtgaccaaatgactttcatagagagggtaaaaaatatgatctatgtgctttattttgaattttggttccaaatatttgacatgaagaagtgggatcagttctacagtgaagttctaggaagacccactacgttatctgagacaatggcaaaagctgacatatggcttattcgaaactactgggattttcaatttcctcacccactcttaccaaatgttgagttcgttggaggactccactgcaaacctgccaaacccctaccgaaggaaatggaagagtttgtccagagctctggagaaaatggtgttgtggtgttttctctggggtcgatggtcagtaacacgtcagaagaaagggccaatgtaattgcatcagcccttgccaagatcccacaaaaggttctgtggagatttgatgggaataaaccagatactttaggactcaatactcggctgtacaagtggataccccagaatgatcttcttggtcacccaaaaaccagagcttttataactcatggtggagccaatggcatctatgaggcaatctaccatggaatccctatggtgggcgttccattgtttgcagatcaacctgataacattgcacacatgaaggccaagggagcagctgttagtttggacttccacacaatgtcgagtacagacttactcaatgcactgaagacagtaattaatgatcctttatataaagagaatgctatgaaattatcaagaattcatcatgatcaaccagtgaagccccttgatcgagcagtcttctggattgaatttgtcatgcgccataaaggagccaagcaccttcgggttgcagcccacgacctcacctggttccagtaccactctttggatgtgactgggttcctgctggcctgtgtggcaactgtgatattcatcatcacaaaatgtctgttttgtgtctggaagtttgttagaacaggaaagaaggggaaaagagattaattacgtctgaggctggaagctgggaaacccaataaatgaactcctttagtttattacaacaagaagacgttgtgatacaagagattcctttcttcttgtgacaaaacatctttcaaaacttaccttgtcaagtcaaaatttgttttagtacctgtttaaccattagaaatatttcatgtcaaggaggaaaacattagggaaaacaaaaatgatataaagccatatgaggttatattgaaatgtattgagcttatattgaaatttattgttccaattcacaggttacatgaaaaaaaatttactaagcttaactacatgtcacacattgtacatggaaacaagaacattaagaagtccactgacagtatcagtactgttttgcaaatactcagcatactttggatccatttcatgcaggattgtgttgttttaactgttgttgaggaaactaataaataattaaattgtaaaaagtc

SEQ ID NO: 86486 - DNA, 535 bp, Homo sapiens
aatgttttcattaatccaattccaaaaagcagaattatttaatttcctctctgtgagtctaatttatatctcttctccatctagaaaggactttgagacagctctaaaaatgagtatcttggaaaatatcccaaatttaggaataataacgtattagagaaaccaatagggccgaagacaaatgggagaaatattttctcaaagtaaacaacacgtcgcttgctattttatgtctaatgcaagcaaccacctcccagcagagtagccagcagccaggggcaagtgcattggcaaccaagggcctatgtcagggctcagatgcctctgattcagccctcaatttacagaaagttcacagatccccttattttagccacaaatgcactcaactcctcactgatgctttctggaaactgccagcttctcagtgcatggctctaggttggctgcctcatattgcgctagttttcaaggcagcctgtttggtggtgatgtcctgggtcagctgtgtgaaagggacttggctattggatat

SEQ ID NO: 86487 - DNA, 268 bp, Homo sapiens
ggcatcatggggccactggagtggagagagtttcagagggttctggctggggtcggtcccctgaggcatggctctgcagctgatatgcttgcatgcattgagtgtggagaacttagtgtggagaacttctgtggttttggcaaatgcataatgtcatgtatccaccaccacagaatcatgcagaatagtttcactgcctttaaaaaaatcccaggctgggcgcagtggctcatgcttgtgatcccagcactttgtgaggccagggcag

SEQ ID NO: 86488 - DNA, 392 bp, Homo sapiens
cttgtccccacccagtttcctgctctagacaagttgtacctctgggctctttctcctctacttttgcccctctgtaactgtcagtgtgtcatttctgcctcactctggacaagcctgccatctctgcaggtgtgatttattgccagatggttattttgttagcagtggttgagtcttatgaaatgtaatcccaactgatcttttttccctctgtgtgaagtgtgtggcgtgcacagtttgtgccatttgtataccctggtgctgaggtgtggtggtttatgggggagctccgtttctggccgccatgtggccatgggagattgacaacaacgctcaccctcagcacttcagagacagccatgaatgttttcagataatctgttcagaaatgg

SEQ ID NO: 86489 - DNA, 807 bp, Homo sapiens
ctttattgcgaggctgagtatgatgggctccatccagcacgaacacaaagccctgtgagaggaggcagagtgagatgaagtcgaactgtgggatatgaaaggcattttgaaggagtaggcatcaggttgggttttaaaggaaatctactcaggagcttgggaggattgcttgagaccaggagttcaagaccagcctgggctacagagcaagaccccatctttttgaaacttcctgcaactcgcatctggaaaagtgctgttatttgaaagggtgccgacattgtgaaaaacacggagtattgatctctgaagctgagatttttgtcctaaagaatactcaagatgtgtccctggctgggcacagcagctcgtgcctgtaatcccagcactttgggaggctgaggcaggaggatcgcttgaggccaggagttcaagaccagcctattgtgaatagtaccactataaatagagaaagcgtgccgctccaagtgtcgagggttagaaatgagaattcgaagtcttgtgtcctggaaagttttgataagcaaatacggctgagctcccgcgctctcttcattggctgcttgttcaccgccagattttgacacaaataatcagattgaaaatcagggaggggaacagaagaggaaaaacacacagagagacagagcaaaaaggagaagtatctatttgtgcaaagagtcacacagttgacagagtggaggccagtcccgagagaggctttgcagttcccacctcgggaagctccggcagaacccaggcgagggacagctccggacaggtgag

SEQ ID NO: 86490 - DNA, 222 bp, Homo sapiens
  misc_feature (215)..(215): n is a, c, g, or t
  misc_feature (220)..(222): n is a, c, g, or t
tgctaagtatcttattttgatgtcttgccaattccctttaattatacattttagtcacatgaacctgtctgtggatcctgacacacaccactgggtttcataactttgtgtcattccataggctggactccatttctttcctgcctcgtgaactcctagttgttaaaacgcggtacaaacttcctcagtttttttgcctgcccactgcccacacngattnnn

SEQ ID NO: 86491 - DNA, 685 bp, Homo sapiens
gatctatctgagaacaaagaagtcgacagaataacattgatgactttttaaataattaatttatttgaagaatgcttgcatacaaaaagcttcctgcaggaattttaaacaagctgtccttggttatcccaggcaatgtcagttgatttaattaagtttacatgcaaaagagaatacaattgtaacattaattggaacattaagttggcttataagcagtatttccactgctcctacaattgattttagttatttgataatttatttaatatttgtatttagtgtggtaaactcctgtagttcataatattttcaagagtgtcatttgtatttttgttagttcttaatgaataatggaaaagttatcttataatttcattggagccaaagattttaaaataaaaataaaaacaaacacacaaataaggcaccttgtgtttgtttattttctgtcctctgatcatcacccagttaatgagcaaacaaggtaggtggcacccatgagcctgctgtgacatttaccacggggcacattctcctaagagtaactgcaaggcaatgtgtataatgataaaatgatcttacttgatttcttttaatgaacattatatcccagatgaatgtcctgttcccaactctttgtggaaataacaaaccctttctctaagttatgtgaagattttag

SEQ ID NO: 86492 - DNA, 420 bp, Homo sapiens
gtgcaatggatactactgagctgctgggtggatttgagcaggttgatcttatacgaccttggaggaggctgctagagaaggtggagggaactgtaagggcactgttaagggatagcctccttatcagtgctgatgatgcagaagtagtgctgcgagcctggagtcattttcttctgacatataagcctaagtgtcttggagaaggtggtaaagctatcacgatggagattgtcaacaaactagaagcagtgttattgcttatgcagcgactcaacaataaaatcaactcatactgcaaggcagagtttgccaaacttgttgaagagttccgaagctttggtgtgaagcttacgcagttggccagtggccatagccatggcacatttgaatgggttgacagcatgttggttcaggccctga

SEQ ID NO: 86493 - DNA, 1574 bp, Homo sapiens
cccctcatagctcactccccgtcaaagctgaggaccatcgttgtcaaagcatctactccccgggaaatgagagagggaggttggtagcaacatcagagtgacagttggctgtctctcatttcttggggtcatcagtctgatttgtttagagcctgggatcatcccagttcctggaagaatctttggaaaagggtccccttgttcttgggacatgtgtcatggtcactaagccccctttccctcaggctactgttgctcagggacacaatgagataccccaaggacatctagacctgacttttcatgaactctcttgcctctgtggtccccacattggagacctccctccctcctccttcccttgtgtgaaggagacacctcccgagcaatcctaactcatccagctcacttttaacaaagcaaagagcagagggcactgaagactggatggctgtgaatggtacaccttggggttgaaaccgtgttggcaggaacctggtgataaaagctgcctacttcctgggtgtgtgaatttgcacatatcttttcccctcactggacttcagaagcctactgtgaactggggacgatgctatctactttccctcctgaagcccttctaactttcaaatgtatggtcctggggccatgagtcctgcacagaaactgcagccttgccagattgcttcccttggtgcagaaaagtgtgtgtgtgtgtgtgtgtgaaatatacgtacggttttacgtcaaaaacagtcgaatatcagctatttcatatggttcaccctaatgtacctgcctctctctttggctttaggtctgagaatgacttgtctttgtcaaggtatactattgttagaaacgcattaccaaatgcatctcttctgtcggatcagcgtattcctagattaggaattcaaattaatgaaaattcacatatgaaaggaaaatccattgctatttctggagaggacctcagtcctgggcttttccctggcattgctacctgggtgggtgctcaccactcaggtgctggtgttggaaggcaggaggaggaagctgaaatcctgccgattaaggctaattaacagggtttaggtgcctaattatcatgactcagcccgggacttatggttagccgtgcaggccaggtgagtctcttatggacttcctctcagactgctctttctcattttgtcctgatgagatattgacagtcatgtccacccgcttcctcatccatttcccgtcttgggccctggaagtacgggggcctctgtaggctgcctagggagccctggctttgctcttcgtgttgggctcactccatgatcaggagccggtgggactggtccttcctgattcttactgtctgtggttccccatcccctacggggagcctgctttgggccttgagctggatagagagaagagctttggggcccagctggttataggagctgagcttttccacacctctctttgttaacccttggaaacagacctgcctttcacctgacccatcttcctacctgtctggtctgacctgccctctttgaaagcactcatcacct

SEQ ID NO: 86494 - DNA, 411 bp, Homo sapiens
  misc_feature (1)..(1): n is a, c, g, or t
  misc_feature (152)..(152): n is a, c, g, or t
  misc_feature (233)..(233): n is a, c, g, or t
ngactctagatccctggagctggttttctcctagagcttcaaaaggaaggcagttgacacctaatttggcccagtgaaactcattttggacttctgaattacagaactataagataataaatttgtgttgttttaagccacttggtggtagnttgttatagaagtaataagtaataggaaaataaacacagaagtgtatatgatgaaatacaataaataatatctatagccgnctcaaaatatgaacacaaattgccactcagaatatgccagaattcactgtttttgatcagtatgttaaaatattcacggccgggtgcagtggctcacacctgtaatcccggcactttgggaggccaaggtggtcagatcacctgaggtcaggagttgaagacctgcctgaccaacatg

SEQ ID NO: 86495 - DNA, 272 bp, Homo sapiens
aatttgcagccaagtcagacaaaagtaggtagcctgagtactttgtttgtgactggcatctaaagtgaggactgttcgtgtgggactgaacccttaaaccatggagtctctaactctagctagtatcagaactgaactgaattggagtcagaaaaaacttgagagtactctgttaaaaatccttttataagtttgttgactgtatactctgaaagacaagaccatgtttgccttgtctaccattgtatccccaggcacctggcacagtgcct

SEQ ID NO: 86496 - DNA, 492 bp, Homo sapiens
gcacatgggccatgttcccaggcattttctacctcagcctctagtgcatatgattacggaagtctttgccctgccatggggacctgcacagataccttccttgccaactggtatcctcagctctgctgttgctcgtctctctcctgactttctcccatgccctgacagaactttctgccgaataactcacatccaagaagcaaaccctagccactcttcccataatcttgtgtctccctaaacattattctgcctcctttgcaaacacctcagattcactttatttcctttctactcttccaaattgttcttatatcttctccctcccgtctctctccctccctccctcaatgactagacattgtcaggtaaaggtcaggcctggtagaccagttggagtcactgccacattgcctcaaaagctgcacctggggcctccaccagtactgagtgaccatcctgctcccacagcctcttcacttttccatttaa

SEQ ID NO: 86497 - DNA, 379 bp, Homo sapiens
aggcgagaggcttcggcggcgggagaaggggcttcgtcccaccgccatctttgcgggaattgaacagcttggacttggagacagtgagttaaaacagaaataagaaggcggcagaaaaagactaccagattgaaatgtgttggatattcatatccacccagcacctcagaatgtggccatggaggatggagacagagattggagtgatgcatcttcaagcctaggaacactaaggattgctggtaatcaccagaagctggaagaggcaagaaagtgtcctttcctagagccttcagagagagcgcagccctgccaacaccttgattatatgcttcaagcttctagaattgtgagagaataaatttctgttgttataaac

SEQ ID NO: 86498 - DNA, 157 bp, Homo sapiens
gatccccaagtgtgaacagtctgaaaagggctttttgcttgctgcagggacctgagaattgagaaacagctgtgaaactttgaaccctggctggaaggtcctggtattgactgtggcaagaaaacgggggagctaatctgtaatctgcttagatgga

SEQ ID NO: 86499 - DNA, 190 bp, Homo sapiens
cagtgcatccacatgcacacacattcaagcaggacataaggcggccggccggtccacttcagatcataaccaaaagtcttggcccctcaccactcacctgtcagcctcaggcagccagggacccagcatgggaggcacacctcatgagaactaccccaatgctcaagtgcccgcaaatgcccacaaaccc

SEQ ID NO: 86500 - DNA, 168 bp, Homo sapiens
aaacaaagtgacttaatttacagtgtctggtttgcctaatcattcagctctctcatgtagtattccttctttttttaatttaaaatttttttatttcaataggttgttgggaacaggtggtgtttggttacatgcgtaggttctttagtggtgatctgtgagattttg

SEQ ID NO: 86501 - DNA, 159 bp, Homo sapiens
caacccaacaaggaactaagctaaccccaccatgcacaacgcaacagggaacctaaactaaccccaccatgcacaacccaacagggaacctaaactaaccccaccatgcacaacccaacagggaacctaaactaaccccaccatgcacaacccaacagg

SEQ ID NO: 86502 - DNA, 293 bp, Homo sapiens
ggatcagtgaccagcaccccaggaccaattttttatcccaagttcctagcagtccctgctgtcaccctgggtctttctatttggatttctcatgagcaatttaaacacaacatgtctaagactaagtccaccattttccaaaaacaacctactcctctaccacccctgcccaccagcctaacaaggataacaaccttccataacaaggatatgacaatcggctacccgtgtgcccagccctggggtggcttccttaggtgcacacaactgcccccacgatgtgtggttttccc

SEQ ID NO: 86503 - DNA, 412 bp, Homo sapiens
aatagcttcagctgattgggtgagtcctattcatgttataaaaggtactctgctttccttaacattccataaatgttaatcacatctgcaaataccttcacagcaacatctagactagtgtttgacccaacaactgggcacaatagtttagccaggtttacacataaaacatcatcacactatgcttctcttctgtgttctttgttaccacgtatctgttccatgtgtttttctttgtatatatcctatcctgtcatatctctcctatggttttgtggaaactataagccttctgggggtaaacactatatcttgttcattgttatacatcgtatagcatatcatgcctggcgcattgttaaccctcattaatacagctggcagcagattttagcattcgtcatgtgtgcca

SEQ ID NO: 86504 - DNA, 168 bp, Homo sapiens
ggaatcgtgctcttttaaatatatctttttcataaaagttattttaaaatgtggcagtttaaaatgcctgctgaaagagttgatcttacctgtaagatcactgatttctttctttaaaagctagtggatacccaacttgtaaagcaccaaagtaggacttagtgtggg

SEQ ID NO: 86505 - DNA, 1326 bp, Homo sapiens
atggatgttaacagcagcggccacccggacctctacgggcgcctctgctctttcctcctgccggaggtggggggcaggctgcccgacctgagccccgacggtggcgccgaaccggtcgcggtctccgggacgccgcatctgctgagcgggggcccccgaggtgacggccagcccggcgcccacctgggacgcaaccccgggcaatgcctccggccgcggggagcaaatcaagaaagggccgagaaagttgtgatcggctctgtcctgacgctcatctctctgcgatcgcgggcaactgcctggtggtatctccgtgtgcttcgtcaagaagctccgccagccctccaactacctgatcgtgtccatggcgctggccaacctctcggtggccatggcggtcatgcccttcatcagtgtcaccgacctcatcgggggcaagtggatctttggacactttttctgtaacgtcttctccatgaatgtcatgtgctgcacggcctggatcttgaccttgtacgtgatcagcatcgacaggtaccttgggatcatgaagcctctcacgtaccctatgaggcagaaggggaaatgcatgacgaagatgattctttctgtctgccttctttccgcctttgtcactttacctaccatttttggtcgggctcagaatgtaaacgatgataaggtgtgcttggtcagtcaagactttggctacacgatttactccaccgcagtggcatcctaatccccatgtgcgtcatgcttttcatgtactaacagatttacaaggccgccaggaaaagcgcggcctaacacaggttacctggcttccctcgagtggagccagacagcagtagtcaccctgaatggcacagtgaagttccaggaggtggaagagtgtgcaaacctttcgagactcctcaagcatgaaaggaaaaaatatctccatctttaagcggaaacagaaagcagcgactaccttggggatcatcgtctgggcctccaccatgtgctggccgccctttttcctcctgacagccagacccttctgtctatggcactgcctgcagctgcatcccactgtgggtggagaggatatttccatggctgggctatgcaaactctctcattaacccttttatttatgccttcttcaactgggacctgaggaccacctattgcagccggctccagtgccagtaccagaatatcaaccagacactctcagctgcaggcatgcatgaagccctgaagcttgctgagaggccagagagacctgagtttgtcctacaaaactctgactactgtagaaaaaaaagtcatgattca

SEQ ID NO: 86506 - DNA, 274 bp, Homo sapiens
ttttcacactcaagttgaggacatacttaaattagccaaccaaataaaggtatgtaatacaacaataccctttttggaagctagggaagcagtattttttactggtagagatcaaaaaattttccctaagtgagtgttgtatactttgtgaatgtgtgaatatatgaatgagtcagagggcaagtctttaggaattttctttgtaactctgagtaaaacagtagtgtcaatattcccttgggttaatgtaagcagatctgctattaatactagg

SEQ ID NO: 86507 - DNA, 290 bp, Homo sapiens
tctttgcattgatagattagttatttatgccagtcgtctctgtctggcttgttttggtttttattgcatttgtttgctagagattcgttttagtttttcaatttctttctctgtacacctgcccctcccccaccccaccactgggttactacctcctttttggcactacatgatgccttaagcccaggtttgcctaagctttcataacagatcccagcactgctcatccccagtggtggaggttctaaatgggataacctgatagtgtgggaaggctggctgggggttgt

SEQ ID NO: 86508 - DNA, 685 bp, Homo sapiens
ctgccaggacgccgcgcctccgccagacgcgcccgggggcggggcgggtgatgtgccgctgcgcccgcgctttcctgctctcccccgctcgtctgcccgcggagggcggccccggggtacccctccccacctgatggcaccgacgtccctggccttagcgccccaccccgactcttcctcatggcgggcacctgtgtttatcaaactagccggaccacaggtgccctgctgagtgcgcaccgggcgctgaaaccagagccgcgctctacagggtccagagtgaggcccacagagtggatggaacccctgagccacacagctggtcagagaatggcacagacacaacccaggcctccatctactcgacagacctcaccacgagcctactatgtgctgggtgtggtccccaccctctgggatctcctgcgaccacgctgagtgccgaggacaggagccctgtctacacctgtgtgtccccttctcccctccaggaccagcccagcagaggctcaggagcccagaggacaacagtccctgcagtgcgccttccatccactgggaggcacaagaccagtctgaacagcagagggagcaggaggatggggctacagggaaagggtcctggctggaggcctgtgggcaggcagggctgttctgggccctctggagaggagctggttgacag

SEQ ID NO: 86509 - DNA, 139 bp, Homo sapiens
aagcattcttacacatacacctcattctgtcttaagattaagaaactttccaagactctcgagaaagctttccagaccctagtccctagctaaagatgagatagagattgaatgcaacactcccacttgcagttacaat

SEQ ID NO: 86510 - DNA, 649 bp, Homo sapiens
ctgactgaaatcaggcttggatttgtgaatcactgttttttccccctgtggtcactcctgtgatgaggtcaactgcttcaatcctttaggttttgtagacaggtttccggattccaggagtcccagaaggtccagggagcgctccccacattttagccagaagtaattaactaaaacataaaggccccactttctcttttcacactttgagccacagatcatctaattcctagcttgagacatcagatttcagatcattagtgcaaagcatcttccacaggaggcaataaaatgtcactttatgtaactcagctacagttacactgccttcagaaagcaggaatctccctgaaaacaaatttacatgaaaacagtcccattgtttgagaatttatgcaaatgttgcacaaaggggtttgatagtgattttaaaaacttaaatctttatcactgcctcaaagatatcctgagaaacttggttacctctaaagaattccattgcacttattttttaaaatgcctataatatagagttgttttaaaaattttccctaaactctaaacttctttctcagcttcaaagccttccgtaatgaatatcctaaagagagcctagtgcatattggtttaacacttactaggatcactc

SEQ ID NO: 86511 - DNA, 329 bp, Homo sapiens
tttgctcatagggctgcctcttctccagctccaaccactggaaattccatccctcaaagcccagatcaactgctaactgcttcataaccacctagtccaaaatgaatatgatcattatgttccagaactcctctatgcttcaaattagagtactccctgatctaccactacctgctggactagtcacttaacttctcttcgcctcagtttcctatggtagaaccgactagtcggttctaccataccatcaatatcttcaccatcaccatcctcatcaccttcaccatcaccatctacatcatcaccatcctcatcaccgtcaccaccat

SEQ ID NO: 86512 - DNA, 1219 bp, Homo sapiens
taaatgaaaagaactgtattttctagaattgaaaaataattcttttagatgatagataagatgtttacatcaacctgcaaaaagtcaatgttgaagaggtctcattgtatctcacagaattttgatttgcctactcacccacaggagacatttctgggacagtagcaacataaggtccatcccaaaactttggctcattatcattaatatcctgcactttgatgatgaattctgattcaggctccaggggctttctggtttctatgtccacagcctgagcacgaagagtgtagaaaggtttttcttctctatctaggctccttattgcatgaatgtcccctgtggtttcatcaatggtaaaaacggtgccagcgccatctcctgagagggtgtatttcgcagtgccctctcccttgtctaagtcggaatggagctttagggaagagagggagagagagaggaagagaaagagaaggacaaagaaagaacaccattaaaaggatgttgccaaattaaaaagtcataatttgcaatacaattcctttaatcaaaaatgttaaataaaaatcttatggttctgttttcttgttttttatttctccaacttctttttataaaaatttcaacacaaaaagttgaaaactgcaatgaacacatatacatatacatccaaacattcctccattcgtctattaatctgcttgccttatcagataggtctcatatccattcttctgttcatccttctcttaacccatttttttttttgaggtgttacaaagatcagaacaaaagtacaacctcagatatagcagcaggcaaaaaaaaacaataaattttgaaaatttgtatttagttcttctgtatccctttgggataacattttcataaaatgaaatgcacaaaacttcagtgtacttattgtttcattttaaataaacattgcaataaaaataaattagctcatagacaccacaaaataaactttccaagtgttctgaagatgaaatcaatgacctgaatccagtgggagatagtgcaaaggaactcagaaaacactaagcattttcatttgtaaagaagggaaaaatctggcaaatcaagaggttttcagtgatatagggcagagcgtctcattttaacaggctgagtttgaatgagtttaccactatgattggtagaatcactgattatcctttcagattcacaaatagcttgt

SEQ ID NO: 86513 - DNA, 952 bp, Homo sapiens
acagaaaaccaaacaccacatgttgtctcttagaagtgggagctgaacagctccttattgcatgaatgtcccctgtggtttcatcaatggtaaaaacggtgccagcgccatctcctgagagggtgtatttcgcagtgccctctcccttgtctaagtcggaatggagctttagggaagagagggagagagagaggaagagaaagagaaggacaaagaaagaacaccattaaaaggatgttgccaaattaaaaagtcataatttgcaatacaattcctttaatcaaaaatgttaaataaaaatcttatggttctgttttcttgttttttatttctccaacttctttttataaaaatttcaacacaaaaagttgaaaactgcaatgaacacatatacatatacatccaaacattcctccattcgtctattaatctgcttgccttatcagataggtctcatatccattcttctgttcatccttctcttaacccatttttttttttgaggtgttacaaagatcagaacaaaagtacaacctcagatatagcagcaggcaaaaaaaaacaataaattttgaaaatttgtatttagttcttctgtatccctttgggataacattttcataaaatgaaatgcacaaaacttcagtgtacttattgtttcattttaaataaacattgcaataaaaataaattagctcatagacaccacaaaataaactttccaagtgttctgaagatgaaatcaatgacctgaatccagtgggagatagtgcaaaggaactcagaaaacactaagcattttcatttgtaaagaagggaaaaatctggcaaatcaagaggttttcagtgatatagggcagagcgtctcattttaacaggctgagtttgaatgagtttaccactatgattggtagaatcactgattatcctttcagattcacaaatagcttgt

SEQ ID NO: 86514 - DNA, 311 bp, Homo sapiens
acaaatatcaaacaaagatggcaggggaaaaaaagaaagccaaccaatatcctttatgaatacagacacaaaaaatccttaataagtcattagcaaaaaaaaattcagaaatatattttttaaattatacactgtaagaaattagggtttattccaaatatgcaaggctcattcaaatgtgtgaaaatcaatcagtgcaacccaccacattaacaagctattattttgtacaactgcatatgaatctacgattatcttaaaataaaagttttaagtaaacaaatgaaagaacctgccccaagaaagcaaat

SEQ ID NO: 86515 - DNA, 395 bp, Homo sapiens
cagtattttcaagtgttgataaactgtggcataagccccaccaatccacaacttaatgtcttgcacactacacagattttcagtgtccaagcacatcaatagagttactaggaaaacgggactgccacagccaaagacatcacagagtgcacacagttctcacaggagagccacaatcaagaagtggtttacattagaaataattctacaaaaaaaaccatgggaatataagtcatttaagatgttcaagacatattaaatgcacgactgtgactccaaattgccattttgtatgctttgtattacatgatacaaaaaccaccccaatgcacccatggaatgttaagctgatctaaggtgcttatttttgttttgttttgttttgttttgcttga

SEQ ID NO: 86516 - DNA, 497 bp, Homo sapiens
  misc_feature (5)..(5): n is a, c, g, or t
  misc_feature (10)..(10): n is a, c, g, or t
  misc_feature (488)..(489): n is a, c, g, or t
  misc_feature (494)..(494): n is a, c, g, or t
  misc_feature (496)..(496): n is a, c, g, or t
gcccngcccnacagcgggtggtaactccagttctagccaggacagattcagagccctcaggactcaggggcacacacaagccacacaggtggggctgcagatgtggggctcaccgtgctggagccaggctggttggcactggcatgggacctggggaatcagccctcggctgggcagccaggatgcctcctgctctctttcctccatcccaccccttccacttccagaggccccgggatatttttaaggggaaggggaaggatagagagaaatgcaggcagggctggggtctgggcctgtgggatcctcaggcaggaggggagggctatatcatgatggcctggagctggggctggaggtgagtcttcccggatgctgggaatcaccaggcgggcaggagggctgttccaggctgagggaagggcaggtgcaaagcccagagtggggaagacgctgggcagcagtgtgggtggtgcagccggactggnnggagngng

SEQ ID NO: 86517 - DNA, 473 bp, Homo sapiens
gagttcaaggttacagtaaactacgattgtgccactgcactccaatctgggtaacagagtgagaccttgtctctaaaaacttaaaaaatatttttgtttattgaatgtctcttcctgctacactgtgacctccctaaggaccccagtccacatcagtttggtttgctaatgtatcccaagcccccaggacagagcatggcaatgtaggctctcagttaatatttgctgaatcaatgaatggtgcagcagcactgtccaccttctatgtcctgtttgcccaacccagtcttggacttaggtgtgtgttccctgaatggaatcacctggtgacccacagacacagagctgttccccccatgtgtacatccagctgatactagaaaggagaggtgggcccgagttttggctctgctgcatcactggcttgctgttccaggtcggaattttcctctttctgagcctttgtttctcac

SEQ ID NO: 86518 - DNA, 675 bp, Homo sapiens
aatggaactggaatccccagcaactgagtaattcacaagtatgccatcagggaaatagttttgatgattgccaagagatgacacatggcaaatgtgtcagtgaaaatactcttgtttgaataaaacttcttctagtctattctactggaccctgctggcacctcaaagagttttttgtttgtttgtttgttctccaaaaataaatggcatgggtaactgggtctctcagtttgtcatgagttcagtgtctaggtatattactacaaacataaaatatgcatctcttattacatatgtctgattactacggtaatacataagtattgtagaaaatttggaaaattaaaattaaagaatttaaaatcatcttaaatcctacccaggaatgatcaccaataacacttttagaatacagtctttagattttattttatatgaacacacataaaaagatgggaccttgtcactttgagctaaaaccaggcaaagctcaccaccttagattttcatgatatcagaatggcgtctagacctgaagttgtcattacctggctgactctaagaaattccctttgcaaccttagctctcagttttcttatctgtgaaatggccttgatcaacattttgaaaatcatatttcctggaatgttatggatgtttcttgaaagaatctg

SEQ ID NO: 86519 - DNA, 166 bp, Homo sapiens
gactctgcttttctaagacgactcttttttaaaaaaatagtaatttggtagtaatttggcagaaattcagaaattttatttgagcggttaagacatcaaataaaaaaacattttagcaaatgtttttggaatgtaatagatacactaagcatgttcagtagtttag

SEQ ID NO: 86520 - DNA, 401 bp, Homo sapiens
caaagaaagcaagaagggagggtattcagagcaaaacatggaaggactcacctatggtagaagagagaccattccacagaaattgcagggaagaaggataaatgggtgtgaacacttgcttaaatagaagttttttggttacatttatgagcagcccagttgaaccagtttatgcaaaaagagagaatataatgtttagaggtgtctcctcagacctcagagcaggaaacacacctcactagggactagaagtaggagccagaaactcttcaagattcaaaatcccactctctagggctatgggtttctcatttctgcttcccttggtagctctgcttcaatgccacatagcctgcttttttatgtgcacatggctcctgagtcttacatggcagttcaaa

SEQ ID NO: 86521 - DNA, 379 bp, Homo sapiens
cttttactgggaaggggatcatccctcaacaactggatttgttgtggtggtggtggtagtggtttgcatctcgggaaaattttgcacccagaatgctacagctgtagggatatttacagagcatctaattcaattccttagtttcatccattaggaaacaagccctgaaggggaactgactggctcattgcttcataagtgagttttagagttctaacaggaatccctgccaacttacctcaactgtcattctttagactaataccatacttgggaggaagatccaaaagtgtctagaattttacttttggtattgatatgttagatatgttatgaatgtgtcgaggcttgctgacataataatggctttatggacttt

SEQ ID NO: 86522 - DNA, 387 bp, Homo sapiens
tacatgattccttttctggctaccctaggtatgtatgtacaggatggtaactgtttcggcaaacactaaactctgatcctggacaggttagcaagtctgggccattgctaataatttttctcataatcctgtgtgctctgtcccggagaccaggacttttatgtattttcattcttaacctaaggatcctgctccaaatcccaaagttgggtctcagaaagaccctttcactcatagccaagaagctcctctactaagatccccttttgccaagtctccagatgcctctcaccttcccccaaactcatttcatctgcggatgttttatttacttcaagttgctatggcatccttttctgttagtaccatacagcgtgggggtgaaga

SEQ ID NO: 86523 - DNA, 378 bp, Homo sapiens
gcaaaactgcatgctaaaatctgcttggggagattcataaaacacttttctggctcaaaaattaggctcttcattcaaacatttcaggcttctttttttccttttacccatccgataggttgtgagaatgctatgattatagtttcctcatcataaattctttatccacaatctatttttaattaccccttatcaattttaattttgacataatgtattttttgacagcaaagattttaaatactacatatagacatacatatgtatacatacatatacacacattcttttcttaacacagatcccttaatacaaaaaaagtgacaattcctgttgacatcttccccagtccaccgggttggtagtcataggatggtg

SEQ ID NO: 86524 - DNA, 486 bp, Homo sapiens
tggtgcccggccgccctaccctttttcttagctttttgcagaaagctgtcatctgtatttcctcactattcaagtcatgttggtcctaggttctatatatctctatatattattttctatatagatttctctaaccatcattcttagagccatctcagaatttgatagcccatttactttgttcttgattatccctaattaccttattattgcttctatctccctttgctctttttccattttccacacacctttcctaaaagcctgcttagatcttcgcaattctggctcacattcctattaagctggtgctacccaacagaaccacactgtttgtggatcacttgaggtcaggagttggagaacagcctgacgaacatggtgagactccatctctactaaaaataaaaaaactagctgggcgtggtggcgtgcacctgtaatcccagctactgggaaggctgaggcacgagaatcgcccgggaa

SEQ ID NO: 86525 - DNA, 257 bp, Homo sapiens
gattaaattagttcccagagaaggttgactccaaaagagagagcacaggaagatgatggaatagaaaacaccagatcctccttcccctatggagatgaattaacaatgttagatggcctctgtgagaaatccagaaactagttaagaggtttctgtaccccaagtatgccaagaagaacctcatgaaagccagcagaaaagttcatggcatatactttccacagcctctccccagcacagcatagcaccattggaaa

SEQ ID NO: 86526 - DNA, 121 bp, Homo sapiens
gatccagtcagagccagggagagtgtttgccttaaggagggactcccttgtccaggatggggctggcactagggatggggtgaatcttaggacaggagtgggggtcagaaatgggaggggt

SEQ ID NO: 86527 - DNA, 799 bp, Homo sapiens
attatatgtgacggtaagcatcattgccactgctgtgctttatcatcaaaacagtcaataaactcttgctttgatttcacatattcattcattcattcatccatccatccatccatccatccatccatccatccatccatccgtctaccacctacttaccccctcctccacatatgcacagacacacagatgtactggggtgtctgttacatggaggcattgcaaagtgtgcttgaatgctacttgccagcctggtttctccctgacaatttgggcatgcacaggattgggactcaggattgaaactaccattatctcaaattgaggctttgtaaaagtctcttcatacctagaagttgtctattgttttttctcattttttgaagacaagattggattgatgattttttggataacttccactgtttaaatttcagggattttttgtttttctgataatgccattaccttagttatgttatattcttcctggataataaggcagagtaagccctgtttcacagatacaagcaagtatgatgagaggattcagtgtctaagattttttagtgagtttagctgaagctaaaaatggttatagagtgtcctgattcccatttagttttccatcagatcaataagatacttggaataattactcatagtggtttggaacaactttttgacttaaaattttccattatatttttcactaataaagatttttttaaagttaccatgtttgcagtagagttaaaagaattcaattattgctgttaatccttaccagtcatattta

SEQ ID NO: 86528 - DNA, 443 bp, Homo sapiens
gccccttccctccttctcatctttccctacttccttcacactatctgaggcatcctggcctgcttgaagtatgcaaataaatatccccatttacatggggtactttctgaagtaaatactacacagaagtgaaatcaacgaactgccccctcccttcacctttaattcctggtcagccctgctccctccttgcccatccattatagcaggagccaccagcagacccataaagaatgcgcccatcaaccctgtgagcagcctccctcccagccaacagcagggtcctcaggcccagctggaggctcccctgtgtggtaccggctctccagggctgtaaggccaccttttgtgtgtgacggtggctggaagccactaggcatgtgctaagtactcctcttgcctctcccctcacctgctccgaatgctcaaaccctcaaggccaa

SEQ ID NO: 86529 - DNA, 2621 bp, Homo sapiens
  misc_feature (915)..(915): n is a, c, g, or t
  misc_feature (1992)..(1992): n is a, c, g, or t
ttttcatgcttccatagaatcatccctgacctcaggaaaaaatacaaaaatggaacaaacaaaacagaatagtaaaacctgaagtaagaaaaaaagaaatgaatttgacattgtacagatcaggagaaagaaagttcattaacagtttcaagatccctgcgttttcacccagcaggaaacaaattaccatgagttaaggtggggaaattactggcaattcattgccttcttttaaagactttaaaaaaaaatgagtaaataattttagactattaccccctttccatgagagatacacagctagttaaactgccatgcatattaattttttgttttcattttattccacctaccaactacacagtgtctgctttccaaaattagtttgaaagccaatgacctgtgtttgaactgggtgaaatagcatagcagttcacacctggaataaaagaatgattgtgtgtgagtctgttaatggctgtgtagagctatatctctatatggagctatataaaaatatattttatacatgccagattcatttagacttgaattgaccctgtggtaaagcagcaggaataaaatatttttttgataaagcactcactcaaatagagaaatgagctcttgcagttaccatttaatctgtgacttctttttgagatgcagaaaaactccattataaagtgctcagttcatccagggacacagacacactgtgggttataacacaccctcatctgcatggtgaggtacatgagtcagctgctcttctctcaggagggtggctttaaagctccacagtcatgcatgctgccaattccagattgtccaaacctgtaggttagcaaggacacaggtgagccataggtatgacatgttcataaaaagaaaaatatattttaatacaaaacntgtcaggggagtggagagtgtcaaattgaggacaggagagacctagattcaatgccatagttcttggctaatctctgagaagcttgttagtcaccctctttctccttcccttactctcctgtatcttcccttacatactgcatagtcccttgtaatttacaagacataaaatacttcctttgttcatctgtatactgaatgtaagaatgaacaaaaggtcatcataaggacagcctgtgagtttatgcactgcatactgcaaatgacccactccagcaatgggaagacacccctaacattgcttctctccttataacgaaaatattattcatcatcagctttaaaatggatcttctcactctgtgcagtctccgtggtaacgtcccataagcccagggttttaagacctttctcctgtgctctaagcctacatatctaactgcctaatggcctttccacttgaatgacacatcattcagtttcagtgtcctaaactgaagtttcaactccaagtctgtttttttctcttgtagtcttcatgtcagtcaatcagtcttttatcctaaccagaaatatgtgagttctcatggattcctccctctcactcacttttcagttctataatcacccagttcctacattgtttgcatcttaaatatctcttctagtcctcccttctcctttatacccactgccactgccacaatgttagctccttcagatctcatattttctcacttttattgctatagacataccccccgcagttatcctacctctaggcaaatcccttccaaaatgcagctgccagtgtgatctttgtaaaatgcttttatgataaagttcaaactcattagcaaagcacacaaagacctttgtgatgtggtattgctgaattaaactactggcagccctagaaaggtaaagtgtatttgatgcttctgtgctgttcccttagcccagaaagcccttccagtttctgtttagtaaagtcctattcatctttcactactcaatgagtcataagtaatcccattaggaaagcctgtgtgatctacctcctccctaatttgccancttgagtttgcttcaccccttcataatactcagtcaatcataatgtcttataatccatcatagcacctcacacaatgaactccaatgtctggtttgttgggatgtccgccttactacattgtaagcttcttaagggtagaaaccagttctgataggcttagggcagtgaccaccaacagaaaaagtacttggtaaatgtctaacacaatctgttttactttttccagagcacgaggcatgcatgaaagagattaatttactccacatgggaagttactacccaggcttaccaaaaggtcaggtttatataaagtggcgttcctttttttcccccttagtaagacattaaaaaaagaaaccacaattgaaaagccaagagctatctgtgatacggaatatgaacacagaatcagattctcatagcagctaagctgttccccaggcagtggttctcaaggtgtgcttccaagaacagcagcagcagcggcatcacacatgcaaattactggactctgccccagatccacagaattggagactggggatggggcttagcattctgttttaacaagtcctccagatgattctgttgtgtatctagcttgagaatcactgccctggagaatgga

SEQ ID NO: 86530 - DNA, 525 bp, Homo sapiens
gagaactacattaacatgcagatgcccgagatcgagcctggagctaaggagtcagttccctctgctgtggggcccaggtatgggtaggagtctgctcatgactcaaatcatagcctggctgacccagtggactagtttctaaaaacatccactccttcctgtttcaacaatcatacaccagagcctgctaccacgtttgaatttatttcaatgatatgcaggtcagaaccttatctgtttatatttcaatgccaaaatattttaaaaatgactttttaatgatgtgtaaaattgttccaactttataaataacctccatttgtttgctttcagattttgtacatttgttttttatcttaataaaccaaatctattcacagaactaggaagatgcttattaataccagattgcatggtccatatatcaagtttagcaaataagcattatccacttatttgctaaaagcaatctttttccctccaggtaatttagatgattctcaaagatgacatatcattttgcaa

SEQ ID NO: 86531 - DNA, 565 bp, Homo sapiens
gatacaggacttttaatactgaaccaggaaagtcctgggcaacctggaataaggtggttaccttctgaagaccagctggcaggggtaaggctctgaatttcacagccaacgtgttgtggttggccaggctaccaactagaaggaaagcagctctctgattggccatccttggctatgtagggttagtcttttagcccatagagctaaaaggtgaaatagtctaatagaagagataaatgagaacaaataggaaaggggaggagagagggtttgcgtgagaggagcagtggtcaccaggcagcctgcaatggaccctggaagaggaagagaggaaatgaagaggaaggagaccagcagttccactatccacagccagatgacatggatggctttgcacagctcagcagcacctgcctcaaaggcctagagcagtggttcttcatcctacttggccattagaattacttgaaaacttctgaaaatgcagatatctgagctatccaccaggccaatttgaagtagagtttctgggggtgggcacaatcattggtctttaaaaaaaaaa

SEQ ID NO: 86532 - DNA, 418 bp, Homo sapiens
aactcctgacctcaggtgatccacccacctcagcctcccaaagtgctaggattacaggagtgagccactgcactcgtccaacaccctgattttgtacttctagcctcaagaactgagacagaacacatttctgttgttttaagctgcccagatagaaactactatagttgatgacagaataagaactagactccagattttttaacctctagcctagacctcttttactccattgctgcctccccaaaccagcaataaacatttatggaaatttacttatttggaaaaaaattgacacaatctataatttttaagcactttaagttgttgcctgacacaataggcatttaataaatattttactgtccagttgataaaatgatagacattaaaatgttatattttgttatacaaatct

SEQ ID NO: 86533 - DNA, 816 bp, Homo sapiens
acacccacctgcacacgctgcttctctgggctctgcctcacggttctcacgctgcagctccggtctcgcgcctccttttacgttgtttaggtttctttctgacatgactgagggaaggatcacctccctggggagagaggtgtgcaggcggcccgttgttcaccgggccccggcctcgctaaattcacacctcggcggcgtctggcagcttccgcggcgtgggctttagcacaacacaaccccgtcggccctcagagctgcagggttgccgacgtgccctcctgcgcgtgccagtccctcgccccagcacgtcccccgccactgttgtccttgattctggttggaggtgtgatttcccacatacatattcatgtggtgtgtttgcagcgtggggtgtgagtcacacggatattttaatggggagagtgggggggcttgcggaggcgccgggcggatggacgtgtccatctggctgcgtggggagacccggggccctcagatggtgcgatgtctgaggctgccctcctcacattgatgggagccagggcctacttggcttgctgcccccaaggggaacgtggccctagataccgggggaggccccgccgcagcctcaagtgactgactcaggcccccaggtttagcacagctgccacaggcctggcggaaactccggatgggggtctgaaaagcctttgtggggtcggggcaccacacgggttgggctgatggcgcgctgggggcggggctccagggcacattgtcagatagatgaccccacggggtgggctgaggactgctggtcatggtgagggg

SEQ ID NO: 86534 - DNA, 333 bp, Homo sapiens
gggcattatatacatgtaccttgccttttacaaatttcatttaatacaactagaagtcactgatccatctcaaatttttttgttgtttttttgagacagagccttgctctgtcgcccatgctggagtgcagtggcacaatctcggctcactacaacctcctcctcccaggttcaagcaattcttgtgcctcagcctcccatgtagcagggattacaggcatgagccactgcgcccggcctgctcatctcaattttttttaacttgaaaggatgaatgatatatgttctaatagctgtccactgttttgtttcaaaagcaagtgcattttgtta

SEQ ID NO: 86535 - DNA, 270 bp, Homo sapiens
  misc_feature (187)..(187): n is a, c, g, or t
ggttggttcaggtgagctctaaaagtcccaaagataaaaaggtgcaggtttgggggggatctcagcatacctgtatgacccctagtcggcaaatggccacttggctctatttcaaatctggacccagtgagccactaaggatctatattggaagactggcccttccaggttcacatttgttcacatntacctacctacctacctacctacttacctatctgtctgtctgtctacggtgtttataagtatcaagcatgcctgaaaataagg

SEQ ID NO: 86536 - DNA, 364 bp, Homo sapiens
tacagacaaagtcttgtcatgttgcccaggttggtcttgaacccctgggctcaagtgatcctcctgcctcagcctctcaaagtgttgggattataggagtagccaccacattttgtcccaccccacttttataacagaaaatgttattgaacaagcaaggaaaagtgctaagaggatgttctcattcccaaaaggcagaatgactggatctgggaaggacaggcaagcctcacagcctgagatgtgctgaacaaactaaactgtgctcagagttcacccaccaccagctttagctacgccacagtctgctggctcttattcaatgtgcctaggttttgatagacccagtgaggcctctacatcc

SEQ ID NO: 86537 - DNA, 249 bp, Homo sapiens
cctcccgggttcacgccattctctctccactcccgggagtggaaatgaatgaatatatgggagtgggtggaaagtatgaaaatctttgtttcatgtgttaatgcccaccagaaagtatccaatacagaagagccaatgaacagccaaggagacaaaatgactcaactagctgacatcggtcacccagaagtggcaagatggggacataaatggagaggtcactgtggcagaaatagagatggaagcaga

SEQ ID NO: 86538 - DNA, 774 bp, Homo sapiens
aaacaatcaggcctgcttcccagtctggaaatgagcagagggcactgccccagggtcgaggctgcaagctatgggtagatgaggggaatctgtaggccccaaaaggctggtggctctagtctgaaggcaagaaaactatttgggcaaccaggcactgaaggagaaggaacattggtagaacctatttcgtgtctgtctcccactctgcccttgtgttcctggagagtgggggctgcctctgactgttcttccaaacaccacacccggcactaagacccagtgcatgtgtgtggagtcgatgaattaatgaaagggaagcccctttccatgggtaaagccaaattacctggatgtgagtacagcacaaatccatatgcccgtggaggatggagcatctgtatctgctcccgaaggtgcagatgcccagacctcggcacacccagcgccagcattgtctgctttgacccatcataaccactctgagaggccaaggaggttgtttccattttacagaggggaatgccgaggatcagagagattggctgacatgcctgttgtgcgttttgtaagcggcacagggggattcttctgccccacttctactgactccgtgatccagtgctgccttgaatcttcggaaactctaaagtaggggctccccgcttctgagaaagactccgtagctctcttttggacacagctgcagtgccatccttctgggagagccagcctggagcagaacagctggggctcatctatctgctgcccaacaaa

SEQ ID NO: 86539 - DNA, 349 bp, Homo sapiens
aatgatttccttaagataactaagcaaaagtagaattggtgggacaaagaggagtggaattgttggaaggtggccgggcgcagtggctcacgcctgtaatcccagtgctttgggaggccaaggtgagtggatcacctgaggtcaggagttcaataccagcctggccaacatggtgaaaccccatctctactaaaagtacaaaaaaattagctgggcatggtggcaggcgcctgtaattcccaggtactcaggagggtgaggcaggagaatcgcttgaacccgggaggtagaggttgcagtgagccgagattgcataccagcctgggggacaagagcaaaactccttctc

SEQ ID NO: 86540 - DNA, 267 bp, Homo sapiens
tcctgactgcctgatggggtggaggtggaggggtgctggcccaggatcaggaggtagccacacacagatggcagaaacaagggcatccagagtctctgcatcccaaggctgccctgaccagaagacccagagggacagttaaggagaagccactgttgcatgagtggttttcaaaccatggtcccaggaccctcagccatttcccctcaacctgggaaatgatggaatgcaaacactcaggtcccccaccaggcatgctcaatcaga

SEQ ID NO: 86541 - DNA, 355 bp, Homo sapiens
gtttcctaaatgtcactgaactgtacacttcaaatggttgaaatggtaaattttatgttatgtatgttttaccacaatataagagaaaaagagaaggtggagctgacattcagacttaggacttcctgatgacgcctcctttccctatgctgcatccagacttcttctgctgattttaaagggaaaatctccctgcctaaaagcctctaagaaaccatttttaatcttcgcagtgggggcgggggatgtacagactcctttgagaagctaatgaaaagttatcatcgcctatcatctccccttcctattccctcccccataccttcacatacactttacatttttgtttacagtt

SEQ ID NO: 86542 - DNA, 115 bp, Homo sapiens
aggaggacagagctgttcattacaacagccctgaccctggaactgaggccttggaactctggtccagggctctttgcactacaccagactgatgtcagtccccaggtcttgctga

SEQ ID NO: 86543 - DNA, 389 bp, Homo sapiens
gtaaatcgtactgcgtatgttttatgctttgctatcatagagagtgacagctttgtggggacactgtcgctgcctcgaaattggagtataacgaagtcatatgatagaggggaaaacaaagtatagaaaatccatccaatatgactatgatgttggtctggaaaaaaacctgggagaggacacacgctttacaaattaaaatcataatgtggtatgctgtgcttgtgggattgtggtttctttttttttgtttccctgccaattaaaagattacaaatatataagtgtgtttctcatttaaagggagggcccatctcctctttaggaggaggagaataaaagtattctattctcaagacattgagaaacaaatatgggcttgaatatag

SEQ ID NO: 86544 - DNA, 300 bp, Homo sapiens
gttggaccctttctaaggacatttcagtgtacataagcatcgttcccatagagtgtccccagcatccctgggcacatacattatcaacttagcatccatacagaaagaaagtaaaatgtagattctgattcagtggatctgggacagggccccagctctccatttctgataaggtcccttgtgctgccattgctttgaatactagggtttcaaaccagaattggtgcatcggaatctcttgcgagacttattaaaaatgcagatttttggccccatcccagagcttctggatccagctct

SEQ ID NO: 86545 - DNA, 336 bp, Homo sapiens
ggaagtagtgcttgataatttgtaattccaatgaagttatacataaaacccttgcagcatttatttatttcttgtagtagcttattttatagacttgctattttgtcaatcaaaggacaacaggctgtaatataataacttacagacaagtagatatattgaaactactcatattactcaaaaagaaacgaatacattacaattaaatttggagatgaaaactaacataaaatacataaaacaaaataaacatataggtcattactaaattgttactttttttataccagaattacaatgactccctataattttttatactttttttataatatt

SEQ ID NO: 86546 - DNA, 394 bp, Homo sapiens
tggcattttggcaggatccattataatataaaagtatttcacacacttgacatttcagtatctatccaagagaaatacttgtgcatgtgtgtgtagtacaaatactctgttttcctttcctttcttcttggtcttgataatgactatttggtgaacaattacaattctaagtaatattttgaggcatgtttgttcagtcctttcatcattcaaatatttattaagcatctagtgtatagcaagcagaacactaagtgttggggatatagcagtgaacaaaactaagtacctaccattatggaaagagacacacacacacactagtgaaaagtgctaggaagaccaatgggagaacagagtgagtgacgactagtaagatgctgtttgatacaag

SEQ ID NO: 86547 - DNA, 298 bp, Homo sapiens
ttctggaatcaggcttgaaaaggagagaccttccctgtgacattagtaaaaacaaaaaagtctgagtcatgtggatcacctgaggtcaggagtttgaggccagcctggccaacatggtgaaacctgtctctactaaaactacaaaattagccaggtgtggtggtgcgcgcctgtaatcccagctgcttgggtggctgaggcaggagaatcgcttgaacccaggaggtggaggttacagtgagctgagattgtgccactgcactccagcctgggagacaagagggaaactcctcattta

SEQ ID NO: 86548 - DNA, 142 bp, Homo sapiens
cttccaaactacccagtaaagcattatccccattatctccatttctctgatgaaggcagttggcttagaataaatcagaacttgcgcaggttaaaagtgagtgactggcacagccatggcaaggggccttggactgattttc

SEQ ID NO: 86549 - DNA, 323 bp, Homo sapiens
acctgcatctgctgcttcctctaatacactcctgttcctcaccttcctttcactaccaaacatttcacataaaagttcatgaattacttcactcatcttctccataaaaaccagccttcttatttatgttattctgaataccaaaatgcacaaaatctagttctctctctctctttatatatctatacgtataggaaggtagataaatatagatatatctaattagctaaatccaatgccttttctgccttcttcacatttcttcacctactttgtatttttgctaaatatgtcactattcacccacccactctgatcaatga

SEQ ID NO: 86550 - DNA, 366 bp, Homo sapiens
actgaatacacattggctatttgtattagtgtgtgtgtgagtttgtgcatgtgtatatggcacacactatattagctgcaacagtctctgatgtttcagtttccttgtctgaaaaatagaagtttagattggaccatcactaaaattccttcttgctccgaaatatcaggaacatgagtctaatacaaatcttctattttttgaattctaagactttaatagcaatctgttatttaacttgtatagcagatgaaatggaagatcataaaacaaataaatagcaaagcctctgtccttaagagtcttaaaatattttgttttaaaaagtaaagataagtttcaatttgttccctcagatatatatca

SEQ ID NO: 86551 - DNA, 1040 bp, Homo sapiens
atacaatagtcttgctaccagcaccttaatctcccacatccaagttaaaattcatccaacactcaatctcccagctatcctgactgctcctatacaggtatctctcccactatatatatatcaagtgctattagtggctattatttgttgggttacacaaagccagaaatcatctacatctactctcttttcttctggttttgaatagcaaaatgcaacagggagatgttctcagatagagggagaacaacaaaaagaagggtccatgctgaacaaacttgtttgctttgaaatcggaagttctagaggaggtattctgacagtggccaggaaaacctcctgcccgcagaattttgtctaatccaccccagacagagttatccaacagcctggtatggtgcagaccaggggctctcgaaaggtgggctccaggcagcagcaccagtagcacctgggaaattgttggaaatgcaaattcttgggctccaccccagatcaacttaatcggactctctgggagtagggcccatcaatctgtgtttaacaagtcctccaggtgattccgatcctaatcaagtgtgagcccactgtctaatgcggtgcataccaaagcaggtgcacgggtcttaatcatcacctcagtcctctgaaacaggcaagtgtgtccattttacagaagaaggaactaaggcctggaaggcaagtccttgcctgagactaaacagaatcccagcaacataggacgaggctggaattcccacacctggactaatgcacagccagtgtttcaacgtcgccaacccagaaatgttttctctccctgtcatgctaattttcagccctttctgggtgacttgttcatcatccaaatatattatttttgttttgtttgactaaaggcaattatatttacattttctctaagtactggaatgtaatggttgaaattcctattcagtgatctggaagaactctaatgttctaaagtgattctttgataattaaagaaagatgtaattatgtataatgtgatttgtaag

SEQ ID NO: 86552 - DNA, 575 bp, Homo sapiens
agagggtggattatcttcacctgaattttcagagctctgtatttggttaggctctcaaataaaatcattatgcaacttggaagaaagtatcacgtctgctggaagagatgatctagagagcttccagcttgagataagtggctttttaaaagaaatggcatgtccatattctgtactcatatcaggagatattaaagatcgtttaaaaaagaagaaggaactaaggcctggaaggcaagtccttgcctgagactaaacagaatcccagcaacataggacgaggctggaattcccacacctggactaatgcacagccagtgtttcaacgtcgccaacccagaaatgttttctctccctgtcatgctaattttcagccctttctgggtgacttgttcatcatccaaatatattatttttgttttgtttgactaaaggcaattatatttacattttctctaagtactggaatgtaatggttgaaattcctattcagtgatctggaagaactctaatgttctaaagtgattctttgataattaaagaaagatgtaattatgtataatgtgatttgtaag

SEQ ID NO: 86553 - DNA, 717 bp, Homo sapiens
agctagaaaatatatgtatgtatactcacacatttatacacatctgtacttatttatacaattatccatctgtacgtatactaaaaacaatgatttcatgaagcttttgatcccaatccaacactagataaagactatataggcccatttatttgcaaatcatcacataaacatagaagaattattaacaatataagctgtagcttatgctaaatgttgataggaacagacaataagttatggagaacttcagaggacactaaggttggatgggattttggaagttgtacaggtcaatgccactccatctattggctgagtttcactaggttaatacatgaacaacaacaaaaataacctagatcagaagttaaagatcattttattgactatctgccgtgtctgtgccattgcagtgtactaggtgcacttacgagtcctctacttacaaactgcttttcacaaaatatgaaactccaggcaaaggttcagacatacgacgtttgtttttaaaatctttctacagccttgtatcctttttcctttccttcctttcaccctttttaaaatgtgttatgagttttatcttagactaacatcatctgtaatgttgctatacgccagtattcagttgctgtgtttgatgaatcataaaatggtgtaaaacttcaattagtgtactttttaaataaagtatctatgaatgcatccaaaaaa

SEQ ID NO: 86554 - DNA, 256 bp, Homo sapiens
gttattttctgtcatgtcatttttatctccacaatatctttttttctttttataacagggatctccctatgttgtccaggtcggtcttgaactcctggactcaagcagtcctccagcctcagcctctcaaagtatgggcatgagccatagtgtccagcccaaaatatcttttgattctgacctcttttagtccttaacatcttacgttagggcctcattttttgggaactgactgtgaactatgtatggctcatta

SEQ ID NO: 86555 - DNA, 864 bp, Homo sapiens
agccgcacgaccggtacaaatcctgcatgccagtgagtgcttgtcataagaccaaagttaccactgatgcaacaggaaatggcatgcctctggctcaccaaaatgaaggtgttctcttttggggctccgcacactaatttagaaagcttgaagaaccaggaattatagaatggagaaaagcactcatgggggaggtttgcagcctggtggcctatagcccagtttgggatttgagtgcctcttggccaggcatgctccctgctgtttaccagggtcctggtcacctgcacatccttacacttcctccatctcgcttctttgtcacttgtctgacccacagagaaaactgagttatcaatctttgaataaaactagaaggatgtggcctggagaaaagagggaaggaggtaattaaataatgctccatgaagaactttaaaaatatgcttcttaattaatacatgtggaaagaatacatatgggttaaaaatacaataatgtaaaagaatagaaaatcttccattatcttgtgtcctagagataaccacttttagtaattggtgtctacctttttttccccttttcttttaaataatagagatggggtttcgctatgttgaccaggctggtcttgaactcctggcttcaagtgatcctcccatctcggcatcccaaagtgctgggattataggtctgagtcatcatgcctggtgggtgtctatcttataaaaagcactaaacttaaagatttaaaggtgagagcctgtattaggccattctcatggtgctataaagaactgcccaagactgagtaatttataaaggaaagaggtttaattgactcacaattccacatggctgggg

SEQ ID NO: 86556 - DNA, 239 bp, Homo sapiens
gggacgcatccagggtcccaggcccagaaaacagtggagccaagagaggaacgaggtctctggattccggacgccctgctgctacttggcctccaaccaaaaaattgttcttctccttccttttttagtaggggagagaggagcaattttccatggaatatatctgatggcaggtcttgaggtcagtctgtcagaggcctgggagatcaggggacaagggtgaaattcgaatagattgt

SEQ ID NO: 86557 - DNA, 433 bp, Homo sapiens
agcgaaagtatctgtgttttggtcactgttttgctgtgaatgctgtgtttatgaggctgcctagcagttttcaccctttcctgcaactcagcacattccctggggcggagtcaggtcatgggctgcaacctggagagtttatggcaaacagaagcccctgttacctcatccaatggagataacccttgctgcctaggagatgtgctgtatattcttccaggtcttgtttttcttgatagactcatggtagcttttacatcatttccatttgcgaatgaaactcagttgacccttgaacaacatgagcttgaactgcatgggtccacttacatgcagattattttcaatcaatatatttcggagattttcaacaacatgaaaacactcatagatatacaccatgtataactgtgtagcctagatataccaaaaa

SEQ ID NO: 86558 - DNA, 321 bp, Homo sapiens
gaataaccaaaatcctgggatatttctgaaactcagtcgaggtcagtagatctgtctgggactacattttccatcccagttcctaacaaagtttcattttcttttctttattctctgatgtaagagttaacagtgaaatgaccaaaatcctgaaagccaatggagcaacaataaacatactcagatagattgcctcataaattctttcaagttagtttttaaaagtaacacattttttaaaagtccactttggcaaaattgataatttaatatctggttatcagcctctccaaaggattcctggaaaagttattttctttt

SEQ ID NO: 86559 - DNA, 293 bp, Homo sapiens
tgttattaaaatataacaaggttgtaagtgaccaagaatccatttgtgttgaatctcctgtcttatcagaaacaaaaattgcagctatttcaggaagacagttctaattttggggtttccggagaaggggatctcaggatctcattacaattttagcagcccccaagtgaaaagaaattcttacatcccattgtgggaattttaaatatgtccacaaattctttgatactctgaccttctcaagaggaggaggttaattcttttctccttgagtgtgggctgaacttagtgac

SEQ ID NO: 86560 - DNA, 709 bp, Homo sapiens
ccggcctctgggcggagatctgctgccgcgttctacccttccggcccgtgttctatccgccgcctccaccttccatccggcgccggctttcggcgcgacggtcgccgcgttccatcgtcgcgcggcccttcgggcgcccgagcccgcaatgtcgggccccaacggagacctggggatgccggtggaggcgggagcggaaggcgaggaggacggcttcggggaagcagaatacgctgccatcaactccatgctggaccagatcaactcctgtctggaccacctggaggagaagaatgaccacctccacgcccgcctccaggagctgctggagtccaaccggcagacacgcctggagttccagcagcagctcggggaggcccccagtgatgccagcccctaggctccaagagcccccaaccgggacccaaccctgcctccctgggctaggctctggcctgggcactcaccccctggcttagacaccttctcaagggctggccttcagggacccctggtgggtctgcctgcctgggccacccttcctgcctgggcctccccttggcctacctgggccagcccccaccacctggcatgccctcctggggccaagagtgggcctgcaacccacccacttgcctgcccacccaactcctgggcgctccccactctgcccaggccttgagtgtccacattaaatgggtctcccaca

SEQ ID NO: 86561 - DNA, 764 bp, Homo sapiens
  misc_feature (740)..(740): n is a, c, g, or t
ccggcctctgggcggagatctgctgccgcgttctacccttccggcccgtgttctatccgccgcctccaccttccatccggcgccggctttcggcgcgacggtcgccgcgttccatcgtcgcgcggcccttcgggcgcccgagcccgcaatgtcgggccccaacggagacctggggatgccggtggaggcgggagcggaaggcgaggaggacggcttcggggaagcagaatacgctgccatcaactccatgctggaccagatcaactcctgtctggaccacctggaggagaagaatgaccacctccacgcccgcctccaggagctgctggagtccaaccggcagacacgcctggagttccagcagcagctcggggaggcccccagtgatgccagcccctaggctccaagagcccccaaccgggacccaaccctgcctccctgggctaggctctggcctgggcactcaccccctggcttagacaccttctcaagggctggccttcagggacccctggtgggtctgcctgcctgggccacccttcctgcctgggcctccccttggcctacctgggccagcccccaccacctggcatgccctcctggggccaagagtgggcctgcaacccacccacttgcctgcccacccaactcctgggcgctccccactctgcccaggccttgagtgtccacattaaatgggtctcccacaaaaaaaaaaaacaaaaaaacaaaaaaaaaanaaagggggcgggatgaaaaaaatt

SEQ ID NO: 86562 - DNA, 579 bp, Homo sapiens
ccggcctctgggcggagatctgctgccgcgttctacccttccggcccgtgttctatccgccgcctccaccttccatccggcgccggctttcggcgcgacggtcgccgcgttccatcgtcgcgcggcccttcgggcgcccgagcccgcaatgtcgggccccaacggagacctggggatgccggtggaggcgggagcggaaggcgaggaggacggcttcggggaagcagaatacgctgccatcaactccatgctggaccagatcaactcctgtctggaccacctggaggagaagaatgaccacctccacgcccgcctccaggagctgctggagtccaaccggcagacacgcctggagttccagcagcagctcggggaggcccccagtgatgccagcccctaggctccaagagcccccaaccgggacccaaccctgcctccctgggctaggctctggcctgggcactcaccccctctgtgctgctcacctcctctgtgctgtccacctcctctgtgctgtccacctcctctgtgctgtccacctcctctgtgctgtccacctcctctgtgcctcctctgtgc

SEQ ID NO: 86563 - DNA, 2148 bp, Homo sapiens
ccggcctctgggcggagatctgctgccgcgttctacccttccggcccgtgttctatccgccgcctccaccttccatccggcgccggctttcggcgcgacggtcgccgcgttccatcgtcgcgcggcccttcgggcgcccgagcccgcaatgtcgggccccaacggagacctggggatgccggtggaggcgggagcggaaggcgaggaggacggcttcggggaagcagaaaggtacaacttgctggggtaaagcagagctgaaattcaaacccaagtgaccctgacccccaagtccaatcctgagtttcggctgttaccaacctggaggaccctgggcaggttccttccttctgaggcctcggtttccctagctatataccatgagggggttggactttaagatgcagccgatttcccaggacgctgtcgtctgtgagggtggctggctctaggcaacgggtgccctttcccagaacacaggcacatatgcacccataacccagatacgctcctccagctcctccaccggctgcttcccccttggtctcaagctggcagctgagtgtatgtgagtcatgggctggctcagaactgggtcccgcagtgggcacaggcccagaccttgagtcctcagggacactgtgttgctgagcagggcagctctggagtggccgtggaggggagggagtgatggtttctagtggagaccagggaaggcttcttggaggaggcattttgagctggtccttgaagggctgttgtggttgaggcattctaggttgcagggatagttgagcaatggcggagaggctggaaagtcagaggcttcattcattcactcactcagtcattcaacaaatgcttatcgcaaaactgtgagggcaccagggagccagcagcgaacacaggaccgttcatctttcatggggaaacataacagcactcagataagcacagcagtcaatcctggagagaaggtcgtggagggctgaggagggctaggggctcagcatagaggcctgatccagtctggggcattgggtgggctcccggtggtgacatccatactgagacttgaaggatgagtgggactcatccaggaggagagaagggaaggaagatgggaggacccagcaccttccaggcagagacagcagcatgttcaaagggcctgaggtaggtaaaggcaggtgtgagagaggaaaggaagaggcagggaggcagggctagctaggaggcaggggctggagactccgctgggtgttttatcctgagggagccacagaagggctggcgaacagggcccatctggggacagaggccttgaatgcccaactcaggaatgtgggctctggccactaagcagctgctgcaggaagtgcagagacttggcatctggcaggacttcccatgtaggacactggctcgccaccctatgaccaccctaaccctagaaaaaaggatgcagtactaaagtgtcattcattcaaagccactcctcttttggtattccacccattttccagacggtgacactgaggctcaggaagcagtagggacttgcacaaagccctttgggaagcaggctgggaaacagtggagggagggtgtccattagccccaaggagacacaggatctgggctctgtctttcgccttcctcccagaatacgctgccatcaactccatgctggaccagatcaactcctgtctggaccacctggaggagaagaatgaccacctccacgcccgcctccaggagctgctggagtccaaccggcagacacgcctggagttccagcagcagctcggggaggcccccagtgatgccagcccctaggctccaagagcccccaaccgggacccaaccctgcctccctgggctaggctctggcctgggcactcaccccctggcttagacaccttctcaagggctggccttcagggacccctggtgggtctgcctgcctgggccacccttcctgcctgggcctccccttggcctacctgggccagcccccaccacctggcatgccctcctggggccaagagtgggcctgcaacccacccacttgcctgcccacccaactcctgggcgctccccactctgcccaggccttgagtgtccacattaaatgggtctcccaca

SEQ ID NO: 86564 - DNA, 958 bp, Homo sapiens
ccggcctctgggcggagatctgctgccgcgttctacccttccggcccgtgttctatccgccgcctccaccttccatccggcgccggctttcggcgcgacggtcgccgcgttccatcgtcgcgcggcccttcgggcgcccgagcccgcaatgtcgggccccaacggagacctggggatgccggtggaggcgggagcggaaggcgaggaggacggcttcggggaagcagaatacgctgccatcaactccatgctggaccagatcaactcctgtctggaccacctggaggagaagaatgaccacctccacgcccgcctccaggagctgctggagtccaaccggcagacacgcctggagttccagcagcagctcggggaggcccccagtgatgccagcccctaggctccaagagcccccaaccgggacccaaccctgcctccctgggctaggctctggcctgggcactcaccccctggcttagacaccttctcaagggctggccttcagggacccctggtgggtctgcctgcctgggccacccttcctgcctgggcctccccttggcctacctgggccagcccccaccacctggcatgccctcctggggccaagagtgggcctgcaacccacccacttgcctgcccacccaactcctgggcgctccccactctgcccaggccttgagtgtccacattaaatgggtctcccacaacaaaaaaaatacaacaacgaaaaacactccgagaataaagctctcatccccatgaatgcagtacgtgtgacgcattagctttagagagcctaaatatctaggcgaaccgcttcacgaaggttactaatgcgacccctgtgcaacaaacctttaccccttgacaataagcgtggttcacacacccactattttgtatcacacactctcccgacactacaatcacacaacaaacttggcaaggaaaaatc

SEQ ID NO: 86565 - DNA, 1444 bp, Homo sapiens
ccggcctctgggcggagatctgctgccgcgttctacccttccggcccgtgttctatccgccgcctccaccttccatccggcgccggctttcggcgcgacggtcgccgcgttccatcgtcgcgcggcccttcgggcgcccgagcccgcaatgtcgggccccaacggagacctggggatgccggtggaggcgggagcggaaggcgaggaggacggcttcggggaagcagaaaggtacaacttgctggggtaaagcagagctgaaattcaaacccaagtgaccctgacccccaagtccaatcctgagtttcggctgttaccaacctggaggaccctgggcaggttccttccttctgaggcctcggtttccctagctatataccatgagggggttggactttaagatgcagccgatttcccaggacgctgtcgtctgtgagggtggctggctctaggcaacgggtgccctttcccagaacacaggcacatatgcacccataacccagatacgctcctccagctcctccaccggctgcttcccccttggtctcaagctggcagctgagtgtatgtgagtcatgggctggctcagaactgggtcccgcagtgggcacaggcccagaccttgagtcctcagggacactgtgttgctgagcagggcagctctggagtggccgtggaggggagggagtgatggtttctagtggagaccagggaaggcttcttggaggaggcattttgagctggtccttgaagggctgttgtggttgaggcattctaggttgcagggatagttgagcaatggcggagaggctggaaagtcagaggcttcattcattcactcactcagtcattcaacaaatgcttatcgcaaaactgtgagggcaccagggagccagcagcgaacacaggaccgttcatctttcatggggaaacataacagcactcagataagcacagcagtcaatcctggagagaaggtcgtggagggctgaggagggctaggggctcagcatagaggcctgatccagtctggggcattgggtgggctcccggtggtgacatccatactgagacttgaaggatgagtgggactcatccaggaggagagaagggaaggaagatgggaggacccagcaccttccaggcagagacagcagcatgttcaaagggcctctgggctaggctctggcctgggcactcaccccctggcttagacaccttctcaagggctggccttcagggacccctggtgggtctgcctgcctgggccacccttcctgcctgggcctccccttggcctacctgggccagcccccaccacctggcatgccctcctggggccaagagtgggcctgcaacccacccacttgcctgcccacccaactcctgggcgctccccactctgcccaggccttgagtgtccacattaaatgggtctcccaca

SEQ ID NO: 86566 - DNA, 3261 bp, Homo sapiens
  misc_feature (402)..(402): n is a, c, g, or t
  misc_feature (406)..(406): n is a, c, g, or t
  misc_feature (409)..(409): n is a, c, g, or t
  misc_feature (414)..(415): n is a, c, g, or t
  misc_feature (419)..(421): n is a, c, g, or t
  misc_feature (980)..(980): n is a, c, g, or t
  misc_feature (1297)..(1297): n is a, c, g, or t
gtgagagctgcaggtcaccagtcccgttttacagatggggaaactaaggcagcttcggggacactcgcccttgtgggccttgctccaccacttccttcagtcctgggggagaccgaggcacctgagggaggcagggttgagcttagcggaggggccgggccgggacgtggagttggggacgcgggggcgtcgctctgccgattcagcatccccagccacccggctttgctggtgtagcctcacagccttgccaaatgtcagcagcttacagagcagccttttgcgtgcttacgagtgcaggggtggggtgtgaagagaaccatcggctcccttctcaccttcttcagcctcagtttccccctctataaaataggaataacgattagtgtctgctgcactggnatgngtnagaannaaannnaaaaaaaaggaaaatccttagcaggttctagcatgcaagagttcagtaaatggttatcgtcattattatctttggtatagtaaagattggcatgttaacatacactgaggatttagtaaatgtggtgtaagtatggtgcatgctctttgttttgtttggcgtaacagctttattgagctatacaacttacccatttaaactgtacagttcagtaggctttagtgtattcccagggttgtacatccatcacaatagtttcaggtagctctgcattgggcaatgctgttgggagcatcaggaagagcttcccaggaggtcacattaagtggatgttggcagacaggacttagaacagtggggaggagggtggtgtcccaggcagaagcaaaggcttggaactgggaagtacccttgacacagataaagcctggcctggaggggtgtggggcacctgcctccccaattcctcctcctagcctgtatcccaggacacagagttcgaaatattgataataatgaccatccactaagtacttgctgtggccagatcctgtctgancttttttttttttttgagtcggagtcttgctctgttgcccaggctggagtacagtggcgtgatcttggctcactgcaacctccgccttctgggttcaagcgattctcatgcctcagcctcccgagtagctgggactacagacgcctgccaccacgcctggctaatttttatacatctttagtagagacaatgtttcaccacgtcggctaggctggtctcgaactcctgacctcaggtgatccacccgccttggcttcccaaagtactgggattacaggcgtgagccaccacaccggccactgtctgaactcttgatntgtttgaatcctcacaaccttttttattttcccttttttccagaaaggtacaacttgctggggtaaagcagagctgaaattcaaacccaagtgaccctgacccccaagtccaatcctgagtttcggctgttaccaacctggaggaccctgggcaggttccttccttctgaggcctcggtttccctagctatataccatgagggggttggactttaagatgcagccgatttcccaggacgctgtcgtctgtgagggtggctggctctaggcaacgggtgccctttcccagaacacaggcacatatgcacccataacccagatacgctcctccagctcctccaccggctgcttcccccttggtctcaagctggcagctgagtgtatgtgagtcatgggctggctcagaactgggtcccgcagtgggcacaggcccagaccttgagtcctcagggacactgtgttgctgagcagggcagctctggagtggccgtggaggggagggagtgatggtttctagtggagaccagggaaggcttcttggaggaggcattttgagctggtccttgaagggctgttgtggttgaggcattctaggttgcagggatagttgagcaatggcggagaggctggaaagtcagaggcttcattcattcactcactcagtcattcaacaaatgcttatcgcaaaactgtgagggcaccagggagccagcagcgaacacaggaccgttcatctttcatggggaaacataacagcactcagataagcacagcagtcaatcctggagagaaggtcgtggagggctgaggagggctaggggctcagcatagaggcctgatccagtctggggcattgggtgggctcccggtggtgacatccatactgagacttgaaggatgagtgggactcatccaggaggagagaagggaaggaagatgggaggacccagcaccttccaggcagagacagcagcatgttcaaagggcctgaggtaggtaaaggcaggtgtgagagaggaaaggaagaggcagggaggcagggctagctaggaggcaggggctggagactccgctgggtgttttatcctgagggagccacagaagggctggcgaacagggcccatctggggacagaggccttgaatgcccaactcaggaatgtgggctctggccactaagcagctgctgcaggaagtgcagagacttggcatctggcaggacttcccatgtaggacactggctcgccaccctatgaccaccctaaccctagaaaaaaggatgcagtactaaagtgtcattcattcaaagccactcctcttttggtattccacccattttccagacggtgacactgaggctcaggaagcagtagggacttgcacaaagccctttgggaagcaggctgggaaacagtggagggagggtgtccattagccccaaggagacacaggatctgggctctgtctttcgccttcctcccagaatacgctgccatcaactccatgctggaccagatcaactcctgtctggaccacctggaggagaagaatgaccacctccacgcccgcctccaggagctgctggagtccaaccggcagacacgcctggagttccagcagcagctcggggaggcccccagtgatgccagcccctaggctccaagagcccccaaccgggacccaaccctgcctccctgggctaggctctggcctgggcactcaccccctggcttagacaccttctcaagggctggccttcagggacccctggtgggtctgcctgcctgggccacccttcctgcctgggcctccccttggcctacctgggccagcccccaccacctggcatgccctcctggggccaagagtgggcctgcaacccacccacttgcctgcccacccaactcctgggcgctccccactctgcccaggccttgagtgtccacattaaatgggtctcccaca

SEQ ID NO: 86567 - DNA, 980 bp, Homo sapiens
ccggcctctgggcggagatctgctgccgcgttctacccttccggcccgtgttctatccgccgcctccaccttccatccggcgccggctttcggcgcgacggtcgccgcgttccatcgtcgcgcggcccttcgggcgcccgagcccgcaatgtcgggccccaacggagacctggggatgccggtggaggcgggagcggaaggcgaggaggacggcttcggggaagcagaatacgctgccatcaactccatgctggaccagatcaactcctgtctggaccacctggaggagaagaatgaccacctccacgcccgcctccaggagctgctggagtccaaccggcagacacgcctggagttccagcagcagctcggggaggcccccagtgatgccagcccctaggctccaagagcccccaaccgggacccaaccctgcctccctgggctaggctctggcctgggcactcaccccctggcttagacaccttctcaagggctggccttcagggacccctggtgggtctgcctgcctgggccacccttcctgcctgggcctccccttggcctacctgggccagcccccaccacctggcatgccctcctggggccaagagtgggcctgcaacccacccacttgcctgcccacccaactcctgggcgctccccactctgcccaggccttgagtgtccacattaaatgggtctcccacaaaaaaaaaaaaaaaaaacagaagtataaaagataataacatcagtctatccactaataacaagaacgacacgacgcggggggcactatttttgcggggggcgcgggcacacaagaacgggtgtcatcaaacggggcggcgacgtgcgcgcaaaagcggtggctgctcgacgaccccgcttttgtgtgtgaccaaaggggggtaacataccgggggcggcccccacattgaggaggccgcgcataatcttgcgctaacccccgggttcctgt

SEQ ID NO: 86568 - DNA, 422 bp, Homo sapiens
cccccctggctttgctcagagtctagtaagggcttagcttaattaaagtggccgtggaggggagggagtgatggtttctagtggagaccagggaaggcttcttggaggaggcattttgagctggtccttgaagggctgttgtggttgaggcattctaggttgcagggatagttgagcaatggcggagaggctggaaagtcagaggcttcattcattcactcactcagtcattcaacaaatgcttatcgcaaaactgtgagggcaccagggagccagcagcgaacacaggaccgttcatctttcatggggaaacataacagcactcagatgagcaagccaggagacctgagcaagccaggagacctgagcaagccaggagacctgagcaagccaggagacctgagcaagccaggagacctgag

SEQ ID NO: 86569 - DNA, 1655 bp, Homo sapiens
ccggcctctgggcggagatctgctgccgcgttctacccttccggcccgtgttctatccgccgcctccaccttccatccggcgccggctttcggcgcgacggtcgccgcgttccatcgtcgcgcggcccttcgggcgcccgagcccgcaatgtcgggccccaacggagacctggggatgccggtggaggcgggagcggaaggcgaggaggacggcttcggggaagcagaaaggtacaacttgctggggtaaagcagagctgaaattcaaacccaagtgaccctgacccccaagtccaatcctgagtttcggctgttaccaacctggaggaccctgggcaggttccttccttctgaggcctcggtttccctagctatataccatgagggggttggactttaagatgcagccgatttcccaggacgctgtcgtctgtgagggtggctggctctaggcaacgggtgccctttcccagaacacaggcacatatgcacccataacccagatacgctcctccagctcctccaccggctgcttcccccttggtctcaagctggcagctgagtgtatgtgagtcatgggctggctcagaactgggtcccgcagtgggcacaggcccagaccttgagtcctcagggacactgtgttgctgagcagggcagctctggagtggccgtggaggggagggagtgatggtttctagtggagaccagggaaggcttcttggaggaggcattttgagctggtccttgaagggctgttgtggttgaggcattctaggttgcagggatagttgagcaatggcggagaggctggaaagtcagaggcttcattcattcactcactcagtcattcaacaaatgcttatcgcaaaactgtgagggcaccagggagccagcagcgaacacaggaccgttcatctttcatggggaaacataacagcactcagataagcacagcagtcaatcctggagagaaggtcgtggagggctgaggagggctaggggctcagcatagaggcctgatccagtctggggcattgggtgggctcccggtggtgacatccatactgagacttgaaggatgagtgggactcatccaggaggagagaagggaaggaagatgggaggacccagcaccttccaggcagagacagcagcatgttcaaagggcctaatacgctgccatcaactccatgctggaccagatcaactcctgtctggaccacctggaggagaagaatgaccacctccacgcccgcctccaggagctgctggagtccaaccggcagacacgcctggagttccagcagcagctcggggaggcccccagtgatgccagcccctaggctccaagagcccccaaccgggacccaaccctgcctccctgggctaggctctggcctgggcactcaccccctggcttagacaccttctcaagggctggccttcagggacccctggtgggtctgcctgcctgggccacccttcctgcctgggcctccccttggcctacctgggccagcccccaccacctggcatgccctcctggggccaagagtgggcctgcaacccacccacttgcctgcccacccaactcctgggcgctccccactctgcccaggccttgagtgtccacattaaatgggtctcccaca

SEQ ID NO: 86570 - DNA, 2137 bp, Homo sapiens
  misc_feature (402)..(402): n is a, c, g, or t
  misc_feature (406)..(406): n is a, c, g, or t
  misc_feature (409)..(409): n is a, c, g, or t
  misc_feature (414)..(415): n is a, c, g, or t
  misc_feature (419)..(421): n is a, c, g, or t
  misc_feature (980)..(980): n is a, c, g, or t
  misc_feature (1297)..(1297): n is a, c, g, or t
gtgagagctgcaggtcaccagtcccgttttacagatggggaaactaaggcagcttcggggacactcgcccttgtgggccttgctccaccacttccttcagtcctgggggagaccgaggcacctgagggaggcagggttgagcttagcggaggggccgggccgggacgtggagttggggacgcgggggcgtcgctctgccgattcagcatccccagccacccggctttgctggtgtagcctcacagccttgccaaatgtcagcagcttacagagcagccttttgcgtgcttacgagtgcaggggtggggtgtgaagagaaccatcggctcccttctcaccttcttcagcctcagtttccccctctataaaataggaataacgattagtgtctgctgcactggnatgngtnagaannaaannnaaaaaaaaggaaaatccttagcaggttctagcatgcaagagttcagtaaatggttatcgtcattattatctttggtatagtaaagattggcatgttaacatacactgaggatttagtaaatgtggtgtaagtatggtgcatgctctttgttttgtttggcgtaacagctttattgagctatacaacttacccatttaaactgtacagttcagtaggctttagtgtattcccagggttgtacatccatcacaatagtttcaggtagctctgcattgggcaatgctgttgggagcatcaggaagagcttcccaggaggtcacattaagtggatgttggcagacaggacttagaacagtggggaggagggtggtgtcccaggcagaagcaaaggcttggaactgggaagtacccttgacacagataaagcctggcctggaggggtgtggggcacctgcctccccaattcctcctcctagcctgtatcccaggacacagagttcgaaatattgataataatgaccatccactaagtacttgctgtggccagatcctgtctgancttttttttttttttgagtcggagtcttgctctgttgcccaggctggagtacagtggcgtgatcttggctcactgcaacctccgccttctgggttcaagcgattctcatgcctcagcctcccgagtagctgggactacagacgcctgccaccacgcctggctaatttttatacatctttagtagagacaatgtttcaccacgtcggctaggctggtctcgaactcctgacctcaggtgatccacccgccttggcttcccaaagtactgggattacaggcgtgagccaccacaccggccactgtctgaactcttgatntgtttgaatcctcacaaccttttttattttcccttttttccagaaaggtacaacttgctggggtaaagcagagctgaaattcaaacccaagtgaccctgacccccaagtccaatcctgagtttcggctgttaccaacctggaggaccctgggcaggttccttccttctgaggcctcggtttccctagctatataccatgagggggttggactttaagatgcagccgatttcccaggacgctgtcgtctgtgagggtggctggctctaggcaacgggtgccctttcccagaacacaggcacatatgcacccataacccagatacgctcctccagctcctccaccggctgcttcccccttggtctcaagctggcagctgagtgtatgtgagtcatgggctggctcagaactgggtcccgcagtgggcacaggcccagaccttgagtcctcagggacactgtgttgctgagcagggcagctctggagtggccgtggaggggagggagtgatggtttctagtggagaccagggaaggcttcttggaggaggcattttgagctggtccttgaagggctgttgtggttgaggcattctaggttgcagggatagttgagcaatggcggagaggctggaaagtcagaggcttcattcattcactcactcagtcattcaacaaatgcttatcgcaaaactgtgagggcaccagggagccagcagcgaacacaggaccgttcatctttcatggggaaacataacagcacccacttgcctgcccacccaactcctgggcgctccccactctgcccaggccttgagtgtccacattaaatgggtctcccaca

SEQ ID NO: 86571 - DNA, 1583 bp, Homo sapiens
gtttttctagatttaagtttctgagtgagcctcgttttaccttttaaaattataaccccttctgtttcaaattatatattttttgccatcagaagaagagtttcgttcaggaaatacggagaccctgctctgcctttaccatgtcctccagagccctagactagagtaatggctttttggatggaggtaaccaatgtaggagtcattagcggggagattgagtgggatgtttgggggccagtggcgcggccagttgtgactgtagcagagtgaaggcgaatgcacaaagagataggccagggcaaggtcatagggatcttgaattctagaaaggacttagagttttattctaagtgtgatgggcagccatggaaggctgtgccatgatcgtactcatactttaaaaagattatgtaggcagctgtgtagagaccaagcgtagtggagcaacaatggaggcaagatgaccagtaaggaagctgttgtaatagttgaggtgagagatgatggcaccgtgggctagggtgacagcatcacagatggtggtcagaggctgggtatttttggaagtagagcccacaggatttgctgcacagcatatgggctatgagagaaaagaaagaagtctagaatgattcagatatttttggcctgagcagttatgtgaatgatggtactatttgctaaaatagtttgcttgggaaggattaggtttaggggtaaaattaacaatatgaatgaatgacctaatcttataatgcaaagacaaaatattatgacatggatagttcctgaatacattctcatgcaagcatcaaagagtatagacgtatacagtgtaaaagcacccccttttcctagctaacaatcattgttagcagtttggtatgcattttttcttgtcctttttctgcgtgtttttttcataaatgggattatactataaggattattggtgttttgcttttcgagttgatcatttgtcttgaagaccttccatgtcagtacatgcatgtagtgcattctttttaatgactgcagagagctttatgtggatatgccatagttggtatttactcagtttcctgttgaaggatatttggattgtctctgttgttcactattagaaggcgtgctgcagtgattatttgcacacctgcttttgtgtgtggattccagcatttccctgagatggattccttcaagtggaatggttgctggctccagtttttacaagccctttgacatctgttgtttaggtcctttgcatccttgtagccggttgataatttggtgctcctttgagtatgttagattgtttctgaagcttaatcttttggttaaatcagaagcatccttaacagacccttctgttagacactgacactgattttaaaacaaccaagggatagaaaaaaaaaaaaacttagtgtgtgtgtatgtgtgccagggaaagagagatgacaattaattggatgtgtccctattagccctggaactgcttgatatgctttctgagtggcatgttcttataggtcagatgggagatgggatggggctttgcccatatctaagagtctatt

SEQ ID NO: 86572 - DNA, 1529 bp, Homo sapiens
gtttttctagatttaagtttctgagtgagcctcgttttaccttttaaaattataaccccttctgtttcaaattatatattttttgccatcagaagaagagtttcgttcaggaaatacggagaccctgctctgcctttaccatgtcctccagagccctagactagagtaatggctttttggatggaggtaaccaatgtaggagtcattagcggggagattgagtgggatgtttgggggccagtggcgcggccagttgtgactgtagcagagtgaaggcgaatgcacaaagagataggccagggcaaggtcatagggatcttgaattctagaaaggacttagagttttattctaagtgtgatgggcagccatggaaggctgtgccatgatcgtactcatactttaagcaagatgaccagtaaggaagctgttgtaatagttgaggtgagagatgatggcaccgtgggctagggtgacagcatcacagatggtggtcagaggctgggtatttttggaagtagagcccacaggatttgctgcacagcatatgggctatgagagaaaagaaagaagtctagaatgattcagatatttttggcctgagcagttatgtgaatgatggtactatttgctaaaatagtttgcttgggaaggattaggtttaggggtaaaattaacaatatgaatgaatgacctaatcttataatgcaaagacaaaatattatgacatggatagttcctgaatacattctcatgcaagcatcaaagagtatagacgtatacagtgtaaaagcacccccttttcctagctaacaatcattgttagcagtttggtatgcattttttcttgtcctttttctgcgtgtttttttcataaatgggattatactataaggattattggtgttttgcttttcgagttgatcatttgtcttgaagaccttccatgtcagtacatgcatgtagtgcattctttttaatgactgcagagagctttatgtggatatgccatagttggtatttactcagtttcctgttgaaggatatttggattgtctctgttgttcactattagaaggcgtgctgcagtgattatttgcacacctgcttttgtgtgtggattccagcatttccctgagatggattccttcaagtggaatggttgctggctccagtttttacaagccctttgacatctgttgtttaggtcctttgcatccttgtagccggttgataatttggtgctcctttgagtatgttagattgtttctgaagcttaatcttttggttaaatcagaagcatccttaacagacccttctgttagacactgacactgattttaaaacaaccaagggatagaaaaaaaaaaaaacttagtgtgtgtgtatgtgtgccagggaaagagagatgacaattaattggatgtgtccctattagccctggaactgcttgatatgctttctgagtggcatgttcttataggtcagatgggagatgggatggggctttgcccatatctaagagtctatt

SEQ ID NO: 86573 - DNA, 1777 bp, Homo sapiens
cgtgcgtgtctcgagtcgcacggacggcaaccgtcgacgggcttagcgcctcaactgtcgttggtgtatttttctggtgtcacttctgtgccttccttcaaaggtggtgctttgtccctgtgggtcatctgtactgattgcgccaagaaagcatttgttctccaaatgtcaactgtcaaggagcagctaattgagaagctaattgaggatgatgaaaactcccagtgtaaaattactattgttggaactggtgccgtaggcatggcttgtgctattagtatcttactgaaggatttggctgatgaacttgcccttgttgatgttgcattggacaaactgaagggagaaatgatggatcttcagcatggcagtcttttctttagtacttcaaagattacttctggaaaagattacagtgtatctgcaaactccagaatagttattgtcacagcaggtgcaaggcagcaggagggagaaactcgccttgccctggtccaacgtaatgtggctataatgaaatcaatcattcctgccatagtccattatagtcctgattgtaaaattcttgttgtttcaaatccagtggatattttgacatatatagtctggaagataagtggcttacctgtaactcgtgtaattggaagtggttgtaatctagactctgcccgtttccgttacctaattggagaaaagttgggtgtccaccccacaagctgccatggttggattattggagaacatggtgattctagtgtgcccttatggagtggggtgaatgttgctggtgttgctctgaagactctggaccctaaattaggaacggattcagataaggaacactggaaaaatatccataaacaagttattcaaagtgcctatgaaattatcaagctgaaggggtatacctcttgggctattggactgtctgtgatggatctggtaggatccattttgaaaaatcttaggagagtgcacccagtttccaccatggttaagggattatatggaataaaagaagaactctttctcagtatcccttgtgtcttggggcggaatggtgtctcagatgttgtgaaaattaacttgaattctgaggaggaggcccttttcaagaagagtgcagaaacactttggaatattcaaaaggatctaatattttaaattaaagccttctaatgttccactgtttggagaacagaagatagcaggctgtgtattttaaattttgaaagtattttcatttgatctttaaaaaataaaaacaaattggagacctgtgacataactctagtctctcaagattagaacgagcaaatggtaaagagattttcctctttaagaatcatttatagctctattctaatgatacccaatctgtacaggtgtaagttatacttctgaggtatgtcacatatgttagagtgccttcagatgtagtagaatatgtataatcactataatacagagctttgattcttttcacaaaccaagccctttttctagtattacaattttatcttgtactttcatccgttagagtaccagcatattcacttcattacattagcgtcatatgtttatgtataatcattataaatgtggccgggcactgcagctccagcctgggccacagaggaagactcagactcaaaagaagaagaagaacacagaagaaaagcagaaacaagaagaagatacagatgtaactttacgatgtaaaaaatctaaataagattgtattcaactctgcaagtattatactagtcatataaac

SEQ ID NO: 86574 - DNA, 1251 bp, Homo sapiens
cgtgcgtgtctcgagtcgcacggacggcaaccgtcgacgggcttagcgcctcaactgtcgttggtgtatttttctggtgtcacttctgtgccttccttcaaaggttctccaaatgtcaactgtcaaggagcagctaattgagaagctaattgaggatgatgaaaactcccagtgtaaaattactattgttggaactggtgccgtaggcatggcttgtgctattagtatcttactgaaggatttggctgatgaacttgcccttgttgatgttgcattggacaaactgaagggagaaatgatggatcttcagcatggcagtcttttctttagtacttcaaagattacttctggaaaagattacagtgtatctgcaaactccagaatagttattgtcacagcaggtgcaaggcagcaggagggagaaactcgccttgccctggtccaacgtaatgtggctataatgaaatcaatcattcctgccatagtccattatagtcctgattgtaaaattcttgttgtttcaaatccagtggatattttgacatatatagtctggaagataagtggcttacctgtaactcgtgtaattggaagtggttgtaatctagactctgcccgtttccgttacctaattggagaaaagttgggtgtccaccccacaagctgccatggttggattattggagaacatggtgattctagtgtgcccttatggagtggggtgaatgttgctggtgttgctctgaagactctggaccctaaattaggaacggattcagataaggaacactggaaaaatatccataaacaagttattcaaagtgcctatgaaattatcaagctgaaggggtatacctcttgggctattggactgtctgtgatggatctggtaggatccattttgaaaaatcttaggagagtgcacccagtttccaccatggttaagggattatatggaataaaagaagaactctttctcagtatcccttgtgtcttggggcggaatggtgtctcagatgttgtgaaaattaacttgaattctgaggaggaggcccttttcaagaagagtgcagaaacactttggaatattcaaaaggatctaatattttaaattaaagccttctaatgttccactgtttggagaacagaagatagcaggctgtgtattttaaattttgaaagtattttcatttgatctttaaaaaataaacaactggcctcgttggcctcagcggtggagctctgcggccg

SEQ ID NO: 86575 - DNA, 787 bp, Homo sapiens
atagaatgttaaacaggcaggcaggctacagtatactcacgtcagatcctcctttcctctgcggctatctcatggcaataaagaaagaactctttctcagtatcccttgtgtcttggggcggaatggtgtctcagatgttgtgaaaattaacttgaattctgaggaggaggcccttttcaagaagagtgcagaaacactttggaatattcaaaaggatctaatattttaaattaaagccttctaatgttccactgtttggagaacagaagatagcaggctgtgtattttaaattttgaaagtattttcatttgatctttaaaaaataaaaacaaattggagacctgtgacataactctagtctctcaagattagaacgagcaaatggtaaagagattttcctctttaagaatcatttatagctctattctaatgatacccaatctgtacaggtgtaagttatacttctgaggtatgtcacatatgttagagtgccttcagatgtagtagaatatgtataatcactataatacagagctttgattcttttcacaaaccaagccctttttctagtattacaattttatcttgtactttcatccgttagagtaccagcatattcacttcattacattagcgtcatatgtttatgtataatcattataaatgtggccgggcactgcagcctgggtgacagagtgaggctctgtctcaaaaaaaatcattataaatgcttatttttaagaccatatatatcaaaaagaaataaaaagctgagtgctgtggct

SEQ ID NO: 86576 - DNA, 1721 bp, Homo sapiens
cgtgcgtgtctcgagtcgcacggacggcaaccgtcgacgggcttagcgcctcaactgtcgttggtgtatttttctggtgtcacttctgtgccttccttcaaaggtggtgctttgtccctgtgggtcatctgtactgattgcgccaagaaagcatttgttctccaaatgtcaactgtcaaggagcagctaattgagaagctaattgaggatgatgaaaactcccagtgtaaaattactattgttggaactggtgccgtaggcatggcttgtgctattagtatcttactgaaggatttggctgatgaacttgcccttgttgatgttgcattggacaaactgaagggagaaatgatggatcttcagcatggcagtcttttctttagtacttcaaagattacttctggaaaagattacagtgtatctgcaaactccagaatagttattgtcacagcaggtgcaaggcagcaggagggagaaactcgccttgccctggtccaacgtaatgtggctataatgaaatcaatcattcctgccatagtccattatagtcctgattgtaaaattcttgttgtttcaaatccagtggatattttgacatatatagtctggaagataagtggcttacctgtaactcgtgtaattggaagtggttgtaatctagactctgcccgtttccgttacctaattggagaaaagttgggtgtccaccccacaagctgccatggttggattattggagaacatggtgattctagtgtgcccttatggagtggggtgaatgttgctggtgttgctctgaagactctggaccctaaattaggaacggattcagataaggaacactggaaaaatatccataaacaagttattcaaagtgcctatgaaattatcaagctgaaggggtatacctcttgggctattggactgtctgtgatggatctggtaggatccattttgaaaaatcttaggagagtgcacccagtttccaccatggttaagggattatatggaataaaagaagaactctttctcagtatcccttgtgtcttggggcggaatggtgtctcagatgttgtgaaaattaacttgaattctgaggaggaggcccttttcaagaagagtgcagaaacactttggaatattcaaaaggatctaatattttaaattaaagccttctaatgttccactgtttggagaacagaagatagcaggctgtgtattttaaattttgaaagtattttcatttgatctttaaaaaataaaaacaaattggagacctgtgacataactctagtctctcaagattagaacgagcaaatggtaaagagattttcctctttaagaatcatttatagctctattctaatgatacccaatctgtacaggtgtaagttatacttctgaggtatgtcacatatgttagagtgccttcagatgtagtagaatatgtataatcactataatacagagctttgattcttttcacaaaccaagccctttttctagtattacaattttatcttgtactttcatccgttagagtaccagcatattcacttcattacattagcgtcatatgtttatgtataatcattataaatgtggccgggcactgcagcctgggtgacagagtgaggctctgtctcaaaaaaaatcattataaatgcttatttttaagaccatatatatcaaaaagaaataaaaagctgagtgctgtggct

SEQ ID NO: 86577 - DNA, 1668 bp, Homo sapiens
cgtgcgtgtctcgagtcgcacggacggcaaccgtcgacgggcttagcgcctcaactgtcgttggtgtatttttctggtgtcacttctgtgccttccttcaaaggttctccaaatgtcaactgtcaaggagcagctaattgagaagctaattgaggatgatgaaaactcccagtgtaaaattactattgttggaactggtgccgtaggcatggcttgtgctattagtatcttactgaaggatttggctgatgaacttgcccttgttgatgttgcattggacaaactgaagggagaaatgatggatcttcagcatggcagtcttttctttagtacttcaaagattacttctggaaaagattacagtgtatctgcaaactccagaatagttattgtcacagcaggtgcaaggcagcaggagggagaaactcgccttgccctggtccaacgtaatgtggctataatgaaatcaatcattcctgccatagtccattatagtcctgattgtaaaattcttgttgtttcaaatccagtggatattttgacatatatagtctggaagataagtggcttacctgtaactcgtgtaattggaagtggttgtaatctagactctgcccgtttccgttacctaattggagaaaagttgggtgtccaccccacaagctgccatggttggattattggagaacatggtgattctagtgtgcccttatggagtggggtgaatgttgctggtgttgctctgaagactctggaccctaaattaggaacggattcagataaggaacactggaaaaatatccataaacaagttattcaaagtgcctatgaaattatcaagctgaaggggtatacctcttgggctattggactgtctgtgatggatctggtaggatccattttgaaaaatcttaggagagtgcacccagtttccaccatggttaagggattatatggaataaaagaagaactctttctcagtatcccttgtgtcttggggcggaatggtgtctcagatgttgtgaaaattaacttgaattctgaggaggaggcccttttcaagaagagtgcagaaacactttggaatattcaaaaggatctaatattttaaattaaagccttctaatgttccactgtttggagaacagaagatagcaggctgtgtattttaaattttgaaagtattttcatttgatctttaaaaaataaaaacaaattggagacctgtgacataactctagtctctcaagattagaacgagcaaatggtaaagagattttcctctttaagaatcatttatagctctattctaatgatacccaatctgtacaggtgtaagttatacttctgaggtatgtcacatatgttagagtgccttcagatgtagtagaatatgtataatcactataatacagagctttgattcttttcacaaaccaagccctttttctagtattacaattttatcttgtactttcatccgttagagtaccagcatattcacttcattacattagcgtcatatgtttatgtataatcattataaatgtggccgggcactgcagcctgggtgacagagtgaggctctgtctcaaaaaaaatcattataaatgcttatttttaagaccatatatatcaaaaagaaataaaaagctgagtgctgtggct

SEQ ID NO: 86578 - DNA, 781 bp, Homo sapiens
gtgaaaatttatccttcattccctcattatatgtttcttcatattcataaaggggagaaattaatgttccttttattttaatttctgaagtaatttcattctaagttattaaggtaatttttcctatgatattctattctcataccttaatgtattaaagctttattttcaaaggtttggatttcccactgtaactattcacacatagaatacttgatattttatattatatttggtaagttttttccagcaacaattaaaccttcacaaaaagttttggattttcatgcacaacagaatgcttttttttttccagaagatacatgaagaggttttgagtgggagtagtacaagtgagaaagcgatgagcttcctgtctttgctgtggcaataattgaagaacattgttatgtacttatataagacactgccatgttttttttccagtgcaaattgatagctccttaatttaatagcaataaatctattttgatctgcataatctttggggaaaagtgggaggtattgttttccatttctcatctgattttagtatgatttttattacaaaaaaatttaaaattactatgccttattttgtagcattatgtattagataaatgtagtatgtgtttttcactaaatttattttgagaaatgatagttatttgaaatgagctattcaacttttatgtcttataatacaatggatattattttatgattcctacttgttatttgataccaaattatgtataatacagaatagttttatattcac

SEQ ID NO: 86579 - DNA, 254 bp, Homo sapiens
tcagacttgtagataatctgaatctcagatgtatagagttccttttctataaagtgaagatagtgctgcataagtttcagggttgctgagaggattaagggaagagttatgaaagtgcctggcacagtccaggtatattgaggcactcagtaatgctactttcccttctcccataaaattgagattgaagtaatcatcaaatatgcattgaatatcaaaaatgtacaaaaattaattttcatccaaatttagta

SEQ ID NO: 86580 - DNA, 268 bp, Homo sapiens
agaaaaattgaaactaaaaacaggccaaagcaaaaaatgcaaaaggtacttttgtaatttattcaataaaggaaaacataatctgatatttaaggtagctggtaaaatactgctgctactattttcatcttcattctttcactctacaaatctttactttgtggcacctatgtgccaagcactgatctaagttgttaggacatggtgatgaacaaaacagtcttagacttcatggcacttgtgtttctcagtcttccaaatctcatac

SEQ ID NO: 86581 - DNA, 268 bp, Homo sapiens
gaagaaacgaaaaaaggccagggtttgtgtctaaacactatggtactgagagaaaaacaaatatagagacacacacaaatgaatgtgatcacaactgtgaaaaaaaactgcacacgcaaaagactacagggaaatatgtaattgattatgttgttttctctcagtgataagatggggtggtttcttctttgtacttttgtattaatttcttacggtgtttgtattacttttataatcaagaactttgttttaaaaaataaatcagaaa

SEQ ID NO: 86582 - DNA, 858 bp, Homo sapiens
caggtgaccaggataaattccctctactttcctgaagcattttaatagtgctttagagttgacaaagctttcacacatctcagatcactgtttgcttatagtctggtaaggcaggtgttaccattcccattttacagcagaggaaggggaggagcaggaactcacacacattcccacattgagaacatggtggagccagggctcaagcccaggtctattcacatccaaatctctttccatagagaccccagcatgccttcagtcaatcttctttacgtcacgtgtaaagctgccttcttccagaacttctgttaaacattaagtacatttcatgctgctgagtttcctgccaaacattgttaagaatatgcttcttatgcattgttagtttcctgtggaagaggcttcctccagtctatgttttattgatcaacctgctctcactttcctcaccgcttaccctgacaagtacttcactgtagattgtgctgttgaaggagtacatggggagaaagataacagtgctctaaagcgtgagcaattcacccttcatacaggtaacctcaggtaaacctccatcctgcagcagcccagacaacttctccagtacgaacaaagttgagtcctttatttaatatacagcatgtggctcagggtgggaaaaaaatggaaagaagaggtggtttcattagatatttaccatgtcaaggatggatctctgttttgtaaaatctgtaccttgctggggaaatggggattttcttttccaattcagataatcccaactcgaaagagaagcagctggaatcagtatacagcatcctactctcatgtcatttttagtatcattacctatcg

SEQ ID NO: 86583 - DNA, 326 bp, Homo sapiens
actttggggaggcccaaggtgggctgaatcacctgaggtcaggagttcaaagaccagcctgacccaacatggctaatttttttcatttttagtagagatggggtttcaccgtgttagccaggatggtctcaatctcctgacctcgtgatccgcccaccttggcctcccaaagtgctgggattacaggcgtgagccaccgcgccctggccctgagtcacttattaatgtggaaaaaattttattttttaatccaaactgtatttcttttcctatatacatggtgtgtttgtcacatttacaattgctattagaaaagatgggtgtag

SEQ ID NO: 86584 - DNA, 307 bp, Homo sapiens
gtgtggcatgttccatgggggatgataggacagtgacggcaaggcctgccagccatgtggatgggtctcagacgtgctgtggaatatgagtggcagcttccatatgttactcatttctatggagctaaagacagggaggggcagctggtccttgcaatgggagcccttacagcccttttccgtggggaccctggctgggaggggacacaaggtaggctcctggggccgatgtcttccccttggctggctggtggctgcatggcagcgtgcatttgtaagagtccctcactcagagtagattctttcc

SEQ ID NO: 86585 - DNA, 2824 bp, Homo sapiens
acttccggaatctctcggcgtgtgagcttggttgtcctaccaaagccagcgtttcggctcgcgtgcgccggcctagtttgctcgcgtcctcacgcgctttgggtttcccggtctcatggccggcctgaccttatttgtgggccgcctcccgccctcggcccgcagtgagcagctggaggaactgttcagtcaggtggggccggtgaagcagtgcttcgtggtgactgaaaaagggagtaaggcatgtcgaggctttggctatgtcactttttcaatgctggaagatgttcagagggccctcaaggagattaccacctttgaaggttgcaagatcaacgtgactgttgccaagaaaaaactgaggaacaagacaaaggaaaaggggaaaaatgaaaactcagagtgcccaaagaaggagccgaaggctaaaaaagccaaagtggcagataagaaagccagattaattattcggaacctgagctttaagtgttcagaagatgacttgaagacagtatttgctcaatttggagctgtcctggaagtaaatatccctaggaaaccagatgggaagatgcgcggttttggttttgttcagttcaaaaacctcctagaagcaggtaaagctctcaaaggcatgaacatgaaagagataaaaggccggacagtggctgtggattgggccgtggcaaaggataaatataaagatacacagtctgtttctgctataggtgaggaaaagagccatgaatctaaacatcaggaatcagttaaaaagaagggcagagaggaagaggatatggaagaggaagaaaacgatgatgatgacgatgatgatgatgaagaagatggggtttttgatgatgaagatgaagaggaagagaatatagaatcaaaggtgaccaagcctgtgcaaattcagaagagagcagtcaagagaccagcccctgcaaaaagcagtgatcattctgaggaggacagtgacctagaggaaagcgatagtattgatgatggagaggaactggctcagagtgataccagcactgaggagcaagaggataaagctgtgcaagtctcaaacaaaaagaagaggaaattaccctctgatgtgaatgaagggaaaactgtttttatcagaaatctgtcctttgactcagaagaagaagaacttggggagcttctccaacagtttggagaactcaaatatgtccgcattgtcttgcatccagacacagagcattctaaaggttgtgcatttgcccagttcatgactcaagaagcagctcagaaatgccttctagctgcttctccagagaatgaggctggtgggcttaaactggatggccggcagctcaaggttgacttggcggtgacccgtgatgaggctgcaaagcttcagacgacgaaggtgaagaagccgactggcacccggaatctctatctggcccgagaaggcttgattcgtgctgggacgaaggctgcagagggtgtgagtgctgctgatatggccaaaagagaacggtttgagctgctgaagcatcagaaactcaaggaccagaatatctttgtctcccgaaccaggctctgcctgcacaatctcccaaaggctgtagatgacaaacagctcagaaagctgctgctgagtgctactagtggagagaaaggggtgcgcatcaaggagtgtagagtgatgcgagacctcaaaggagttcatgggaacatgaagggtcagtccctgggctacgcctttgcggagttccaagagcacgagcatgccctgaaagccctccgcctcatcaacaacaatccagaaatctttgggcctctgaagagaccaatagtggagttctctttagaagatcgaagaaaacttaaaatgaaggaattaaggatccagcgcagcttgcaaaaaatgagatccaagcctgcaactggtgagcctcagaaggggcaaccagagcctgcaaaagaccagcaacagaaggcagctcaacaccacacagaggaacaaagcaaggtgcccccagagcagaagagaaaggcgggctctacctcatggaccgggttccagaccaaggctgaagtggagcaggtggagctgcctgatggaaagaagagaagaaaggtcctggcgctcccctcacaccgaggccccaaaatcaggttgcgggacaaaggcaaagtgaagcccgtccatcccaaaaagccaaagccacagataaaccagtggaagcaggagaagcagcaattatcgtccgagcaggtatctaggaaaaaagctaagggaaataagacggaaacccgcttcaaccagctggtcgaacaatataagcagaaattattgggaccttctaaaggagcacctcttgcaaagaggagcaaatggtttgatagttgatgatggcagcaggctgggtaagaagctgggttgtgtactttctggtgacactcctgggctcctccccatcccccgtgtctctcactgagggaaagaaaatccccaagggcactgccactgtgctcggaggtgccctggactgtgtacatctgaactttggtccatcctttgatgtgtggttcgttagccacaaagagaaatatctgaaagtcaacatgatgcttcttgcatattatccagattattgtatgaagttgtgtctataattattaccaatttttattctttatttctcaaatggaaacacctgaaaaagcattctggagtgctgaatttttaagatgtatattttgttaagcatattctctaaatgagatattgtgtggctttttagtaacaacgtcatttctaatatgtgtgactccttta

SEQ ID NO: 86586 - DNA, 2770 bp, Homo sapiens
acttccggaatctctcggcgtgtgagcttggttgtcctaccaaagccagcgtttcggctcgcgtgcgccggcctagtttgctcgcgtcctcacgcgctttgggtttcccggtctcatggccggcctgaccttatttgtgggccgcctcccgccctcggcccgcagtgagcagctggaggaactgttcagtcaggtggggccggtgaagcagtgcttcgtggtgactgaaaaagggagtaaggcatgtcgaggctttggctatgtcactttttcaatgctggaagatgttcagagggccctcaaggagattaccacctttgaaggttgcaagatcaacgtgactgttgccaagaaaaaactgaggaacaagacaaaggaaaaggggaaaaatgaaaactcagagtgcccaaagaaggagccgaaggctaaaaaagccaaagtggcagataagaaagccagattaattattcggaacctgagctttaagtgttcagaagatgacttgaagacagtatttgctcaatttggagctgtcctggaagtaaatatccctaggaaaccagatgggaagatgcgcggttttggttttgttcagttcaaaaacctcctagaagcaggtaaagctctcaaaggcatgaacatgaaagagataaaaggccggacagtggctgtggattgggccgtggcaaaggataaatataaagatacacagtctgtttctgctataggtgaggaaaagagccatgaatctaaacatcaggaatcagttaaaaagaagggcagagaggaagaggatatggaagaggaagaaaacgatgatgatgacgatgatgatgatgaagaagatggggtttttgatgatgaagatgaagaggaagagaatatagaatcaaaggtgaccaagcctgtgcaaattcagaagagagcagtcaagagaccagcccctgcaaaaagcagtgatcattctgaggaggacagtgacctagaggaaagcgatagtattgatgatggagaggaactggctcagagtgataccagcactgaggagcaagaggataaagctgtgcaagtctcaaacaaaaagaagaggaaattaccctctgatgtgaatgaagggaaaactgtttttatcagaaatctgtcctttgactcagaagaagaagaacttggggagcttctccaacagtttggagaactcaaatatgtccgcattgtcttgcatccagacacagagcattctaaaggttgtgcatttgcccagttcatgactcaagaagcagctcagaaatgccttctagctgcttctccagagaatgaggctggtgggcttaaactggatggccggcagctcaaggttgacttggcggtgacccgtgatgaggctgcaaagcttcagacgacgaaggtgaagaagccgactggcacccggaatctctatctggcccgagaaggcttgattcgtgctgggacgaaggctgcagagggtgtgagtgctgctgatatggccaaaagagaacggtttgagctgctgaagcatcagaaactcaaggaccagaatatctttgtctcccgaaccaggctctgcctgcacaatctcccaaaggctgtagatgacaaacagctcagaaagctgctgctgagtgctactagtggagagaaaggggtgcgcatcaaggagtgtagagtgatgcgagacctcaaaggagttcatgggaacatgaagggtcagtccctgggctacgcctttgcggagttccaagagcacgagcatgccctgaaagccctccgcctcatcaacaacaatccagaaatctttgggcctctgaagagaccaatagtggagttctctttagaagatcgaagaaaacttaaaatgaaggaattaaggatccagcgcagcttgcaaaaaatgagatccaagcctgcaactggtgagcctcagaaggggcaaccagagcctgcaaaagaccagcaacagaaggcagctcaacaccacacagaggaacaaagcaaggtgcccccagagcagaagagaaaggcgggctctacctcatggaccgggttccagaccaaggctgaagtggagcaggtggagctgcctgatggaaagaagagaagaaaggtcctggcgctcccctcacaccgaggccccaaaatcaggttgcgggacaaaggcaaagtgaagcccgtccatcccaaaaagccaaagccacagataaaccagtggaagcaggagaagcagcaattatcgtccgagcaggtatctaggaaaaaagctaagggaaataagacggaaacccgcttcaaccagctggtcgaacaatataagcagaaattattgggaccttctaaaggagcacctcttgcaaagaggagcaaatggtttgatagttgatgatggcagcaggctgggtaagaagctgggttgtgtactttctggtgacactcctgggctcctccccatcccccgtgtctctcactgagggaaatctgaactttggtccatcctttgatgtgtggttcgttagccacaaagagaaatatctgaaagtcaacatgatgcttcttgcatattatccagattattgtatgaagttgtgtctataattattaccaatttttattctttatttctcaaatggaaacacctgaaaaagcattctggagtgctgaatttttaagatgtatattttgttaagcatattctctaaatgagatattgtgtggctttttagtaacaacgtcatttctaatatgtgtgactccttta

SEQ ID NO: 86587 - DNA, 2599 bp, Homo sapiens
acttccggaatctctcggcgtgtgagcttggttgtcctaccaaagccagcgtttcggctcgcgtgcgccggcctagtttgctcgcgtcctcacgcgctttgggtttcccggtctcatggccggcctgaccttatttgtgggccgcctcccgccctcggcccgcagtgagcagctggaggaactgttcagtcaggtggggccggtgaagcagtgcttcgtggtgactgaaaaagggagtaaggcatgtcgaggctttggctatgtcactttttcaatgctggaagatgttcagagggccctcaaggagattaccacctttgaaggttgcaagatcaacgtgactgttgccaagaaaaaactgaggaacaagacaaaggaaaaggggaaaaatgaaaactcagagtgcccaaagaaggagccgaaggctaaaaaagccaaagtggcagataagaaagccagattaattattcggaacctgagctttaagtgttcagaagatgacttgaagacagtatttgctcaatttggagctgtcctggaagtaaatatccctaggaaaccagatgggaagatgcgcggttttggttttgttcagttcaaaaacctcctagaagcaggtaaagctctcaaaggcatgaacatgaaagagataaaaggccggacagtggctgtggattgggccgtggcaaaggataaatataaagatacacagtctgtttctgctataggtgaggaaaagagccatgaatctaaacatcaggaatcagttaaaaagaagggcagagaggaagaggatatggaagaggaagaaaacgatgatgatgacgatgatgatgatgaagaagatggggtttttgatgatgaagatgaagaggaagagaatatagaatcaaaggtgaccaagcctgtgcaaattcagaagagagcagtcaagagaccagcccctgcaaaaagcagtgatcattctgaggaggacagtgacctagaggaaagcgatagtattgatgatggagaggaactggctcagagtgataccagcactgaggagcaagaggataaagctgtgcaagtctcaaacaaaaagaagaggaaattaccctctgatgtgaatgaagggaaaactgtttttatcagaaatctgtcctttgactcagaagaagaagaacttggggagcttctccaacagtttggagaactcaaatatgtccgcattgtcttgcatccagacacagagcattctaaaggttgtgcatttgcccagttcatgactcaagaagcagctcagaaatgccttctagctgcttctccagagaatgaggctggtgggcttaaactggatggccggcagctcaaggttgacttggcggtgacccgtgatgaggctgcaaagcttcagacgacgaaggtgaagaagccgactggcacccggaatctctatctggcccgagaaggcttgattcgtgctgggacgaaggctgcagagggtgtgagtgctgctgatatggccaaaagagaacggtttgagctgctgaagcatcagaaactcaaggaccagaatatctttgtctcccgaaccaggctctgcctgcacaatctcccaaaggctgtagatgacaaacagctcagaaagctgctgctgagtgctactagtggagagaaaggggtgcgcatcaaggagcaaaaaatgagatccaagcctgcaactggtgagcctcagaaggggcaaccagagcctgcaaaagaccagcaacagaaggcagctcaacaccacacagaggaacaaagcaaggtgcccccagagcagaagagaaaggcgggctctacctcatggaccgggttccagaccaaggctgaagtggagcaggtggagctgcctgatggaaagaagagaagaaaggtcctggcgctcccctcacaccgaggccccaaaatcaggttgcgggacaaaggcaaagtgaagcccgtccatcccaaaaagccaaagccacagataaaccagtggaagcaggagaagcagcaattatcgtccgagcaggtatctaggaaaaaagctaagggaaataagacggaaacccgcttcaaccagctggtcgaacaatataagcagaaattattgggaccttctaaaggagcacctcttgcaaagaggagcaaatggtttgatagttgatgatggcagcaggctgggtaagaagctgggttgtgtactttctggtgacactcctgggctcctccccatcccccgtgtctctcactgagggaaagaaaatccccaagggcactgccactgtgctcggaggtgccctggactgtgtacatctgaactttggtccatcctttgatgtgtggttcgttagccacaaagagaaatatctgaaagtcaacatgatgcttcttgcatattatccagattattgtatgaagttgtgtctataattattaccaatttttattctttatttctcaaatggaaacacctgaaaaagcattctggagtgctgaatttttaagatgtatattttgttaagcatattctctaaatgagatattgtgtggctttttagtaacaacgtcatttctaatatgtgtgactccttta

SEQ ID NO: 86588 - DNA, 2347 bp, Homo sapiens
acttccggaatctctcggcgtgtgagcttggttgtcctaccaaagccagcgtttcggctcgcgtgcgccggcctagtttgctcgcgtcctcacgcgctttgggtttcccggtctcatggccggcctgaccttatttgtgggccgcctcccgccctcggcccgcagtgagcagctggaggaactgttcagtcaggtggggccggtgaagcagtgcttcgtggtgactgaaaaagggagtaaggcatgtcgaggctttggctatgtcactttttcaatgctggaagatgttcagagggccctcaaggagattaccacctttgaaggttgcaagatcaacgtgactgttgccaagaaaaaactgaggaacaagacaaaggaaaaggggaaaaatgaaaactcagagtgcccaaagaaggagccgaaggctaaaaaagccaaagtggcagataagaaagccagattaattattcggaacctgagctttaagtgttcagaagatgacttgaagacagtatttgctcaatttggagctgtcctggaagtaaatatccctaggaaaccagatgggaagatgcgcggttttggttttgttcagttcaaaaacctcctagaagcaggtaaagctctcaaaggcatgaacatgaaagagataaaaggccggacagtggctgtggattgggccgtggcaaaggataaatataaagatacacagtctgtttctgctataggtgaggaaaagagccatgaatctaaacatcaggaatcagttaaaaagaagggcagagaggaagaggatatggaagaggaagaaaacgatgatgatgacgatgatgatgatgaagaagatggggtttttgatgatgaagatgaagaggaagagaatatagaatcaaaggtgaccaagcctgtgcaaattcagaagagagcagtcaagagaccagcccctgcaaaaagcagtgatcattctgaggaggacagtgacctagaggaaagcgatagtattgatgatggagaggaactggctcagagtgataccagcactgaggagcaagaggataaagctgtgcaagtctcaaacaaaaagaagaggaaattaccctctgatgtgaatgaagggaaaactgtttttatcagaaatctgtcctttgactcagaagaagaagaacttggggagcttctccaacagtttggagaactcaaatatgtccgcattgtcttgcatccagacacagagcattctaaaggttgtgcatttgcccagttcatgactcaagaagcagctcagaaatgccttctagctgcttctccagagaatgaggctggtgggcttaaactggatggccggcagctcaaggttgacttggcggtgacccgtgatgaggctgcaaagcttcagacgacgaaggtgaagaagccgactggcacccggaatctctatctggcccgagaaggcttgattcgtgctgggacgaaggctgcagagggtgtgagtgctgctgatatggccaaaagagaacggtttgagctgctgaagcatcagaaactcaaggaccagaatatctttgtctcccgaaccaggctctgcctgcacaatctcccaaaggctgtagatgacaaacagctcagaaagctgctgctgagtgctactagtggagagaaaggggtgcgcatcaaggagtgtagagtgatgcgagacctcaaaggagttcatgggaacatgaagggtcagtccctgggctacgcctttgcggagttccaagagcacgagcatgccctgaaagccctccgcctcatcaacaacaatccagaaatctttgggcctctgaagagaccaatagtggagttctctttagaagatcgaagaaaacttaaaatgaaggaattaaggatccagcgcagcttgcaaaaaatgagatccaagcctgcaactggtgagcctcagaaggggcaaccagagcctgcaaaagaccagcaacagaaggcagctcaacaccacacagaggaacaaagcaaggtgcccccagagcagaagagaaaggcgggctctacctcatggaccgggttccagaccaaggctgaagtggagcaggtggagctgcctgatggaaagaagagaagaaaggtcctggcgctcccctcacaccgaggccccaaaatcaggttgcgggacaaaggcaaagtgaagcccgtccatcccaaaaagccaaagccacagataaaccagtggaagcaggagaagcagcaattatcgtccgagcaggtgagttctgcaggacatacagctttggtatggcatggttctgccaggtcgtagccatgtttgtaccttggttagttgagcaaaaaa

SEQ ID NO: 86589 - DNA, 1921 bp, Homo sapiens
acttccggaatctctcggcgtgtgagcttggttgtcctaccaaagccagcgtttcggctcgcgtgcgccggcctagtttgctcgcgtcctcacgcgctttgggtttcccggtctcatggccggcctgaccttatttgtgggccgcctcccgccctcggcccgcagtgagcagctggaggaactgttcagtcaggtggggccggtgaagcagtgcttcgtggtgactgaaaaagggagtaaggcatgtcgaggctttggctatgtcactttttcaatgctggaagatgttcagagggccctcaaggagattaccacctttgaaggttgcaagatcaacgtgactgttgccaagaaaaaactgaggaacaagacaaaggaaaaggggaaaaatgaaaactcagagtgcccaaagaaggagccgaaggctaaaaaagccaaagtggcagataagaaagccagattaattattcggaacctgagctttaagtgttcagaagatgacttgaagacagtatttgctcaatttggagctgtcctggaagtaaatatccctaggaaaccagatgggaagatgcgcggttttggttttgttcagttcaaaaacctcctagaagcaggtaaagctctcaaaggcatgaacatgaaagagataaaaggccggacagtggctgtggattgggccgtggcaaaggataaatataaagatacacagtctgtttctgctataggtgaggaaaagagccatgaatctaaacatcaggaatcagttaaaaagaagggcagagaggaagaggatatggaagaggaagaaaacgatgatgatgacgatgatgatgatgaagaagatggggtttttgatgatgaagatgaagaggaagagaatatagaatcaaaggtgaccaagcctgtgcaaattcagaagagagcagtcaagagaccagcccctgcaaaaagcagtgatcattctgaggaggacagtgacctagaggaaagcgatagtattgatgatggagaggaactggctcagagtgataccagcactgaggagcaagaggataaagctgtgcaagtctcaaacaaaaagaagaggaaattaccctctgatgtgaatgaagggaaaactgtttttatcagaaatctgtcctttgactcagaagaagaagaacttggggagcttctccaacagtttggagaactcaaatatgtccgcattgtcttgcatccagacacagagcattctaaaggttgtgcatttgcccagttcatgactcaagaagcagctcagaaatgccttctagctgcttctccagagaatgaggctggtgggcttaaactggatggccggcagctcaaggttgacttggcggtgacccgtgatgaggctgcaaagcttcagacgacgaaggtgaagaagccgactggcacccggaatctctatctggcccgagaaggcttgattcgtgctgggacgaaggctgcagagggtgtgagtgctgctgatatggccaaaagagaacggtttgagctgctgaagcatcagaaactcaaggaccagaatatctttgtctcccgaaccaggctctgcctgcacaatctcccaaaggctgtagatgacaaacagctcagaaagctgctgctgagtgctactagtggagagaaaggggtgcgcatcaaggagtgtagagtgatgcgagacctcaaaggagttcatgggaacatgaagggtcagtccctgggctacgcctttgcggagttccaagagcacgagcatgccctgaaagccctccgcctcatcaacaacaatccagaaatctttgggcctctgaagagaccaatagtggagttctctttagaagatcgaagaaaacttaaaatgaaggaattaaggatccagcgcagcttggtacagaaattaaatggt

SEQ ID NO: 86590 - DNA, 342 bp, Homo sapiens
tgagacagggtctcgttctgctacccaggatggagtgcagtggtgtgattatagctcactgcagccttgaattcctaggctcaagcaatcttcccacctcagcctcccagtaggtgagagtataggtacacgccaccatacccagttaattttctttttctttttctttttttttttccatttattttgatgttttgtagagacacagtcttgctacattgcacaggctggtctcaacctcctggcttcaaataatcctcctgcctcagcctcccaaaatgctgggattacaagcataagccacatgcccagtctattttatgacttttcaataacaggcat

SEQ ID NO: 86591 - DNA, 1403 bp, Homo sapiens
gggggctggagcggggaagaaaagggaattccaacctgtggaaccttggggggtccccggggtcggcgccttcccattgactgtgggcggtgcaagggacggagcctctggcggctcgtgggggtgttggggtccgcagggggagggaggggagtgtcagagtgtgagcggggtacgggaattccaaatttgagggcctcccggctctggcgccggggagggagagctcaggccgccatgcgggacaggacccacgagctgagacagggggatgacagctcggacgaagaggacaaggagcgggtcgcgctggtggtgcacccgggcacggcacggctggggagcccggacgaggagttcttccacaaggtccggacaattcggcagactattgtcaaactggggaataaagtccaggagttggagaaacagcaggtcaccatcctggccacgccccttcccgaggagagcatgaagcaggagctgcagaacctgcgcgatgagatcaaacagctggggagggagatccgcctgcagctgaaggccatagagccccagaaggaggaagctgatgagaactataactccgtcaacacaagaatgagaaaaacccagcatggggtcctgtcccagcaattcgtggagctcatcaacaagtgcaattcaatgcagtccgaataccgggagaagaacgtggagcggattcggaggcagctgaagatcaccaatgctgggatggtgtctgatgaggagttggagcagatgctggacagtgggcaaagcgaggtgtttgtgtccaatatcctgaaggacacgcaggtgactcgacaggccttaaatgagatctcggcccggcacagtgagatccagcagcttgaacgcagtattcgtgagctgcacgacatattcacttttctggctaccgaagtggagatgcagggggagatgatcaatcggattgagaagaacatcctgagctcagcggactacgtggaacgtgggcaggagcacgtcaagacggccctggagaaccagaagaaggcgaggaagaagaaagtcttgattgccatctgtgtgtccatcaccgtcgtcctcctagcagtcatcattggcgtcacagtggttggataatgtcgcacattgttggcactaggagcaccaggaacccagggcctggccttctctcccagcagcctggggggcagggcagagcctccagtcggaccccttcctcacactggcccctatgcagaagggcagacagttcttctggggttggcagctgctcattcatgatggcctcctccttcaggcctcaatgcctgggggaggcctgcactgtcctgattggccgggacacacggttttgtaaaaaattaaaaaacaaaaaaagagcataaaaa

SEQ ID NO: 86592 - DNA, 1539 bp, Homo sapiens
  misc_feature (486)..(486): n is a, c, g, or t
  misc_feature (584)..(584): n is a, c, g, or t
gggggctggagcggggaagaaaagggaattccaacctgtggaaccttggggggtccccggggtcggcgccttcccattgactgtgggcggtgcaagggacggagcctctggcggctcgtgggggtgttggggtccgcagggggagggaggggagtgtcagagtgtgagcggggtacgggaattccaaatttgagggcctcccggctctggcgccggggagggagagctcaggccgccatgcgggacaggacccacgagctgagacagggggatgacagctcggacgaagaggacaaggagcgggtcgcgctggtggtgcacccgggcacggcacggctggggagcccggacgaggagttcttccacaaggtccggacaattcggcagactattgtcaaactggggaataaagtccaggagttggagaaacagcaggtcaccatcctggccacgccccttcccgaggagagtgagtgaaaccccggntgcagggcgcatgctccgccccagggattgtgggggttgtagttccacgcaggtggtggccagagtggtttgttgaggtgggggctgctgtttgggantcttggccttctcttattcaggcatgaagcaggagctgcagaacctgcgcgatgagatcaaacagctggggagggagatccgcctgcagctgaaggccatagagccccagaaggaggaagctgatgagaactataactccgtcaacacaagaatgagaaaaacccagcatggggtcctgtcccagcaattcgtggagctcatcaacaagtgcaattcaatgcagtccgaataccgggagaagaacgtggagcggattcggaggcagctgaagatcaccaatgctgggatggtgtctgatgaggagttggagcagatgctggacagtgggcaaagcgaggtgtttgtgtccaatatcctgaaggacacgcaggtgactcgacaggccttaaatgagatctcggcccggcacagtgagatccagcagcttgaacgcagtattcgtgagctgcacgacatattcacttttctggctaccgaagtggagatgcagggggagatgatcaatcggattgagaagaacatcctgagctcagcggactacgtggaacgtgggcaggagcacgtcaagacggccctggagaaccagaagaaggcgaggaagaagaaagtcttgattgccatctgtgtgtccatcaccgtcgtcctcctagcagtcatcattggcgtcacagtggttggataatgtcgcacattgttggcactaggagcaccaggaacccagggcctggccttctctcccagcagcctggggggcagggcagagcctccagtcggaccccttcctcacactggcccctatgcagaagggcagacagttcttctggggttggcagctgctcattcatgatggcctcctccttcaggcctcaatgcctgggggaggcctgcactgtcctgattggccgggacacacggttttgtaaaaaattaaaaaacaaaaaaagagcataaaaa

SEQ ID NO: 86593 - DNA, 243 bp, Homo sapiens
ttttttttagggtgtggagatgtatcccagcagcctggggggcagggcagagcctccagtcggaccccttcctcacactggcccctatgcagaagggcagacagttcttctggggttggcagctgctcattcatgatggcctcctccttcaggcctcaatgcctgggggaggcctgcactgtcctgattggccgggacacacggttttgtaaaaaattaaaaaacaaaaaaagagcataaaaa

SEQ ID NO: 86594 - DNA, 1761 bp, Homo sapiens
gggggctggagcggggaagaaaagggaattccaacctgtggaaccttggggggtccccggggtcggcgccttcccattgactgtgggcggtgcaagggacggagcctctggcggctcgtgggggtgttggggtccgcagggggagggaggggagtgtcagagtgtgagcggggtacgggaattccaaatttgagggcctcccggctctggcgccggggagggagagctcaggccgccatgcgggacaggacccacgagctgagacagggggatgacagctcggacgaagaggacaaggagcgggtcgcgctggtggtgcacccgggcacggcacggctggggagcccggacgaggagttcttccacaaggtccggacaattcggcagactattgtcaaactggggaataaagtccaggagttggagaaacagcaggtcaccatcctggccacgccccttcccgaggagagcatgaagcaggagctgcagaacctgcgcgatgagatcaaacagctggggagggagatccgcctgcagctgaaggccatagagccccagaaggaggaagctgatgagaactataactccgtcaacacaagaatgagaaaaacccagcatggggtcctgtcccagcaattcgtggagctcatcaacaagtgcaattcaatgcagtccgaataccgggagaagaacgtggagcggattcggaggcagctgaagatcaccaatgctgggatggtgtctgatgaggagttggagcagatgctggacagtgggcaaagcgaggtgtttgtgtccaatatcctgaaggacacgcaggtgactcgacaggccttaaatgagatctcggcccggcacagtgagatccagcagcttgaacgcagtattcgtgagctgcacgacatattcacttttctggctaccgaagtggagatgcagggggagatgatcaatcggattgagaagaacatcctgagctcagcggactacgtggaacgtgggcaggagcacgtcaagacggccctggagaaccagaagaaggcgaggaagaagaaagtcttgattgccatctgtgtgtccatcaccgtcgtcctcctagcagtcatcattggcgtcacagtggttggataatgtcgcacattgttggcactaggagcaccaggaacccagggcctggccttctctcccagcagcctggggggcagggcagagcctccagtcggaccccttcctcacactggcccctatgcagaagggcagacagttcttctggggttggcagctgctcattcatgatggcctcctccttcaggcctcaatgcctgggggaggcctgcactgtcctgattggccgggacacacggttttgtaaaaaattaaaaaacaaaaaaagagcataaaaaaaaaaaaaaaaaaaaaaaaaaaaaaaaaaaaaaaaaaaaaaaaaaaaaaaaaaaaaaaaaaaaaaagggggggggcgctgtaaaaattgtcctcctagtggggcgccgacacttctaagacgcagccaccgcagcctttttatcgtacaaagaaggggcgcccacaaataagaggaggcgatttaactatttatatcagaggaagcagccgacgagcgcggcgtgttaacaacaaacccgctcggaggtcgggagagaaacctcggtgcagcgaggcaacatcttctggagagaagagaaacaccaccactctctgggggggggagcaaacaaaattgggcgagacacctcataaagt

SEQ ID NO: 86595 - DNA, 870 bp, Homo sapiens
acccagtccgttcgactgagcccagaaggaggaagctgatgagaactataactccgtcaacacaagaatgagaaaaacccagcatggggtcctgtcccagcaattcgtggagctcatcaacaagtgcaattcaatgcagtccgaataccgggagaagaacgtggagcggattcggaggcagctgaagatcaccaatgctgggatggtgtctgatgaggagttggagcagatgctggacagtgggcaaagcgaggtgtttgtgtccaatatcctgaaggacacgcaggtgactcgacaggccttaaatgagatctcggcccggcacagtgagatccagcagcttgaacgcagtattcgtgagctgcacgacatattcacttttctggctaccgaagtggagatgcagggggagatgatcaatcggattgagaagaacatcctgagctcagcggactacgtggaacgtgggcaggagcacgtcaagacggccctggagaaccagaagaaggcgaggaagaagaaagtcttgattgccatctgtgtgtccatcaccgtcgtcctcctagcagtcatcattggcgtcacagtggttggataatgtcgcacattgttggcactaggagcaccaggaacccagggcctggccttctctcccagcagcctggggggcagggcagagcctccagtcggaccccttcctcacactggcccctatgcagaagggcagacagttcttctggggttggcagctgctcattcatgatggcctcctccttcaggcctcaatgcctgggggaggcctgcactgtcctgattggccgggacacacggttttgtaaaaaattaaaaaacaaaaaaagagcataaaaa

SEQ ID NO: 86596 - DNA, 1496 bp, Homo sapiens
gggggctggagcggggaagaaaagggaattccaacctgtggaaccttggggggtccccggggtcggcgccttcccattgactgtgggcggtgcaagggacggagcctctggcggctcgtgggggtgttggggtccgcagggggagggaggggagtgtcagagtgtgagcggggtacgggaattccaaatttgagggcctcccggctctggcgccggggagggagagctcaggccgccatgcgggacaggacccacgagctgagacagggggatgacagctcggacgaagaggacaaggagcgggtcgcgctggtggtgcacccgggcacggcacggctggggagcccggacgaggagttcttccacaaggtccggacaattcggcagactattgtcaaactggggaataaagtccaggagttggagaaacagcaggtcaccatcctggccacgccccttcccgaggagagcatgaagcaggagctgcagaacctgcgcgatgagatcaaacagctggggagggagatccgcctgcagctgaaggccatagagccccagaaggaggaagctgatgagaactataactccgtcaacacaagaatgagaaaaacccagcatggggtcctgtcccagcaattcgtggagctcatcaacaagtgcaattcaatgcagtccgaataccgggagaagaacgtggagcggattcggaggcagctgaagatcaccaatgctgggatggtgtctgatgaggagttggagcagatgctggacagtgggcaaagcgaggtgtttgtgtccaatatcctgaaggacacgcaggtgactcgacaggccttaaatgagatctcggcccggcacagtgagatccagcagcttgaacgcagtattcgtgagctgcacgacatattcacttttctggctaccgaagtggagatgcagggggagatgatcaatcggattgagaagaacatcctgagctcagcggactacgtggaacgtgggcaggagcacgtcaagacggccctggagaaccagaagaaggcgaggaagaagaaagtcttgattgccatctgtgtgtccatcaccgtcgtcctcctagcagtcatcattggcgtcacagtggttggataatgtcgcacattgttggtgagatgttgtgggctgccccctggcctgccccagccctggccccagccctccctcctccctcagaccctgttctccctcctttccttacaggcactaggagcaccaggaacccagggcctggccttctctcccagcagcctggggggcagggcagagcctccagtcggaccccttcctcacactggcccctatgcagaagggcagacagttcttctggggttggcagctgctcattcatgatggcctcctccttcaggcctcaatgcctgggggaggcctgcactgtcctgattggccgggacacacggttttgtaaaaaattaaaaaacaaaaaaagagcataaaaa

SEQ ID NO: 86597 - DNA, 1464 bp, Homo sapiens
  misc_feature (667)..(667): n is a, c, g, or t
gggggctggagcggggaagaaaagggaattccaacctgtggaaccttggggggtccccggggtcggcgccttcccattgactgtgggcggtgcaagggacggagcctctggcggctcgtgggggtgttggggtccgcagggggagggaggggagtgtcagagtgtgagcggggtacgggaattccaaatttgagggcctcccggctctggcgccggggagggagagctcaggccgccatgcgggacaggacccacgagctgagacagggggatgacagctcggacgaagaggacaaggagcgggtcgcgctggtggtgcacccgggcacggcacggctggggagcccggacgaggagttcttccacaaggtccggacaattcggcagactattgtcaaactggggaataaagtccaggagttggagaaacagcaggtcaccatcctggccacgccccttcccgaggagagcatgaagcaggagctgcagaacctgcgcgatgagatcaaacagctggggagggagatccgcctgcagctgaaggccatagagccccagaaggaggaagctgatgagaactataactccgtcaacacaagaatgagaaaaacccaggtggaattcaagaagtcaggaagaggaacttccttgggcaacactgaagagnaaaacccagcatggggtcctgtcccagcaattcgtggagctcatcaacaagtgcaattcaatgcagtccgaataccgggagaagaacgtggagcggattcggaggcagctgaagatcaccaatgctgggatggtgtctgatgaggagttggagcagatgctggacagtgggcaaagcgaggtgtttgtgtccaatatcctgaaggacacgcaggtgactcgacaggccttaaatgagatctcggcccggcacagtgagatccagcagcttgaacgcagtattcgtgagctgcacgacatattcacttttctggctaccgaagtggagatgcagggggagatgatcaatcggattgagaagaacatcctgagctcagcggactacgtggaacgtgggcaggagcacgtcaagacggccctggagaaccagaagaaggcgaggaagaagaaagtcttgattgccatctgtgtgtccatcaccgtcgtcctcctagcagtcatcattggcgtcacagtggttggataatgtcgcacattgttggcactaggagcaccaggaacccagggcctggccttctctcccagcagcctggggggcagggcagagcctccagtcggaccccttcctcacactggcccctatgcagaagggcagacagttcttctggggttggcagctgctcattcatgatggcctcctccttcaggcctcaatgcctgggggaggcctgcactgtcctgattggccgggacacacggttttgtaaaaaattaaaaaacaaaaaaagagcataaaaa

SEQ ID NO: 86598 - DNA, 855 bp, Homo sapiens
tgcaaactgccgtaggtctctttgagatctgcccagtcggcggctgccgttttccagcctccccatcagcgtttggagccttcctctaggtcctttaggagttgatagtcatcgctgtccgaggtgtcatacaccaggttgttgccgaacatactcctgaggaaccgcacgggctccagccacgactcgatgagcagcagggagattggagcagatgctggacagtgggcaaagcgaggtgtttgtgtccaatatcctgaaggacacgcaggtgactcgacaggccttaaatgagatctcggcccggcacagtgagatccagcagcttgaacgcagtattcgtgagctgcacgacatattcacttttctggctaccgaagtggagatgcagggggagatgatcaatcggattgagaagaacatcctgagctcagcggactacgtggaacgtgggcaggagcacgtcaagacggccctggagaaccagaagaaggcgaggaagaagaaagtcttgattgccatctgtgtgtccatcaccgtcgtcctcctagcagtcatcattggcgtcacagtggttggataatgtcgcacattgttggcactaggagcaccaggaacccagggcctggccttctctcccagcagcctggggggcagggcagagcctccagtcggaccccttcctcacactggcccctatgcagaagggcagacagttcttctggggttggcagctgctcattcatgatggcctcctccttcaggcctcaatgcctgggggaggcctgcactgtcctgattggccgggacacacggttttgtaaaaaattaaaaaacaaaaaaagagcataaaaa

SEQ ID NO: 86599 - DNA, 1474 bp, Homo sapiens
gggggctggagcggggaagaaaagggaattccaacctgtggaaccttggggggtccccggggtcggcgccttcccattgactgtgggcggtgcaagggacggagcctctggcggctcgtgggggtgttggggtccgcagggggagggaggggagtgtcagagtgtgagcggggtacgggaattccaaatttgagggcctcccggctctggcgccggggagggagagctcaggccgccatgcgggacaggacccacgagctgagacagggggatgacagctcggacgaagaggacaaggagcgggtcgcgctggtggtgcacccgggcacggcacggctggggagcccggacgaggagttcttccacaaggtccggacaattcggcagactattgtcaaactggggaataaagtccaggagttggagaaacagcaggtcaccatcctggccacgccccttcccgaggagagcatgaagcaggagctgcagaacctgcgcgatgagatcaaacagctggggagggagatccgcctgcagctgaaggccatagagccccagaaggaggaagctgatgagaactataactccgtcaacacaagaatgagaaaaacccagcatggggtcctgtcccagcaattcgtggagctcatcaacaagtgcaattcaatgcagtccgaataccgggagaagaacgtggagcggattcggaggcagctgaagatcaccaatgctgggatggtgtctgatgaggagttggagcagatgctggacagtgggcaaagcgaggtgtttgtgtccaatatcctgaaggacacgcaggtgactcgacaggccttaaatgagatctcggcccggcacagtgagatccagcagcttgaacgcagtattcgtgagctgcacgacatattcacttttctggctaccgaagtggagatgcagggggagatgatcaatcggattgagaagaacatcctgagctcagcggactacgtggaacgtgggcaggagcacgtcaagacggccctggagaaccagaagaaggcgaggaaggtgagcctcccaggcccggccactgccccaggcaccctgtgtgacttccctgaccccctcctctcccacagaagaaagtcttgattgccatctgtgtgtccatcaccgtcgtcctcctagcagtcatcattggcgtcacagtggttggataatgtcgcacattgttggcactaggagcaccaggaacccagggcctggccttctctcccagcagcctggggggcagggcagagcctccagtcggaccccttcctcacactggcccctatgcagaagggcagacagttcttctggggttggcagctgctcattcatgatggcctcctccttcaggcctcaatgcctgggggaggcctgcactgtcctgattggccgggacacacggttttgtaaaaaattaaaaaacaaaaaaagagcataaaaa

SEQ ID NO: 86600 - DNA, 1319 bp, Homo sapiens
gggggctggagcggggaagaaaagggaattccaacctgtggaaccttggggggtccccggggtcggcgccttcccattgactgtgggcggtgcaagggacggagcctctggcggctcgtgggggtgttggggtccgcagggggagggaggggagtgtcagagtgtgagcggggtacgggaattccaaatttgagggcctcccggctctggcgccggggagggagagctcaggccgccatgcgggacaggacccacgagctgagacagggggatgacagctcggacgaagaggacaaggagcgggtcgcgctggtggtgcacccgggcacggcacggctggggagcccggacgaggagttcttccacaaggtccggacaattcggcagactattgtcaaactggggaataaagtccaggagttggagaaacagcaggtcaccatcctggccacgccccttcccgaggagacccagaaggaggaagctgatgagaactataactccgtcaacacaagaatgagaaaaacccagcatggggtcctgtcccagcaattcgtggagctcatcaacaagtgcaattcaatgcagtccgaataccgggagaagaacgtggagcggattcggaggcagctgaagatcaccaatgctgggatggtgtctgatgaggagttggagcagatgctggacagtgggcaaagcgaggtgtttgtgtccaatatcctgaaggacacgcaggtgactcgacaggccttaaatgagatctcggcccggcacagtgagatccagcagcttgaacgcagtattcgtgagctgcacgacatattcacttttctggctaccgaagtggagatgcagggggagatgatcaatcggattgagaagaacatcctgagctcagcggactacgtggaacgtgggcaggagcacgtcaagacggccctggagaaccagaagaaggcgaggaagaagaaagtcttgattgccatctgtgtgtccatcaccgtcgtcctcctagcagtcatcattggcgtcacagtggttggataatgtcgcacattgttggcactaggagcaccaggaacccagggcctggccttctctcccagcagcctggggggcagggcagagcctccagtcggaccccttcctcacactggcccctatgcagaagggcagacagttcttctggggttggcagctgctcattcatgatggcctcctccttcaggcctcaatgcctgggggaggcctgcactgtcctgattggccgggacacacggttttgtaaaaaattaaaaaacaaaaaaagagcataaaaa

SEQ ID NO: 86601 - DNA, 826 bp, Homo sapiens
aggggcctgtactggccggaattaggatgaaaacccagcatggggtcctgtcccagcaattcgtggagctcatcaacaagtgcaattcaatgcagtccgaataccgggagaagaacgtggagcggattcggaggcagctgaagatcaccaatgctgggatggtgtctgatgaggagttggagcagatgctggacagtgggcaaagcgaggtgtttgtgtccaatatcctgaaggacacgcaggtgactcgacaggccttaaatgagatctcggcccggcacagtgagatccagcagcttgaacgcagtattcgtgagctgcacgacatattcacttttctggctaccgaagtggagatgcagggggagatgatcaatcggattgagaagaacatcctgagctcagcggactacgtggaacgtgggcaggagcacgtcaagacggccctggagaaccagaagaaggcgaggaagaagaaagtcttgattgccatctgtgtgtccatcaccgtcgtcctcctagcagtcatcattggcgtcacagtggttggataatgtcgcacattgttggcactaggagcaccaggaacccagggcctggccttctctcccagcagcctggggggcagggcagagcctccagtcggaccccttcctcacactggcccctatgcagaagggcagacagttcttctggggttggcagctgctcattcatgatggcctcctccttcaggcctcaatgcctgggggaggcctgcactgtcctgattggccgggacacacggttttgtaaaaaattaaaaaacaaaaaaagagcataaaaa

SEQ ID NO: 86602 - DNA, 1925 bp, Homo sapiens
gggggctggagcggggaagaaaagggaattccaacctgtggaaccttggggggtccccggggtcggcgccttcccattgactgtgggcggtgcaagggacggagcctctggcggctcgtgggggtgttggggtccgcagggggagggaggggagtgtcagagtgtgagcggggtacgggaattccaaatttgagggcctcccggctctggcgccggggagggagagctcaggccgccatgcgggacaggacccacgagctgagacagggggatgacagctcggacgaagaggacaaggagcgggtcgcgctggtggtgcacccgggcacggcacggctggggagcccggacgaggagttcttccacaaggtccggacaattcggcagactattgtcaaactggggaataaagtccaggagttggagaaacagcaggtcaccatcctggccacgccccttcccgaggagagcatgaagcaggagctgcagaacctgcgcgatgagatcaaacagctggggagggagatccgcctgcagctgaaggccatagagccccagaaggaggaagctgatgagaactataactccgtcaacacaagaatgagaaaaacccagcatggggtcctgtcccagcaattcgtggagctcatcaacaagtgcaattcaatgcagtccgaataccgggagaagaacgtggagcggattcggaggcagctgaagatcaccaatgctgggatggtgtctgatgaggagttggagcagatgctggacagtgggcaaagcgaggtgtttgtgtccaatatcctgaaggacacgcaggtgactcgacaggccttaaatgagatctcggcccggcacagtgagatccagcagcttgaacgcagtattcgtgagctgcacgacatattcacttttctggctaccgaagtggagatgcagggggagatgatcaatcggattgagaagaacatcctgagctcagcggactacgtggaacgtgggcaggagcacgtcaagacggccctggagaaccagaagaaggcgaggaaggtgagcctcccaggcccggccactgccccaggcaccctgtgtgacttccctgaccccctcctctcccacagaagaaagtcttgattgccatctgtgtgtccatcaccgtcgtcctcctagcagtcatcattggcgtcacagtggttggataatgtcgcacattgttggtgagatgttgtgggctgccccctggcctgccccagccctggccccagccctccctcctccctcagaccctgttctccctcctttccttacaggcactaggagcaccaggaacccagggcctggccttctctcccagcagcctggggggcagggcagagcctccagtcggaccccttcctcacactggcccctatgcagaagggcagacagttcttctggggttggcagctgctcattcatgatggcctcctccttcaggcctcaatgcctgggggaggcctgcactgtcctgattggccgggacacacggttttgtaaaaaattaaaaaacaaaaaaagagcataaaaaaaaaaaaaaaaaaaaaaaaaaaaaaaaaaaaaaaaaaaaaaaaaaaaaaaaaaaaaaaaaaaaaaagggggggggcgctgtaaaaattgtcctcctagtggggcgccgacacttctaagacgcagccaccgcagcctttttatcgtacaaagaaggggcgcccacaaataagaggaggcgatttaactatttatatcagaggaagcagccgacgagcgcggcgtgttaacaacaaacccgctcggaggtcgggagagaaacctcggtgcagcgaggcaacatcttctggagagaagagaaacaccaccactctctgggggggggagcaaacaaaattgggcgagacacctcataaagt

SEQ ID NO: 86603 - DNA, 1329 bp, Homo sapiens
gggggctggagcggggaagaaaagggaattccaacctgtggaaccttggggggtccccggggtcggcgccttcccattgactgtgggcggtgcaagggacggagcctctggcggctcgtgggggtgttggggtccgcagggggagggaggggagtgtcagagtgtgagcggggtacgggaattccaaatttgagggcctcccggctctggcgccggggagggagagctcaggccgccatgcgggacaggacccacgagctgagacagggggatgacagctcggacgaagaggacaaggagcgggtcgcgctggtggtgcacccgggcacggcacggctggggagcccggacgaggagttcttccacaaggtccggacaattcggcagactattgtcaaactggggaataaagtccaggagttggagaaacagcaggtcaccatcctggccacgccccttcccgaggagagcatgaagcaggagctgcagaacctgcgcgatgagatcaaacagctggggagggagatccgcctgcagctgaaggccatagagccccagaaggaggaagctgatgagaactataactccgtcaacacaagaatgagaaaaacccagcatggggtcctgtcccagcaattcgtggagctcatcaacaagtgcaattcaatgcagtccgaataccgggagaagaacgtggagcggattcggaggcagctgaagatcaccaatgctgggatggtgtctgatgaggagttggagcagatgctggacagtgggcaaagcgaggtgtttgtgtccaatatcctgaaggacacgcaggtgactcgacaggccttaaatgagatctcggcccggcacagtgagatccagcagcttgaacgcagtattcgtgagctgcacgacatattcacttttctggctaccgaagtggagatgcagggggagatgatcaatcggattgagaagaacatcctgagctcagcggactacgtggaacgtgggcaggagcacgtcaagacggccctggagaaccagaagaaggcgaggaaggtgagcctcccaggcccggccactgccccaggcaccctgtgtgacttccctgaccccctcctctcccacagaagaaagtcttgattgccatctgtgtgtccatcaccgtcgtcctcctagcagtcatcattggcgtcacagtggttggataatgtcgcacattgttggtgagatgttgtgggctgccccctggcctgccccagccctggccccagtagcctaggcccctaatgtaaaaactccccgaactccctagatctctcgcacagtagtagacag

SEQ ID NO: 86604 - DNA, 451 bp, Homo sapiens
ccatgtgggatactgggttatgttcttgtccctatgggattggtcatgggatgttatttagacagaaagagtgatgaacggctaacgggtcttaagtatggcttatgagagaaagcaaggcatccaggatgactcgcaggttttatgcctcactagaatgatggagatgccttgatcagagatgagggtgactctgggaggggaagaaagatgaaagtgctcagctatctgagtgggatgtggagtagatggatagtagttgatacaaaggtctagagttcaagagagaactctggtctggaaaataggagttttcataatatgtgaaaccgtgaggaactcaccatggcagtgagtgcccaggcccaagtggcccaagcagggggaccagcaaaaggttctagatgcctccccatcttctgaacctcccccagctcaattcctttttcag

SEQ ID NO: 86605 - DNA, 359 bp, Homo sapiens
acctacttgagaggctgaggtggaaggatcacttgagtccgggaggtggaggttgcagtgagccaagacaacttgggcaacggagcaagacacttaaatttaaaaaaggtaaaatgaggcactgcacacataaagcttaaaaaatttagttcccttctcttttaaagggttatagcctccacagactcctgtagagttgtatttcccttctatcagttggggaaacagcattactgggcaaagaacataaacttttgagctaaccagatctaggtttgagtcccagtttcctaatttgttcgttgtgttgccttggacaagttactttgcttgtctgtgcttcagattcctgatgtata

SEQ ID NO: 86606 - DNA, 3594 bp, Homo sapiens
gctgggcagtgcttctgggccctctgctgctcctgcttgtcggttgctaggcgctgggacgcgcctcccgaagggtgcggggcacaggtggcctcttcggggtggaccgcgcctggccggggccgaggacaccgcggccgcccgggcctgcgggaagcgatggagcccgggaagagaagaaccaaagatgatacctggaaagcagatgacctcagaaaacatctctgggccatacagtcaggtggttccaaggaagaaagaaagcacagagagaagaagctgcgtaaggagtctgagatggaccttcctgaacataaggagccgaggtgcagggatcccgaccaggatgccaggagcagagacagggtggccgaagtccacaccgctaaggagagtcctcgtggggagagggacagagacagacagagggagaggagaagagacgcaaaagaccgggagaaagaaaagctgaaggagaaacatcgagaggcagaaaagtctcacagcagaggaaaggacagggaaaaagaaaaagacagaagggcccggaaggaagagctccggcagaccgtggcccaccacaacctgctgggccaggagacacgcgaccggcagctcctggagcgggcggagaggaaaggccgctcagtaagtaaagtaagaagtgaagagaaagatgaagactctgaaagaggagatgaagatagagaaagaagataccgagaaagaaagctgcagtacggagacagcaaggacaaccctctcaagtactggctttataaagaagaaggcgagaggagacacaggaagcccagagagccagatcgagacaagaaacaccgagaaaaaagcagcacaagggaaaaaagagagaaatattccaaagagaaaagtaattcattctctgacaaaggggaagaaagacataaagaaaagcgacacaaagaaggttttcattttgatgatgagaggcaccgaagcaacgtggatagaaaagagaaatcggcaaaagatgagcccaggaaaagggaatcccagaatggtgaacacagaaatcgaggtgcaagctcaaaaagagatgggaccagcagccagcatgctgagaatttagtaaggaatcatggaaaagataaagattcaagacggaagcatggccacgaggaaggctcttctgtgtggtggaagctggaccagaggccgggaggcgaggaaaccgtggaaattgaaaaggaagaaactgatttagaaaatgctagagctgatgcatatacagccagttgtgaagatgattttgaagactatgaagatgactttgaggtttgtgatggtgatgatgatgaaagcagtaatgaacctgagtcaagagaaaaactggaagaacttcctctagctcaaaaaaaggaaatacaagaaattcaaagagctattaatgcagaaaatgaaaggattggcgagttatctttgaaactgtttcagaagcgaggtagaacagaatttgaaaaggagcccaggacagatacaaacagttccccttccagagcctctgtttgtggaatttttgtggattttgcctcagcttcacaccgtcaaaagagtcggactcaggcccttaagcaaaagatgcgaagtacaaaactgcttcggctcattgacttagatttttcatttactttctctctcttggatctaccaccagtaaatgaatatgacatgtatatcagaaactttgggaaaaaaaataccaagcaggcatatgttcagtgtaacgaagataatgttgaaagagacattcaaacggaggaaatagagaccagggaagtgtggacccagcacccgggagaaagtactgttgtatctggaggcagtgaacaaagagatacctctgatgctgtagttatgccaaagattgatactccaaggttatgtagctttctgcgggctgcttgtcaggtgatggccgttttgctggaagaggatcgcttggcagctgaacccagctggaatcttagggctcaagacagggccctgtattttagtgacagctcatctcagctgaacaccagtctaccattccttcaaagtcacgtgttgctgcttgagccctttgaaagcatttttactgtttgccggaacagcgcacggctcagttgtcgtctgggatttgagagaagactcaaggctgcattactctgtgacgctgagcgatggcttctggacgttccggaccgccacgttttccaccgatggaatccttacctcagtaaaccaccgaagccctcttcaagcagtagaacctatctcaacgtccgtccacaaaaagcagagctttgtgctttcacccttttctactcaagaagaaatgtcaggtttgtccttccacatcgcttccttggatgagagtggggttctcaatgtatgggtggttgttgaattaccaaaggcagacatcgcaggttcaataagtgatttaggtctgatgcctggagggagggtcaagctggtacatagtgctctgatccagttgggtgacagtctttcccataaaggtaatgaattttggggcactacacaaacactgaatgttaaatttctgccttcagatcctaatcactttattattggcacagacatgggtctcataagccatggcacaagacaagatttgagagtggctcccaaactattcaaacctcagcaacatggtataagaccagtgaaagttaatgtcattgatttttcaccatttggagaaccaatatttttggccggctgttcggacggaagcatcaggctgcaccagctgagctccgcgtttccgctcctgcagtgggacagcagcacggacagccatgcggtcaccggcctgcagtggtccccaaccaggcctgccgtgttcctggtgcaggacgacacatccaacatctacatctgggacctcctccagagcgatctgggtcctgtcgccaaacagcaggtctcccccaacaggctggtggccatggctgcggtgggtgagcctgagaaggctggtggcagcttcctggccctggtgctggccagggcgtctggctccatcgacatccagcacctgaagaggcggtgggcggccccggaggtggacgagtgcaacaggctgcgtctgcttttgcaggaagccctgtggccagagggaaaactgcacaagtagcgggtgtggctgagaggaccgcgtttctgtaatgacccagatttaaaagacataaggtggataattctacatttgtgtgcaagtatatttatgtatatagactatgtatattctgtatataatttattttacatgaatatgtctttggtattcccagtaaatagatgactacttttgagtggaaacaaagaacattctagcatttacaaaacttccaggggaatgtagagccacgtccagggtgctcttttctgagagtatttcgagttatttttagaacagtttaaatattgtcacattactgctagattttaaacagcctaccatgaaaatgtatcttaatgaactattttcttatgcataaagtatgtgaacacatgtctaaattaaaaggaattactccaccg

SEQ ID NO: 86607 - DNA, 3491 bp, Homo sapiens
cttctgtcctgggttgagcccagcgccgcagaaggagcacagactccctctgtgtgcacagcatttggaagagaagaaccaaagatgatacctggaaagcagatgacctcagaaaacatctctgggccatacagtcaggtggttccaaggaagaaagaaagcacagagagaagaagctgcgtaaggagtctgagatggaccttcctgaacataaggagccgaggtgcagggatcccgaccaggatgccaggagcagagacagggtggccgaagtccacaccgctaaggagagtcctcgtggggagagggacagagacagacagagggagaggagaagagacgcaaaagaccgggagaaagaaaagctgaaggagaaacatcgagaggcagaaaagtctcacagcagaggaaaggacagggaaaaagaaaaagacagaagggcccggaaggaagagctccggcagaccgtggcccaccacaacctgctgggccaggagacacgcgaccggcagctcctggagcgggcggagaggaaaggccgctcagtaagtaaagtaagaagtgaagagaaagatgaagactctgaaagaggagatgaagatagagaaagaagataccgagaaagaaagctgcagtacggagacagcaaggacaaccctctcaagtactggctttataaagaagaaggcgagaggagacacaggaagcccagagagccagatcgagacaagaaacaccgagaaaaaagcagcacaagggaaaaaagagagaaatattccaaagagaaaagtaattcattctctgacaaaggggaagaaagacataaagaaaagcgacacaaagaaggttttcattttgatgatgagaggcaccgaagcaacgtggatagaaaagagaaatcggcaaaagatgagcccaggaaaagggaatcccagaatggtgaacacagaaatcgaggtgcaagctcaaaaagagatgggaccagcagccagcatgctgagaatttagtaaggaatcatggaaaagataaagattcaagacggaagcatggccacgaggaaggctcttctgtgtggtggaagctggaccagaggccgggaggcgaggaaaccgtggaaattgaaaaggaagaaactgatttagaaaatgctagagctgatgcatatacagccagttgtgaagatgattttgaagactatgaagatgactttgaggtttgtgatggtgatgatgatgaaagcagtaatgaacctgagtcaagagaaaaactggaagaacttcctctagctcaaaaaaaggaaatacaagaaattcaaagagctattaatgcagaaaatgaaaggattggcgagttatctttgaaactgtttcagaagcgaggtagaacagaatttgaaaaggagcccaggacagatacaaacagttccccttccagagcctctgtttgtggaatttttgtggattttgcctcagcttcacaccgtcaaaagagtcggactcaggcccttaagcaaaagatgcgaagtacaaaactgcttcggctcattgacttagatttttcatttactttctctctcttggatctaccaccagtaaatgaatatgacatgtatatcagaaactttgggaaaaaaaataccaagcaggcatatgttcagtgtaacgaagataatgttgaaagagacattcaaacggaggaaatagagaccagggaagtgtggacccagcacccgggagaaagtactgttgtatctggaggcagtgaacaaagagatacctctgatgctgtagttatgccaaagattgatactccaaggttatgtagctttctgcgggctgcttgtcaggtgatggccgttttgctggaagaggatcgcttggcagctgaacccagctggaatcttagggctcaagacagggccctgtattttagtgacagctcatctcagctgaacaccagtctaccattccttcaaagtcacgtgttgctgcttgagccctttgaaagcatttttactgtttgccggaacagcgcacggctcagttgtcgtctgggatttgagagaagactcaaggctgcattactctgtgacgctgagcgatggcttctggacgttccggaccgccacgttttccaccgatggaatccttacctcagtaaaccaccgaagccctcttcaagcagtagaacctatctcaacgtccgtccacaaaaagcagagctttgtgctttcacccttttctactcaagaagaaatgtcaggtttgtccttccacatcgcttccttggatgagagtggggttctcaatgtatgggtggttgttgaattaccaaaggcagacatcgcaggttcaataagtgatttaggtctgatgcctggagggagggtcaagctggtacatagtgctctgatccagttgggtgacagtctttcccataaaggtaatgaattttggggcactacacaaacactgaatgttaaatttctgccttcagatcctaatcactttattattggcacagacatgggtctcataagccatggcacaagacaagatttgagagtggctcccaaactattcaaacctcagcaacatggtataagaccagtgaaagttaatgtcattgatttttcaccatttggagaaccaatatttttggccggctgttcggacggaagcatcaggctgcaccagctgagctccgcgtttccgctcctgcagtgggacagcagcacggacagccatgcggtcaccggcctgcagtggtccccaaccaggcctgccgtgttcctggtgcaggacgacacatccaacatctacatctgggacctcctccagagcgatctgggtcctgtcgccaaacagcaggtctcccccaacaggctggtggccatggctgcggtgggtgagcctgagaaggctggtggcagcttcctggccctggtgctggccagggcgtctggctccatcgacatccagcacctgaagaggcggtgggcggccccggaggtggacgagtgcaacaggctgcgtctgcttttgcaggaagccctgtggccagagggaaaactgcacaagtagcgggtgtggctgagaggaccgcgtttctgtaatgacccagatttaaaagacataaggtggataattctacatttgtgtgcaagtatatttatgtatatagactatgtatattctgtatataatttattttacatgaatatgtctttggtattcccagtaaatagatgactacttttgagtggaaacaaagaacattctagcatttacaaaacttccaggggaatgtagagccacgtccagggtgctcttttctgagagtatttcgagttatttttagaacagtttaaatattgtcacattactgctagattttaaacagcctaccatgaaaatgtatcttaatgaactattttcttatgcataaagtatgtgaacacatgtctaaattaaaaggaattactccaccg

SEQ ID NO: 86608 - DNA, 3195 bp, Homo sapiens
ttcaagttctcagaaaactacatatggtttaatgcaatttttataaactcagaccgggagaaagaaaagctgaaggagaaacatcgagaggcagaaaagtctcacagcagaggaaaggacagggaaaaagaaaaagacagaagggcccggaaggaagagctccggcagaccgtggcccaccacaacctgctgggccaggagacacgcgaccggcagctcctggagcgggcggagaggaaaggccgctcagtaagtaaagtaagaagtgaagagaaagatgaagactctgaaagaggagatgaagatagagaaagaagataccgagaaagaaagctgcagtacggagacagcaaggacaaccctctcaagtactggctttataaagaagaaggcgagaggagacacaggaagcccagagagccagatcgagacaagaaacaccgagaaaaaagcagcacaagggaaaaaagagagaaatattccaaagagaaaagtaattcattctctgacaaaggggaagaaagacataaagaaaagcgacacaaagaaggttttcattttgatgatgagaggcaccgaagcaacgtggatagaaaagagaaatcggcaaaagatgagcccaggaaaagggaatcccagaatggtgaacacagaaatcgaggtgcaagctcaaaaagagatgggaccagcagccagcatgctgagaatttagtaaggaatcatggaaaagataaagattcaagacggaagcatggccacgaggaaggctcttctgtgtggtggaagctggaccagaggccgggaggcgaggaaaccgtggaaattgaaaaggaagaaactgatttagaaaatgctagagctgatgcatatacagccagttgtgaagatgattttgaagactatgaagatgactttgaggtttgtgatggtgatgatgatgaaagcagtaatgaacctgagtcaagagaaaaactggaagaacttcctctagctcaaaaaaaggaaatacaagaaattcaaagagctattaatgcagaaaatgaaaggattggcgagttatctttgaaactgtttcagaagcgaggtagaacagaatttgaaaaggagcccaggacagatacaaacagttccccttccagagcctctgtttgtggaatttttgtggattttgcctcagcttcacaccgtcaaaagagtcggactcaggcccttaagcaaaagatgcgaagtacaaaactgcttcggctcattgacttagatttttcatttactttctctctcttggatctaccaccagtaaatgaatatgacatgtatatcagaaactttgggaaaaaaaataccaagcaggcatatgttcagtgtaacgaagataatgttgaaagagacattcaaacggaggaaatagagaccagggaagtgtggacccagcacccgggagaaagtactgttgtatctggaggcagtgaacaaagagatacctctgatgctgtagttatgccaaagattgatactccaaggttatgtagctttctgcgggctgcttgtcaggtgatggccgttttgctggaagaggatcgcttggcagctgaacccagctggaatcttagggctcaagacagggccctgtattttagtgacagctcatctcagctgaacaccagtctaccattccttcaaagtcacgtgttgctgcttgagccctttgaaagcatttttactgtttgccggaacagcgcacggctcagttgtcgtctgggatttgagagaagactcaaggctgcattactctgtgacgctgagcgatggcttctggacgttccggaccgccacgttttccaccgatggaatccttacctcagtaaaccaccgaagccctcttcaagcagtagaacctatctcaacgtccgtccacaaaaagcagagctttgtgctttcacccttttctactcaagaagaaatgtcaggtttgtccttccacatcgcttccttggatgagagtggggttctcaatgtatgggtggttgttgaattaccaaaggcagacatcgcaggttcaataagtgatttaggtctgatgcctggagggagggtcaagctggtacatagtgctctgatccagttgggtgacagtctttcccataaaggtaatgaattttggggcactacacaaacactgaatgttaaatttctgccttcagatcctaatcactttattattggcacagacatgggtctcataagccatggcacaagacaagatttgagagtggctcccaaactattcaaacctcagcaacatggtataagaccagtgaaagttaatgtcattgatttttcaccatttggagaaccaatatttttggccggctgttcggacggaagcatcaggctgcaccagctgagctccgcgtttccgctcctgcagtgggacagcagcacggacagccatgcggtcaccggcctgcagtggtccccaaccaggcctgccgtgttcctggtgcaggacgacacatccaacatctacatctgggacctcctccagagcgatctgggtcctgtcgccaaacagcaggtctcccccaacaggctggtggccatggctgcggtgggtgagcctgagaaggctggtggcagcttcctggccctggtgctggccagggcgtctggctccatcgacatccagcacctgaagaggcggtgggcggccccggaggtggacgagtgcaacaggctgcgtctgcttttgcaggaagccctgtggccagagggaaaactgcacaagtagcgggtgtggctgagaggaccgcgtttctgtaatgacccagatttaaaagacataaggtggataattctacatttgtgtgcaagtatatttatgtatatagactatgtatattctgtatataatttattttacatgaatatgtctttggtattcccagtaaatagatgactacttttgagtggaaacaaagaacattctagcatttacaaaacttccaggggaatgtagagccacgtccagggtgctcttttctgagagtatttcgagttatttttagaacagtttaaatattgtcacattactgctagattttaaacagcctaccatgaaaatgtatcttaatgaactattttcttatgcataaagtatgtgaacacatgtctaaattaaaaggaattactccaccg

SEQ ID NO: 86609 - DNA, 1646 bp, Homo sapiens
gctgggcagtgcttctgggccctctgctgctcctgcttgtcggttgctaggcgctgggacgcgcctcccgaagggtgcggggcacaggtggcctcttcggggtggaccgcgcctggccggggccgaggacaccgcggccgcccgggcctgcgggaagcgatggagcccgggaagagaagaaccaaagatgatacctggaaagcagatgacctcagaaaacatctctgggccatacagtcaggtggttccaaggaagaaagaaagcacagagagaagaagctgcgtaaggagtctgagatggaccttcctgaacataaggagccgaggtgcagggatcccgaccaggatgccaggagcagagacagggtggccgaagtccacaccgctaaggagagtcctcgtggggagagggacagagacagacagagggagaggagaagagacgcaaaagaccgggagaaagaaaagctgaaggagaaacatcgagaggcagaaaagtctcacagcagaggaaaggacagggaaaaagaaaaagacagaagggcccggaaggaagagctccggcagaccgtggcccaccacaacctgctgggccaggagacacgcgaccggcagctcctggagcgggcggagaggaaaggccgctcagtaagtaaagtaagaagtgaagagaaagatgaagactctgaaagaggagatgaagatagagaaagaagataccgagaaagaaagctgcagtacggagacagcaaggacaaccctctcaagtactggctttataaagaagaaggcgagaggagacacaggaagcccagagagccagatcgagacaagaaacaccgagaaaaaagcagcacaagggaaaaaagagagaaatattccaaagagaaaagtaattcattctctgacaaaggggaagaaagacataaagaaaagcgacacaaagaaggttttcattttgatgatgagaggcaccgaagcaacgtggatagaaaagagaaatcggcaaaagatgagcccaggaaaagggaatcccagaatggtgaacacagaaatcgaggtgcaagctcaaaaagagatgggaccagcagccagcatgctgagaatttagtaaggaatcatggaaaagataaagattcaagacggaagcatggccacgaggaaggctcttctgtgtggtggaagctggaccagaggccgggaggcgaggaaaccgtggaaattgaaaaggaagaaactgatttagaaaatgctagagctgatgcatatacagccagttgtgaagatgattttgaagactatgaagatgactttgaggtttgtgatggtgatgatgatgaaagcagtaatgaacctgagtcaagagaaaaactggaagaacttcctctagctcaaaaaaaggaaatacaagaaattcaaagagctattaatgcagaaaatgaaaggattggcgagttatctttgaaactgtttcagaagcgaggtagaacagaatttgaaaaggagcccaggacagatacaaacagttccccttccagagcctctgtttgtggaatttttgtggattttgcctcagcttcacaccgtcaaaagagtcggactcaggcccttaagcaaaagtgtggactcaggtgactcagtggtgg

SEQ ID NO: 86610 - DNA, 997 bp, Homo sapiens
gctgggcagtgcttctgggccctctgctgctcctgcttgtcggttgctaggcgctgggacgcgcctcccgaagggtgcggggcacaggtggcctcttcggggtggaccgcgcctggccggggccgaggacaccgcggccgcccgggcctgcgggaagcgatggagcccgggaagagaagaaccaaagatgatacctggaaagcagatgacctcagaaaacatctctgggccatacagtcaggtggttccaaggaagaaagaaagcacagagagaagaagctgcgtaaggagtctgagatggaccttcctgaacataaggagccgaggtgcagggatcccgaccaggatgccaggagcagagacagggtggccgaagtccacaccgctaaggagagtcctcgtggggagagggacagagacagacagagggagaggagaagagacgcaaaagaccgggagaaagaaaagctgaaggagaaacatcgagaggcagaaaagtctcacagcagaggaaaggacagggaaaaagaaaaagacagaagggcccggaaggaagagctccggcagaccgtggcccaccacaacctgctgggccaggagacacgcgaccggcagctcctggagcgggcggagaggaaaggccgctcagtaagtaaagtaagaagtgaagagaaagatgaagactctgaaagaggagatgaagatagagaaagaagataccgagaaagaaagctgcagtacggagaccatctcttcctttctttccccttcttttacttagaatgtctttgtattcatttgctagggcttccatagcaaagcatcatagattgctgatttaaactgtaattgtattgccgtactgtgggctggaaatcccaaatctagattccagcagagttggttctttctgaggtctgcaaggaagggcctctgttccatgcctctctccttggcttgtagaaggcattcttgtccctatgactcttcacattgt

SEQ ID NO: 86611 - DNA, 893 bp, Homo sapiens
cttctgtcctgggttgagcccagcgccgcagaaggagcacagactccctctgtgtgcacagcatttggaaggtgagtctgttgtggctgtttttggaaaatacagtctgacacaagatattttaaacccacagaatatttgtccttcctctgttgttcaactgctgttataacttgttttcacttttattttataatatttaagttttgaagtagccaaaggaacacattttataataatgtgtcattttagactagtgaataatttttaaaaatctgtatttctgttaccttttattccaggaggtagagaagtattttctggcatgtcaagaattaactgccattgatttaaatggcataatgaaaaagcagctcactacaacactgaaaataaattattttaaactttaaacattctaactttatacttttctatttagagaagaaccaaagatgatacctggaaagcagatgacctcagaaaacatctctgggccatacagtcaggtggttccaaggaagaaagaaagcacagagagaagaagctgcgtaaggagtctgagatggaccttcctgaacataaggagccgaggtgcagggatcccgaccaggatgccaggagcagagacagggtggccgaagtccacaccgctaaggagagtcctcgtggggagagggacagagacagacagagggagaggagaagagacgcaaaaggtaaaaaggggctgcttaccggattttaaattggtgagatgtttactgggctggtcggtctgaggacctgaggtcgtacgtggatctttctcacgagcaaagaacaggaggacaggggattgatctcacaagggaagtcccctgatccgagtcgcggcaccaaatttcatgcac

SEQ ID NO: 86612 - DNA, 2158 bp, Homo sapiens
gatctcggctcactgcaaccttcatttcctggattcaagcgattcttctgcttcagcctcccgagtagctgggactacagatacaaacagttccccttccagagcctctgtttgtggaatttttgtggattttgcctcagcttcacaccgtcaaaagagtcggactcaggcccttaagcaaaagatgcgaagtacaaaactgcttcggctcattgacttagatttttcatttactttctctctcttggatctaccaccagtaaatgaatatgacatgtatatcagaaactttgggaaaaaaaataccaagcaggcatatgttcagtgtaacgaagataatgttgaaagagacattcaaacggaggaaatagagaccagggaagtgtggacccagcacccgggagaaagtactgttgtatctggaggcagtgaacaaagagatacctctgatgctgtagttatgccaaagattgatactccaaggttatgtagctttctgcgggctgcttgtcaggtgatggccgttttgctggaagaggatcgcttggcagctgaacccagctggaatcttagggctcaagacagggccctgtattttagtgacagctcatctcagctgaacaccagtctaccattccttcaaagtcacgtgttgctgcttgagccctttgaaagcatttttactgtttgccggaacagcgcacggctcagttgtcgtctgggatttgagagaagactcaaggctgcattactctgtgacgctgagcgatggcttctggacgttccggaccgccacgttttccaccgatggaatccttacctcagtaaaccaccgaagccctcttcaagcagtagaacctatctcaacgtccgtccacaaaaagcagagctttgtgctttcacccttttctactcaagaagaaatgtcaggtttgtccttccacatcgcttccttggatgagagtggggttctcaatgtatgggtggttgttgaattaccaaaggcagacatcgcaggttcaataagtgatttaggtctgatgcctggagggagggtcaagctggtacatagtgctctgatccagttgggtgacagtctttcccataaaggtaatgaattttggggcactacacaaacactgaatgttaaatttctgccttcagatcctaatcactttattattggcacagacatgggtctcataagccatggcacaagacaagatttgagagtggctcccaaactattcaaacctcagcaacatggtataagaccagtgaaagttaatgtcattgatttttcaccatttggagaaccaatatttttggccggctgttcggacggaagcatcaggctgcaccagctgagctccgcgtttccgctcctgcagtgggacagcagcacggacagccatgcggtcaccggcctgcagtggtccccaaccaggcctgccgtgttcctggtgcaggacgacacatccaacatctacatctgggacctcctccagagcgatctgggtcctgtcgccaaacagcaggtctcccccaacaggctggtggccatggctgcggtgggtgagcctgagaaggctggtggcagcttcctggccctggtgctggccagggcgtctggctccatcgacatccagcacctgaagaggcggtgggcggccccggaggtggacgagtgcaacaggctgcgtctgcttttgcaggaagccctgtggccagagggaaaactgcacaagtagcgggtgtggctgagaggaccgcgtttctgtaatgacccagatttaaaagacataaggtggataattctacatttgtgtgcaagtatatttatgtatatagactatgtatattctgtatataatttattttacatgaatatgtctttggtattcccagtaaatagatgactacttttgagtggaaacaaagaacattctagcatttacaaaacttccaggggaatgtagagccacgtccagggtgctcttttctgagagtatttcgagttatttttagaacagtttaaatattgtcacattactgctagattttaaacagcctaccatgaaaatgtatcttaatgaactattttcttatgcataaagtatgtgaacacatgtctaaattaaaaggaattactccaccg

SEQ ID NO: 86613 - DNA, 310 bp, Homo sapiens
taaacctgattcaagttctcagaaaactacatatggtttaatgcaatttttataaactcagaaataaagctacacagtatgttgtttagactcatataaatatgagataaaattatattttgaaaaacaagaaactgataaccacaaaattcagtctagtgattgttgtgggcagtgggggatcttggaatgtgtcagggaggagccactaagtagatgggggtcattggttgccttccctccctttccatttccctttcccttttcctttccctttccctttccgttccctttcctttcccttttcttt

SEQ ID NO: 86614 - DNA, 545 bp, Homo sapiens
  misc_feature (7)..(7): n is a, c, g, or t
  misc_feature (13)..(13): n is a, c, g, or t
  misc_feature (16)..(16): n is a, c, g, or t
  misc_feature (37)..(37): n is a, c, g, or t
  misc_feature (45)..(45): n is a, c, g, or t
gcgaccncccggnctngcgggaagcgatcggagcccnggaagatnggagtctcactctgtcaccaggctggaatgcaatggcacgaacttggcttactgcaacctccgactccagggttcaagagattctcctgcctcagtctcccgagccatacagtcaggtggttccaaggaagaaagaaagcacagagagaagaagctgcgtaaggagtctgagatggaccttcctgaacataaggagccgaggtgcagggatcccgaccaggatgccaggagcagagacagggtggccgaagtccacaccgctaaggagagtcctcgtggggagagggacagagacagacagagggagaggagaagagacgcaaaaggtaaaaaggggctgcttaccggattttaaattggtgagatgtttactgggctggtcggtctgaggacctgaggtcgtacgtggatctttctcacgagcaaagaacaggaggacaggggattgatctcacaagggaagtcccctgatccgagtcgcggcaccaaatttcatgcac

SEQ ID NO: 86615 - DNA, 3862 bp, Homo sapiens
cttctgtcctgggttgagcccagcgccgcagaaggagcacagactccctctgtgtgcacagcatttggaaggtgagtctgttgtggctgtttttggaaaatacagtctgacacaagatattttaaacccacagaatatttgtccttcctctgttgttcaactgctgttataacttgttttcacttttattttataatatttaagttttgaagtagccaaaggaacacattttataataatgtgtcattttagactagtgaataatttttaaaaatctgtatttctgttaccttttattccaggaggtagagaagtattttctggcatgtcaagaattaactgccattgatttaaatggcataatgaaaaagcagctcactacaacactgaaaataaattattttaaactttaaacattctaactttatacttttctatttagagaagaaccaaagatgatacctggaaagcagatgacctcagaaaacatctctgggccatacagtcaggtggttccaaggaagaaagaaagcacagagagaagaagctgcgtaaggagtctgagatggaccttcctgaacataaggagccgaggtgcagggatcccgaccaggatgccaggagcagagacagggtggccgaagtccacaccgctaaggagagtcctcgtggggagagggacagagacagacagagggagaggagaagagacgcaaaagaccgggagaaagaaaagctgaaggagaaacatcgagaggcagaaaagtctcacagcagaggaaaggacagggaaaaagaaaaagacagaagggcccggaaggaagagctccggcagaccgtggcccaccacaacctgctgggccaggagacacgcgaccggcagctcctggagcgggcggagaggaaaggccgctcagtaagtaaagtaagaagtgaagagaaagatgaagactctgaaagaggagatgaagatagagaaagaagataccgagaaagaaagctgcagtacggagacagcaaggacaaccctctcaagtactggctttataaagaagaaggcgagaggagacacaggaagcccagagagccagatcgagacaagaaacaccgagaaaaaagcagcacaagggaaaaaagagagaaatattccaaagagaaaagtaattcattctctgacaaaggggaagaaagacataaagaaaagcgacacaaagaaggttttcattttgatgatgagaggcaccgaagcaacgtggatagaaaagagaaatcggcaaaagatgagcccaggaaaagggaatcccagaatggtgaacacagaaatcgaggtgcaagctcaaaaagagatgggaccagcagccagcatgctgagaatttagtaaggaatcatggaaaagataaagattcaagacggaagcatggccacgaggaaggctcttctgtgtggtggaagctggaccagaggccgggaggcgaggaaaccgtggaaattgaaaaggaagaaactgatttagaaaatgctagagctgatgcatatacagccagttgtgaagatgattttgaagactatgaagatgactttgaggtttgtgatggtgatgatgatgaaagcagtaatgaacctgagtcaagagaaaaactggaagaacttcctctagctcaaaaaaaggaaatacaagaaattcaaagagctattaatgcagaaaatgaaaggattggcgagttatctttgaaactgtttcagaagcgaggtagaacagaatttgaaaaggagcccaggacagatacaaacagttccccttccagagcctctgtttgtggaatttttgtggattttgcctcagcttcacaccgtcaaaagagtcggactcaggcccttaagcaaaagatgcgaagtacaaaactgcttcggctcattgacttagatttttcatttactttctctctcttggatctaccaccagtaaatgaatatgacatgtatatcagaaactttgggaaaaaaaataccaagcaggcatatgttcagtgtaacgaagataatgttgaaagagacattcaaacggaggaaatagagaccagggaagtgtggacccagcacccgggagaaagtactgttgtatctggaggcagtgaacaaagagatacctctgatgctgtagttatgccaaagattgatactccaaggttatgtagctttctgcgggctgcttgtcaggtgatggccgttttgctggaagaggatcgcttggcagctgaacccagctggaatcttagggctcaagacagggccctgtattttagtgacagctcatctcagctgaacaccagtctaccattccttcaaagtcacgtgttgctgcttgagccctttgaaagcatttttactgtttgccggaacagcgcacggctcagttgtcgtctgggatttgagagaagactcaaggctgcattactctgtgacgctgagcgatggcttctggacgttccggaccgccacgttttccaccgatggaatccttacctcagtaaaccaccgaagccctcttcaagcagtagaacctatctcaacgtccgtccacaaaaagcagagctttgtgctttcacccttttctactcaagaagaaatgtcaggtttgtccttccacatcgcttccttggatgagagtggggttctcaatgtatgggtggttgttgaattaccaaaggcagacatcgcaggttcaataagtgatttaggtctgatgcctggagggagggtcaagctggtacatagtgctctgatccagttgggtgacagtctttcccataaaggtaatgaattttggggcactacacaaacactgaatgttaaatttctgccttcagatcctaatcactttattattggcacagacatgggtctcataagccatggcacaagacaagatttgagagtggctcccaaactattcaaacctcagcaacatggtataagaccagtgaaagttaatgtcattgatttttcaccatttggagaaccaatatttttggccggctgttcggacggaagcatcaggctgcaccagctgagctccgcgtttccgctcctgcagtgggacagcagcacggacagccatgcggtcaccggcctgcagtggtccccaaccaggcctgccgtgttcctggtgcaggacgacacatccaacatctacatctgggacctcctccagagcgatctgggtcctgtcgccaaacagcaggtctcccccaacaggctggtggccatggctgcggtgggtgagcctgagaaggctggtggcagcttcctggccctggtgctggccagggcgtctggctccatcgacatccagcacctgaagaggcggtgggcggccccggaggtggacgagtgcaacaggctgcgtctgcttttgcaggaagccctgtggccagagggaaaactgcacaagtagcgggtgtggctgagaggaccgcgtttctgtaatgacccagatttaaaagacataaggtggataattctacatttgtgtgcaagtatatttatgtatatagactatgtatattctgtatataatttattttacatgaatatgtctttggtattcccagtaaatagatgactacttttgagtggaaacaaagaacattctagcatttacaaaacttccaggggaatgtagagccacgtccagggtgctcttttctgagagtatttcgagttatttttagaacagtttaaatattgtcacattactgctagattttaaacagcctaccatgaaaatgtatcttaatgaactattttcttatgcataaagtatgtgaacacatgtctaaattaaaaggaattactccaccg

SEQ ID NO: 86616 - DNA, 3202 bp, Homo sapiens
ggaccccctcagataccaaaatccatgaatactcaagtcccccatataaaatggtgtagtgcctgcatataacctacgccctaccaccagaatgctttaaatcgtctctatattacttaaaatccctaatgcaatataaatgagatgcaaatagttgttattgtttagggtgtaatgacaaggaaaaagtctgtacatgtttactacagacacgattttcttcaaatgtttttgatctgtggttggttggatccgtcgttgcagaacccacagagagggagggctggctgcactcctatttgatgtgctcctgtgtttctcagcttgtcgtgttttacagctgcagtacggagacagcaaggacaaccctctcaagtactggctttataaagaagaaggcgagaggagacacaggaagcccagagagccagatcgagacaagaaacaccgagaaaaaagcagcacaagggaaaaaagagagaaatattccaaagagaaaagtaattcattctctgacaaaggggaagaaagacataaagaaaagcgacacaaagaaggttttcattttgatgatgagaggcaccgaagcaacgtggatagaaaagagaaatcggcaaaagatgagcccaggaaaagggaatcccagaatggtgaacacagaaatcgaggtgcaagctcaaaaagagatgggaccagcagccagcatgctgagaatttagtaaggaatcatggaaaagataaagattcaagacggaagcatggccacgaggaaggctcttctgtgtggtggaagctggaccagaggccgggaggcgaggaaaccgtggaaattgaaaaggaagaaactgatttagaaaatgctagagctgatgcatatacagccagttgtgaagatgattttgaagactatgaagatgactttgaggtttgtgatggtgatgatgatgaaagcagtaatgaacctgagtcaagagaaaaactggaagaacttcctctagctcaaaaaaaggaaatacaagaaattcaaagagctattaatgcagaaaatgaaaggattggcgagttatctttgaaactgtttcagaagcgaggtagaacagaatttgaaaaggagcccaggacagatacaaacagttccccttccagagcctctgtttgtggaatttttgtggattttgcctcagcttcacaccgtcaaaagagtcggactcaggcccttaagcaaaagatgcgaagtacaaaactgcttcggctcattgacttagatttttcatttactttctctctcttggatctaccaccagtaaatgaatatgacatgtatatcagaaactttgggaaaaaaaataccaagcaggcatatgttcagtgtaacgaagataatgttgaaagagacattcaaacggaggaaatagagaccagggaagtgtggacccagcacccgggagaaagtactgttgtatctggaggcagtgaacaaagagatacctctgatgctgtagttatgccaaagattgatactccaaggttatgtagctttctgcgggctgcttgtcaggtgatggccgttttgctggaagaggatcgcttggcagctgaacccagctggaatcttagggctcaagacagggccctgtattttagtgacagctcatctcagctgaacaccagtctaccattccttcaaagtcacgtgttgctgcttgagccctttgaaagcatttttactgtttgccggaacagcgcacggctcagttgtcgtctgggatttgagagaagactcaaggctgcattactctgtgacgctgagcgatggcttctggacgttccggaccgccacgttttccaccgatggaatccttacctcagtaaaccaccgaagccctcttcaagcagtagaacctatctcaacgtccgtccacaaaaagcagagctttgtgctttcacccttttctactcaagaagaaatgtcaggtttgtccttccacatcgcttccttggatgagagtggggttctcaatgtatgggtggttgttgaattaccaaaggcagacatcgcaggttcaataagtgatttaggtctgatgcctggagggagggtcaagctggtacatagtgctctgatccagttgggtgacagtctttcccataaaggtaatgaattttggggcactacacaaacactgaatgttaaatttctgccttcagatcctaatcactttattattggcacagacatgggtctcataagccatggcacaagacaagatttgagagtggctcccaaactattcaaacctcagcaacatggtataagaccagtgaaagttaatgtcattgatttttcaccatttggagaaccaatatttttggccggctgttcggacggaagcatcaggctgcaccagctgagctccgcgtttccgctcctgcagtgggacagcagcacggacagccatgcggtcaccggcctgcagtggtccccaaccaggcctgccgtgttcctggtgcaggacgacacatccaacatctacatctgggacctcctccagagcgatctgggtcctgtcgccaaacagcaggtctcccccaacaggctggtggccatggctgcggtgggtgagcctgagaaggctggtggcagcttcctggccctggtgctggccagggcgtctggctccatcgacatccagcacctgaagaggcggtgggcggccccggaggtggacgagtgcaacaggctgcgtctgcttttgcaggaagccctgtggccagagggaaaactgcacaagtagcgggtgtggctgagaggaccgcgtttctgtaatgacccagatttaaaagacataaggtggataattctacatttgtgtgcaagtatatttatgtatatagactatgtatattctgtatataatttattttacatgaatatgtctttggtattcccagtaaatagatgactacttttgagtggaaacaaagaacattctagcatttacaaaacttccaggggaatgtagagccacgtccagggtgctcttttctgagagtatttcgagttatttttagaacagtttaaatattgtcacattactgctagattttaaacagcctaccatgaaaatgtatcttaatgaactattttcttatgcataaagtatgtgaacacatgtctaaattaaaaggaattactccaccg

SEQ ID NO: 86617 - DNA, 1003 bp, Homo sapiens
gctgggcagtgcttctgggccctctgctgctcctgcttgtcggttgctaggcgctgggacgcgcctcccgaagggtgcggggcacaggtggcctcttcggggtggaccgcgcctggccggggccgaggacaccgcggccgcccgggcctgcgggaagcgatggagcccgggaagagaagaaccaaagatgatacctggaaagcagatgacctcagaaaacatctctgggccatacagtcaggtggttccaaggaagaaagaaagcacagagagaagaagctgcgtaaggagtctgagatggaccttcctgaacataaggagccgaggtgcagggatcccgaccaggatgccaggagcagagacagggtggccgaagtccacaccgctaaggagagtcctcgtggggagagggacagagacagacagagggagaggagaagagacgcaaaagaccgggagaaagaaaagctgaaggagaaacatcgagaggcagaaaagtctcacagcagaggaaaggacagggaaaaagaaaaagacagaagggcccggaaggaagagctccggcagaccgtggcccaccacaacctgctgggccaggagacacgcgaccggcagctcctggagcgggcggagaggaaaggccgctcagtaagtaaagtaagaagtgaagagaaagatgaagactctgaaagaggagatgaagatagagaaagaagataccgagaaagaaagagaagaaccaaagatgatacctggaaagcagatgacctcagaaaacatctctgggccatacagtcaggtggttccaaggaagaaagaaagcacagagagaagaagctgcgtaaggagtctgagatggaccttcctgaacataaggagccgaggtgcagggatcccgaccaggatgccaggagcagagacagggtggccgaagtccacaccgctaaggagagtcctcgtggggagagggacagagacagacagagggagaggagaagagacg

SEQ ID NO: 86618 - DNA, 518 bp, Homo sapiens
gctgggcagtgcttctgggccctctgctgctcctgcttgtcggttgctaggcgctgggacgcgcctcccgaagggtgcggggcacaggtggcctcttcggggtggaccgcgcctggccggggccgaggacaccgcggccgcccgggcctgcgggaagcgatggagcccgggaaggtcggtgcggcgctgggtctgggcgaggggtggtcgagcttcgcggactccttcgggcgccgctagcagcgccgccgccgccctccctttgcgcagcggttctctcggccgggccggggcttcccggaggagccgcggtgcctccgaggcaggaagggaaacggaggcgcggctggccgtcggcgcgagggatggcaggacgccgggctcccggcggtcgggagaggcggtctgtgcagcctcaggcctggggtcgccgccgcggcccgtctcctcgcgcccggcctggaggcggcctcggcccctgctgcggggccggggtggctgaggagacatatttaaaa

SEQ ID NO: 86619 - DNA, 440 bp, Homo sapiens
catgctgcttcccatcgttgtgaaaggacgcctcgcattctgggtatagatgagccatgcccttcaccctaagtggcagtcctaatgctccttgctgggtcctggatttcaaccctgtgtctcacatgtacatgcaaacgtgtgtgcagacagatgtgtgcacagtgtgtttcctgaggctgggcatgctgccagctgatgccaaaataggggtggggacagtaatctctaatccagagacgagaatgatctttgatatgagagctggttcttaaagctgcttctcttgttccaggcaaatagactaattgggattgcctccccgtcattttcccaccctactccaaacacgcactcacacacccaagagacacacatgcgaatatacagattcttaacagctaggcatggcttctttttgctgggagaaaaacagagac

SEQ ID NO: 86620 - DNA, 362 bp, Homo sapiens
taaacctcattaagaatatgtgatgtgtttaacacttcatgtatatgtcatctaacttaatccacttgacaaagccagacctcagctcagaggtgatgtgacagtctcctgggtcatagctgccctcccgctgacagcctctcttggcacctcttttcatgttttcatgagtaacagaggtgggacaaaccagataggtctgactccaaagcctatgctgaagagaatgccaaagagaccaccattttagagctataatgtattttttagaattacagcggggatgacatgcacagtccaaagttgttgcgcccccattatggcaaggcagcatgcctgcatctaaaaatctagaatactcc

SEQ ID NO: 86621 - DNA, 437 bp, Homo sapiens
ccaccagtctgttctacatcaggaaagtggcaatcaggaggttgctactgaaacagtggcaagaaaatgctactgtagctgtgatccaggtgatcagggcagccactgctgttaacattgtaactgctggaagtctggaatgtaggatctggccattgctgtgacagcttctccttgatgctcgtgaactggtgactagatgctgttatgatgaatctggtccctgctgcctttgccattgtctctaaaataattggaaaatgattaattatgtttttaatataatttaattgtaattttatgcggctgaattcttaatggtggctgtgtttgacaactgatttgtgaaattcatggaaatttgatagttggccttgcaagagagtacagccaactccattgcatcactgtaaaacctcctagctgacggttctact

SEQ ID NO: 86622 - DNA, 519 bp, Homo sapiens
ttcacacttggataaaatccacactccctcaccacaacctatatgactggactcttgcctaatcttctcacctcatcctctatcactttcttccctgttcattcctctccaggaactggccttctcactgttcctcagaaatatgaagcggactactgctttagggtcttgcatttgctgtttcctctgttttcaacccccagaccgtcacatggctttctctcttacctcactcaggtctctgctcaaatgttgcctcagagaggacttccctcatcaccacccctaatataaatgaagcaccgtagccgtagccgttccctaaccaattgccctactttattcaccttcacatctcttatcaaatatcctgtttacctgtttacttgattattgtttgctttacctctagaatgcatgttctatgagtgtagggacttggtcaatcttgttcaacaaggaacttccagtccaaaactgtacctgtcatagaaaaggcacccaataaatatgcaaatc

SEQ ID NO: 86623 - DNA, 8733 bp, Homo sapiens
gccatgttgatttctgatccttgagcttttctgtgcttctctgttcattcttcatggcatccttggaaggatgccaagctaaggaggccaggggggaataaaaggagtccaggctcccaactgtgcccttcccctctcccctgggagcaaccacttagggtcctcatggttcctccagtctggactctgctgcttctggtgggggctgcccttttcaggaaagagaagcctccggaccagaagctggttgttcgcagctctagggacaactatgtcctcacccagtgtgattttgaggatgacgccaaacccctctgtgactggtcccaagtgtccgcagacgatgaagactgggttcgagccagtgggccctctcccaccggctccaccggggcccccggggggtaccctaacggagagggcagctatctgcatatggaatcgaacagcttccaccgtgggggagtggcccgcctgctcagccccgacctatgggagcaaggccccctctgtgtgcactttgcccaccacatgttcgggctgtcttggggcgcccagctcaggctgctgctgctctcgggtgaagagggccgccgccccgatgtgctctggaaacactggaacacccagagaccctcctggatgctcaccaccgtcactgtgcccgcagggttcaccctgcccacccggctgatgtttgagggaacacggggtagcactgcctacctggacatcgccctggatgccctctctatccgccggggctcctgtaatcgcgtctgtatgatgcaaacatgcagctttgacattccaaatgacctctgtgactggacctggatcccaactgcctccggggccaagtggactcagaagaaagggtcatcaggaaagccaggcgtggggcctgatggcgacttctctagccctggtagtggctgctacatgctcctggaccccaagaatgcaagacctgggcagaaagctgtcctcctgagccccgtgagcctgtcctctggctgtctgagcttttccttccactacatcctccggggccagtctcctggtgcagccctccacatttatgcttcagtcttggggagtatccggaaacacactctcttctcaggacaacctgggcccaactggcaggctgtttctgtcaattacacagccgtgggacggatacagtttgccgtggtaggcgtttttggaaagaccccagagccagctgtggcagttgatgcaaccagcattgctccttgtggggagggttttcctcagtgtgactttgaagacaacgcccatcccttctgtgactgggtccagacttccggggatggtggacactgggccctcggacataaaaatggacccgtccatggcatgggccctgcgggaggtttccctaatgcagggggtcactatatctaccttgaggctgacgagttctcccaggcaggccagtcagtcagactggtgagccggcccttctgcgccccaggtgacatctgcgtggagttcgcataccacatgtatggccttggggagggtactatgctcgaactcctcctgggaagtcctgcggggagtcccccgattcctctctggaaacgcgtggggtctcagcgcccttactggcagaacacctccgtcaccgtcccctcaggacaccaacagcccatgcagcttattttcaagggcatccagggaagcaacacggcctctgtggttgctatgggtttcatcttgatcaatcctgggacttgtccagtaaaagtgctaccagagcttcctcccgtatctccagtttcttccactggcccttctgaaaccactggcctcacagaaaaccctacaatctccaccaagaaacctacagtttccatagaaaaacccagtgtcaccacagaaaagcccacagtccccaaagaaaagcccaccattcccacagaaaaacccaccatctccacagaaaaacccaccattccttcagaaaaacccaacatgccctcagaaaaacccaccattccctcagaaaaacccaccatcctcacagaaaaacccaccattccctcagaaaaacccaccattccctcagaaaaacccaccatttccacagaaaaacccaccgtccccacagaagagcccaccacccccactgaggagaccaccacctccatggaagagcctgtcatccctacagaaaaacccagcatccctacagaaaaacccagcatccccacggaaaaacccaccatctccatggaagagactatcatctccacagaaaaacccaccatctccccagaaaaacccaccatccccacagaaaaacccaccatccccacagaaaaatccaccatctccccagaaaaacccaccacccccacagaaaaacccaccatccccacagaaaaacccaccatctccccagaaaaacccaccacccccacagaaaaacccaccatctccccagaaaaactcaccatccccacagaaaaacccaccatccccacagaaaaacccaccattcccacagaaaaacccaccatctccacagaagagcccaccacccccactgaggagaccaccatctccacagaaaaacccagcatccccatggaaaaacccactctccccactgaagaaaccaccacctctgttgaagagactaccatctctacagaaaaactcaccatccccatggaaaaacccaccatctccacagaaaaacccaccatccccacagaaaaacccaccatctccccagaaaaactcaccatccccacggaaaaactcaccatccccacggaaaaacccaccatccccattgaagagactaccatctccacagaaaaactcaccatccccacagaaaaacccaccatctccccagaaaaacccaccatctccacggaaaaacccaccatccccacggaaaaacccaccatccccactgaagagactaccatctccacagaaaaactcaccatccccacagaaaaacccaccatctccccagaaaaactcaccatccccacagaaaaacccaccatctccacggaaaaacccaccatccccacggaaaaacttaccatccccacggaaaaacccaccatccccacagaaaaacccaccattcccacagagaagctcacagccctgaggccaccccatcccagccccacagccactgggctggcagccttggtgatgtctccacatgctccaagtacccctatgaccagtgtgattctgggcactaccacaacctccagatccagtacagagcgctgccctccaaatgcccgctacgaatcctgtgcttgtcctgcttcgtgcaagagccccaggcctagctgtgggcccctctgtcgggagggctgtgtctgcaaccctggctttttgtttagtgacaaccactgcatccaggcctcttcctgcaattgcttctacaacaacgactactatgagcctggggcagagtggttcagccccaactgcacagaacattgccgctgctggcccggcagtcgggtcgagtgccagatctctcagtgtgggacacacaccgtgtgccagcttaagaatggccagtatggatgccacccctacgcaggcactgccacctgcttggtctacggagaccctcattatgtcacctttgacgggaggcactttggcttcatgggcaagtgcacttacatcttggcccagccctgtggcaactcaacagacccattcttcagggtgacagccaagaatgaggagcagggacaggaaggcgtgtcctgcctgagcaaagtctacgtgaccctgcccgagagcaccgtcaccctgcttaagggcagacgcactctggttgggggtcagcaagttactctcccagccataccctctaaaggcgtcttcctgggtgcaagcgggcggtttgtggagctgcagacggagttcggtttgcgggtgagatgggatggtgaccagcagctgtatgttactgtgtccagcacatactctggcaaactctgtggtttgtgtgggaactatgacggcaacagtgacaatgaccacctgaagttggacggcagcccagcaggagacaaggaggagctggggaacagctggcagacggaccaggacgaggaccaggagtgtcagaagtaccaggtggtgaattccccgtcttgtgattcatctctgcagagcagcatgtcggggccagggttctgtggacggctggtcgacactcatggcccatttgagacatgcctgctgcacgtgaaggccgcttccttcttcgacagctgcatgcttgatatgtgcggattccaggggctgcagcacctgctgtgcacacacatgtccaccatgaccaccacctgccaggacgcaggccacgctgtgaagccctggagggaaccccacttctgcccaatggcctgcccgcccaacagcaagtactccctgtgtgcgaagccatgccctgacacctgccattcaggattctccggcatgttctgctcagaccggtgcgtggaggcctgtgaatgcaatccgggcttcgtcctcagtggcctcgagtgcatacctcgctcccagtgtgggtgcctccaccctgcaggcagctacttcaaggtaggggagcggtggtacaagccaggctgcaaagagttgtgcgtctgtgaaagcaacaacagaattcgctgccagccctggaggtgtagggcccaggagttctgtggccaacaggatggtatctatggctgccatgcccaaggtgccgccacctgcacagcctcgggtgacccccactacctgaccttcgatggcgccttgcaccacttcatgggcacctgcacctatgtcctgacccggccttgctggtccaggtcccaagacagctattttgttgtgagcgccaccaacgagaaccgcggggggatcctggaggtctcctacatcaaagccgtccacgtgacagtctttgacctcagcatctcactgctcagaggctgtaaggtcatgctgaatggccatcgggtggccctacctgtgtggcttgcacaaggccgggtgaccataaggctcagcagcaacctcgtcctcctctacacgaactttgggctccaagttcgctacgacgggagccacttggtggaagtgacagtcccctcctcctatggcggccagctctgtgggctgtgtgggaactacaacaacaacagcttggatgacaacctgcgccccgacagaaagcttgcaggcgattccatgcagctgggggccgcctggaagttacctgaatcctctgaacctggctgtttccttgtgggtggcaagccctccagctgccaggagaacagcatggcagacgcctggaacaagaactgtgcgatcttaataaaccctcagggacccttctctcaatgtcaccaggtggtgcctccccagtccagctttgccagttgcgtgcatggtcagtgtgggaccaagggcgacaccacagccctgtgccgctccctgcaggcctacgcgtccctgtgtgcccaggctggccaggcccctgcctggcggaacagaaccttctgccctatgaggtgcccacctggcagcagctacagcccctgcagcagcccctgcccagacacctgcagcagcataaacaacccgagggactgccccaaagcactgccctgtgctgagagctgtgaatgtcagaaaggccacatcttgagtggaacctcctgcgtgccccttggccagtgtggctgcactgacccagcgggctcctaccacccggtcggggagcgctggtacacagagaacacctgcaccaggctctgcacctgctccgtccacaacaacatcacctgcttccagagcacctgcaaacccaaccagatatgctgggccctggatgggctgctccgttgtcgggcctcaggtgtgggagtgtgtcagctcccaggggagtcccactacgtgagctttgatggtagtaaccattctatcccggacgcctgcactcttgtcctggtgaaagtgtgccaccccgccatggccttgcccttcttcaagatcagtgccaagcatgagaaggaggaaggtggaactgaggctttccgccttcatgaggtctacattgacatctacgatgcccaggtcaccctgcagaagggccaccgtgtgctaatcaacagcaaacaggtcaccctccccgccatctcccagatccctggggtcagtgtcaagtccagcagcatctacagcattgttaacatcaagatcggggtgcaagtcaagtttgacgggaatcatctcttagagattgaaatccccacaacctactatggaaaggtctgcggcatgtgtgggaacttcaatgatgaggaagaggacgaactaatgatgcccagcgatgaagtagcaaatagtgacagtgaatttgtgaacagttggaaagataaggacattgacccaagttgtcagagtctcctggtagatgagcagcagattccagcggaacagcaggagaacccgagtggaaactgcagggcggccgacctccgcagggcgcgggaaaagtgcgaggcagcgctccgggctcctgtgtgggcccagtgcgcctcccgcatagacctcacgcccttcctggtggactgtgcaaacaccctctgtgagttcggaggtctctaccaggccctctgccaggctctgcaagccttcggggccacctgccagagccaggggctcaagcccccactctggagaaacagcagcttctgccctctggaatgccctgcctacagcagctacaccaactgccttccctcctgctcaccctcctgctgggacctggatggccggtgtgagggcgccaaagtcccctctgcctgcgctgagggctgcatttgtcagcccggctatgtgctgagtgaagacaagtgtgtccccagaagtcagtgtggctgcaaggatgcccatggtggctccatccctctgggcaagagctgggtctccagcggttgcacggagaagtgtgtctgcacgggaggagccattcagtgcggggacttccgatgcccctctgggtcccactgccagctcacttccgacaacagcaacagcaattgtgtctcagacaagtctgaacaatgctcagtctatggcgacccccgttacctcacatttgacggcttcagctaccgcttgcaaggccgcatgacctatgttctgatcaagactgtggacgtactgcctgagggggtggagcccctcctcgtggaaggacgcaacaagatggatccgcccaggagctccatcttcttgcaggaagtgattaccaccgtctacggctataaagtgcagctccaagctggtctggagcttgtggtcaacaaccagaagatggccgtcccctacaggccaaatgaacacctgcgggtcaccctgtggggccaacggctctacctggtcaccgactttgagctggtcgtcagctttggtggaaggaaaaatgcagtgatctccctacccagcatgtacgaggggcttgtgagtggcctgtgcggaaactacgacaagaaccgcaagaatgacatgatgctgcccagtggcgccctgacccagaacctcaacacctttggcaacagctgggaggtgaagaccgaggacgcactcctgcgcttccccagggctataccagcggaggaggagggacaaggggcggagctgggcctccgcacgggcctccaagtgtccgaatgtagcccggagcagctggcgagcaacagcacccaggcctgtagggtgctggcagacccccagggcccctttgctgcctgtcaccagacggtggccccagagcccttccaagagcactgcgtgctggatctgtgctctgctcaggacccaagagagcaagaggagctgcgttgccaggtcctcagtgggtacgccatcctctgccaggaggcgggcgctgccctggctggctggcgggaccgcaccctctgcgccatggagtgtccagcaggtaccatatatcagagctgtatgacaccctgcccagcatcctgtgccaacctggcagaccccggggactgcgagggcccctgcgtggaaggctgcgccagcatcccaggctatgcctacagtggcacccagagcctcccctggctgactgtggctgcaccagcaatggcatctactaccagctgggcagcagctttctgactgaggactgctctcagcggtgcacctgtgccagctcacggatcctgctgtgtgagcccttcagctgcagagcgggggaggtctgcaccctggggaaccacacccaaggctgctttccagaaagcccgtgtctgcagaacccctgtcagaatgacgggcagtgtcgggagcagggagccaccttcacctgcgagtgtgaagttggttacgggggaggcctgtgtatggagcctcgagatgcgccacctcccagaaagccagcatctaacctggtggccgtcctactgggactgctggtgcctgtggtggtcgtactactggccgtgaccagagagtgcatttacagaacgaggaggaagagagagaaaacgcaggagggagacagactggccaggctggtggacacagatactgttctggactgtgcctgttaagttgctcagttttgagctgtcttcagacaagaagattaaataaatttatatatttatttatttg

SEQ ID NO: 86624 - DNA, 8668 bp, Homo sapiens
gccatgttgatttctgatccttgagcttttctgtgcttctctgttcattcttcatggcatccttggaaggatgccaagctaaggaggccaggggggaataaaaggagtccaggctcccaactgtgcccttcccctctcccctgggagcaaccacttagggtcctcatggttcctccagtctggactctgctgcttctggtgggggctgcccttttcaggaaagagaagcctccggaccagaagctggttgttcgcagctctagggacaactatgtcctcacccagtgtgattttgaggatgacgccaaacccctctgtgactggtcccaagtgtccgcagacgatgaagactgggttcgagccagtgggccctctcccaccggctccaccggggcccccggggggtaccctaacggagagggcagctatctgcatatggaatcgaacagcttccaccgtgggggagtggcccgcctgctcagccccgacctatgggagcaaggccccctctgtgtgcactttgcccaccacatgttcgggctgtcttggggcgcccagctcaggctgctgctgctctcgggtgaagagggccgccgccccgatgtgctctggaaacactggaacacccagagaccctcctggatgctcaccaccgtcactgtgcccgcagggttcaccctgcccacccggctgatgtttgagggaacacggggtagcactgcctacctggacatcgccctggatgccctctctatccgccggggctcctgtaatcgcgtctgtatgatgcaaacatgcagctttgacattccaaatgacctctgtgactggacctggatcccaactgcctccggggccaagtggactcagaagaaagggtcatcaggaaagccaggcgtggggcctgatggcgacttctctagccctggtagtggctgctacatgctcctggaccccaagaatgcaagacctgggcagaaagctgtcctcctgagccccgtgagcctgtcctctggctgtctgagcttttccttccactacatcctccggggccagtctcctggtgcagccctccacatttatgcttcagtcttggggagtatccggaaacacactctcttctcaggacaacctgggcccaactggcaggctgtttctgtcaattacacagccgtgggacggatacagtttgccgtggtaggcgtttttggaaagaccccagagccagctgtggcagttgatgcaaccagcattgctccttgtggggagggttttcctcagtgtgactttgaagacaacgcccatcccttctgtgactgggtccagacttccggggatggtggacactgggccctcggacataaaaatggacccgtccatggcatgggccctgcgggaggtttccctaatgcagggggtcactatatctaccttgaggctgacgagttctcccaggcaggccagtcagtcagactggtgagccggcccttctgcgccccaggtgacatctgcgtggagttcgcataccacatgtatggccttggggagggtactatgctcgaactcctcctgggaagtcctgcggggagtcccccgattcctctctggaaacgcgtggggtctcagcgcccttactggcagaacacctccgtcaccgtcccctcaggacaccaacagcccatgcagcttattttcaagggcatccagggaagcaacacggcctctgtggttgctatgggtttcatcttgatcaatcctgggacttgtccagtaaaagtgctaccagagcttcctcccgtatctccagtttcttccactggcccttctgaaaccactggcctcacagaaaaccctacaatctccaccaagaaacctacagtttccatagaaaaacccagtgtcaccacagaaaagcccacagtccccaaagaaaagcccaccattcccacagaaaaacccaccatctccacagaaaaacccaccattccttcagaaaaacccaacatgccctcagaaaaacccaccattccctcagaaaaacccaccatcctcacagaaaaacccaccattccctcagaaaaacccaccattccctcagaaaaacccaccatttccacagaaaaacccaccgtccccacagaagagcccaccacccccactgaggagaccaccacctccatggaagagcctgtcatccctacagaaaaacccagcatccctacagaaaaacccagcatccccacggaaaaacccaccatctccatggaagagactatcatctccacagaaaaacccaccatctccccagaaaaacccaccatccccacagaaaaacccaccatccccacagaaaaatccaccatctccccagaaaaacccaccacccccacagaaaaacccaccatccccacagaaaaacccaccatctccccagaaaaacccaccacccccacagaaaaacccaccatctccccagaaaaactcaccatccccacagaaaaacccaccatccccacagaaaaacccaccattcccacagaaaaacccaccatctccacagaagagcccaccacccccactgaggagaccaccatctccacagaaaaacccagcatccccatggaaaaacccactctccccactgaagaaaccaccacctctgttgaagagactaccatctctacagaaaaactcaccatccccatggaaaaacccaccatctccacagaaaaacccaccatccccacagaaaaacccaccatctccccagaaaaactcaccatccccacggaaaaactcaccatccccacggaaaaacccaccatccccattgaagagactaccatctccacagaaaaactcaccatccccacagaaaaacccaccatctccccagaaaaacccaccatctccacggaaaaacccaccatccccacggaaaaacccaccatccccactgaagagactaccatctccacagaaaaactcaccatccccacagaaaaacccaccatctccccagaaaaactcaccatccccacagaaaaacccaccatctccacggaaaaacccaccatccccacggaaaaacttaccatccccacggaaaaacccaccatccccacagaaaaacccaccattcccacagagaagctcacagccctgaggccaccccatcccagccccacagccactgggctggcagccttggtgatgtctccacatgctccaagtacccctatgaccagtgtgattctgggcactaccacaacctccagatccagtacagagcgctgccctccaaatgcccgctacgaatcctgtgcttgtcctgcttcgtgcaagagccccaggcctagctgtgggcccctctgtcgggagggctgtgtctgcaaccctggctttttgtttagtgacaaccactgcatccaggcctcttcctgcaattgcttctacaacaacgactactatgagcctggggcagagtggttcagccccaactgcacagaacattgccgctgctggcccggcagtcgggtcgagtgccagatctctcagtgtgggacacacaccgtgtgccagcttaagaatggccagtatggatgccacccctacgcaggcactgccacctgcttggtctacggagaccctcattatgtcacctttgacgggaggcactttggcttcatgggcaagtgcacttacatcttggcccagccctgtggcaactcaacagacccattcttcagggtgacagccaagaatgaggagcagggacaggaaggcgtgtcctgcctgagcaaagtctacgtgaccctgcccgagagcaccgtcaccctgcttaagggcagacgcactctggttgggggtcagcaagttactctcccagccataccctctaaaggcgtcttcctgggtgcaagcgggcggtttgtggagctgcagacggagttcggtttgcgggtgagatgggatggtgaccagcagctgtatgttactgtgtccagcacatactctggcaaactctgtggtttgtgtgggaactatgacggcaacagtgacaatgaccacctgaagttggacggcagcccagcaggagacaaggaggagctggggaacagctggcagacggaccaggacgaggaccaggagtgtcagaagtaccaggtggtgaattccccgtcttgtgattcatctctgcagagcagcatgtcggggccagggttctgtggacggctggtcgacactcatggcccatttgagacatgcctgctgcacgtgaaggccgcttccttcttcgacagctgcatgcttgatatgtgcggattccaggggctgcagcacctgctgtgcacacacatgtccaccatgaccaccacctgccaggacgcaggccacgctgtgaagccctggagggaaccccacttctgcccaatggcctgcccgcccaacagcaagtactccctgtgtgcgaagccatgccctgacacctgccattcaggattctccggcatgttctgctcagaccggtgcgtggaggcctgtgaatgcaatccgggcttcgtcctcagtggcctcgagtgcatacctcgctcccagtgtgggtgcctccaccctgcaggcagctacttcaaggtaggggagcggtggtacaagccaggctgcaaagagttgtgcgtctgtgaaagcaacaacagaattcgctgccagccctggaggtgtagggcccaggagttctgtggccaacaggatggtatctatggctgccatgcccaaggtgccgccacctgcacagcctcgggtgacccccactacctgaccttcgatggcgccttgcaccacttcatgggcacctgcacctatgtcctgacccggccttgctggtccaggtcccaagacagctattttgttgtgagcgccaccaacgagaaccgcggggggatcctggaggtctcctacatcaaagccgtccacgtgacagtctttgacctcagcatctcactgctcagaggctgtaaggtcatgctgaatggccatcgggtggccctacctgtgtggcttgcacaaggccgggtgaccataaggctcagcagcaacctcgtcctcctctacacgaactttgggctccaagttcgctacgacgggagccacttggtggaagtgacagtcccctcctcctatggcggccagctctgtgggctgtgtgggaactacaacaacaacagcttggatgacaacctgcgccccgacagaaagcttgcaggcgattccatgcagctgggggccgcctggaagttacctgaatcctctgaacctggctgtttccttgtgggtggcaagccctccagctgccaggagaacagcatggcagacgcctggaacaagaactgtgcgatcttaataaaccctcagggacccttctctcaatgtcaccaggtggtgcctccccagtccagctttgccagttgcgtgcatggtcagtgtgggaccaagggcgacaccacagccctgtgccgctccctgcaggcctacgcgtccctgtgtgcccaggctggccaggcccctgcctggcggaacagaaccttctgccctatgaggtgcccacctggcagcagctacagcccctgcagcagcccctgcccagacacctgcagcagcataaacaacccgagggactgccccaaagcactgccctgtgctgagagctgtgaatgtcagaaaggccacatcttgagtggaacctcctgcgtgccccttggccagtgtggctgcactgacccagcgggctcctaccacccggtcggggagcgctggtacacagagaacacctgcaccaggctctgcacctgctccgtccacaacaacatcacctgcttccagagcacctgcaaacccaaccagatatgctgggccctggatgggctgctccgttgtcgggcctcaggtgtgggagtgtgtcagctcccaggggagtcccactacgtgagctttgatggtagtaaccattctatcccggacgcctgcactcttgtcctggtgaaagtgtgccaccccgccatggccttgcccttcttcaagatcagtgccaagcatgagaaggaggaaggtggaactgaggctttccgccttcatgaggtctacattgacatctacgatgcccaggtcaccctgcagaagggccaccgtgtgctaatcaacagcaaacaggtcaccctccccgccatctcccagatccctggggtcagtgtcaagtccagcagcatctacagcattgttaacatcaagatcggggtgcaagtcaagtttgacgggaatcatctcttagagattgaaatccccacaacctactatggaaaggtctgcggcatgtgtgggaacttcaatgatgaggaagaggacgaactaatgatgcccagcgatgaagtagcaaatagtgacagtgaatttgtgaacagttggaaagataaggacattgacccaagttgtcagagtctcctggtagatgagcagcagattccagcggaacagcaggagaacccgagtggaaactgcagggcggccgacctccgcagggcgcgggaaaagtgcgaggcagcgctccgggctcctgtgtgggcccagtgcgcctcccgcatagacctcacgcccttcctggtggactgtgcaaacaccctctgtgagttcggaggtctctaccaggccctctgccaggctctgcaagccttcggggccacctgccagagccaggggctcaagcccccactctggagaaacagcagcttctgccctctggaatgccctgcctacagcagctacaccaactgccttccctcctgctcaccctcctgctgggacctggatggccggtgtgagggcgccaaagtcccctctgcctgcgctgagggctgcatttgtcagcccggctatgtgctgagtgaagacaagtgtgtccccagaagtcagtgtggctgcaaggatgcccatggtggctccatccctctgggcaagagctgggtctccagcggttgcacggagaagtgtgtctgcacgggaggagccattcagtgcggggacttccgatgcccctctgggtcccactgccagctcacttccgacaacagcaacagcaattgtgtctcagacaagtctgaacaatgctcagtctatggcgacccccgttacctcacatttgacggcttcagctaccgcttgcaaggccgcatgacctatgttctgatcaagactgtggacgtactgcctgagggggtggagcccctcctcgtggaaggacgcaacaagatggatccgcccaggagctccatcttcttgcaggaagtgattaccaccgtctacggctataaagtgcagctccaagctggtctggagcttgtggtcaacaaccagaagatggccgtcccctacaggccaaatgaacacctgcgggtcaccctgtggggccaacggctctacctggtcaccgactttgagctggtcgtcagctttggtggaaggaaaaatgcagtgatctccctacccagcatgtacgaggggcttgtgagtggcctgtgcggaaactacgacaagaaccgcaagaatgacatgatgctgcccagtggcgccctgacccagaacctcaacacctttggcaacagctgggaggtgaagaccgaggacgcactcctgcgcttccccagggctataccagcggaggaggagggacaaggggcggagctgggcctccgcacgggcctccaagtgtccgaatgtagcccggagcagctggcgagcaacagcacccaggcctgtagggtgctggcagacccccagggcccctttgctgcctgtcaccagacggtggccccagagcccttccaagagcactgcgtgctggatctgtgctctgctcaggacccaagagagcaagaggagctgcgttgccaggtcctcagtggccatggagtgtccagcaggtaccatatatcagagctgtatgacaccctgcccagcatcctgtgccaacctggcagaccccggggactgcgagggcccctgcgtggaaggctgcgccagcatcccaggctatgcctacagtggcacccagagcctcccctggctgactgtggctgcaccagcaatggcatctactaccagctgggcagcagctttctgactgaggactgctctcagcggtgcacctgtgccagctcacggatcctgctgtgtgagcccttcagctgcagagcgggggaggtctgcaccctggggaaccacacccaaggctgctttccagaaagcccgtgtctgcagaacccctgtcagaatgacgggcagtgtcgggagcagggagccaccttcacctgcgagtgtgaagttggttacgggggaggcctgtgtatggagcctcgagatgcgccacctcccagaaagccagcatctaacctggtggccgtcctactgggactgctggtgcctgtggtggtcgtactactggccgtgaccagagagtgcatttacagaacgaggaggaagagagagaaaacgcaggagggagacagactggccaggctggtggacacagatactgttctggactgtgcctgttaagttgctcagttttgagctgtcttcagacaagaagattaaataaatttatatatttatttatttg

SEQ ID NO: 86625 - DNA, 8469 bp, Homo sapiens
gccatgttgatttctgatccttgagcttttctgtgcttctctgttcattcttcatggcatccttggaaggatgccaagctaaggaggccaggggggaataaaaggagtccaggctcccaactgtgcccttcccctctcccctgggagcaaccacttagggtcctcatggttcctccagtctggactctgctgcttctggtgggggctgcccttttcaggaaagagaagcctccggaccagaagctggttgttcgcagctctagggacaactatgtcctcacccagtgtgattttgaggatgacgccaaacccctctgtgactggtcccaagtgtccgcagacgatgaagactgggttcgagccagtgggccctctcccaccggctccaccggggcccccggggggtaccctaacggagagggcagctatctgcatatggaatcgaacagcttccaccgtgggggagtggcccgcctgctcagccccgacctatgggagcaaggccccctctgtgtgcactttgcccaccacatgttcgggctgtcttggggcgcccagctcaggctgctgctgctctcgggtgaagagggccgccgccccgatgtgctctggaaacactggaacacccagagaccctcctggatgctcaccaccgtcactgtgcccgcagggttcaccctgcccacccggctgatgtttgagggaacacggggtagcactgcctacctggacatcgccctggatgccctctctatccgccggggctcctgtaatcgcgtctgtatgatgcaaacatgcagctttgacattccaaatgacctctgtgactggacctggatcccaactgcctccggggccaagtggactcagaagaaagggtcatcaggaaagccaggcgtggggcctgatggcgacttctctagccctggtagtggctgctacatgctcctggaccccaagaatgcaagacctgggcagaaagctgtcctcctgagccccgtgagcctgtcctctggctgtctgagcttttccttccactacatcctccggggccagtctcctggtgcagccctccacatttatgcttcagtcttggggagtatccggaaacacactctcttctcaggacaacctgggcccaactggcaggctgtttctgtcaattacacagccgtgggacggatacagtttgccgtggtaggcgtttttggaaagaccccagagccagctgtggcagttgatgcaaccagcattgctccttgtggggagggttttcctcagtgtgactttgaagacaacgcccatcccttctgtgactgggtccagacttccggggatggtggacactgggccctcggacataaaaatggacccgtccatggcatgggccctgcgggaggtttccctaatgcagggggtcactatatctaccttgaggctgacgagttctcccaggcaggccagtcagtcagactggtgagccggcccttctgcgccccaggtgacatctgcgtggagttcgcataccacatgtatggccttggggagggtactatgctcgaactcctcctgggaagtcctgcggggagtcccccgattcctctctggaaacgcgtggggtctcagcgcccttactggcagaacacctccgtcaccgtcccctcaggacaccaacagcccatgcagcttattttcaagggcatccagggaagcaacacggcctctgtggttgctatgggtttcatcttgatcaatcctgggacttgtccagtaaaagtgctaccagagcttcctcccgtatctccagtttcttccactggcccttctgaaaccactggcctcacagaaaaccctacaatctccaccaagaaacctacagtttccatagaaaaacccagtgtcaccacagaaaagcccacagtccccaaagaaaagcccaccattcccacagaaaaacccaccatctccacagaaaaacccaccattccttcagaaaaacccaacatgccctcagaaaaacccaccattccctcagaaaaacccaccatcctcacagaaaaacccaccattccctcagaaaaacccaccattccctcagaaaaacccaccatttccacagaaaaacccaccgtccccacagaagagcccaccacccccactgaggagaccaccacctccatggaagagcctgtcatccctacagaaaaacccagcatccctacagaaaaacccagcatccccacggaaaaacccaccatctccatggaagagactatcatctccacagaaaaacccaccatctccccagaaaaacccaccatccccacagaaaaacccaccatccccacagaaaaatccaccatctccccagaaaaacccaccacccccacagaaaaacccaccatccccacagaaaaacccaccatctccccagaaaaacccaccacccccacagaaaaacccaccatctccccagaaaaactcaccatccccacagaaaaacccaccatccccacagaaaaacccaccattcccacagaaaaacccaccatctccacagaagagcccaccacccccactgaggagaccaccatctccacagaaaaacccagcatccccatggaaaaacccactctccccactgaagaaaccaccacctctgttgaagagactaccatctctacagaaaaactcaccatccccatggaaaaacccaccatctccacagaaaaacccaccatccccacagaaaaacccaccatctccccagaaaaactcaccatccccacggaaaaactcaccatccccacggaaaaacccaccatccccattgaagagactaccatctccacagaaaaactcaccatccccacagaaaaacccaccatctccccagaaaaacccaccatctccacggaaaaacccaccatccccacggaaaaacccaccatccccactgaagagactaccatctccacagaaaaactcaccatccccacagaaaaacccaccatctccccagaaaaactcaccatccccacagaaaaacccaccatctccacggaaaaacccaccatccccacggaaaaacttaccatccccacggaaaaacccaccatccccacagaaaaacccaccattcccacagagaagctcacagccctgaggccaccccatcccagccccacagccactgggctggcagccttggtgatgtctccacatgctccaagtacccctatgaccagtgtgattctgggcactaccacaacctccagatccagtacagagcgctgccctccaaatgcccgctacgaatcctgtgcttgtcctgcttcgtgcaagagccccaggcctagctgtgggcccctctgtcgggagggctgtgtctgcaaccctggctttttgtttagtgacaaccactgcatccaggcctcttcctgcaattgcttctacaacaacgactactatgagcctggggcagagtggttcagccccaactgcacagaacattgccgctgctggcccggcagtcgggtcgagtgccagatctctcagtgtgggacacacaccgtgtgccagcttaagaatggccagtatggatgccacccctacgcaggcactgccacctgcttggtctacggagaccctcattatgtcacctttgacgggaggcactttggcttcatgggcaagtgcacttacatcttggcccagccctgtggcaactcaacagacccattcttcagggtgacagccaagaatgaggagcagggacaggaaggcgtgtcctgcctgagcaaagtctacgtgaccctgcccgagagcaccgtcaccctgcttaagggcagacgcactctggttgggggtcagcaagttactctcccagccataccctctaaaggcgtcttcctgggtgcaagcgggcggtttgtggagctgcagacggagttcggtttgcgggtgagatgggatggtgaccagcagctgtatgttactgtgtccagcacatactctggcaaactctgtggtttgtgtgggaactatgacggcaacagtgacaatgaccacctgaagttggacggcagcccagcaggagacaaggaggagctggggaacagctggcagacggaccaggacgaggaccaggagtgtcagaagtaccaggtggtgaattccccgtcttgtgattcatctctgcagagcagcatgtcggggccagggttctgtggacggctggtcgacactcatggcccatttgagacatgcctgctgcacgtgaaggccgcttccttcttcgacagctgcatgcttgatatgtgcggattccaggggctgcagcacctgctgtgcacacacatgtccaccatgaccaccacctgccaggacgcaggccacgctgtgaagccctggagggaaccccacttctgcccaatggcctgcccgcccaacagcaagtactccctgtgtgcgaagccatgccctgacacctgccattcaggattctccggcatgttctgctcagaccggtgcgtggaggcctgtgaatgcaatccgggcttcgtcctcagtggcctcgagtgcatacctcgctcccagtgtgggtgcctccaccctgcaggcagctacttcaaggtaggggagcggtggtacaagccaggctgcaaagagttgtgcgtctgtgaaagcaacaacagaattcgctgccagccctggaggtgtagggcccaggagttctgtggccaacaggatggtatctatggctgccatgcccaaggtgccgccacctgcacagcctcgggtgacccccactacctgaccttcgatggcgccttgcaccacttcatgggcacctgcacctatgtcctgacccggccttgctggtccaggtcccaagacagctattttgttgtgagcgccaccaacgagaaccgcggggggatcctggaggtctcctacatcaaagccgtccacgtgacagtctttgacctcagcatctcactgctcagaggctgtaaggtcatgctgaatggccatcgggtggccctacctgtgtggcttgcacaaggccgggtgaccataaggctcagcagcaacctcgtcctcctctacacgaactttgggctccaagttcgctacgacgggagccacttggtggaagtgacagtcccctcctcctatggcggccagctctgtgggctgtgtgggaactacaacaacaacagcttggatgacaacctgcgccccgacagaaagcttgcaggcgattccatgcagctgggggccgcctggaagttacctgaatcctctgaacctggctgtttccttgtgggtggcaagccctccagctgccaggagaacagcatggcagacgcctggaacaagaactgtgcgatcttaataaaccctcagggacccttctctcaatgtcaccaggtggtgcctccccagtccagctttgccagttgcgtgcatggtcagtgtgggaccaagggcgacaccacagccctgtgccgctccctgcaggcctacgcgtccctgtgtgcccaggctggccaggcccctgcctggcggaacagaaccttctgccctatgaggtgcccacctggcagcagctacagcccctgcagcagcccctgcccagacacctgcagcagcataaacaacccgagggactgccccaaagcactgccctgtgctgagagctgtgaatgtcagaaaggccacatcttgagtggaacctcctgcgtgccccttggccagtgtggctgcactgacccagcgggctcctaccacccggtcggggagcgctggtacacagagaacacctgcaccaggctctgcacctgctccgtccacaacaacatcacctgcttccagagcacctgcaaacccaaccagatatgctgggccctggatgggctgctccgttgtcgggcctcaggtgtgggagtgtgtcagctcccaggggagtcccactacgtgagctttgatggtagtaaccattctatcccggacgcctgcactcttgtcctggtgaaagtgtgccaccccgccatggccttgcccttcttcaagatcagtgccaagcatgagaaggaggaaggtggaactgaggctttccgccttcatgaggtctacattgacatctacgatgcccaggtcaccctgcagaagggccaccgtgtgctaatcaacagcaaacaggtcaccctccccgccatctcccagatccctggggtcagtgtcaagtccagcagcatctacagcattgttaacatcaagatcggggtgcaagtcaagtttgacgggaatcatctcttagagattgaaatccccacaacctactatggaaaggtctgcggcatgtgtgggaacttcaatgatgaggaagaggacgaactaatgatgcccagcgatgaagtagcaaatagtgacagtgaatttgtgaacagttggaaagataaggacattgacccaagttgtcagagtctcctggtagatgagcagcagattccagcggaacagcaggagaacccgagtggaaactgcagggcggccgacctccgcagggcgcgggaaaagtgcgaggcagcgctccgggctcctgtgtgggcccagtgcgcctcccgcatagacctcacgcccttcctggtggactgtgcaaacaccctctgtgagttcggaggtctctaccaggccctctgccaggctctgcaagccttcggggccacctgccagagccaggggctcaagcccccactctggagaaacagcagcttctgccctctggaatgccctgcctacagcagctacaccaactgccttccctcctgctcaccctcctgctgggacctggatggccggtgtgagggcgccaaagtcccctctgcctgcgctgagggctgcatttgtcagcccggctatgtgctgagtgaagacaagtgtgtccccagaagtcagtgtggctgcaaggatgcccatggtggctccatccctctgggcaagagctgggtctccagcggttgcacggagaagtgtgtctgcacgggaggagccattcagtgcggggacttccgatgcccctctgggtcccactgccagctcacttccgacaacagcaacagcaattgtgtctcagacaagtctgaacaatgctcagtctatggcgacccccgttacctcacatttgacggcttcagctaccgcttgcaaggccgcatgacctatgttctgatcaagactgtggacgtactgcctgagggggtggagcccctcctcgtggaaggacgcaacaagatggatccgcccaggagctccatcttcttgcaggaagtgattaccaccgtctacggctataaagtgcagctccaagctggtctggagcttgtggtcaacaaccagaagatggccgtcccctacaggccaaatgaacacctgcgggtcaccctgtggggccaacggctctacctggtcaccgactttgagctggtcgtcagctttggtggaaggaaaaatgcagtgatctccctacccagcatgtacgaggggcttgtgagtggcctgtgcggaaactacgacaagaaccgcaagaatgacatgatgctgcccagtggcgccctgacccagaacctcaacacctttggcaacagctgggaggtgaagaccgaggacgcactcctgcgcttccccagggctataccagcggaggaggagggacaaggggcggagctgggcctccgcacgggcctccaagtgtccgaatgtagcccggagcagctggcgagcaacagcacccaggcctgtagggtgctggcagacccccagggcccctttgctgcctgtcaccagacggtggccccagagcccttccaagagcactgcgtgctggatctgtgctctgctcaggacccaagagagcaagaggagctgcgttgccaggtcctcagtggctgggcagcagctttctgactgaggactgctctcagcggtgcacctgtgccagctcacggatcctgctgtgtgagcccttcagctgcagagcgggggaggtctgcaccctggggaaccacacccaaggctgctttccagaaagcccgtgtctgcagaacccctgtcagaatgacgggcagtgtcgggagcagggagccaccttcacctgcgagtgtgaagttggttacgggggaggcctgtgtatggagcctcgagatgcgccacctcccagaaagccagcatctaacctggtggccgtcctactgggactgctggtgcctgtggtggtcgtactactggccgtgaccagagagtgcatttacagaacgaggaggaagagagagaaaacgcaggagggagacagactggccaggctggtggacacagatactgttctggactgtgcctgttaagttgctcagttttgagctgtcttcagacaagaagattaaataaatttatatatttatttatttg

SEQ ID NO: 86626 - DNA, 8834 bp, Homo sapiens
gccatgttgatttctgatccttgagcttttctgtgcttctctgttcattcttcatggcatccttggaaggatgccaagctaaggaggccaggggggaataaaaggagtccaggctcccaactgtgcccttcccctctcccctgggagcaaccacttagggtcctcatggttcctccagtctggactctgctgcttctggtgggggctgcccttttcaggaaagagaagcctccggaccagaagctggttgttcgcagctctagggacaactatgtcctcacccagtgtgattttgaggatgacgccaaacccctctgtgactggtcccaagtgtccgcagacgatgaagactgggttcgagccagtgggccctctcccaccggctccaccggggcccccggggggtaccctaacggagagggcagctatctgcatatggaatcgaacagcttccaccgtgggggagtggcccgcctgctcagccccgacctatgggagcaaggccccctctgtgtgcactttgcccaccacatgttcgggctgtcttggggcgcccagctcaggctgctgctgctctcgggtgaagagggccgccgccccgatgtgctctggaaacactggaacacccagagaccctcctggatgctcaccaccgtcactgtgcccgcagggttcaccctgcccacccggctgatgtttgagggaacacggggtagcactgcctacctggacatcgccctggatgccctctctatccgccggggctcctgtaatcgcgtctgtatgatgcaaacatgcagctttgacattccaaatgacctctgtgactggacctggatcccaactgcctccggggccaagtggactcagaagaaagggtcatcaggaaagccaggcgtggggcctgatggcgacttctctagccctggtagtggctgctacatgctcctggaccccaagaatgcaagacctgggcagaaagctgtcctcctgagccccgtgagcctgtcctctggctgtctgagcttttccttccactacatcctccggggccagtctcctggtgcagccctccacatttatgcttcagtcttggggagtatccggaaacacactctcttctcaggacaacctgggcccaactggcaggctgtttctgtcaattacacagccgtgggacggatacagtttgccgtggtaggcgtttttggaaagaccccagagccagctgtggcagttgatgcaaccagcattgctccttgtggggagggttttcctcagtgtgactttgaagacaacgcccatcccttctgtgactgggtccagacttccggggatggtggacactgggccctcggacataaaaatggacccgtccatggcatgggccctgcgggaggtttccctaatgcagggggtcactatatctaccttgaggctgacgagttctcccaggcaggccagtcagtcagactggtgagccggcccttctgcgccccaggtgacatctgcgtggagttcgcataccacatgtatggccttggggagggtactatgctcgaactcctcctgggaagtcctgcggggagtcccccgattcctctctggaaacgcgtggggtctcagcgcccttactggcagaacacctccgtcaccgtcccctcaggacaccaacagcccatgcagcttattttcaagggcatccagggaagcaacacggcctctgtggttgctatgggtttcatcttgatcaatcctgggacttgtccagtaaaagtgctaccagagcttcctcccgtatctccagtttcttccactggcccttctgaaaccactggcctcacagaaaaccctacaatctccaccaagaaacctacagtttccatagaaaaacccagtgtcaccacagaaaagcccacagtccccaaagaaaagcccaccattcccacagaaaaacccaccatctccacagaaaaacccaccattccttcagaaaaacccaacatgccctcagaaaaacccaccattccctcagaaaaacccaccatcctcacagaaaaacccaccattccctcagaaaaacccaccattccctcagaaaaacccaccatttccacagaaaaacccaccgtccccacagaagagcccaccacccccactgaggagaccaccacctccatggaagagcctgtcatccctacagaaaaacccagcatccctacagaaaaacccagcatccccacggaaaaacccaccatctccatggaagagactatcatctccacagaaaaacccaccatctccccagaaaaacccaccatccccacagaaaaacccaccatccccacagaaaaatccaccatctccccagaaaaacccaccacccccacagaaaaacccaccatccccacagaaaaacccaccatctccccagaaaaacccaccacccccacagaaaaacccaccatctccccagaaaaactcaccatccccacagaaaaacccaccatccccacagaaaaacccaccattcccacagaaaaacccaccatctccacagaagagcccaccacccccactgaggagaccaccatctccacagaaaaacccagcatccccatggaaaaacccactctccccactgaagaaaccaccacctctgttgaagagactaccatctctacagaaaaactcaccatccccatggaaaaacccaccatctccacagaaaaacccaccatccccacagaaaaacccaccatctccccagaaaaactcaccatccccacggaaaaactcaccatccccacggaaaaacccaccatccccattgaagagactaccatctccacagaaaaactcaccatccccacagaaaaacccaccatctccccagaaaaacccaccatctccacggaaaaacccaccatccccacggaaaaacccaccatccccactgaagagactaccatctccacagaaaaactcaccatccccacagaaaaacccaccatctccccagaaaaactcaccatccccacagaaaaacccaccatctccacggaaaaacccaccatccccacggaaaaacttaccatccccacggaaaaacccaccatccccacagaaaaacccaccattcccacagagaagctcacagccctgaggccaccccatcccagccccacagccactgggctggcagccttggtgatgtctccacatgctccaagtacccctatgaccagtgtgattctgggcactaccacaacctccagatccagtacagagcgctgccctccaaatgcccgctacgaatcctgtgcttgtcctgcttcgtgcaagagccccaggcctagctgtgggcccctctgtcgggagggctgtgtctgcaaccctggctttttgtttagtgacaaccactgcatccaggcctcttcctgcaattgcttctacaacaacgactactatgagcctggggcagagtggttcagccccaactgcacagaacattgccgctgctggcccggcagtcgggtcgagtgccagatctctcagtgtgggacacacaccgtgtgccagcttaagaatggccagtatggatgccacccctacgcaggcactgccacctgcttggtctacggagaccctcattatgtcacctttgacgggaggcactttggcttcatgggcaagtgcacttacatcttggcccagccctgtggcaactcaacagacccattcttcagggtgacagccaagaatgaggagcagggacaggaaggcgtgtcctgcctgagcaaagtctacgtgaccctgcccgagagcaccgtcaccctgcttaagggcagacgcactctggttgggggtcagcaagttactctcccagccataccctctaaaggcgtcttcctgggtgcaagcgggcggtttgtggagctgcagacggagttcggtttgcgggtgagatgggatggtgaccagcagctgtatgttactgtgtccagcacatactctggcaaactctgtggtttgtgtgggaactatgacggcaacagtgacaatgaccacctgaagttggacggcagcccagcaggagacaaggaggagctggggaacagctggcagacggaccaggacgaggaccaggagtgtcagaagtaccaggtggtgaattccccgtcttgtgattcatctctgcagagcagcatgtcggggccagggttctgtggacggctggtcgacactcatggcccatttgagacatgcctgctgcacgtgaaggccgcttccttcttcgacagctgcatgcttgatatgtgcggattccaggggctgcagcacctgctgtgcacacacatgtccaccatgaccaccacctgccaggacgcaggccacgctgtgaagccctggagggaaccccacttctgcccaatggcctgcccgcccaacagcaagtactccctgtgtgcgaagccatgccctgacacctgccattcaggattctccggcatgttctgctcagaccggtgcgtggaggcctgtgaatgcaatccgggcttcgtcctcagtggcctcgagtgcatacctcgctcccagtgtgggtgcctccaccctgcaggcagctacttcaaggtaggggagcggtggtacaagccaggctgcaaagagttgtgcgtctgtgaaagcaacaacagaattcgctgccagccctggaggtgtagggcccaggagttctgtggccaacaggatggtatctatggctgccatgcccaaggtgccgccacctgcacagcctcgggtgacccccactacctgaccttcgatggcgccttgcaccacttcatgggcacctgcacctatgtcctgacccggccttgctggtccaggtcccaagacagctattttgttgtgagcgccaccaacgagaaccgcggggggatcctggaggtctcctacatcaaagccgtccacgtgacagtctttgacctcagcatctcactgctcagaggctgtaaggtcatgctgaatggccatcgggtggccctacctgtgtggcttgcacaaggccgggtgaccataaggctcagcagcaacctcgtcctcctctacacgaactttgggctccaagttcgctacgacgggagccacttggtggaagtgacagtcccctcctcctatggcggccagctctgtgggctgtgtgggaactacaacaacaacagcttggatgacaacctgcgccccgacagaaagcttgcaggcgattccatgcagctgggggccgcctggaagttacctgaatcctctgaacctggctgtttccttgtgggtggcaagccctccagctgccaggagaacagcatggcagacgcctggaacaagaactgtgcgatcttaataaaccctcagggacccttctctcaatgtcaccaggtggtgcctccccagtccagctttgccagttgcgtgcatggtcagtgtgggaccaagggcgacaccacagccctgtgccgctccctgcaggcctacgcgtccctgtgtgcccaggctggccaggcccctgcctggcggaacagaaccttctgccctatgaggtgcccacctggcagcagctacagcccctgcagcagcccctgcccagacacctgcagcagcataaacaacccgagggactgccccaaagcactgccctgtgctgagagctgtgaatgtcagaaaggccacatcttgagtggaacctcctgcgtgccccttggccagtgtggctgcactgacccagcgggctcctaccacccggtcggggagcgctggtacacagagaacacctgcaccaggctctgcacctgctccgtccacaacaacatcacctgcttccagagcacctgcaaacccaaccagatatgctgggccctggatgggctgctccgttgtcgggcctcaggtgtgggagtgtgtcagctcccaggggagtcccactacgtgagctttgatggtagtaaccattctatcccggacgcctgcactcttgtcctggtgaaagtgtgccaccccgccatggccttgcccttcttcaagatcagtgccaagcatgagaaggaggaaggtggaactgaggctttccgccttcatgaggtctacattgacatctacgatgcccaggtcaccctgcagaagggccaccgtgtgctaatcaacagcaaacaggtcaccctccccgccatctcccagatccctggggtcagtgtcaagtccagcagcatctacagcattgttaacatcaagatcggggtgcaagtcaagtttgacgggaatcatctcttagagattgaaatccccacaacctactatggaaaggtctgcggcatgtgtgggaacttcaatgatgaggaagaggacgaactaatgatgcccagcgatgaagtagcaaatagtgacagtgaatttgtgaacagttggaaagataaggacattgacccaagttgtcagagtctcctggtagatgagcagcagattccagcggaacagcaggagaacccgagtggaaactgcagggcggccgacctccgcagggcgcgggaaaagtgcgaggcagcgctccgggctcctgtgtgggcccagtgcgcctcccgcatagacctcacgcccttcctggtggactgtgcaaacaccctctgtgagttcggaggtctctaccaggccctctgccaggctctgcaagccttcggggccacctgccagagccaggggctcaagcccccactctggagaaacagcagcttctgccctctggaatgccctgcctacagcagctacaccaactgccttccctcctgctcaccctcctgctgggacctggatggccggtgtgagggcgccaaagtcccctctgcctgcgctgagggctgcatttgtcagcccggctatgtgctgagtgaagacaagtgtgtccccagaagtcagtgtggctgcaaggatgcccatggtggctccatccctctgggcaagagctgggtctccagcggttgcacggagaagtgtgtctgcacgggaggagccattcagtgcggggacttccgatgcccctctgggtcccactgccagctcacttccgacaacagcaacagcaattgtgtctcagacaagtctgaacaatgctcagtctatggcgacccccgttacctcacatttgacggcttcagctaccgcttgcaaggccgcatgacctatgttctgatcaagactgtggacgtactgcctgagggggtggagcccctcctcgtggaaggacgcaacaagatggatccgcccaggagctccatcttcttgcaggaagtgattaccaccgtctacggctataaagtgcagctccaagctggtctggagcttgtggtcaacaaccagaagatggccgtcccctacaggccaaatgaacacctgcgggtcaccctgtggggccaacggctctacctggtcaccgactttgagctggtcgtcagctttggtggaaggaaaaatgcagtgatctccctacccagcatgtacgaggggcttgtgagtggcctgtgcggaaactacgacaagaaccgcaagaatgacatgatgctgcccagtggcgccctgacccagaacctcaacacctttggcaacagctgggaggtgaagaccgaggacgcactcctgcgcttccccagggctataccagcggaggaggagggacaaggggcggagctgggcctccgcacgggcctccaagtgtccgaatgtagcccggagcagctggcgagcaacagcacccaggcctgtagggtgctggcagacccccagggcccctttgctgcctgtcaccagacggtggccccagagcccttccaagagcactgcgtgctggatctgtgctctgctcaggacccaagagagcaagaggagctgcgttgccaggtcctcagtgggtacgccatcctctgccaggaggcgggcgctgccctggctggctggcgggaccgcaccctctgcgccatggagtgtccagcaggtaccatatatcagagctgtatgacaccctgcccagcatcctgtgccaacctggcagaccccggggactgcgagggcccctgcgtggaaggctgcgccagcatcccaggctatgcctacagtggcacccagagcctcccctggctgactgtggctgcaccagcaatggcatctactaccaggtccgagctggcagcaggaggccctggggagcagaggcgccaaggagagccagaccagggatggaactggaacgtctcctcctggcccttcccctttctagctgggcagcagctttctgactgaggactgctctcagcggtgcacctgtgccagctcacggatcctgctgtgtgagcccttcagctgcagagcgggggaggtctgcaccctggggaaccacacccaaggctgctttccagaaagcccgtgtctgcagaacccctgtcagaatgacgggcagtgtcgggagcagggagccaccttcacctgcgagtgtgaagttggttacgggggaggcctgtgtatggagcctcgagatgcgccacctcccagaaagccagcatctaacctggtggccgtcctactgggactgctggtgcctgtggtggtcgtactactggccgtgaccagagagtgcatttacagaacgaggaggaagagagagaaaacgcaggagggagacagactggccaggctggtggacacagatactgttctggactgtgcctgttaagttgctcagttttgagctgtcttcagacaagaagattaaataaatttatatatttatttatttg

SEQ ID NO: 86627 - DNA, 8534 bp, Homo sapiens
gccatgttgatttctgatccttgagcttttctgtgcttctctgttcattcttcatggcatccttggaaggatgccaagctaaggaggccaggggggaataaaaggagtccaggctcccaactgtgcccttcccctctcccctgggagcaaccacttagggtcctcatggttcctccagtctggactctgctgcttctggtgggggctgcccttttcaggaaagagaagcctccggaccagaagctggttgttcgcagctctagggacaactatgtcctcacccagtgtgattttgaggatgacgccaaacccctctgtgactggtcccaagtgtccgcagacgatgaagactgggttcgagccagtgggccctctcccaccggctccaccggggcccccggggggtaccctaacggagagggcagctatctgcatatggaatcgaacagcttccaccgtgggggagtggcccgcctgctcagccccgacctatgggagcaaggccccctctgtgtgcactttgcccaccacatgttcgggctgtcttggggcgcccagctcaggctgctgctgctctcgggtgaagagggccgccgccccgatgtgctctggaaacactggaacacccagagaccctcctggatgctcaccaccgtcactgtgcccgcagggttcaccctgcccacccggctgatgtttgagggaacacggggtagcactgcctacctggacatcgccctggatgccctctctatccgccggggctcctgtaatcgcgtctgtatgatgcaaacatgcagctttgacattccaaatgacctctgtgactggacctggatcccaactgcctccggggccaagtggactcagaagaaagggtcatcaggaaagccaggcgtggggcctgatggcgacttctctagccctggtagtggctgctacatgctcctggaccccaagaatgcaagacctgggcagaaagctgtcctcctgagccccgtgagcctgtcctctggctgtctgagcttttccttccactacatcctccggggccagtctcctggtgcagccctccacatttatgcttcagtcttggggagtatccggaaacacactctcttctcaggacaacctgggcccaactggcaggctgtttctgtcaattacacagccgtgggacggatacagtttgccgtggtaggcgtttttggaaagaccccagagccagctgtggcagttgatgcaaccagcattgctccttgtggggagggttttcctcagtgtgactttgaagacaacgcccatcccttctgtgactgggtccagacttccggggatggtggacactgggccctcggacataaaaatggacccgtccatggcatgggccctgcgggaggtttccctaatgcagggggtcactatatctaccttgaggctgacgagttctcccaggcaggccagtcagtcagactggtgagccggcccttctgcgccccaggtgacatctgcgtggagttcgcataccacatgtatggccttggggagggtactatgctcgaactcctcctgggaagtcctgcggggagtcccccgattcctctctggaaacgcgtggggtctcagcgcccttactggcagaacacctccgtcaccgtcccctcaggacaccaacagcccatgcagcttattttcaagggcatccagggaagcaacacggcctctgtggttgctatgggtttcatcttgatcaatcctgggacttgtccagtaaaagtgctaccagagcttcctcccgtatctccagtttcttccactggcccttctgaaaccactggcctcacagaaaaccctacaatctccaccaagaaacctacagtttccatagaaaaacccagtgtcaccacagaaaagcccacagtccccaaagaaaagcccaccattcccacagaaaaacccaccatctccacagaaaaacccaccattccttcagaaaaacccaacatgccctcagaaaaacccaccattccctcagaaaaacccaccatcctcacagaaaaacccaccattccctcagaaaaacccaccattccctcagaaaaacccaccatttccacagaaaaacccaccgtccccacagaagagcccaccacccccactgaggagaccaccacctccatggaagagcctgtcatccctacagaaaaacccagcatccctacagaaaaacccagcatccccacggaaaaacccaccatctccatggaagagactatcatctccacagaaaaacccaccatctccccagaaaaacccaccatccccacagaaaaacccaccatccccacagaaaaatccaccatctccccagaaaaacccaccacccccacagaaaaacccaccatccccacagaaaaacccaccatctccccagaaaaacccaccacccccacagaaaaacccaccatctccccagaaaaactcaccatccccacagaaaaacccaccatccccacagaaaaacccaccattcccacagaaaaacccaccatctccacagaagagcccaccacccccactgaggagaccaccatctccacagaaaaacccagcatccccatggaaaaacccactctccccactgaagaaaccaccacctctgttgaagagactaccatctctacagaaaaactcaccatccccatggaaaaacccaccatctccacagaaaaacccaccatccccacagaaaaacccaccatctccccagaaaaactcaccatccccacggaaaaactcaccatccccacggaaaaacccaccatccccattgaagagactaccatctccacagaaaaactcaccatccccacagaaaaacccaccatctccccagaaaaacccaccatctccacggaaaaacccaccatccccacggaaaaacccaccatccccactgaagagactaccatctccacagaaaaactcaccatccccacagaaaaacccaccatctccccagaaaaactcaccatccccacagaaaaacccaccatctccacggaaaaacccaccatccccacggaaaaacttaccatccccacggaaaaacccaccatccccacagaaaaacccaccattcccacagagaagctcacagccctgaggccaccccatcccagccccacagccactgggctggcagccttggtgatgtctccacatgctccaagtacccctatgaccagtgtgattctgggcactaccacaacctccagatccagtacagagcgctgccctccaaatgcccgctacgaatcctgtgcttgtcctgcttcgtgcaagagccccaggcctagctgtgggcccctctgtcgggagggctgtgtctgcaaccctggctttttgtttagtgacaaccactgcatccaggcctcttcctgcaattgcttctacaacaacgactactatgagcctggggcagagtggttcagccccaactgcacagaacattgccgctgctggcccggcagtcgggtcgagtgccagatctctcagtgtgggacacacaccgtgtgccagcttaagaatggccagtatggatgccacccctacgcaggcactgccacctgcttggtctacggagaccctcattatgtcacctttgacgggaggcactttggcttcatgggcaagtgcacttacatcttggcccagccctgtggcaactcaacagacccattcttcagggtgacagccaagaatgaggagcagggacaggaaggcgtgtcctgcctgagcaaagtctacgtgaccctgcccgagagcaccgtcaccctgcttaagggcagacgcactctggttgggggtcagcaagttactctcccagccataccctctaaaggcgtcttcctgggtgcaagcgggcggtttgtggagctgcagacggagttcggtttgcgggtgagatgggatggtgaccagcagctgtatgttactgtgtccagcacatactctggcaaactctgtggtttgtgtgggaactatgacggcaacagtgacaatgaccacctgaagttggacggcagcccagcaggagacaaggaggagctggggaacagctggcagacggaccaggacgaggaccaggagtgtcagaagtaccaggtggtgaattccccgtcttgtgattcatctctgcagagcagcatgtcggggccagggttctgtggacggctggtcgacactcatggcccatttgagacatgcctgctgcacgtgaaggccgcttccttcttcgacagctgcatgcttgatatgtgcggattccaggggctgcagcacctgctgtgcacacacatgtccaccatgaccaccacctgccaggacgcaggccacgctgtgaagccctggagggaaccccacttctgcccaatggcctgcccgcccaacagcaagtactccctgtgtgcgaagccatgccctgacacctgccattcaggattctccggcatgttctgctcagaccggtgcgtggaggcctgtgaatgcaatccgggcttcgtcctcagtggcctcgagtgcatacctcgctcccagtgtgggtgcctccaccctgcaggcagctacttcaaggtaggggagcggtggtacaagccaggctgcaaagagttgtgcgtctgtgaaagcaacaacagaattcgctgccagccctggaggtgtagggcccaggagttctgtggccaacaggatggtatctatggctgccatgcccaaggtgccgccacctgcacagcctcgggtgacccccactacctgaccttcgatggcgccttgcaccacttcatgggcacctgcacctatgtcctgacccggccttgctggtccaggtcccaagacagctattttgttgtgagcgccaccaacgagaaccgcggggggatcctggaggtctcctacatcaaagccgtccacgtgacagtctttgacctcagcatctcactgctcagaggctgtaaggtcatgctgaatggccatcgggtggccctacctgtgtggcttgcacaaggccgggtgaccataaggctcagcagcaacctcgtcctcctctacacgaactttgggctccaagttcgctacgacgggagccacttggtggaagtgacagtcccctcctcctatggcggccagctctgtgggctgtgtgggaactacaacaacaacagcttggatgacaacctgcgccccgacagaaagcttgcaggcgattccatgcagctgggggccgcctggaagttacctgaatcctctgaacctggctgtttccttgtgggtggcaagccctccagctgccaggagaacagcatggcagacgcctggaacaagaactgtgcgatcttaataaaccctcagggacccttctctcaatgtcaccaggtggtgcctccccagtccagctttgccagttgcgtgcatggtcagtgtgggaccaagggcgacaccacagccctgtgccgctccctgcaggcctacgcgtccctgtgtgcccaggctggccaggcccctgcctggcggaacagaaccttctgccctatgaggtgcccacctggcagcagctacagcccctgcagcagcccctgcccagacacctgcagcagcataaacaacccgagggactgccccaaagcactgccctgtgctgagagctgtgaatgtcagaaaggccacatcttgagtggaacctcctgcgtgccccttggccagtgtggctgcactgacccagcgggctcctaccacccggtcggggagcgctggtacacagagaacacctgcaccaggctctgcacctgctccgtccacaacaacatcacctgcttccagagcacctgcaaacccaaccagatatgctgggccctggatgggctgctccgttgtcgggcctcaggtgtgggagtgtgtcagctcccaggggagtcccactacgtgagctttgatggtagtaaccattctatcccggacgcctgcactcttgtcctggtgaaagtgtgccaccccgccatggccttgcccttcttcaagatcagtgccaagcatgagaaggaggaaggtggaactgaggctttccgccttcatgaggtctacattgacatctacgatgcccaggtcaccctgcagaagggccaccgtgtgctaatcaacagcaaacaggtcaccctccccgccatctcccagatccctggggtcagtgtcaagtccagcagcatctacagcattgttaacatcaagatcggggtgcaagtcaagtttgacgggaatcatctcttagagattgaaatccccacaacctactatggaaaggtctgcggcatgtgtgggaacttcaatgatgaggaagaggacgaactaatgatgcccagcgatgaagtagcaaatagtgacagtgaatttgtgaacagttggaaagataaggacattgacccaagttgtcagagtctcctggtagatgagcagcagattccagcggaacagcaggagaacccgagtggaaactgcagggcggccgacctccgcagggcgcgggaaaagtgcgaggcagcgctccgggctcctgtgtgggcccagtgcgcctcccgcatagacctcacgcccttcctggtggactgtgcaaacaccctctgtgagttcggaggtctctaccaggccctctgccaggctctgcaagccttcggggccacctgccagagccaggggctcaagcccccactctggagaaacagcagcttctgccctctggaatgccctgcctacagcagctacaccaactgccttccctcctgctcaccctcctgctgggacctggatggccggtgtgagggcgccaaagtcccctctgcctgcgctgagggctgcatttgtcagcccggctatgtgctgagtgaagacaagtgtgtccccagaagtcagtgtggctgcaaggatgcccatggtggctccatccctctgggcaagagctgggtctccagcggttgcacggagaagtgtgtctgcacgggaggagccattcagtgcggggacttccgatgcccctctgggtcccactgccagctcacttccgacaacagcaacagcaattgtgtctcagacaagtctgaacaatgctcagtctatggcgacccccgttacctcacatttgacggcttcagctaccgcttgcaaggccgcatgacctatgttctgatcaagactgtggacgtactgcctgagggggtggagcccctcctcgtggaaggacgcaacaagatggatccgcccaggagctccatcttcttgcaggaagtgattaccaccgtctacggctataaagtgcagctccaagctggtctggagcttgtggtcaacaaccagaagatggccgtcccctacaggccaaatgaacacctgcgggtcaccctgtggggccaacggctctacctggtcaccgactttgagctggtcgtcagctttggtggaaggaaaaatgcagtgatctccctacccagcatgtacgaggggcttgtgagtggcctgtgcggaaactacgacaagaaccgcaagaatgacatgatgctgcccagtggcgccctgacccagaacctcaacacctttggcaacagctgggaggtgaagaccgaggacgcactcctgcgcttccccagggctataccagcggaggaggagggacaaggggcggagctgggcctccgcacgggcctccaagtgtccgaatgtagcccggagcagctggcgagcaacagcacccaggcctgtagggtgctggcagacccccagggcccctttgctgcctgtcaccagacggtggccccagagcccttccaagagcactgcgtgctggatctgtgctctgctcaggacccaagagagcaagaggagctgcgttgccaggtcctcagtgggtacgccatcctctgccaggaggcgggcgctgccctggctggctggcgggaccgcaccctctgcgctgggcagcagctttctgactgaggactgctctcagcggtgcacctgtgccagctcacggatcctgctgtgtgagcccttcagctgcagagcgggggaggtctgcaccctggggaaccacacccaaggctgctttccagaaagcccgtgtctgcagaacccctgtcagaatgacgggcagtgtcgggagcagggagccaccttcacctgcgagtgtgaagttggttacgggggaggcctgtgtatggagcctcgagatgcgccacctcccagaaagccagcatctaacctggtggccgtcctactgggactgctggtgcctgtggtggtcgtactactggccgtgaccagagagtgcatttacagaacgaggaggaagagagagaaaacgcaggagggagacagactggccaggctggtggacacagatactgttctggactgtgcctgttaagttgctcagttttgagctgtcttcagacaagaagattaaataaatttatatatttatttatttg

SEQ ID NO: 86628 - DNA, 8395 bp, Homo sapiens
gccatgttgatttctgatccttgagcttttctgtgcttctctgttcattcttcatggcatccttggaaggatgccaagctaaggaggccaggggggaataaaaggagtccaggctcccaactgtgcccttcccctctcccctgggagcaaccacttagggtcctcatggttcctccagtctggactctgctgcttctggtgggggctgcccttttcaggaaagagaagcctccggaccagaagctggttgttcgcagctctagggacaactatgtcctcacccagtgtgattttgaggatgacgccaaacccctctgtgactggtcccaagtgtccgcagacgatgaagactgggttcgagccagtgggccctctcccaccggctccaccggggcccccggggggtaccctaacggagagggcagctatctgcatatggaatcgaacagcttccaccgtgggggagtggcccgcctgctcagccccgacctatgggagcaaggccccctctgtgtgcactttgcccaccacatgttcgggctgtcttggggcgcccagctcaggctgctgctgctctcgggtgaagagggccgccgccccgatgtgctctggaaacactggaacacccagagaccctcctggatgctcaccaccgtcactgtgcccgcagggttcaccctgcccacccggctgatgtttgagggaacacggggtagcactgcctacctggacatcgccctggatgccctctctatccgccggggctcctgtaatcgcgtctgtatgatgcaaacatgcagctttgacattccaaatgacctctgtgactggacctggatcccaactgcctccggggccaagtggactcagaagaaagggtcatcaggaaagccaggcgtggggcctgatggcgacttctctagccctggtagtggctgctacatgctcctggaccccaagaatgcaagacctgggcagaaagctgtcctcctgagccccgtgagcctgtcctctggctgtctgagcttttccttccactacatcctccggggccagtctcctggtgcagccctccacatttatgcttcagtcttggggagtatccggaaacacactctcttctcaggacaacctgggcccaactggcaggctgtttctgtcaattacacagccgtgggacggatacagtttgccgtggtaggcgtttttggaaagaccccagagccagctgtggcagttgatgcaaccagcattgctccttgtggggagggttttcctcagtgtgactttgaagacaacgcccatcccttctgtgactgggtccagacttccggggatggtggacactgggccctcggacataaaaatggacccgtccatggcatgggccctgcgggaggtttccctaatgcagggggtcactatatctaccttgaggctgacgagttctcccaggcaggccagtcagtcagactggtgagccggcccttctgcgccccaggtgacatctgcgtggagttcgcataccacatgtatggccttggggagggtactatgctcgaactcctcctgggaagtcctgcggggagtcccccgattcctctctggaaacgcgtggggtctcagcgcccttactggcagaacacctccgtcaccgtcccctcaggacaccaacagcccatgcagcttattttcaagggcatccagggaagcaacacggcctctgtggttgctatgggtttcatcttgatcaatcctgggacttgtccagtaaaagtgctaccagagcttcctcccgtatctccagtttcttccactggcccttctgaaaccactggcctcacagaaaaccctacaatctccaccaagaaacctacagtttccatagaaaaacccagtgtcaccacagaaaagcccacagtccccaaagaaaagcccaccattcccacagaaaaacccaccatctccacagaaaaacccaccattccttcagaaaaacccaacatgccctcagaaaaacccaccattccctcagaaaaacccaccatcctcacagaaaaacccaccattccctcagaaaaacccaccattccctcagaaaaacccaccatttccacagaaaaacccaccgtccccacagaagagcccaccacccccactgaggagaccaccacctccatggaagagcctgtcatccctacagaaaaacccagcatccctacagaaaaacccagcatccccacggaaaaacccaccatctccatggaagagactatcatctccacagaaaaacccaccatctccccagaaaaacccaccatccccacagaaaaacccaccatccccacagaaaaatccaccatctccccagaaaaacccaccacccccacagaaaaacccaccatccccacagaaaaacccaccatctccccagaaaaacccaccacccccacagaaaaacccaccatctccccagaaaaactcaccatccccacagaaaaacccaccatccccacagaaaaacccaccattcccacagaaaaacccaccatctccacagaagagcccaccacccccactgaggagaccaccatctccacagaaaaacccagcatccccatggaaaaacccactctccccactgaagaaaccaccacctctgttgaagagactaccatctctacagaaaaactcaccatccccatggaaaaacccaccatctccacagaaaaacccaccatccccacagaaaaacccaccatctccccagaaaaactcaccatccccacggaaaaactcaccatccccacggaaaaacccaccatccccattgaagagactaccatctccacagaaaaactcaccatccccacagaaaaacccaccatctccccagaaaaacccaccatctccacggaaaaacccaccatccccacggaaaaacccaccatccccactgaagagactaccatctccacagaaaaactcaccatccccacagaaaaacccaccatctccccagaaaaactcaccatccccacagaaaaacccaccatctccacggaaaaacccaccatccccacggaaaaacttaccatccccacggaaaaacccaccatccccacagaaaaacccaccattcccacagagaagctcacagccctgaggccaccccatcccagccccacagccactgggctggcagccttggtgatgtctccacatgctccaagtacccctatgaccagtgtgattctgggcactaccacaacctccagatccagtacagagcgctgccctccaaatgcccgctacgaatcctgtgcttgtcctgcttcgtgcaagagccccaggcctagctgtgggcccctctgtcgggagggctgtgtctgcaaccctggctttttgtttagtgacaaccactgcatccaggcctcttcctgcaattgcttctacaacaacgactactatgagcctggggcagagtggttcagccccaactgcacagaacattgccgctgctggcccggcagtcgggtcgagtgccagatctctcagtgtgggacacacaccgtgtgccagcttaagaatggccagtatggatgccacccctacgcaggcactgccacctgcttggtctacggagaccctcattatgtcacctttgacgggaggcactttggcttcatgggcaagtgcacttacatcttggcccagccctgtggcaactcaacagacccattcttcagggtgacagccaagaatgaggagcagggacaggaaggcgtgtcctgcctgagcaaagtctacgtgaccctgcccgagagcaccgtcaccctgcttaagggcagacgcactctggttgggggtcagcaagttactctcccagccataccctctaaaggcgtcttcctgggtgcaagcgggcggtttgtggagctgcagacggagttcggtttgcgggtgagatgggatggtgaccagcagctgtatgttactgtgtccagcacatactctggcaaactctgtggtttgtgtgggaactatgacggcaacagtgacaatgaccacctgaagttggacggcagcccagcaggagacaaggaggagctggggaacagctggcagacggaccaggacgaggaccaggagtgtcagaagtaccaggtggtgaattccccgtcttgtgattcatctctgcagagcagcatgtcggggccagggttctgtggacggctggtcgacactcatggcccatttgagacatgcctgctgcacgtgaaggccgcttccttcttcgacagctgcatgcttgatatgtgcggattccaggggctgcagcacctgctgtgcacacacatgtccaccatgaccaccacctgccaggacgcaggccacgctgtgaagccctggagggaaccccacttctgcccaatggcctgcccgcccaacagcaagtactccctgtgtgcgaagccatgccctgacacctgccattcaggattctccggcatgttctgctcagaccggtgcgtggaggcctgtgaatgcaatccgggcttcgtcctcagtggcctcgagtgcatacctcgctcccagtgtgggtgcctccaccctgcaggcagctacttcaaggtaggggagcggtggtacaagccaggctgcaaagagttgtgcgtctgtgaaagcaacaacagaattcgctgccagccctggaggtgtagggcccaggagttctgtggccaacaggatggtatctatggctgccatgcccaaggtgccgccacctgcacagcctcgggtgacccccactacctgaccttcgatggcgccttgcaccacttcatgggcacctgcacctatgtcctgacccggccttgctggtccaggtcccaagacagctattttgttgtgagcgccaccaacgagaaccgcggggggatcctggaggtctcctacatcaaagccgtccacgtgacagtctttgacctcagcatctcactgctcagaggctgtaaggtcatgctgaatggccatcgggtggccctacctgtgtggcttgcacaaggccgggtgaccataaggctcagcagcaacctcgtcctcctctacacgaactttgggctccaagttcgctacgacgggagccacttggtggaagtgacagtcccctcctcctatggcggccagctctgtgggctgtgtgggaactacaacaacaacagcttggatgacaacctgcgccccgacagaaagcttgcaggcgattccatgcagctgggggccgcctggaagttacctgaatcctctgaacctggctgtttccttgtgggtggcaagccctccagctgccaggagaacagcatggcagacgcctggaacaagaactgtgcgatcttaataaaccctcagggacccttctctcaatgtcaccaggtggtgcctccccagtccagctttgccagttgcgtgcatggtcagtgtgggaccaagggcgacaccacagccctgtgccgctccctgcaggcctacgcgtccctgtgtgcccaggctggccaggcccctgcctggcggaacagaaccttctgccctatgaggtgcccacctggcagcagctacagcccctgcagcagcccctgcccagacacctgcagcagcataaacaacccgagggactgccccaaagcactgccctgtgctgagagctgtgaatgtcagaaaggccacatcttgagtggaacctcctgcgtgccccttggccagtgtggctgcactgacccagcgggctcctaccacccggtcggggagcgctggtacacagagaacacctgcaccaggctctgcacctgctccgtccacaacaacatcacctgcttccagagcacctgcaaacccaaccagatatgctgggccctggatgggctgctccgttgtcgggcctcaggtgtgggagtgtgtcagctcccaggggagtcccactacgtgagctttgatggtagtaaccattctatcccggacgcctgcactcttgtcctggtgaaagtgtgccaccccgccatggccttgcccttcttcaagatcagtgccaagcatgagaaggaggaaggtggaactgaggctttccgccttcatgaggtctacattgacatctacgatgcccaggtcaccctgcagaagggccaccgtgtgctaatcaacagcaaacaggtcaccctccccgccatctcccagatccctggggtcagtgtcaagtccagcagcatctacagcattgttaacatcaagatcggggtgcaagtcaagtttgacgggaatcatctcttagagattgaaatccccacaacctactatggaaaggtctgcggcatgtgtgggaacttcaatgatgaggaagaggacgaactaatgatgcccagcgatgaagtagcaaatagtgacagtgaatttgtgaacagttggaaagataaggacattgacccaagttgtcagagtctcctggtagatgagcagcagattccagcggaacagcaggagaacccgagtggaaactgcagggcggccgacctccgcagggcgcgggaaaagtgcgaggcagcgctccgggctcctgtgtgggcccagtgcgcctcccgcatagacctcacgcccttcctggtggactgtgcaaacaccctctgtgagttcggaggtctctaccaggccctctgccaggctctgcaagccttcggggccacctgccagagccaggggctcaagcccccactctggagaaacagcagcttctgccctctggaatgccctgcctacagcagctacaccaactgccttccctcctgctcaccctcctgctgggacctggatggccggtgtgagggcgccaaagtcccctctgcctgcgctgagggctgcatttgtcagcccggctatgtgctgagtgaagacaagtgtgtccccagaagtcagtgtggctgcaaggatgcccatggtggctccatccctctgggcaagagctgggtctccagcggttgcacggagaagtgtgtctgcacgggaggagccattcagtgcggggacttccgatgcccctctgggtcccactgccagctcacttccgacaacagcaacagcaattgtgtctcagacaagtctgaacaatgctcagtctatggcgacccccgttacctcacatttgacggcttcagctaccgcttgcaaggccgcatgacctatgttctgatcaagactgtggacgtactgcctgagggggtggagcccctcctcgtggaaggacgcaacaagatggatccgcccaggagctccatcttcttgcaggaagtgattaccaccgtctacggctataaagtgcagctccaagctggtctggagcttgtggtcaacaaccagaagatggccgtcccctacaggccaaatgaacacctgcgggtcaccctgtggggccaacggctctacctggtcaccgactttgagctggtcgtcagctttggtggaaggaaaaatgcagtgatctccctacccagcatgtacgaggggcttgtgagtggcctgtgcggaaactacgacaagaaccgcaagaatgacatgatgctgcccagtggcgccctgacccagaacctcaacacctttggcaacagctgggaggtgaagaccgaggacgcactcctgcgcttccccagggctataccagcggaggaggagggacaaggggcggagctgggcctccgcacgggcctccaagtgtccgaatgtagcccggagcagctggcgagcaacagcacccaggcctgtagggtgctggcagacccccagggcccctttgctgcctgtcaccagacggtggccccagagcccttccaagagcactgcgtgctggatctgtgctctgctcaggacccaagagagcaagaggagctgcgttgccaggtcctcagtgggtacgccatcctctgccaggaggcgggcgctgccctggctggctggcgggaccgcaccctctgcgaaagcccgtgtctgcagaacccctgtcagaatgacgggcagtgtcgggagcagggagccaccttcacctgcgagtgtgaagttggttacgggggaggcctgtgtatggagcctcgagatgcgccacctcccagaaagccagcatctaacctggtggccgtcctactgggactgctggtgcctgtggtggtcgtactactggccgtgaccagagagtgcatttacagaacgaggaggaagagagagaaaacgcaggagggagacagactggccaggctggtggacacagatactgttctggactgtgcctgttaagttgctcagttttgagctgtcttcagacaagaagattaaataaatttatatatttatttatttg

SEQ ID NO: 86629 - DNA, 7352 bp, Homo sapiens
ttcatctgggcctctgattcatctttattccctccatcatctagacttgattttatttgtaccaaggagatgcgtgtctaatgtttttctttcttctatttctaggagggctgttggcctgctgctgtgctgctgaacagtatgcagtcctttcgggagcaaagcagttaccacggaaaccagcaaagctacccacaggaggtacacggctcatcccggctagaagagttcagccctcgtcaggcccagatgttccagaattttggaggtacaggtggcagtagtggcagcagtggcagtggcagtggtggtggacgacgaggagcagcagctgctgcggcagcgatggctagcgagacctctggccatcaaggttaccagggtttcaggaaagaggctggagatttttactacatggcaggcaacaaagaccccgtgactacaggaaccccacagcctcctcagcgaaggccttctgggcctgtgcagagctatggacccccccaggggagcagctttggcaatcagtatgggagtgagggtcatgtgggccagtttcaagcacagcactctggccttggcggtgtgtcacattatcagcaggattacactgggcctttctctccagggagtgctcagtaccaacagcaggcttccagccagcagcagcagcagcaagtccagcagttgagacaacagctttaccagtcccatcagcccctgccacaggccactggccaaccagcatccagctcatcccatctacagccaatgcagcggccctcaactctgccatcctctgctgctggttaccagttaagagtgggtcagtttggccaacactatcagtcttctgcttcctcctcctcctcctcctccttcccttcaccacagcgttttagccagtctggacagagctatgatggcagttacaatgtgaatgctggatctcagtatgaaggacacaatgtgggttctaatgcacaggcttatggaacacaatccaattacagctatcagcctcaatctatgaagaattttgaacaggcaaagattccacaagggacccaacaggggcagcagcagcagcaaccgcagcaacaacaacacccttctcagcatgtgatgcagtatactaacgctgccaccaagctgcccctgcaaagccaagtggggcagtacaaccagcctgaggttcctgtgaggtcccccatgcagtttcaccagaacttcagccccatttctaacccttctccagctgcctctgtggttcagtctccaagctgtagttctaccccatctcctctcatgcagactggggagaatctccagtgtgggcaaggcagtgtgcctatgggttccagaaacagaattttacagttaatgcctcaactcagtccaaccccatcaatgatgcccagtcctaattctcatgctgcaggcttcaaagggtttggactagaaggggtaccagaaaagcgactgacagatcctgggttgagtagtttgagtgctctgagtactcaagtggccaatcttcctaacactgtccagcacatgttactttctgatgccctgactcctcagaagaagacctccaagaggccctcatcttccaagaaagcagatagctgcacaaattctgaaggctcctcacaacctgaagaacagctgaagtcccctatggcagagtcattagatggaggctgctccagcagttcagaggatcaaggcgagagagtgcggcaactaagtggccagagcaccagctctgacaccacctacaagggtggagcctctgagaaagctggctcctcaccggcacaaggtgctcagaatgaaccccccagactcaatgctagtcctgccgcaagagaagaggccacctcaccaggcgctaaggacatgccattgtcatccgacgggaacccaaaggttaatgagaagactgttggggtgattgtctcccgggaagccatgacaggtcgggtagaaaagcctggtggacaagataaaggctcccaagaggatgatcctgcagccactcaaaggccacctagcaatggtggggcaaaggaaaccagtcatgcatcacttccccagccagagcctccaggaggaggagggagcaaaggaaacaagaatggcgataacaactccaaccataatggagaaggaaatggccagagtggccactctgcagcgggccctggttttacgagcagaactgagcctagcaaatctcctggaagtctgcgctatagttacaaagatagtttcgggtcagccgtgccacgaaatgtcagtggctttcctcagtatcctacagggcaagaaaagggagatttcactggccatggggaacgaaagggtagaaatgaaaaattcccaagcctcctgcaggaagtgcttcagggttaccaccaccaccctgacaggagatattctaggagtactcaagagcatcaggggatggctggtagcctagaaggaaccacaaggcccaatgtcttggttagtcaaaccaatgaattagctagcaggggccttctgaacaaaagcattgggtctctattagaaaatccccactggggcccctgggaaaggaaatcaagcagcacagctcctgaaatgaaacagatcaatttgactgactatccaattcccagaaagtttgaaatagagcctcagtcatcagcacatgagcctgggggttccctctctgaaagaagatcagtgatctgtgatatttctccactaagacagattgtcagggacccaggggctcactcactgggacacatgagtgccgacaccagaattgggaggaatgaccgtctcaatccaactttaagtcagtcggtcattcttcctggtggtttggtgtccatggaaaccaagctgaaatcccagagcgggcagataaaagaggaagactttgaacagtctaaatctcaagctagtttcaacaacaagaaatctggagaccactgccatcctcctagcatcaagcatgagtcttaccgcggcaatgccagccctggagcagcaacccatgattccctttcagactatggcccgcaagacagcagacccacgccaatgcggcgggtccctggcagagttggtggtcgggagggcatgaggggtcggtccccttctcaatatcatgactttgcagaaaaattgaaaatgtctcctgggcggagcagaggcccagggggagaccctcatcacatgaatccacacatgaccttttcagagagggctaaccggagttctttacacactcccttttctcccaactcagaaaccctggcctctgcttatcatgcaaatactcgggctcatgcttatggggaccctaacgcaggtttgaattctcagctgcattataagagacagatgtaccaacagcaaccagaggagtataaagactggagcagcggttctgctcagggagtaattgctgcagcacagcacaggcaggaggggccacggaagagtccaaggcagcagcagtttcttgacagagtacggagccctctgaaaaatgacaaagatggtatgatgtatggcccaccagtggggacttaccatgaccccagtgcccaggaggctgggcgctgcctaatgtctagtgatggtctgcctaacaagggcatggaattaaagcatggctcccagaagttacaagaatcctgttgggatctttctcggcaaacttctccagccaaaagcagcggtcctccaggaatgtccagtcaaaaaaggtatgggccgccccatgagactgatggacatggactagctgaggctacacagtcatccaaacctggtagtgttatgctgagacttccaggccaggaggatcattcttctcaaaaccccttaatcatgaggaggcgtgttcgttcttttatctctcccattcccagtaagagacagtcacaagatgtaaagaacagtagcactgaagataaaggtcgcctccttcactcatcaaaagaaggcgctgataaagcattcaattcctatgcccatctttctcacagtcaggatatcaagtctatccctaagagagattcctccaaggaccttccaagtccagatagtagaaactgccctgctgttaccctcacaagccctgctaagaccaaaatactgcccccacggaaaggacggggattgaaattggaagctatagttcagaagattacatccccaaatattaggaggagcgcatcttcgaacagtgcggaggctgggggagacacggttacgcttgatgatatactgtctttgaagagtggtcctcctgaaggtgggagtgttgctgttcaggatgctgacatagagaagagaaaaggtgaggtggcttcggacctagtcagtccagcaaaccaggagttgcacgtagagaaacctcttccaaggtcttcagaagagtggcgtggcagcgtggatgacaaagtgaagacagagacacatgcagaaacagttactgccggaaaggaaccccctggtgccatgacatccacaacctcacagaagcctggtagtaaccaagggagaccagatggttccctgggtggaacagcacctttaatctttccagactcaaagaatgtacctccagtgggcatattggcccctgaggcaaaccccaaggctgaagagaaggagaacgatacagtgacgatttcaccgaagcaagagggtttccctccaaagggatatttcccatcaggaaagaagaaggggagacccattggtagtgtgaataagcaaaagaaacagcagcagccaccgcctccaccccctcagcccccacagataccagaaggttctgcagatggagagccaaagccaaaaaaacagaggcaaaggagggagagaaggaagcctggggcccagccgaggaagcgaaaaaccaaacaagcagttcccattgtggaaccccaagaacctgagatcaaactaaaatatgccacccagccactggataaaactgatgccaagaacaagtctttttacccttacatccatgtagtaaataagtgtgaacttggagccgtttgtacaatcatcaatgctgaggaagaagaacagaccaaattagtgaggggcaggaagggtcagaggtcactgacccctccacctagcagcactgaaagcaaggcgctcccggcctcgtcctttatgctgcagggacctgttgtgacagagtcttcggttatggggcacctggtttgctgtctgtgtggcaagtgggccagttaccggaacatgggtgacctctttggacctttttatccccaagattatgcagccactctcccgaagaatccacctcctaagagggccacagaaatgcagagcaaagttaaggtacggcacaaaagtgcttctaatggctccaagacggacactgaggaggaggaagagcagcagcagcagcagaaggagcagagaagcctggccgcacaccccaggtttaagcggcgccaccgctcggaagactgtggtggaggccctcggtccctgtccagggggctcccttgtaaaaaagcagccactgagggcagcagtgaaaagactgttttggactcgaagccctccgtgcccaccacttcagaaggtggccctgagctggagttacaaatccctgaactacctcttgacagcaatgaattttgggtccatgagggttgtattctctgggccaatggaatctacctggtttgtggcaggctctatggcctgcaggaagcgctggaaatagccagagagatgaaatgttcccactgccaggaggcaggcgccaccttgggctgctacaacaaaggctgctccttccgataccattacccgtgtgccattgatgcagattgtttgctacatgaggagaacttctcggtgaggtgccctaagcacaagcctccccttccgtgccctctcccccccttgcagaacaagaccgcgaaaggcagcctcagcacagagcagtcggagcgggggtgaggggggcagtgtgctcgtgggaatggaaaggacagcaagcacaggtgagactgtggagatgagaaggtggtggacactcgtgatggaatggaaatcgtcctaccgtgcagccacaccctgccctgccccgccccgccccgcccgcgtgcctgcccatgccagcacttccttaagttctcacatcacactcaaaccagtgacaccacaggaaagaaagacccaagacgttggaatggctgtttccatggacacaatctccatagtgacaatgtggggggaggggggaggggtgggatgatggggaaagggtggggggaattaaaagggagggataaatatatatatataaatctatttttagtctggaaagactttgtttaaatgaaaggtgcgctatcccttttgattctgttttaaaattatctcgttaaagatctccaaatttgttccgatgacaagtgaaatttaaatgtgagattgaactgaacaaaccctcatctcatgaaggacggggtgtgtgtgtggcgttgatctttagcctgtctcacaccagttcagaaaacactagacccaggattgaaaaagcaaaccacagcagaaccatccttttgtcattaatttgtctcaaagtgggaaggttttgggggagggggaaatacagggatggtccatgttttcaagagtaggggaatgatgtttaaacacaaaaataaattttttttcatttccagaaacactatttatttatggttttttttttttaattttttctttttgggggtgaaattggcagatgcctgaggtcatagctgtgtcctgggtcactgtggctggtgaggacctcaaggaccccatcaagtgtacacagcagcagcaaaatcaagggatgaccctcctctggggccccctgtcctcagcacattccaggcagctgtgccctgacccacagggacccgtggggatgggaggaggtccaggcctgtgttgccagagctggcagtgtgagctgtaggcagggacggggagggactgtcgctgtgatcagagtgggttaagctgaccaggaacacccatttaacccctttttctttttgctttcatttttataaaggaaaagaggacctgtcagataggcagccccatgctacgtgattctttatgttgtgttgttttgttttgtaaattgtataatttttaaatatctgagttttaaaaaaagaaaaaagtacaaaaaaatcttgttatggccttaagaaggggttagtgcatctttcaggggtcactctgccatggggataaaatagctgtttcacaaacagttttattta

SEQ ID NO: 86630 - DNA, 7224 bp, Homo sapiens
ttcatctgggcctctgattcatctttattccctccatcatctagacttgattttatttgtaccaaggagatgcgtgtctaatgtttttctttcttctatttctaggagggctgttggcctgctgctgtgctgctgaacagtatgcagtcctttcgggagcaaagcagttaccacggaaaccagcaaagctacccacaggaggtacacggctcatcccggctagaagagttcagccctcgtcaggcccagatgttccagaattttggaggtacaggtggcagtagtggcagcagtggcagtggcagtggtggtggacgacgaggagcagcagctgctgcggcagcgatggctagcgagacctctggccatcaaggttaccagggtttcaggaaagaggctggagatttttactacatggcaggcaacaaagaccccgtgactacaggaaccccacagcctcctcagcgaaggccttctgggcctgtgcagagctatggacccccccaggggagcagctttggcaatcagtatgggagtgagggtcatgtgggccagtttcaagcacagcactctggccttggcggtgtgtcacattatcagcaggattacactgggcctttctctccagggagtgctcagtaccaacagcaggcttccagccagcagcagcagcagcaagtccagcagttgagacaacagctttaccagtcccatcagcccctgccacaggccactggccaaccagcatccagctcatcccatctacagccaatgcagcggccctcaactctgccatcctctgctgctggttaccagttaagagtgggtcagtttggccaacactatcagtcttctgcttcctcctcctcctcctcctccttcccttcaccacagcgttttagccagtctggacagagctatgatggcagttacaatgtgaatgctggatctcagtatgaaggacacaatgtgggttctaatgcacaggcttatggaacacaatccaattacagctatcagcctcaatctatgaagaattttgaacaggcaaagattccacaagggacccaacaggggcagcagcagcagcaaccgcagcaacaacaacacccttctcagcatgtgatgcagtatactaacgctgccaccaagctgcccctgcaaagccaagtggggcagtacaaccagcctgaggttcctgtgaggtcccccatgcagtttcaccagaacttcagccccatttctaacccttctccagctgcctctgtggttcagtctccaagctgtagttctaccccatctcctctcatgcagactggggagaatctccagtgtgggcaaggcagtgtgcctatgggttccagaaacagaattttacagttaatgcctcaactcagtccaaccccatcaatgatgcccagtcctaattctcatgctgcaggcttcaaagggtttggactagaaggggtaccagaaaagcgactgacagatcctgggttgagtagtttgagtgctctgagtactcaagtggccaatcttcctaacactgtccagcacatgttactttctgatgccctgactcctcagaagaagacctccaagaggccctcatcttccaagaaagcagatagctgcacaaattctgaaggctcctcacaacctgaagaacagctgaagtcccctatggcagagtcattagatggaggctgctccagcagttcagaggatcaaggcgagagagtgcggcaactaagtggccagagcaccagctctgacaccacctacaagggtggagcctctgagaaagctggctcctcaccggcacaaggtgctcagaatgaaccccccagactcaatgctagtcctgccgcaagagaagaggccacctcaccaggcgctaaggacatgccattgtcatccgacgggaacccaaaggttaatgagaagactgttggggtgattgtctcccgggaagccatgacaggtcgggtagaaaagcctggtggacaagataaaggctcccaagaggatgatcctgcagccactcaaaggccacctagcaatggtggggcaaaggaaaccagtcatgcatcacttccccagccagagcctccaggaggaggagggagcaaaggaaacaagaatggcgataacaactccaaccataatggagaaggaaatggccagagtggccactctgcagcgggccctggttttacgagcagaactgagcctagcaaatctcctggaagtctgcgctatagttacaaagatagtttcgggtcagccgtgccacgaaatgtcagtggctttcctcagtatcctacagggcaagaaaagggagatttcactggccatggggaacgaaagggtagaaatgaaaaattcccaagcctcctgcaggaagtgcttcagggttaccaccaccaccctgacaggagatattctaggagtactcaagagcatcaggggatggctggtagcctagaaggaaccacaaggcccaatgtcttggttagtcaaaccaatgaattagctagcaggggccttctgaacaaaagcattgggtctctattagaaaatccccactggggcccctgggaaaggaaatcaagcagcacagctcctgaaatgaaacagatcaatttgactgactatccaattcccagaaagtttgaaatagagcctcagtcatcagcacatgagcctgggggttccctctctgaaagaagatcagtgatctgtgatatttctccactaagacagattgtcagggacccaggggctcactcactgggacacatgagtgccgacaccagaattgggaggaatgaccgtctcaatccaactttaagtcagtcggtcattcttcctggtggtttggtgtccatggaaaccaagctgaaatcccagagcgggcagataaaagaggaagactttgaacagtctaaatctcaagctagtttcaacaacaagaaatctggagaccactgccatcctcctagcatcaagcatgagtcttaccgcggcaatgccagccctggagcagcaacccatgattccctttcagactatggcccgcaagacagcagacccacgccaatgcggcgggtccctggcagagttggtggtcgggagggcatgaggggtcggtccccttctcaatatcatgactttgcagaaaaattgaaaatgtctcctgggcggagcagaggcccagggggagaccctcatcacatgaatccacacatgaccttttcagagagggctaaccggagttctttacacactcccttttctcccaactcagaaaccctggcctctgcttatcatgcaaatactcgggctcatgcttatggggaccctaacgcaggtttgaattctcagctgcattataagagacagatgtaccaacagcaaccagaggagtataaagactggagcagcggttctgctcagggagtaattgctgcagcacagcacaggcaggaggggccacggaagagtccaaggcagcagcagtttcttgacagagtacggagccctctgaaaaatgacaaagatggtatgatgtatggcccaccagtggggacttaccatgaccccagtgcccaggaggctgggcgctgcctaatgtctagtgatggtctgcctaacaagggcatggaattaaagcatggctcccagaagttacaagaatcctgttgggatctttctcggcaaacttctccagccaaaagcagcggtcctccaggaatgtccagtcaaaaaaggtatgggccgccccatgagactgatggacatggactagctgaggctacacagtcatccaaacctggtagtgttatgctgagacttccaggccaggaggatcattcttctcaaaaccccttaatcatgaggaggcgtgttcgttcttttatctctcccattcccagtaagagacagtcacaagatgtaaagaacagtagcactgaagataaaggtcgcctccttcactcatcaaaagaaggcgctgataaagcattcaattcctatgcccatctttctcacagtcaggatatcaagtctatccctaagagagattcctccaaggaccttccaagtccagatagtagaaactgccctgctgttaccctcacaagccctgctaagaccaaaatactgcccccacggaaaggacggggattgaaattggaagctatagttcagaagattacatccccaaatattaggaggagcgcatcttcgaacagtgcggaggctgggggagacacggttacgcttgatgatatactgtctttgaagagtggtcctcctgaaggtgggagtgttgctgttcaggatgctgacatagagaagagaaaaggtgaggtggcttcggacctagtcagtccagcaaaccaggagttgcacgtagagaaacctcttccaaggtcttcagaagagtggcgtggcagcgtggatgacaaagtgaagacagagacacatgcagaaacagttactgccggaaaggaaccccctggtgccatgacatccacaacctcacagaagcctggtagtaaccaagggagaccagatggttccctgggtggaacagcacctttaatctttccagactcaaagaatgtacctccagtgggcatattggcccctgaggcaaaccccaaggctgaagagaaggagaacgatacagtgacgatttcaccgaagcaagagggtttccctccaaagggatatttcccatcaggaaagaagaaggggagacccattggtagtgtgaataagcaaaagaaacagcagcagccaccgcctccaccccctcagcccccacagataccagaaggttctgcagatggagagccaaagccaaaaaaacagaggcaaaggagggagagaaggaagcctggggcccagccgaggaagcgaaaaaccaaacaagcagttcccattgtggaaccccaagaacctgagatcaaactaaaatatgccacccagccactggataaaactgatgccaagaacaagtctttttacccttacatccatgtagtaaataagtgtgaacttggagccgtttgtacaatcatcaatgctgaggaagaagaacagaccaaattagtgaggggcaggaagggtcagaggtcactgacccctccacctagcagcactgaaagcaaggcgctcccggcctcgtcctttatgctgcagggacctgttgtgacagagtcttcggttatggggcacctggtttgctgtctgtgtggcaagtgggccagttaccggaacatgggtgacctctttggacctttttatccccaagattatgcagccactctcccgaagaatccacctcctaagagggccacagaaatgcagagcaaagttaaggtacggcacaaaagtgcttctaatggctccaagacggacactgaggaggaggaagagcagcagcagcagcagaaggagcagagaagcctggccgcacaccccaggtttaagcggcgccaccgctcggaagactgtggtggaggccctcggtccctgtccagggggctcccttgtaaaaaagcagccactgagggcagcagtgaaaagactgttttggactcgaagccctccgtgcccaccacttcagaaggtggccctgagctggagttacaaatccctgaactacctcttgacagcaatgaattttgggtccatgagggttgtattctctgggccaatggaatctacctggtttgtggcaggctctatggcctgcaggaagcgctggaaatagccagagagatgaaatgttcccactgccaggaggcaggcgccaccttgggctgctacaacaaaggctgctccttccgataccattacccgtgtgccattgatgcagattgtttgctacatgaggagaacttctcggtgaggtgccctaagcacaaggtgagactgtggagatgagaaggtggtggacactcgtgatggaatggaaatcgtcctaccgtgcagccacaccctgccctgccccgccccgccccgcccgcgtgcctgcccatgccagcacttccttaagttctcacatcacactcaaaccagtgacaccacaggaaagaaagacccaagacgttggaatggctgtttccatggacacaatctccatagtgacaatgtggggggaggggggaggggtgggatgatggggaaagggtggggggaattaaaagggagggataaatatatatatataaatctatttttagtctggaaagactttgtttaaatgaaaggtgcgctatcccttttgattctgttttaaaattatctcgttaaagatctccaaatttgttccgatgacaagtgaaatttaaatgtgagattgaactgaacaaaccctcatctcatgaaggacggggtgtgtgtgtggcgttgatctttagcctgtctcacaccagttcagaaaacactagacccaggattgaaaaagcaaaccacagcagaaccatccttttgtcattaatttgtctcaaagtgggaaggttttgggggagggggaaatacagggatggtccatgttttcaagagtaggggaatgatgtttaaacacaaaaataaattttttttcatttccagaaacactatttatttatggttttttttttttaattttttctttttgggggtgaaattggcagatgcctgaggtcatagctgtgtcctgggtcactgtggctggtgaggacctcaaggaccccatcaagtgtacacagcagcagcaaaatcaagggatgaccctcctctggggccccctgtcctcagcacattccaggcagctgtgccctgacccacagggacccgtggggatgggaggaggtccaggcctgtgttgccagagctggcagtgtgagctgtaggcagggacggggagggactgtcgctgtgatcagagtgggttaagctgaccaggaacacccatttaacccctttttctttttgctttcatttttataaaggaaaagaggacctgtcagataggcagccccatgctacgtgattctttatgttgtgttgttttgttttgtaaattgtataatttttaaatatctgagttttaaaaaaagaaaaaagtacaaaaaaatcttgttatggccttaagaaggggttagtgcatctttcaggggtcactctgccatggggataaaatagctgtttcacaaacagttttattta

SEQ ID NO: 86631 - DNA, 7319 bp, Homo sapiens
ttcatctgggcctctgattcatctttattccctccatcatctagacttgattttatttgtaccaaggagatgcgtgtctaatgtttttctttcttctatttctaggagggctgttggcctgctgctgtgctgctgaacagtatgcagtcctttcgggagcaaagcagttaccacggaaaccagcaaagctacccacaggaggtacacggctcatcccggctagaagagttcagccctcgtcaggcccagatgttccagaattttggaggtacaggtggcagtagtggcagcagtggcagtggcagtggtggtggacgacgaggagcagcagctgctgcggcagcgatggctagcgagacctctggccatcaaggttaccagggtttcaggaaagaggctggagatttttactacatggcaggcaacaaagaccccgtgactacaggaaccccacagcctcctcagcgaaggccttctgggcctgtgcagagctatggacccccccaggggagcagctttggcaatcagtatgggagtgagggtcatgtgggccagtttcaagcacagcactctggccttggcggtgtgtcacattatcagcaggattacactgggcctttctctccagggagtgctcagtaccaacagcaggcttccagccagcagcagcagcagcaagtccagcagttgagacaacagctttaccagtcccatcagcccctgccacaggccactggccaaccagcatccagctcatcccatctacagccaatgcagcggccctcaactctgccatcctctgctgctggttaccagttaagagtgggtcagtttggccaacactatcagtcttctgcttcctcctcctcctcctcctccttcccttcaccacagcgttttagccagtctggacagagctatgatggcagttacaatgtgaatgctggatctcagtatgaaggacacaatgtgggttctaatgcacaggcttatggaacacaatccaattacagctatcagcctcaatctatgaagaattttgaacaggcaaagattccacaagggacccaacaggggcagcagcagcagcaaccgcagcaacaacaacacccttctcagcatgtgatgcagtatactaacgctgccaccaagctgcccctgcaaagccaagtggggcagtacaaccagcctgaggttcctgtgaggtcccccatgcagtttcaccagaacttcagccccatttctaacccttctccagctgcctctgtggttcagtctccaagctgtagttctaccccatctcctctcatgcagactggggagaatctccagtgtgggcaaggcagtgtgcctatgggttccagaaacagaattttacagttaatgcctcaactcagtccaaccccatcaatgatgcccagtcctaattctcatgctgcaggcttcaaagggtttggactagaaggggtaccagaaaagcgactgacagatcctgggttgagtagtttgagtgctctgagtactcaagtggccaatcttcctaacactgtccagcacatgttactttctgatgccctgactcctcagaagaagacctccaagaggccctcatcttccaagaaagcagatagctgcacaaattctgaaggctcctcacaacctgaagaacagctgaagtcccctatggcagagtcattagatggaggctgctccagcagttcagaggatcaaggcgagagagtgcggcaactaagtggccagagcaccagctctgacaccacctacaagggtggagcctctgagaaagctggctcctcaccggcacaaggtgctcagaatgaaccccccagactcaatgctagtcctgccgcaagagaagaggccacctcaccaggcgctaaggacatgccattgtcatccgacgggaacccaaaggttaatgagaagactgttggggtgattgtctcccgggaagccatgacaggtcgggtagaaaagcctggtggacaagataaaggctcccaagaggatgatcctgcagccactcaaaggccacctagcaatggtggggcaaaggaaaccagtcatgcatcacttccccagccagagcctccaggaggaggagggagcaaaggaaacaagaatggcgataacaactccaaccataatggagaaggaaatggccagagtggccactctgcagcgggccctggttttacgagcagaactgagcctagcaaatctcctggaagtctgcgctatagttacaaagatagtttcgggtcagccgtgccacgaaatgtcagtggctttcctcagtatcctacagggcaagaaaagggagatttcactggccatggggaacgaaagggtagaaatgaaaaattcccaagcctcctgcaggaagtgcttcagggttaccaccaccaccctgacaggagatattctaggagtactcaagagcatcaggggatggctggtagcctagaaggaaccacaaggcccaatgtcttggttagtcaaaccaatgaattagctagcaggggccttctgaacaaaagcattgggtctctattagaaaatccccactggggcccctgggaaaggaaatcaagcagcacagctcctgaaatgaaacagatcaatttgactgactatccaattcccagaaagtttgaaatagagcctcagtcatcagcacatgagcctgggggttccctctctgaaagaagatcagtgatctgtgatatttctccactaagacagattgtcagggacccaggggctcactcactgggacacatgagtgccgacaccagaattgggaggaatgaccgtctcaatccaactttaagtcagtcggtcattcttcctggtggtttggtgtccatggaaaccaagctgaaatcccagagcgggcagataaaagaggaagactttgaacagtctaaatctcaagctagtttcaacaacaagaaatctggagaccactgccatcctcctagcatcaagcatgagtcttaccgcggcaatgccagccctggagcagcaacccatgattccctttcagactatggcccgcaagacagcagacccacgccaatgcggcgggtccctggcagagttggtggtcgggagggcatgaggggtcggtccccttctcaatatcatgactttgcagaaaaattgaaaatgtctcctgggcggagcagaggcccagggggagaccctcatcacatgaatccacacatgaccttttcagagagggctaaccggagttctttacacactcccttttctcccaactcagaaaccctggcctctgcttatcatgcaaatactcgggctcatgcttatggggaccctaacgcaggtttgaattctcagctgcattataagagacagatgtaccaacagcaaccagaggagtataaagactggagcagcggttctgctcagggagtaattgctgcagcacagcacaggcaggaggggccacggaagagtccaaggcagcagcagtttcttgacagagtacggagccctctgaaaaatgacaaagatggtatgatgtatggcccaccagtggggacttaccatgaccccagtgcccaggaggctgggcgctgcctaatgtctagtgatggtctgcctaacaagggcatggaattaaagcatggctcccagaagttacaagaatcctgttgggatctttctcggcaaacttctccagccaaaagcagcggtcctccaggaatgtccagtcaaaaaaggtatgggccgccccatgagactgatggacatggactagctgaggctacacagtcatccaaacctggtagtgttatgctgagacttccaggccaggaggatcattcttctcaaaaccccttaatcatgaggaggcgtgttcgttcttttatctctcccattcccagtaagagacagtcacaagatgtaaagaacagtagcactgaagataaaggtcgcctccttcactcatcaaaagaaggcgctgataaagcattcaattcctatgcccatctttctcacagtcaggatatcaagtctatccctaagagagattcctccaaggaccttccaagtccagatagtagaaactgccctgctgttaccctcacaagccctgctaagaccaaaatactgcccccacggaaaggacggggattgaaattggaagctatagttcagaagattacatccccaaatattaggaggagcgcatcttcgaacagtgcggaggctgggggagacacggttacgcttgatgatatactgtctttgaagagtggtcctcctgaaggtgggagtgttgctgttcaggatgctgacatagagaagagaaaaggtgaggtggcttcggacctagtcagtccagcaaaccaggagttgcacgtagagaaacctcttccaaggtcttcagaagagtggcgtggcagcgtggatgacaaagtgaagacagagacacatgcagaaacagttactgccggaaaggaaccccctggtgccatgacatccacaacctcacagaagcctggtagtaaccaagggagaccagatggttccctgggtggaacagcacctttaatctttccagactcaaagaatgtacctccagtgggcatattggcccctgaggcaaaccccaaggctgaagagaaggagaacgatacagtgacgatttcaccgaagcaagagggtttccctccaaagggatatttcccatcaggaaagaagaaggggagacccattggtagtgtgaataagcaaaagaaacagcagcagccaccgcctccaccccctcagcccccacagataccagaaggttctgcagatggagagccaaagccaaaaaaacagaggcaaaggagggagagaaggaagcctggggcccagccgaggaagcgaaaaaccaaacaagcagttcccattgtggaaccccaagaacctgagatcaaactaaaatatgccacccagccactggataaaactgatgccaagaacaagtctttttacccttacatccatgtagtaaataagtgtgaacttggagccgtttgtacaatcatcaatgctgaggaagaagaacagaccaaattagtgaggggcaggaagggtcagaggtcactgacccctccacctagcagcactgaaagcaaggcgctcccggcctcgtcctttatgctgcagggacctgttgtgacagagtcttcggttatggggcacctggtttgctgtctgtgtggcaagtgggccagttaccggaacatgggtgacctctttggacctttttatccccaagattatgcagccactctcccgaagaatccacctcctaagagggccacagaaatgcagagcaaagttaaggtacggcacaaaagtgcttctaatggctccaagacggacactgaggaggaggaagagcagcagcagcagcagaaggagcagagaagcctggccgcacaccccaggtttaagcggcgccaccgctcggaagactgtggtggaggccctcggtccctgtccagggggctcccttgtaaaaaagcagccactgagggcagcagtgaaaagactgttttggactcgaagccctccgtgcccaccacttcagaaggtggccctgagctggagttacaaatccctgaactacctcttgacagcaatgaattttgggtccatgagggttgtattctctgggccaatggaatctacctggtttgtggcaggctctatggcctgcaggaagcgctggaaatagccagagagatgaaatgttcccactgccaggaggcaggcgccaccttgggctgctacaacaaaggctgctccttccgataccattacccgtgtgccattgatgcagattgtttgctacatgaggagaacttctcggtgaggtgccctaagcacaagaacaagaccgcgaaaggcagcctcagcacagagcagtcggagcgggggtgaggggggcagtgtgctcgtgggaatggaaaggacagcaagcacaggtgagactgtggagatgagaaggtggtggacactcgtgatggaatggaaatcgtcctaccgtgcagccacaccctgccctgccccgccccgccccgcccgcgtgcctgcccatgccagcacttccttaagttctcacatcacactcaaaccagtgacaccacaggaaagaaagacccaagacgttggaatggctgtttccatggacacaatctccatagtgacaatgtggggggaggggggaggggtgggatgatggggaaagggtggggggaattaaaagggagggataaatatatatatataaatctatttttagtctggaaagactttgtttaaatgaaaggtgcgctatcccttttgattctgttttaaaattatctcgttaaagatctccaaatttgttccgatgacaagtgaaatttaaatgtgagattgaactgaacaaaccctcatctcatgaaggacggggtgtgtgtgtggcgttgatctttagcctgtctcacaccagttcagaaaacactagacccaggattgaaaaagcaaaccacagcagaaccatccttttgtcattaatttgtctcaaagtgggaaggttttgggggagggggaaatacagggatggtccatgttttcaagagtaggggaatgatgtttaaacacaaaaataaattttttttcatttccagaaacactatttatttatggttttttttttttaattttttctttttgggggtgaaattggcagatgcctgaggtcatagctgtgtcctgggtcactgtggctggtgaggacctcaaggaccccatcaagtgtacacagcagcagcaaaatcaagggatgaccctcctctggggccccctgtcctcagcacattccaggcagctgtgccctgacccacagggacccgtggggatgggaggaggtccaggcctgtgttgccagagctggcagtgtgagctgtaggcagggacggggagggactgtcgctgtgatcagagtgggttaagctgaccaggaacacccatttaacccctttttctttttgctttcatttttataaaggaaaagaggacctgtcagataggcagccccatgctacgtgattctttatgttgtgttgttttgttttgtaaattgtataatttttaaatatctgagttttaaaaaaagaaaaaagtacaaaaaaatcttgttatggccttaagaaggggttagtgcatctttcaggggtcactctgccatggggataaaatagctgtttcacaaacagttttattta

SEQ ID NO: 86632 - DNA, 3040 bp, Homo sapiens
gaaagatacagagacaaagtacagaggaagaaaaatgggcccaggggaccggcgttcagcatacggaggacccatgccggcactggcctctgagttcccttagtatttattgatcattatcgggcattcccggagagtggcgtggcagcgtggatgacaaagtgaagacagagacacatgcagaaacagttactgccggaaaggaaccccctggtgccatgacatccacaacctcacagaagcctggtagtaaccaagggagaccagatggttccctgggtggaacagcacctttaatctttccagactcaaagaatgtacctccagtgggcatattggcccctgaggcaaaccccaaggctgaagagaaggagaacgatacagtgacgatttcaccgaagcaagagggtttccctccaaagggatatttcccatcaggaaagaagaaggggagacccattggtagtgtgaataagcaaaagaaacagcagcagccaccgcctccaccccctcagcccccacagataccagaaggttctgcagatggagagccaaagccaaaaaaacagaggcaaaggagggagagaaggaagcctggggcccagccgaggaagcgaaaaaccaaacaagcagttcccattgtggaaccccaagaacctgagatcaaactaaaatatgccacccagccactggataaaactgatgccaagaacaagtctttttacccttacatccatgtagtaaataagtgtgaacttggagccgtttgtacaatcatcaatgctgaggaagaagaacagaccaaattagtgaggggcaggaagggtcagaggtcactgacccctccacctagcagcactgaaagcaaggcgctcccggcctcgtcctttatgctgcagggacctgttgtgacagagtcttcggttatggggcacctggtttgctgtctgtgtggcaagtgggccagttaccggaacatgggtgacctctttggacctttttatccccaagattatgcagccactctcccgaagaatccacctcctaagagggccacagaaatgcagagcaaagttaaggtacggcacaaaagtgcttctaatggctccaagacggacactgaggaggaggaagagcagcagcagcagcagaaggagcagagaagcctggccgcacaccccaggtttaagcggcgccaccgctcggaagactgtggtggaggccctcggtccctgtccagggggctcccttgtaaaaaagcagccactgagggcagcagtgaaaagactgttttggactcgaagccctccgtgcccaccacttcagaaggtggccctgagctggagttacaaatccctgaactacctcttgacagcaatgaattttgggtccatgagggttgtattctctgggccaatggaatctacctggtttgtggcaggctctatggcctgcaggaagcgctggaaatagccagagagatgaaatgttcccactgccaggaggcaggcgccaccttgggctgctacaacaaaggctgctccttccgataccattacccgtgtgccattgatgcagattgtttgctacatgaggagaacttctcggtgaggtgccctaagcacaagcctccccttccgtgccctctcccccccttgcagaacaagaccgcgaaaggcagcctcagcacagagcagtcggagcgggggtgaggggggcagtgtgctcgtgggaatggaaaggacagcaagcacaggtgagactgtggagatgagaaggtggtggacactcgtgatggaatggaaatcgtcctaccgtgcagccacaccctgccctgccccgccccgccccgcccgcgtgcctgcccatgccagcacttccttaagttctcacatcacactcaaaccagtgacaccacaggaaagaaagacccaagacgttggaatggctgtttccatggacacaatctccatagtgacaatgtggggggaggggggaggggtgggatgatggggaaagggtggggggaattaaaagggagggataaatatatatatataaatctatttttagtctggaaagactttgtttaaatgaaaggtgcgctatcccttttgattctgttttaaaattatctcgttaaagatctccaaatttgttccgatgacaagtgaaatttaaatgtgagattgaactgaacaaaccctcatctcatgaaggacggggtgtgtgtgtggcgttgatctttagcctgtctcacaccagttcagaaaacactagacccaggattgaaaaagcaaaccacagcagaaccatccttttgtcattaatttgtctcaaagtgggaaggttttgggggagggggaaatacagggatggtccatgttttcaagagtaggggaatgatgtttaaacacaaaaataaattttttttcatttccagaaacactatttatttatggttttttttttttaattttttctttttgggggtgaaattggcagatgcctgaggtcatagctgtgtcctgggtcactgtggctggtgaggacctcaaggaccccatcaagtgtacacagcagcagcaaaatcaagggatgaccctcctctggggccccctgtcctcagcacattccaggcagctgtgccctgacccacagggacccgtggggatgggaggaggtccaggcctgtgttgccagagctggcagtgtgagctgtaggcagggacggggagggactgtcgctgtgatcagagtgggttaagctgaccaggaacacccatttaacccctttttctttttgctttcatttttataaaggaaaagaggacctgtcagataggcagccccatgctacgtgattctttatgttgtgttgttttgttttgtaaattgtataatttttaaatatctgagttttaaaaaaagaaaaaagtacaaaaaaatcttgttatggccttaagaaggggttagtgcatctttcaggggtcactctgccatggggataaaatagctgtttcacaaacagttttattta

SEQ ID NO: 86633 - DNA, 6750 bp, Homo sapiens
ttcatctgggcctctgattcatctttattccctccatcatctagacttgattttatttgtaccaaggagatgcgtgtctaatgtttttctttcttctatttctaggagggctgttggcctgctgctgtgctgctgaacagtatgcagtcctttcgggagcaaagcagttaccacggaaaccagcaaagctacccacaggaggtacacggctcatcccggctagaagagttcagccctcgtcaggcccagatgttccagaattttggaggtacaggtggcagtagtggcagcagtggcagtggcagtggtggtggacgacgaggagcagcagctgctgcggcagcgatggctagcgagacctctggccatcaaggttaccagggtttcaggaaagaggctggagatttttactacatggcaggcaacaaagaccccgtgactacaggaaccccacagcctcctcagcgaaggccttctgggcctgtgcagagctatggacccccccaggggagcagctttggcaatcagtatgggagtgagggtcatgtgggccagtttcaagcacagcactctggccttggcggtgtgtcacattatcagcaggattacactgggcctttctctccagggagtgctcagtaccaacagcaggcttccagccagcagcagcagcagcaagtccagcagttgagacaacagctttaccagtcccatcagcccctgccacaggccactggccaaccagcatccagctcatcccatctacagccaatgcagcggccctcaactctgccatcctctgctgctggttaccagttaagagtgggtcagtttggccaacactatcagtcttctgcttcctcctcctcctcctcctccttcccttcaccacagcgttttagccagtctggacagagctatgatggcagttacaatgtgaatgctggatctcagtatgaaggacacaatgtgggttctaatgcacaggcttatggaacacaatccaattacagctatcagcctcaatctatgaagaattttgaacaggcaaagattccacaagggacccaacaggggcagcagcagcagcaaccgcagcaacaacaacacccttctcagcatgtgatgcagtatactaacgctgccaccaagctgcccctgcaaagccaagtggggcagtacaaccagcctgaggttcctgtgaggtcccccatgcagtttcaccagaacttcagccccatttctaacccttctccagctgcctctgtggttcagtctccaagctgtagttctaccccatctcctctcatgcagactggggagaatctccagtgtgggcaaggcagtgtgcctatgggttccagaaacagaattttacagttaatgcctcaactcagtccaaccccatcaatgatgcccagtcctaattctcatgctgcaggcttcaaagggtttggactagaaggggtaccagaaaagcgactgacagatcctgggttgagtagtttgagtgctctgagtactcaagtggccaatcttcctaacactgtccagcacatgttactttctgatgccctgactcctcagaagaagacctccaagaggccctcatcttccaagaaagcagatagctgcacaaattctgaaggctcctcacaacctgaagaacagctgaagtcccctatggcagagtcattagatggaggctgctccagcagttcagaggatcaaggcgagagagtgcggcaactaagtggccagagcaccagctctgacaccacctacaagggtggagcctctgagaaagctggctcctcaccggcacaaggtgctcagaatgaaccccccagactcaatgctagtcctgccgcaagagaagaggccacctcaccaggcgctaaggacatgccattgtcatccgacgggaacccaaaggttaatgagaagactgttggggtgattgtctcccgggaagccatgacaggtcgggtagaaaagcctggtggacaagataaaggctcccaagaggatgatcctgcagccactcaaaggccacctagcaatggtggggcaaaggaaaccagtcatgcatcacttccccagccagagcctccaggaggaggagggagcaaaggaaacaagaatggcgataacaactccaaccataatggagaaggaaatggccagagtggccactctgcagcgggccctggttttacgagcagaactgagcctagcaaatctcctggaagtctgcgctatagttacaaagatagtttcgggtcagccgtgccacgaaatgtcagtggctttcctcagtatcctacagggcaagaaaagggagatttcactggccatggggaacgaaagggtagaaatgaaaaattcccaagcctcctgcaggaagtgcttcagggttaccaccaccaccctgacaggagatattctaggagtactcaagagcatcaggggatggctggtagcctagaaggaaccacaaggcccaatgtcttggttagtcaaaccaatgaattagctagcaggggccttctgaacaaaagcattgggtctctattagaaaatccccactggggcccctgggaaaggaaatcaagcagcacagctcctgaaatgaaacagatcaatttgactgactatccaattcccagaaagtttgaaatagagcctcagtcatcagcacatgagcctgggggttccctctctgaaagaagatcagtgatctgtgatatttctccactaagacagattgtcagggacccaggggctcactcactgggacacatgagtgccgacaccagaattgggaggaatgaccgtctcaatccaactttaagtcagtcggtcattcttcctggtggtttggtgtccatggaaaccaagctgaaatcccagagcgggcagataaaagaggaagactttgaacagtctaaatctcaagctagtttcaacaacaagaaatctggagaccactgccatcctcctagcatcaagcatgagtcttaccgcggcaatgccagccctggagcagcaacccatgattccctttcagactatggcccgcaagacagcagacccacgccaatgcggcgggtccctggcagagttggtggtcgggagggcatgaggggtcggtccccttctcaatatcatgactttgcagaaaaattgaaaatgtctcctgggcggagcagaggcccagggggagaccctcatcacatgaatccacacatgaccttttcagagagggctaaccggagttctttacacactcccttttctcccaactcagaaaccctggcctctgcttatcatgcaaatactcgggctcatgcttatggggaccctaacgcaggtttgaattctcagctgcattataagagacagatgtaccaacagcaaccagaggagtataaagactggagcagcggttctgctcagggagtaattgctgcagcacagcacaggcaggaggggccacggaagagtccaaggcagcagcagtttcttgacagagtacggagccctctgaaaaatgacaaagatggtatgatgtatggcccaccagtggggacttaccatgaccccagtgcccaggaggctgggcgctgcctaatgtctagtgatggtctgcctaacaagggcatggaattaaagcatggctcccagaagttacaagaatcctgttgggatctttctcggcaaacttctccagccaaaagcagcggtcctccaggaatgtccagtcaaaaaaggtatgggccgccccatgagactgatggacatggactagctgaggctacacagtcatccaaacctggtagtgttatgctgagacttccaggccaggaggatcattcttctcaaaaccccttaatcatgaggaggcgtgttcgttcttttatctctcccattcccagtaagagacagtcacaagatgtaaagaacagtagcactgaagataaaggtcgcctccttcactcatcaaaagaaggcgctgataaagcattcaattcctatgcccatctttctcacagtcaggatatcaagtctatccctaagagagattcctccaaggaccttccaagtccagatagtagaaactgccctgctgttaccctcacaagccctgctaagaccaaaatactgcccccacggaaaggacggggattgaaattggaagctatagttcagaagattacatccccaaatattaggaggagcgcatcttcgaacagtgcggaggctgggggagacacggttacgcttgatgatatactgtctttgaagagtggtcctcctgaaggtgggagtgttgctgttcaggatgctgacatagagaagagaaaaggtgaggtggcttcggacctagtcagtccagcaaaccaggagttgcacgtagagaaacctcttccaaggtcttcagaagagtggcgtggcagcgtggatgacaaagtgaagacagagacacatgcagaaacagttactgccggaaaggaaccccctggtgccatgacatccacaacctcacagaagcctggtagtaaccaagggagaccagatggttccctgggtggaacagcacctttaatctttccagactcaaagaatgtacctccagtgggcatattggcccctgaggcaaaccccaaggctgaagagaaggagaacgatacagtgacgatttcaccgaagcaagagggtttccctccaaagggatatttcccatcaggaaagaagaaggggagacccattggtagtgtgaataagcaaaagaaacagcagcagccaccgcctccaccccctcagcccccacagataccagaaggttctgcagatggagagccaaagccaaaaaaacagaggcaaaggagggagagaaggaagcctggggcccagccgaggaagcgaaaaaccaaacaagcagttcccattgtggaaccccaagaacctgagatcaaactaaaatatgccacccagccactggataaaactgatgccaagaacaagtctttttacccttacatccatgtagtaaataagtgtgaacttggagccgtttgtacaatcatcaatgctgaggaagaagaacagaccaaattagtgaggggcaggaagggtcagaggtcactgacccctccacctagcagcactgaaagcaaggcgctcccggcctcgtcctttatgctgcagggacctgttgtgacagagtcttcggttatggggcacctggtttgctgtctgtgtggcaagtgggccagttaccggaacatgggtgacctctttggacctttttatccccaagattatgcagccactctcccgaagaatccacctcctaagagggccacagaaatgcagagcaaagttaaggtacggcacaaaagtgcttctaatggctccaagacggacactgaggaggaggaagagcagcagcagcagcagaaggagcagagaagcctggccgcacaccccaggtttaagcggcgccaccgctcggaagactgtggtggaggccctcggtccctgtccagggggctcccttgtaaaaaagcagccactgagggcagcagtgaaaagactgttttggactcgaagccctccgtgcccaccacttcagaaggtggccctgagctggagttacaaatccctgaactacctcttgacagcaatgaattttgggtccatgagggttgtattctctgggccaatggaatctacctggtttgtggcaggctctatggcctgcaggaagcgctggaaatagccagagagatgaaatgttcccactgccaggaggcaggcgccaccttgggctgctacaacaaaggctgctccttccgataccattacccgtgtgccattgatgcagattgtttgctacatgaggagaacttctcggtgaggtgccctaagcacaaggtgagtcagaggccccaagagctaccagcagggatgggatcgagggtggctcctcctgaaagacctgaagaccaggtgttggtgggcctcacccacacctgtccccacctgtgcctccggctgttagtcccctcctggccctgggagggtggaggggcatgatgctgaagggagacccgtggcatgggggccagcactcggagtattatgaggatcccaggagaaatgtgttttgggagagggggtgtttgtctgttcattaagagaggtgagaatatctaactcgatcaagccactgatttccacttgaggtgaatagaaccccaattcacaggttggcgtttggtaagtctggttctaggccttgaggcctgtgcaaaggcatcttcccagactagaagtcgagctgaccacaaggctctggggaagctcagtctcttccaggttgtgcttctgcagaagcagcctgatgcacagtggatgggctgtctcgggctccacttcccagtttatttaggaggtggtctcgtggtcgcttcctttagaaagggtgggaggtaaggggtgaatggtctgtttgtggataccacatatgtgtgtggggagggtgtatatggagaaggagccccaagaaaggatcagaacggagaccactgccacctgatgtttcctgcaggggctgcactgtgtctctggctgaggtcacactgacacctggtggtagacttcaagaacaagtatgaggatgaaatcaaacaagcgtaccactgctgagaatgagtttgtgatgctgaagaagatgtagatgcg

SEQ ID NO: 86634 - DNA, 1728 bp, Homo sapiens
tttgtttttttaaataaaactgtttgtgaaacagctattttatccccatggcagagtgacccctgaaagatgcactaaccccttcttaaggccataacaagatttttttgtacttttttctttttttaaaactcagatatttaaaaattatacaatttacaaaacaaaacaacacaacataaagaatcacgtagcaggcgccaccttgggctgctacaacaaaggctgctccttccgataccattacccgtgtgccattgatgcagattgtttgctacatgaggagaacttctcggtgaggtgccctaagcacaagcctccccttccgtgccctctcccccccttgcagaacaagaccgcgaaaggcagcctcagcacagagcagtcggagcgggggtgaggggggcagtgtgctcgtgggaatggaaaggacagcaagcacaggtgagactgtggagatgagaaggtggtggacactcgtgatggaatggaaatcgtcctaccgtgcagccacaccctgccctgccccgccccgccccgcccgcgtgcctgcccatgccagcacttccttaagttctcacatcacactcaaaccagtgacaccacaggaaagaaagacccaagacgttggaatggctgtttccatggacacaatctccatagtgacaatgtggggggaggggggaggggtgggatgatggggaaagggtggggggaattaaaagggagggataaatatatatatataaatctatttttagtctggaaagactttgtttaaatgaaaggtgcgctatcccttttgattctgttttaaaattatctcgttaaagatctccaaatttgttccgatgacaagtgaaatttaaatgtgagattgaactgaacaaaccctcatctcatgaaggacggggtgtgtgtgtggcgttgatctttagcctgtctcacaccagttcagaaaacactagacccaggattgaaaaagcaaaccacagcagaaccatccttttgtcattaatttgtctcaaagtgggaaggttttgggggagggggaaatacagggatggtccatgttttcaagagtaggggaatgatgtttaaacacaaaaataaattttttttcatttccagaaacactatttatttatggttttttttttttaattttttctttttgggggtgaaattggcagatgcctgaggtcatagctgtgtcctgggtcactgtggctggtgaggacctcaaggaccccatcaagtgtacacagcagcagcaaaatcaagggatgaccctcctctggggccccctgtcctcagcacattccaggcagctgtgccctgacccacagggacccgtggggatgggaggaggtccaggcctgtgttgccagagctggcagtgtgagctgtaggcagggacggggagggactgtcgctgtgatcagagtgggttaagctgaccaggaacacccatttaacccctttttctttttgctttcatttttataaaggaaaagaggacctgtcagataggcagccccatgctacgtgattctttatgttgtgttgttttgttttgtaaattgtataatttttaaatatctgagttttaaaaaaagaaaaaagtacaaaaaaatcttgttatggccttaagaaggggttagtgcatctttcaggggtcactctgccatggggataaaatagctgtttcacaaacagttttattta

SEQ ID NO: 86635 - DNA, 1556 bp, Homo sapiens
tgaatgtctcctgtttgtcggtcaggactgactctgccttttctttccttttccatgtgccactcctgtcctccctttgccctccctgatttctgcactgtcctctcccacctgtctgtctcctcttggttttgcccgtgtcagcctccccttccgtgccctctcccccccttgcagaacaagaccgcgaaaggcagcctcagcacagagcagtcggagcgggggtgaggggggcagtgtgctcgtgggaatggaaaggacagcaagcacaggtgagactgtggagatgagaaggtggtggacactcgtgatggaatggaaatcgtcctaccgtgcagccacaccctgccctgccccgccccgccccgcccgcgtgcctgcccatgccagcacttccttaagttctcacatcacactcaaaccagtgacaccacaggaaagaaagacccaagacgttggaatggctgtttccatggacacaatctccatagtgacaatgtggggggaggggggaggggtgggatgatggggaaagggtggggggaattaaaagggagggataaatatatatatataaatctatttttagtctggaaagactttgtttaaatgaaaggtgcgctatcccttttgattctgttttaaaattatctcgttaaagatctccaaatttgttccgatgacaagtgaaatttaaatgtgagattgaactgaacaaaccctcatctcatgaaggacggggtgtgtgtgtggcgttgatctttagcctgtctcacaccagttcagaaaacactagacccaggattgaaaaagcaaaccacagcagaaccatccttttgtcattaatttgtctcaaagtgggaaggttttgggggagggggaaatacagggatggtccatgttttcaagagtaggggaatgatgtttaaacacaaaaataaattttttttcatttccagaaacactatttatttatggttttttttttttaattttttctttttgggggtgaaattggcagatgcctgaggtcatagctgtgtcctgggtcactgtggctggtgaggacctcaaggaccccatcaagtgtacacagcagcagcaaaatcaagggatgaccctcctctggggccccctgtcctcagcacattccaggcagctgtgccctgacccacagggacccgtggggatgggaggaggtccaggcctgtgttgccagagctggcagtgtgagctgtaggcagggacggggagggactgtcgctgtgatcagagtgggttaagctgaccaggaacacccatttaacccctttttctttttgctttcatttttataaaggaaaagaggacctgtcagataggcagccccatgctacgtgattctttatgttgtgttgttttgttttgtaaattgtataatttttaaatatctgagttttaaaaaaagaaaaaagtacaaaaaaatcttgttatggccttaagaaggggttagtgcatctttcaggggtcactctgccatggggataaaatagctgtttcacaaacagttttattta

SEQ ID NO: 86636 - DNA, 5642 bp, Homo sapiens
ttcatctgggcctctgattcatctttattccctccatcatctagacttgattttatttgtaccaaggagatgcgtgtctaatgtttttctttcttctatttctaggagggctgttggcctgctgctgtgctgctgaacagtatgcagtcctttcgggagcaaagcagttaccacggaaaccagcaaagctacccacaggaggtacacggctcatcccggctagaagagttcagccctcgtcaggcccagatgttccagaattttggaggtacaggtggcagtagtggcagcagtggcagtggcagtggtggtggacgacgaggagcagcagctgctgcggcagcgatggctagcgagacctctggccatcaaggttaccagggtttcaggaaagaggctggagatttttactacatggcaggcaacaaagaccccgtgactacaggaaccccacagcctcctcagcgaaggccttctgggcctgtgcagagctatggacccccccaggggagcagctttggcaatcagtatgggagtgagggtcatgtgggccagtttcaagcacagcactctggccttggcggtgtgtcacattatcagcaggattacactgggcctttctctccagggagtgctcagtaccaacagcaggcttccagccagcagcagcagcagcaagtccagcagttgagacaacagctttaccagtcccatcagcccctgccacaggccactggccaaccagcatccagctcatcccatctacagccaatgcagcggccctcaactctgccatcctctgctgctggttaccagttaagagtgggtcagtttggccaacactatcagtcttctgcttcctcctcctcctcctcctccttcccttcaccacagcgttttagccagtctggacagagctatgatggcagttacaatgtgaatgctggatctcagtatgaaggacacaatgtgggttctaatgcacaggcttatggaacacaatccaattacagctatcagcctcaatctatgaagaattttgaacaggcaaagattccacaagggacccaacaggggcagcagcagcagcaaccgcagcaacaacaacacccttctcagcatgtgatgcagtatactaacgctgccaccaagctgcccctgcaaagccaagtggggcagtacaaccagcctgaggttcctgtgaggtcccccatgcagtttcaccagaacttcagccccatttctaacccttctccagctgcctctgtggttcagtctccaagctgtagttctaccccatctcctctcatgcagactggggagaatctccagtgtgggcaaggcagtgtgcctatgggttccagaaacagaattttacagttaatgcctcaactcagtccaaccccatcaatgatgcccagtcctaattctcatgctgcaggcttcaaagggtttggactagaaggggtaccagaaaagcgactgacagatcctgggttgagtagtttgagtgctctgagtactcaagtggccaatcttcctaacactgtccagcacatgttactttctgatgccctgactcctcagaagaagacctccaagaggccctcatcttccaagaaagcagatagctgcacaaattctgaaggctcctcacaacctgaagaacagctgaagtcccctatggcagagtcattagatggaggctgctccagcagttcagaggatcaaggcgagagagtgcggcaactaagtggccagagcaccagctctgacaccacctacaagggtggagcctctgagaaagctggctcctcaccggcacaaggtgctcagaatgaaccccccagactcaatgctagtcctgccgcaagagaagaggccacctcaccaggcgctaaggacatgccattgtcatccgacgggaacccaaaggttaatgagaagactgttggggtgattgtctcccgggaagccatgacaggtcgggtagaaaagcctggtggacaagataaaggctcccaagaggatgatcctgcagccactcaaaggccacctagcaatggtggggcaaaggaaaccagtcatgcatcacttccccagccagagcctccaggaggaggagggagcaaaggaaacaagaatggcgataacaactccaaccataatggagaaggaaatggccagagtggccactctgcagcgggccctggttttacgagcagaactgagcctagcaaatctcctggaagtctgcgctatagttacaaagatagtttcgggtcagccgtgccacgaaatgtcagtggctttcctcagtatcctacagggcaagaaaagggagatttcactggccatggggaacgaaagggtagaaatgaaaaattcccaagcctcctgcaggaagtgcttcagggttaccaccaccaccctgacaggagatattctaggagtactcaagagcatcaggggatggctggtagcctagaaggaaccacaaggcccaatgtcttggttagtcaaaccaatgaattagctagcaggggccttctgaacaaaagcattgggtctctattagaaaatccccactggggcccctgggaaaggaaatcaagcagcacagctcctgaaatgaaacagatcaatttgactgactatccaattcccagaaagtttgaaatagagcctcagtcatcagcacatgagcctgggggttccctctctgaaagaagatcagtgatctgtgatatttctccactaagacagattgtcagggacccaggggctcactcactgggacacatgagtgccgacaccagaattgggaggaatgaccgtctcaatccaactttaagtcagtcggtcattcttcctggtggtttggtgtccatggaaaccaagctgaaatcccagagcgggcagataaaagaggaagactttgaacagtctaaatctcaagctagtttcaacaacaagaaatctggagaccactgccatcctcctagcatcaagcatgagtcttaccgcggcaatgccagccctggagcagcaacccatgattccctttcagactatggcccgcaagacagcagacccacgccaatgcggcgggtccctggcagagttggtggtcgggagggcatgaggggtcggtccccttctcaatatcatgactttgcagaaaaattgaaaatgtctcctgggcggagcagaggcccagggggagaccctcatcacatgaatccacacatgaccttttcagagagggctaaccggagttctttacacactcccttttctcccaactcagaaaccctggcctctgcttatcatgcaaatactcgggctcatgcttatggggaccctaacgcaggtttgaattctcagctgcattataagagacagatgtaccaacagcaaccagaggagtataaagactggagcagcggttctgctcagggagtaattgctgcagcacagcacaggcaggaggggccacggaagagtccaaggcagcagcagtttcttgacagagtacggagccctctgaaaaatgacaaagatggtatgatgtatggcccaccagtggggacttaccatgaccccagtgcccaggaggctgggcgctgcctaatgtctagtgatggtctgcctaacaagggcatggaattaaagcatggctcccagaagttacaagaatcctgttgggatctttctcggcaaacttctccagccaaaagcagcggtcctccaggaatgtccagtcaaaaaaggtatgggccgccccatgagactgatggacatggactagctgaggctacacagtcatccaaacctggtagtgttatgctgagacttccaggccaggaggatcattcttctcaaaaccccttaatcatgaggaggcgtgttcgttcttttatctctcccattcccagtaagagacagtcacaagatgtaaagaacagtagcactgaagataaaggtcgcctccttcactcatcaaaagaaggcgctgataaagcattcaattcctatgcccatctttctcacagtcaggatatcaagtctatccctaagagagattcctccaaggaccttccaagtccagatagtagaaactgccctgctgttaccctcacaagccctgctaagaccaaaatactgcccccacggaaaggacggggattgaaattggaagctatagttcagaagattacatccccaaatattaggaggagcgcatcttcgaacagtgcggaggctgggggagacacggttacgcttgatgatatactgtctttgaagagtggtcctcctgaaggtgggagtgttgctgttcaggatgctgacatagagaagagaaaaggtgaggtggcttcggacctagtcagtccagcaaaccaggagttgcacgtagagaaacctcttccaaggtcttcagaagagtggcgtggcagcgtggatgacaaagtgaagacagagacacatgcagaaacagttactgccggaaaggaaccccctggtgccatgacatccacaacctcacagaagcctggtagtaaccaagggagaccagatggttccctgggtggaacagcacctttaatctttccagactcaaagaatgtacctccagtgggcatattggcccctgaggcaaaccccaaggctgaagagaaggagaacgatacagtgacgatttcaccgaagcaagagggtttccctccaaagggatatttcccatcaggaaagaagaaggggagacccattggtagtgtgaataagcaaaagaaacagcagcagccaccgcctccaccccctcagcccccacagataccagaaggttctgcagatggagagccaaagccaaaaaaacagaggcaaaggagggagagaaggaagcctggggcccagccgaggaagcgaaaaaccaaacaagcagttcccattgtggaaccccaagaacctgagatcaaactaaaatatgccacccagccactggataaaactgatgccaagaacaagtctttttacccttacatccatgtagtaaataagtgtgaacttggagccgtttgtacaatcatcaatgctgaggaagaagaacagaccaaattagtgaggggcaggaagggtcagaggtcactgacccctccacctagcagcactgaaagcaaggcgctcccggcctcgtcctttatgctgcagggacctgttgtgacagagtcttcggttatggggcacctggtttgctgtctgtgtggcaagtgggccagttaccggaacatgggtgacctctttggacctttttatccccaagattatgcagccactctcccgaagaatccacctcctaagagggccacagaaatgcagaacacccatttaacccctttttctttttgctttcatttttataaaggaaaagaggacctgtcagataggcagccccatgctacgtgattctttatgttgtgttgttttgttttgtaaattgtataatttttaaatatctgagttttaaaaaaagaaaaaagtacaaaaaaatcttgttatggccttaagaaggggttagtgcatctttcaggggtcactctgccatggggataaaatagctgtttcacaaacagttttattta

SEQ ID NO: 86637 - DNA, 545 bp, Homo sapiens
  misc_feature (41)..(42): n is a, c, g, or t
  misc_feature (459)..(459): n is a, c, g, or t
  misc_feature (492)..(492): n is a, c, g, or t
aggtagatctagaggatcccaagtacccacctgcactgtcnnaggggctcccttgtaaaaaagcagccactgagggcagcagtgaaaagactgttttggactcgaagccctccgtgcccaccacttcagaaggtggccctgagctggagttacaaatccctgaactacctcttgacagcaatgaattttgggtccatgagggttgtattctctgggccaatggaatctacctggtttgtggcaggctctatggcctgcaggaagcgctggaaatagccagagagatgaaatgttcccactgccaggaggcaggcgccaccttgggctgctacaacaaaggctgctccttccgataccattacccgtgtgccattgatgcaggacctttctacgagaaaataaaccttgtataaagtataccggacactacttcataaccactttactctactccttctnccggggatgtgggggggtggatcgattctgtgngggacacactggcactgcagtagggaagctgttgacgcttgcaggtgggtact

SEQ ID NO: 86638 - DNA, 5400 bp, Homo sapiens
cgtataatgaacgcccgcgatactctatgctcttcccgtgcgcgcgagactaggctagctctacctcgaggcgctcatgacgtgcctctgtcatcctactcgaacctccacgttaatgaaactactgtcgtggtaattgtctcccgggcatcctttaccggtcttgtgtcttagaacccctctcgcgataaaggctcccaagaggatgatcctgcagccactcaaaggccacctagcaatggtggggcaaaggaaaccagtcatgcatcacttccccagccagagcctccaggaggaggagggagcaaaggaaacaagaatggcgataacaactccaaccataatggagaaggaaatggccagagtggccactctgcagcgggccctggttttacgagcagaactgagcctagcaaatctcctggaagtctgcgctatagttacaaagatagtttcgggtcagccgtgccacgaaatgtcagtggctttcctcagtatcctacagggcaagaaaagggagatttcactggccatggggaacgaaagggtagaaatgaaaaattcccaagcctcctgcaggaagtgcttcagggttaccaccaccaccctgacaggagatattctaggagtactcaagagcatcaggggatggctggtagcctagaaggaaccacaaggcccaatgtcttggttagtcaaaccaatgaattagctagcaggggccttctgaacaaaagcattgggtctctattagaaaatccccactggggcccctgggaaaggaaatcaagcagcacagctcctgaaatgaaacagatcaatttgactgactatccaattcccagaaagtttgaaatagagcctcagtcatcagcacatgagcctgggggttccctctctgaaagaagatcagtgatctgtgatatttctccactaagacagattgtcagggacccaggggctcactcactgggacacatgagtgccgacaccagaattgggaggaatgaccgtctcaatccaactttaagtcagtcggtcattcttcctggtggtttggtgtccatggaaaccaagctgaaatcccagagcgggcagataaaagaggaagactttgaacagtctaaatctcaagctagtttcaacaacaagaaatctggagaccactgccatcctcctagcatcaagcatgagtcttaccgcggcaatgccagccctggagcagcaacccatgattccctttcagactatggcccgcaagacagcagacccacgccaatgcggcgggtccctggcagagttggtggtcgggagggcatgaggggtcggtccccttctcaatatcatgactttgcagaaaaattgaaaatgtctcctgggcggagcagaggcccagggggagaccctcatcacatgaatccacacatgaccttttcagagagggctaaccggagttctttacacactcccttttctcccaactcagaaaccctggcctctgcttatcatgcaaatactcgggctcatgcttatggggaccctaacgcaggtttgaattctcagctgcattataagagacagatgtaccaacagcaaccagaggagtataaagactggagcagcggttctgctcagggagtaattgctgcagcacagcacaggcaggaggggccacggaagagtccaaggcagcagcagtttcttgacagagtacggagccctctgaaaaatgacaaagatggtatgatgtatggcccaccagtggggacttaccatgaccccagtgcccaggaggctgggcgctgcctaatgtctagtgatggtctgcctaacaagggcatggaattaaagcatggctcccagaagttacaagaatcctgttgggatctttctcggcaaacttctccagccaaaagcagcggtcctccaggaatgtccagtcaaaaaaggtatgggccgccccatgagactgatggacatggactagctgaggctacacagtcatccaaacctggtagtgttatgctgagacttccaggccaggaggatcattcttctcaaaaccccttaatcatgaggaggcgtgttcgttcttttatctctcccattcccagtaagagacagtcacaagatgtaaagaacagtagcactgaagataaaggtcgcctccttcactcatcaaaagaaggcgctgataaagcattcaattcctatgcccatctttctcacagtcaggatatcaagtctatccctaagagagattcctccaaggaccttccaagtccagatagtagaaactgccctgctgttaccctcacaagccctgctaagaccaaaatactgcccccacggaaaggacggggattgaaattggaagctatagttcagaagattacatccccaaatattaggaggagcgcatcttcgaacagtgcggaggctgggggagacacggttacgcttgatgatatactgtctttgaagagtggtcctcctgaaggtgggagtgttgctgttcaggatgctgacatagagaagagaaaaggtgaggtggcttcggacctagtcagtccagcaaaccaggagttgcacgtagagaaacctcttccaaggtcttcagaagagtggcgtggcagcgtggatgacaaagtgaagacagagacacatgcagaaacagttactgccggaaaggaaccccctggtgccatgacatccacaacctcacagaagcctggtagtaaccaagggagaccagatggttccctgggtggaacagcacctttaatctttccagactcaaagaatgtacctccagtgggcatattggcccctgaggcaaaccccaaggctgaagagaaggagaacgatacagtgacgatttcaccgaagcaagagggtttccctccaaagggatatttcccatcaggaaagaagaaggggagacccattggtagtgtgaataagcaaaagaaacagcagcagccaccgcctccaccccctcagcccccacagataccagaaggttctgcagatggagagccaaagccaaaaaaacagaggcaaaggagggagagaaggaagcctggggcccagccgaggaagcgaaaaaccaaacaagcagttcccattgtggaaccccaagaacctgagatcaaactaaaatatgccacccagccactggataaaactgatgccaagaacaagtctttttacccttacatccatgtagtaaataagtgtgaacttggagccgtttgtacaatcatcaatgctgaggaagaagaacagaccaaattagtgaggggcaggaagggtcagaggtcactgacccctccacctagcagcactgaaagcaaggcgctcccggcctcgtcctttatgctgcagggacctgttgtgacagagtcttcggttatggggcacctggtttgctgtctgtgtggcaagtgggccagttaccggaacatgggtgacctctttggacctttttatccccaagattatgcagccactctcccgaagaatccacctcctaagagggccacagaaatgcagagcaaagttaaggtacggcacaaaagtgcttctaatggctccaagacggacactgaggaggaggaagagcagcagcagcagcagaaggagcagagaagcctggccgcacaccccaggtttaagcggcgccaccgctcggaagactgtggtggaggccctcggtccctgtccagggggctcccttgtaaaaaagcagccactgagggcagcagtgaaaagactgttttggactcgaagccctccgtgcccaccacttcagaaggtggccctgagctggagttacaaatccctgaactacctcttgacagcaatgaattttgggtccatgagggttgtattctctgggccaatggaatctacctggtttgtggcaggctctatggcctgcaggaagcgctggaaatagccagagagatgaaatgttcccactgccaggaggcaggcgccaccttgggctgctacaacaaaggctgctccttccgataccattacccgtgtgccattgatgcagattgtttgctacatgaggagaacttctcggtgaggtgccctaagcacaaggtgagactgtggagatgagaaggtggtggacactcgtgatggaatggaaatcgtcctaccgtgcagccacaccctgccctgccccgccccgccccgcccgcgtgcctgcccatgccagcacttccttaagttctcacatcacactcaaaccagtgacaccacaggaaagaaagacccaagacgttggaatggctgtttccatggacacaatctccatagtgacaatgtggggggaggggggaggggtgggatgatggggaaagggtggggggaattaaaagggagggataaatatatatatataaatctatttttagtctggaaagactttgtttaaatgaaaggtgcgctatcccttttgattctgttttaaaattatctcgttaaagatctccaaatttgttccgatgacaagtgaaatttaaatgtgagattgaactgaacaaaccctcatctcatgaaggacggggtgtgtgtgtggcgttgatctttagcctgtctcacaccagttcagaaaacactagacccaggattgaaaaagcaaaccacagcagaaccatccttttgtcattaatttgtctcaaagtgggaaggttttgggggagggggaaatacagggatggtccatgttttcaagagtaggggaatgatgtttaaacacaaaaataaattttttttcatttccagaaacactatttatttatggttttttttttttaattttttctttttgggggtgaaattggcagatgcctgaggtcatagctgtgtcctgggtcactgtggctggtgaggacctcaaggaccccatcaagtgtacacagcagcagcaaaatcaagggatgaccctcctctggggccccctgtcctcagcacattccaggcagctgtgccctgacccacagggacccgtggggatgggaggaggtccaggcctgtgttgccagagctggcagtgtgagctgtaggcagggacggggagggactgtcgctgtgatcagagtgggttaagctgaccaggaacacccatttaacccctttttctttttgctttcatttttataaaggaaaagaggacctgtcagataggcagccccatgctacgtgattctttatgttgtgttgttttgttttgtaaattgtataatttttaaatatctgagttttaaaaaaagaaaaaagtacaaaaaaatcttgttatggccttaagaaggggttagtgcatctttcaggggtcactctgccatggggataaaatagctgtttcacaaacagttttattta

SEQ ID NO: 86639 - DNA, 7286 bp, Homo sapiens
ttcatctgggcctctgattcatctttattccctccatcatctagacttgattttatttgtaccaaggagatgcgtgtctaatgtttttctttcttctatttctaggagggctgttggcctgctgctgtgctgctgaacagtatgcagtcctttcgggagcaaagcagttaccacggaaaccagcaaagctacccacaggaggtacacggctcatcccggctagaagagttcagccctcgtcaggcccagatgttccagaattttggaggtacaggtggcagtagtggcagcagtggcagtggcagtggtggtggacgacgaggagcagcagctgctgcggcagcgatggctagcgagacctctggccatcaaggttaccagggtttcaggaaagaggctggagatttttactacatggcaggcaacaaagaccccgtgactacaggaaccccacagcctcctcagcgaaggccttctgggcctgtgcagagctatggacccccccaggggagcagctttggcaatcagtatgggagtgagggtcatgtgggccagtttcaagcacagcactctggccttggcggtgtgtcacattatcagcaggattacactgggcctttctctccagggagtgctcagtaccaacagcaggcttccagccagcagcagcagcagcaagtccagcagttgagacaacagctttaccagtcccatcagcccctgccacaggccactggccaaccagcatccagctcatcccatctacagccaatgcagcggccctcaactctgccatcctctgctgctggttaccagttaagagtgggtcagtttggccaacactatcagtcttctgcttcctcctcctcctcctcctccttcccttcaccacagcgttttagccagtctggacagagctatgatggcagttacaatgtgaatgctggatctcagtatgaaggacacaatgtgggttctaatgcacaggcttatggaacacaatccaattacagctatcagcctcaatctatgaagaattttgaacaggcaaagattccacaagggacccaacaggggcagcagcagcagcaaccgcagcaacaacaacacccttctcagcatgtgatgcagtatactaacgctgccaccaagctgcccctgcaaagccaagtggggcagtacaaccagcctgaggttcctgtgaggtcccccatgcagtttcaccagaacttcagccccatttctaacccttctccagctgcctctgtggttcagtctccaagctgtagttctaccccatctcctctcatgcagactggggagaatctccagtgtgggcaaggcagtgtgcctatgggttccagaaacagaattttacagttaatgcctcaactcagtccaaccccatcaatgatgcccagtcctaattctcatgctgcaggcttcaaagggtttggactagaaggggtaccagaaaagcgactgacagatcctgggttgagtagtttgagtgctctgagtactcaagtggccaatcttcctaacactgtccagcacatgttactttctgatgccctgactcctcagaagaagacctccaagaggccctcatcttccaagaaagcagatagctgcacaaattctgaaggctcctcacaacctgaagaacagctgaagtcccctatggcagagtcattagatggaggctgctccagcagttcagaggatcaaggcgagagagtgcggcaactaagtggccagagcaccagctctgacaccacctacaagggtggagcctctgagaaagctggctcctcaccggcacaaggtgctcagaatgaaccccccagactcaatgctagtcctgccgcaagagaagaggccacctcaccaggcgctaaggacatgccattgtcatccgacgggaacccaaaggttaatgagaagactgttggggtgattgtctcccgggaagccatgacaggtcgggtagaaaagcctggtggacaagataaaggctcccaagaggatgatcctgcagccactcaaaggccacctagcaatggtggggcaaaggaaaccagtcatgcatcacttccccagccagagcctccaggaggaggagggagcaaaggaaacaagaatggcgataacaactccaaccataatggagaaggaaatggccagagtggccactctgcagcgggccctggttttacgagcagaactgagcctagcaaatctcctggaagtctgcgctatagttacaaagatagtttcgggtcagccgtgccacgaaatgtcagtggctttcctcagtatcctacagggcaagaaaagggagatttcactggccatggggaacgaaagggtagaaatgaaaaattcccaagcctcctgcaggaagtgcttcagggttaccaccaccaccctgacaggagatattctaggagtactcaagagcatcaggggatggctggtagcctagaaggaaccacaaggcccaatgtcttggttagtcaaaccaatgaattagctagcaggggccttctgaacaaaagcattgggtctctattagaaaatccccactggggcccctgggaaaggaaatcaagcagcacagctcctgaaatgaaacagatcaatttgactgactatccaattcccagaaagtttgaaatagagcctcagtcatcagcacatgagcctgggggttccctctctgaaagaagatcagtgatctgtgatatttctccactaagacagattgtcagggacccaggggctcactcactgggacacatgagtgccgacaccagaattgggaggaatgaccgtctcaatccaactttaagtcagtcggtcattcttcctggtggtttggtgtccatggaaaccaagctgaaatcccagagcgggcagataaaagaggaagactttgaacagtctaaatctcaagctagtttcaacaacaagaaatctggagaccactgccatcctcctagcatcaagcatgagtcttaccgcggcaatgccagccctggagcagcaacccatgattccctttcagactatggcccgcaagacagcagacccacgccaatgcggcgggtccctggcagagttggtggtcgggagggcatgaggggtcggtccccttctcaatatcatgactttgcagaaaaattgaaaatgtctcctgggcggagcagaggcccagggggagaccctcatcacatgaatccacacatgaccttttcagagagggctaaccggagttctttacacactcccttttctcccaactcagaaaccctggcctctgcttatcatgcaaatactcgggctcatgcttatggggaccctaacgcaggtttgaattctcagctgcattataagagacagatgtaccaacagcaaccagaggagtataaagactggagcagcggttctgctcagggagtaattgctgcagcacagcacaggcaggaggggccacggaagagtccaaggcagcagcagtttcttgacagagtacggagccctctgaaaaatgacaaagatggtatgatgtatggcccaccagtggggacttaccatgaccccagtgcccaggaggctgggcgctgcctaatgtctagtgatggtctgcctaacaagggcatggaattaaagcatggctcccagaagttacaagaatcctgttgggatctttctcggcaaacttctccagccaaaagcagcggtcctccaggaatgtccagtcaaaaaaggtatgggccgccccatgagactgatggacatggactagctgaggctacacagtcatccaaacctggtagtgttatgctgagacttccaggccaggaggatcattcttctcaaaaccccttaatcatgaggaggcgtgttcgttcttttatctctcccattcccagtaagagacagtcacaagatgtaaagaacagtagcactgaagataaaggtcgcctccttcactcatcaaaagaaggcgctgataaagcattcaattcctatgcccatctttctcacagtcaggatatcaagtctatccctaagagagattcctccaaggaccttccaagtccagatagtagaaactgccctgctgttaccctcacaagccctgctaagaccaaaatactgcccccacggaaaggacggggattgaaattggaagctatagttcagaagattacatccccaaatattaggaggagcgcatcttcgaacagtgcggaggctgggggagacacggttacgcttgatgatatactgtctttgaagagtggtcctcctgaaggtgggagtgttgctgttcaggatgctgacatagagaagagaaaaggtgaggtggcttcggacctagtcagtccagcaaaccaggagttgcacgtagagaaacctcttccaaggtcttcagaagagtggcgtggcagcgtggatgacaaagtgaagacagagacacatgcagaaacagttactgccggaaaggaaccccctggtgccatgacatccacaacctcacagaagcctggtagtaaccaagggagaccagatggttccctgggtggaacagcacctttaatctttccagactcaaagaatgtacctccagtgggcatattggcccctgaggcaaaccccaaggctgaagagaaggagaacgatacagtgacgatttcaccgaagcaagagggtttccctccaaagggatatttcccatcaggaaagaagaaggggagacccattggtagtgtgaataagcaaaagaaacagcagcagccaccgcctccaccccctcagcccccacagataccagaaggttctgcagatggagagccaaagccaaaaaaacagaggcaaaggagggagagaaggaagcctggggcccagccgaggaagcgaaaaaccaaacaagcagttcccattgtggaaccccaagaacctgagatcaaactaaaatatgccacccagccactggataaaactgatgccaagaacaagtctttttacccttacatccatgtagtaaataagtgtgaacttggagccgtttgtacaatcatcaatgctgaggaagaagaacagaccaaattagtgaggggcaggaagggtcagaggtcactgacccctccacctagcagcactgaaagcaaggcgctcccggcctcgtcctttatgctgcagggacctgttgtgacagagtcttcggttatggggcacctggtttgctgtctgtgtggcaagtgggccagttaccggaacatgggtgacctctttggacctttttatccccaagattatgcagccactctcccgaagaatccacctcctaagagggccacagaaatgcagagcaaagttaaggtacggcacaaaagtgcttctaatggctccaagacggacactgaggaggaggaagagcagcagcagcagcagaaggagcagagaagcctggccgcacaccccaggtttaagcggcgccaccgctcggaagactgtggtggaggccctcggtccctgtccagggggctcccttgtaaaaaagcagccactgagggcagcagtgaaaagactgttttggactcgaagccctccgtgcccaccacttcagaaggtggccctgagctggagttacaaatccctgaactacctcttgacagcaatgaattttgggtccatgagggttgtattctctgggccaatggaatctacctggtttgtggcaggctctatggcctgcaggaagcgctggaaatagccagagagatgaaatgttcccactgccaggaggcaggcgccaccttgggctgctacaacaaaggctgctccttccgataccattacccgtgtgccattgatgcagattgtttgctacatgaggagaacttctcggtgaggtgccctaagcacaaggtgagactgtggagatgagaaggtggtggacactcgtgatggaatggaaatcgtcctaccgtgcagccacaccctgccctgccccgccccgccccgcccgcgtgcctgcccatgccagcacttccttaagttctcacatcacactcaaaccagtgacaccacaggaaagaaagacccaagacgttggaatggctgtttccatggacacaatctccatagtgacaatgtggggggaggggggaggggtgggatgatggggaaagggtggggggaattaaaagggagggataaatatatatatataaatctatttttagtctggaaagactttgtttaaatgaaaggtgcgctatcccttttgattctgttttaaaattatctcgttaaagatctccaaatttgttccgatgacaagtgaaatttaaatgtgagattgaactgaacaaaccctcatctcatgaaggacggggtgtgtgtgtggcgttgatctttagcctgtctcacaccagttcagaaaacactagacccaggattgaaaaagcaaaccacagcagaaccatccttttgtcattaatttgtctcaaagtgggaaggttttgggggagggggaaatacagggatggtccatgttttcaagagtaggggaatgatgtttaaacacaaaaataaattttttttcatttccagaaacactatttatttatggttttttttttttaattttttctttttgggggtgaaattggcagatgcctgaggtcatagctgtgtcctgggtcactgtggctggtgaggacctcaaggaccccatcaagtgtacacagcagcagcaaaatcaagggatgaccctcctctggggccccctgtcctcagcacattccaggcagctgtgccctgacccacagggacccgtggggatgggaggaggtccaggcctgtgttgccagagctggcagtgtgagctgtaggcagggacggggagggactgtcgctgtgatcagagtgggttaagctgaccaggaacacccatttaacccctttttctttttgctttcatttttataaaggaaaagaggacctgtcagataggcagccccatgctacgtgattctttatgttgtgttgttttgttttgtaaattgtataatttttaaatatctgagttttaaaaaaagaaaaaagtacaaaaaaatcttgttatggccttaagaaggggttagtgcatctttcaggggtcactctgccatggggataaaatagctgtttcacaaacagttttatttaaaaaaacaaaaaacaaaaaaaatcaaaaaatcaaaaaaataataaacttcattttaaccttg

SEQ ID NO: 86640 - DNA, 6805 bp, Homo sapiens
ttcatctgggcctctgattcatctttattccctccatcatctagacttgattttatttgtaccaaggagatgcgtgtctaatgtttttctttcttctatttctaggagggctgttggcctgctgctgtgctgctgaacagtatgcagtcctttcgggagcaaagcagttaccacggaaaccagcaaagctacccacaggaggtacacggctcatcccggctagaagagttcagccctcgtcaggcccagatgttccagaattttggaggtacaggtggcagtagtggcagcagtggcagtggcagtggtggtggacgacgaggagcagcagctgctgcggcagcgatggctagcgagacctctggccatcaaggttaccagggtttcaggaaagaggctggagatttttactacatggcaggcaacaaagaccccgtgactacaggaaccccacagcctcctcagcgaaggccttctgggcctgtgcagagctatggacccccccaggggagcagctttggcaatcagtatgggagtgagggtcatgtgggccagtttcaagcacagcactctggccttggcggtgtgtcacattatcagcaggattacactgggcctttctctccagggagtgctcagtaccaacagcaggcttccagccagcagcagcagcagcaagtccagcagttgagacaacagctttaccagtcccatcagcccctgccacaggccactggccaaccagcatccagctcatcccatctacagccaatgcagcggccctcaactctgccatcctctgctgctggttaccagttaagagtgggtcagtttggccaacactatcagtcttctgcttcctcctcctcctcctcctccttcccttcaccacagcgttttagccagtctggacagagctatgatggcagttacaatgtgaatgctggatctcagtatgaaggacacaatgtgggttctaatgcacaggcttatggaacacaatccaattacagctatcagcctcaatctatgaagaattttgaacaggcaaagattccacaagggacccaacaggggcagcagcagcagcaaccgcagcaacaacaacacccttctcagcatgtgatgcagtatactaacgctgccaccaagctgcccctgcaaagccaagtggggcagtacaaccagcctgaggttcctgtgaggtcccccatgcagtttcaccagaacttcagccccatttctaacccttctccagctgcctctgtggttcagtctccaagctgtagttctaccccatctcctctcatgcagactggggagaatctccagtgtgggcaaggcagtgtgcctatgggttccagaaacagaattttacagttaatgcctcaactcagtccaaccccatcaatgatgcccagtcctaattctcatgctgcaggcttcaaagggtttggactagaaggggtaccagaaaagcgactgacagatcctgggttgagtagtttgagtgctctgagtactcaagtggccaatcttcctaacactgtccagcacatgttactttctgatgccctgactcctcagaagaagacctccaagaggccctcatcttccaagaaagcagatagctgcacaaattctgaaggctcctcacaacctgaagaacagctgaagtcccctatggcagagtcattagatggaggctgctccagcagttcagaggatcaaggcgagagagtgcggcaactaagtggccagagcaccagctctgacaccacctacaagggtggagcctctgagaaagctggctcctcaccggcacaaggtgctcagaatgaaccccccagactcaatgctagtcctgccgcaagagaagaggccacctcaccaggcgctaaggacatgccattgtcatccgacgggaacccaaaggttaatgagaagactgttggggtgattgtctcccgggaagccatgacaggtcgggtagaaaagcctggtggacaagataaaggctcccaagaggatgatcctgcagccactcaaaggccacctagcaatggtggggcaaaggaaaccagtcatgcatcacttccccagccagagcctccaggaggaggagggagcaaaggaaacaagaatggcgataacaactccaaccataatggagaaggaaatggccagagtggccactctgcagcgggccctggttttacgagcagaactgagcctagcaaatctcctggaagtctgcgctatagttacaaagatagtttcgggtcagccgtgccacgaaatgtcagtggctttcctcagtatcctacagggcaagaaaagggagatttcactggccatggggaacgaaagggtagaaatgaaaaattcccaagcctcctgcaggaagtgcttcagggttaccaccaccaccctgacaggagatattctaggagtactcaagagcatcaggggatggctggtagcctagaaggaaccacaaggcccaatgtcttggttagtcaaaccaatgaattagctagcaggggccttctgaacaaaagcattgggtctctattagaaaatccccactggggcccctgggaaaggaaatcaagcagcacagctcctgaaatgaaacagatcaatttgactgactatccaattcccagaaagtttgaaatagagcctcagtcatcagcacatgagcctgggggttccctctctgaaagaagatcagtgatctgtgatatttctccactaagacagattgtcagggacccaggggctcactcactgggacacatgagtgccgacaccagaattgggaggaatgaccgtctcaatccaactttaagtcagtcggtcattcttcctggtggtttggtgtccatggaaaccaagctgaaatcccagagcgggcagataaaagaggaagactttgaacagtctaaatctcaagctagtttcaacaacaagaaatctggagaccactgccatcctcctagcatcaagcatgagtcttaccgcggcaatgccagccctggagcagcaacccatgattccctttcagactatggcccgcaagacagcagacccacgccaatgcggcgggtccctggcagagttggtggtcgggagggcatgaggggtcggtccccttctcaatatcatgactttgcagaaaaattgaaaatgtctcctgggcggagcagaggcccagggggagaccctcatcacatgaatccacacatgaccttttcagagagggctaaccggagttctttacacactcccttttctcccaactcagaaaccctggcctctgcttatcatgcaaatactcgggctcatgcttatggggaccctaacgcaggtttgaattctcagctgcattataagagacagatgtaccaacagcaaccagaggagtataaagactggagcagcggttctgctcagggagtaattgctgcagcacagcacaggcaggaggggccacggaagagtccaaggcagcagcagtttcttgacagagtacggagccctctgaaaaatgacaaagatggtatgatgtatggcccaccagtggggacttaccatgaccccagtgcccaggaggctgggcgctgcctaatgtctagtgatggtctgcctaacaagggcatggaattaaagcatggctcccagaagttacaagaatcctgttgggatctttctcggcaaacttctccagccaaaagcagcggtcctccaggaatgtccagtcaaaaaaggtatgggccgccccatgagactgatggacatggactagctgaggctacacagtcatccaaacctggtagtgttatgctgagacttccaggccaggaggatcattcttctcaaaaccccttaatcatgaggaggcgtgttcgttcttttatctctcccattcccagtaagagacagtcacaagatgtaaagaacagtagcactgaagataaaggtcgcctccttcactcatcaaaagaaggcgctgataaagcattcaattcctatgcccatctttctcacagtcaggatatcaagtctatccctaagagagattcctccaaggaccttccaagtccagatagtagaaactgccctgctgttaccctcacaagccctgctaagaccaaaatactgcccccacggaaaggacggggattgaaattggaagctatagttcagaagattacatccccaaatattaggaggagcgcatcttcgaacagtgcggaggctgggggagacacggttacgcttgatgatatactgtctttgaagagtggtcctcctgaaggtgggagtgttgctgttcaggatgctgacatagagaagagaaaaggtgaggtggcttcggacctagtcagtccagcaaaccaggagttgcacgtagagaaacctcttccaaggtcttcagaagagtggcgtggcagcgtggatgacaaagtgaagacagagacacatgcagaaacagttactgccggaaaggaaccccctggtgccatgacatccacaacctcacagaagcctggtagtaaccaagggagaccagatggttccctgggtggaacagcacctttaatctttccagactcaaagaatgtacctccagtgggcatattggcccctgaggcaaaccccaaggctgaagagaaggagaacgatacagtgacgatttcaccgaagcaagagggtttccctccaaagggatatttcccatcaggaaagaagaaggggagacccattggtagtgtgaataagcaaaagaaacagcagcagccaccgcctccaccccctcagcccccacagataccagaaggttctgcagatggagagccaaagccaaaaaaacagaggcaaaggagggagagaaggaagcctggggcccagccgaggaagcgaaaaaccaaacaagcagttcccattgtggaaccccaagaacctgagatcaaactaaaatatgccacccagccactggataaaactgatgccaagaacaagtctttttacccttacatccatgtagtaaataagtgtgaacttggagccgtttgtacaatcatcaatgctgaggaagaagaacagaccaaattagtgaggggcaggaagggtcagaggtcactgacccctccacctagcagcactgaaagcaaggcgctcccggcctcgtcctttatgctgcagggacctgttgtgacagagtcttcggttatggggcacctggtttgctgtctgtgtggcaagtgggccagttaccggaacatgggtgacctctttggacctttttatccccaagattatgcagccactctcccgaagaatccacctcctaagagggccacagaaatgcagagcaaagttaaggtacggcacaaaagtgcttctaatggctccaagacggacactgaggaggaggaagagcagcagcagcagcagaaggagcagagaagcctggccgcacaccccaggtttaagcggcgccaccgctcggaagactgtggtggaggccctcggtccctgtccagggggctcccttgtaaaaaagcagccactgagggcagcagtgaaaagactgttttggactcgaagccctccgtgcccaccacttcagaaggtggccctgagctggagttacaaatccctgaactacctcttgacagcaatgaattttgggtccatgagggttgtattctctgggccaatggaatctacctggtttgtggcaggctctatggcctgcaggaagcgctggaaatagccagagagatgaaatgttcccactgccaggaggcaggcgccaccttgggctgctacaacaaaggctgctccttccgataccattacccgtgtgccattgatgcagattgtttgctacatgaggagaacttctcggtgaggtgccctaagcacaaggtgagtcagaggccccaagagctaccagcagggatgggatcgagggtggctcctcctgaaagacctgaagaccaggtgttggtgggcctcacccacacctgtccccacctgtgcctccggctgttagtcccctcctggccctgggagggtggaggggcatgatgctgaagggagacccgtggcatgggggccagcactcggagtattatgaggatcccaggagaaatgtgttttgggagagggggtgtttgtctgttcattaagagaggtgagaatatctaactcgatcaagccactgatttccacttgaggtgaatagaaccccaattcacaggttggcgtttggtaagtctggttctaggccttgaggcctgtgcaaaggcatcttcccagactagaagtcgagctgaccacaaggctctggggaagctcagtctcttccaggttgtgcttctgcagaagcagcctgatgcacagtggatgggctgtctcgggctccacttcccagtttatttaggaggtggtctcgtggtcgcttcctttagaaagggtgggaggtaaggggtgaatggtctgtttgtggataccacatatgtgtgtggggagggtgtatatggagaaggagccccaagaaaggatcagaacggagaccactgccacctgatgtttcctgcaggggctgcactgtgtctctggctgaggtcacactgacacctggtggtcactggtcactcgcagtcttaaatctagtagggccgaaagtactagaaggaggttgtccagagaggtctgccctcaaaatgctcctgaaagatgcttgcttatgcttttctttaaaaattatttctggggaagggcggggagt

SEQ ID NO: 86641 - DNA, 1760 bp, Homo sapiens
tacaagttgaaaaaaaaaaaattatcagcactataaaatagtgattacaatccagggcaaaattcccaaaccccatggcttccctcacactgtcttttctaccattttcattatagaatgcttccaatcttttgtgaaattttttattataaaaaatctatttgtatctatcctaaccagttcggggaaatagccagagagatgaaatgttcccactgccaggaggcaggcgccaccttgggctgctacaacaaaggctgctccttccgataccattacccgtgtgccattgatgcagattgtttgctacatgaggagaacttctcggtgaggtgccctaagcacaagcctccccttccgtgccctctcccccccttgcagaacaagaccgcgaaaggcagcctcagcacagagcagtcggagcgggggtgaggggggcagtgtgctcgtgggaatggaaaggacagcaagcacaggtgagactgtggagatgagaaggtggtggacactcgtgatggaatggaaatcgtcctaccgtgcagccacaccctgccctgccccgccccgccccgcccgcgtgcctgcccatgccagcacttccttaagttctcacatcacactcaaaccagtgacaccacaggaaagaaagacccaagacgttggaatggctgtttccatggacacaatctccatagtgacaatgtggggggaggggggaggggtgggatgatggggaaagggtggggggaattaaaagggagggataaatatatatatataaatctatttttagtctggaaagactttgtttaaatgaaaggtgcgctatcccttttgattctgttttaaaattatctcgttaaagatctccaaatttgttccgatgacaagtgaaatttaaatgtgagattgaactgaacaaaccctcatctcatgaaggacggggtgtgtgtgtggcgttgatctttagcctgtctcacaccagttcagaaaacactagacccaggattgaaaaagcaaaccacagcagaaccatccttttgtcattaatttgtctcaaagtgggaaggttttgggggagggggaaatacagggatggtccatgttttcaagagtaggggaatgatgtttaaacacaaaaataaattttttttcatttccagaaacactatttatttatggttttttttttttaattttttctttttgggggtgaaattggcagatgcctgaggtcatagctgtgtcctgggtcactgtggctggtgaggacctcaaggaccccatcaagtgtacacagcagcagcaaaatcaagggatgaccctcctctggggccccctgtcctcagcacattccaggcagctgtgccctgacccacagggacccgtggggatgggaggaggtccaggcctgtgttgccagagctggcagtgtgagctgtaggcagggacggggagggactgtcgctgtgatcagagtgggttaagctgaccaggaacacccatttaacccctttttctttttgctttcatttttataaaggaaaagaggacctgtcagataggcagccccatgctacgtgattctttatgttgtgttgttttgttttgtaaattgtataatttttaaatatctgagttttaaaaaaagaaaaaagtacaaaaaaatcttgttatggccttaagaaggggttagtgcatctttcaggggtcactctgccatggggataaaatagctgtttcacaaacagttttattta

SEQ ID NO: 86642 - DNA, 1772 bp, Homo sapiens
  misc_feature (5)..(7): n is a, c, g, or t
ggacnnngcccttaactgcttgggaaatgtgacctttgctctggggggcctggccctgcaggccccaaccttccctcatctctggcggccctcttgggcctctgacccagcccctccccgggccaggctcacagaagctggcttctgggactgtcctgggcccaagtgggcacctgcgccagccccacctgtgcctgggctgtggccccttcctacagggcgctcaccatggccccgccgctcctgctgctgctgctggccagtggagcggccgcctgcccgctgccctgcgtctgccagaacctgtccgagtcgctcagcaccctctgtgcccaccgaggcctgctgtttgtgccgcccaacgtggaccggcgcacagtggagctgcggctggctgacaacttcatccaggccctggggccccctgacttccgcaacatgacgggactggtggacctgacactgtctcgcaatgccatcacccgcattggggcccgcgcctttggggacctcgagagcctgcgttccctccaccttgacggcaacaggctggtggagctgggcaccgggagcctccggggccccgtcaatctgcagcacctcatcctcagcggcaaccagctgggccgcatcgcgccgggagccttcgacgacttcctagagagcctggaggacctggacctgtcctacaacaacctccggcaggtgccctgggccggcatcggcgccatgcctgccctgcacaccctcaacctggaccataaccttattgacgcactgcccccaggcgccttcgcccagctcggtcagctctcccgcctggacctcacctccaaccgcctggccacgctggctccggacccgcttttctctcgtgggcgtgatgcagaggcctctcccgcccccctggtgctgagctttagcgggaaccccctgcactgcaactgtgagctgctgtggctgcggcggctggcgcggccggacgacctggaaacgtgcgcctccccgcccggcctggccggccgctacttctgggcagtgcccgagggcgagttctcctgtgagccgcccctcattgcccgccacacgcagcgcctctgggtgctggaaggccagcgggccacgctgcggtgccgggccctgggtgaccccgcgcctaccatgcactgggtcggtcctgacgaccggttggttggcaactcctcccgagcccgggctttccccaacgggaccttagagattggggtgaccggcgctggggacgctgggggctacacctgcatcgccaccaaccctgctggtgaggccacagcccgagtagaactgcgggtgctggccttgccccatggtgggaacagcagtgccgaggggggccgccccgggccctcggacatcgccgcctccgctcgcactgctgccgagggtgaggggacgctggagtctgagccagccgtgcaggtgacggaggtgaccgccacctcagggctggtgagctggggtcccgggcggccagccgacccagtgtggatgttccaaatccaagggcccggggccgccgcctggcctgggagtccctccctggtttttattctcagtacctcaggctcccctgtgtacttggaggggcagggagccctttcctcggttctggcctccagaccagggtaagggcaggcccctccaacaggtgctcacagccaccgaggcaggggctgcagccacccactgggagtcttgtttttatttataataaaattgttggggacacctca

SEQ ID NO: 86643 - DNA, 2416 bp, Homo sapiens
  misc_feature (5)..(7): n is a, c, g, or t
ggacnnngcccttaactgcttgggaaatgtgacctttgctctggggggcctggccctgcaggccccaaccttccctcatctctggcggccctcttgggcctctgacccagcccctccccgggccaggctcacagaagctggcttctgggactgtcctgggcccaagtgggcacctgcgccagccccacctgtgcctgggctgtggccccttcctacagggcgctcaccatggccccgccgctcctgctgctgctgctggccagtggagcggccgcctgcccgctgccctgcgtctgccagaacctgtccgagtcgctcagcaccctctgtgcccaccgaggcctgctgtttgtgccgcccaacgtggaccggcgcacagtggagctgcggctggctgacaacttcatccaggccctggggccccctgacttccgcaacatgacgggactggtggacctgacactgtctcgcaatgccatcacccgcattggggcccgcgcctttggggacctcgagagcctgcgttccctccaccttgacggcaacaggctggtggagctgggcaccgggagcctccggggccccgtcaatctgcagcacctcatcctcagcggcaaccagctgggccgcatcgcgccgggagccttcgacgacttcctagagagcctggaggacctggacctgtcctacaacaacctccggcaggtgccctgggccggcatcggcgccatgcctgccctgcacaccctcaacctggaccataaccttattgacgcactgcccccaggcgccttcgcccagctcggtcagctctcccgcctggacctcacctccaaccgcctggccacgctggctccggacccgcttttctctcgtgggcgtgatgcagaggcctctcccgcccccctggtgctgagctttagcgggaaccccctgcactgcaactgtgagctgctgtggctgcggcggctggcgcggccggacgacctggaaacgtgcgcctccccgcccggcctggccggccgctacttctgggcagtgcccgagggcgagttctcctgtgagccgcccctcattgcccgccacacgcagcgcctctgggtgctggaaggccagcgggccacgctgcggtgccgggccctgggtgaccccgcgcctaccatgcactgggtcggtcctgacgaccggttggttggcaactcctcccgagcccgggctttccccaacgggaccttagagattggggtgaccggcgctggggacgctgggggctacacctgcatcgccaccaaccctgctggtgaggccacagcccgagtagaactgcgggtgctggccttgccccatggtgggaacagcagtgccgaggggggccgccccgggccctcggacatcgccgcctccgctcgcactgctgccgagggtgaggggacgctggagtctgagccagccgtgcaggtgacggaggtgaccgccacctcagggctggtgagctggggtcccgggcggccagccgacccagtgtggatgttccaaatccagtacaacagcagcgaagatgagaccctcatctaccggattgtcccagcctccagccaccacttcctgctgaagcacctcgtccccggcgctgactatgacctctgcctgctggccttgtcaccggccgctgggccctctgacctcacggccaccaggctgctgggctgtgcccatttctccacgctgccggcctcgcccctgtgccacgccctgcaggcccacgtgctgggcgggaccctgaccgtggccgtggggggtgtgctggtggctgccttactggtcttcactgtggccttgctggttcggggccggggggccggaaatggccgcctccccctcaagctcagccacgtccagtcccagaccaatggaggccccagccccacacccaaggcccacccgccgcggagccccccgccccggccgcagcgcagctgctctctggacctgggagatgccgggtgctacggttatgccaggcgcctgggaggagcttgggcccgacggagccactctgtgcatggggggctgctcggggcagggtgccggggggtaggaggcagcgccgagcggctggaagagagtgtggtgtgatggacgggcagcttcctgtgtgctccaagggatgagcctcgtggggcagagggcccggggccgccgcctggcctgggagtccctccctggtttttattctcagtacctcaggctcccctgtgtacttggaggggcagggagccctttcctcggttctggcctccagaccagggtaagggcaggcccctccaacaggtgctcacagccaccgaggcaggggctgcagccacccactgggagtcttgtttttatttataataaaattgttggggacacctca

SEQ ID NO: 86644 - DNA, 1208 bp, Homo sapiens
ggctggagctcaaggggcggcagaaggaccccaccccgagatgtcccaggtgtcactgagctgtgcaggcctccccggcagcaggtggcggttgggtctgtctgaagcacatggcccgcgcccgcgtgttatttctgcctctgctggtgccatccccccaccccattcccctcgcttgcctgcgtcctgtgccagtgcacacacccatctcctggccacactctccagcctgttcaccttcctgagtgaacccaagagcccgagtggccccagggggaggggtgtttggagctgggagcacgggagtggggaggtgaggatggggctagaccccagccccgggctctgaccacctgcccttgcctgcaggattgtcccagcctccagccaccacttcctgctgaagcacctcgtccccggcgctgactatgacctctgcctgctggccttgtcaccggccgctgggccctctgacctcacggccaccaggctgctgggctgtgcccatttctccacgctgccggcctcgcccctgtgccacgccctgcaggcccacgtgctgggcgggaccctgaccgtggccgtggggggtgtgctggtggctgccttactggtcttcactgtggccttgctggttcggggccggggggccggaaatggccgcctccccctcaagctcagccacgtccagtcccagaccaatggaggccccagccccacacccaaggcccacccgccgcggagccccccgccccggccgcagcgcagctgctctctggacctgggagatgccgggtgctacggttatgccaggcgcctgggaggagcttgggcccgacggagccactctgtgcatggggggctgctcggggcagggtgccggggggtaggaggcagcgccgagcggctggaagagagtgtggtgtgatggacgggcagcttcctgtgtgctccaagggatgagcctcgtggggcagagggcccggggccgccgcctggcctgggagtccctccctggtttttattctcagtacctcaggctcccctgtgtacttggaggggcagggagccctttcctcggttctggcctccagaccagggtaagggcaggcccctccaacaggtgctcacagccaccgaggcaggggctgcagccacccactgggagtcttgtttttatttataataaaattgttggggacacctca

SEQ ID NO: 86645 - DNA, 849 bp, Homo sapiens
  misc_feature (5)..(7): n is a, c, g, or t
ggacnnngcccttaactgcttgggaaatgtgacctttgctctggggggcctggccctgcaggccccaaccttccctcatctctggcggccctcttgggcctctgacccagcccctccccgggccaggctcacagaagctggcttctgggactgtcctgggcccaagtgggcacctgcgccagccccacctgtgcctgggctgtggccccttcctacagggcgctcaccatggccccgccgctcctgctgctgctgctggccagtggagcggccgcctgcccgctgccctgcgtctgccagaacctgtccgagtcgctcagcaccctctgtgcccaccgaggcctgctgtttgtgccgcccaacgtggaccggcgcacagtggagctgcggctggctgacaacttcatccaggccctggggccccctgacttccgcaacatgacgggactggtggacctgacactgtctcgcaatgccatcacccgcattggggcccgcgcctttggggacctcgagagcctgcgttccctccaccttgacggcaacaggctggtggagctgggcaccgggagcctccggggccccgtcaatctgcagcacctcatcctcagcggcaaccagctgggccgcatcgcgccgggagccttcgacgacttcctagagagcctggaggacctggacctgtcctacaacaacctccggcaggtgccctgggcgatcgggcagctgcctgaacctaaccggacatactattgagcatgcccaggctcgcaatggcagtccggggatcactcacggtgcgcggggtcgacgtttctcgggggatggaggtcccgccggggagtggac

SEQ ID NO: 86646 - DNA, 1638 bp, Homo sapiens
ccacaaatgtgggagggcgataaccactcgtagaaagcgtgagaagttactacaagcggtcctcccggccaccgtactgttccgctcccagaagccccgggcggcggaagtcgtcactcttaagaagggacggggccccacgctgcgcacccgcgggtttgctatggcgatgagcagcggcggcagtggtggcggcgtcccggagcaggaggattccgtgctgttccggcgcggcacaggccagagcgatgattctgacatttgggatgatacagcactgataaaagcatatgataaagctgtggcttcatttaagcatgctctaaagaatggtgacatttgtgaaacttcgggtaaaccaaaaaccacacctaaaagaaaacctgctaagaagaataaaagccaaaagaagaatactgcagcttccttacaacagtggaaagttggggacaaatgttctgccatttggtcagaagacggttgcatttacccagctaccattgcttcaattgattttaagagagaaacctgtgttgtggtttacactggatatggaaatagagaggagcaaaatctgtccgatctactttccccaatctgtgaagtagctaataatatagaacagaatgctcaagagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaagccaggtctaaaattcaatggcccaccaccgccaccgccaccaccaccaccccacttactatcatgctggctgcctccatttccttctggaccaccaataattcccccaccacctcccatatgtccagattctcttgatgatgctgatgctttgggaagtatgttaatttcatggtacatgagtggctatcatactggctattatatgggttttagacaaaatcaaaaagaaggaaggtgctcacattccttaaattaaggagaaatgctggcatagagcagcactaaatgacaccactaaagaaacgatcagacagatctggaatgtgaagcgttatagaagataactggcctcatttcttcaaaatatcaagtgttgggaaagaaaaaaggaagtggaatgggtaactcttcttgattaaaagttatgtaataaccaaatgcaatgtgaaatattttactggactctattttgaaaaaccatctgtaaaagactgaggtgggggtgggaggccagcacggtggtgaggcagttgagaaaatttgaatgtggattagattttgaatgatattggataattattggtaattttatgagctgtgagaagggtgttgtagtttataaaagactgtcttaatttgcatacttaagcatttaggaatgaagtgttagagtgtcttaaaatgtttcaaatggtttaacaaaatgtatgtgaggcgtatgtggcaaaatgttacagaatctaactggtggacatggctgttcattgtactgtttttttctatcttctatatgtttaaaagtatataataaaaatatttaatttttttttaaataaacaaaatctg

SEQ ID NO: 86647 - DNA, 1542 bp, Homo sapiens
ccacaaatgtgggagggcgataaccactcgtagaaagcgtgagaagttactacaagcggtcctcccggccaccgtactgttccgctcccagaagccccgggcggcggaagtcgtcactcttaagaagggacggggccccacgctgcgcacccgcgggtttgctatggcgatgagcagcggcggcagtggtggcggcgtcccggagcaggaggattccgtgctgttccggcgcggcacaggccagagcgatgattctgacatttgggatgatacagcactgataaaagcatatgataaagctgtggcttcatttaagcatgctctaaagaatggtgacatttgtgaaacttcgggtaaaccaaaaaccacacctaaaagaaaacctgctaagaagaataaaagccaaaagaagaatactgcagcttccttacaacagtggaaagttggggacaaatgttctgccatttggtcagaagacggttgcatttacccagctaccattgcttcaattgattttaagagagaaacctgtgttgtggtttacactggatatggaaatagagaggagcaaaatctgtccgatctactttccccaatctgtgaagtagctaataatatagaacagaatgctcaagagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaagataattcccccaccacctcccatatgtccagattctcttgatgatgctgatgctttgggaagtatgttaatttcatggtacatgagtggctatcatactggctattatatgggttttagacaaaatcaaaaagaaggaaggtgctcacattccttaaattaaggagaaatgctggcatagagcagcactaaatgacaccactaaagaaacgatcagacagatctggaatgtgaagcgttatagaagataactggcctcatttcttcaaaatatcaagtgttgggaaagaaaaaaggaagtggaatgggtaactcttcttgattaaaagttatgtaataaccaaatgcaatgtgaaatattttactggactctattttgaaaaaccatctgtaaaagactgaggtgggggtgggaggccagcacggtggtgaggcagttgagaaaatttgaatgtggattagattttgaatgatattggataattattggtaattttatgagctgtgagaagggtgttgtagtttataaaagactgtcttaatttgcatacttaagcatttaggaatgaagtgttagagtgtcttaaaatgtttcaaatggtttaacaaaatgtatgtgaggcgtatgtggcaaaatgttacagaatctaactggtggacatggctgttcattgtactgtttttttctatcttctatatgtttaaaagtatataataaaaatatttaatttttttttaaataaacaaaatctg

SEQ ID NO: 86648 - DNA, 2082 bp, Homo sapiens
ccacaaatgtgggagggcgataaccactcgtagaaagcgtgagaagttactacaagcggtcctcccggccaccgtactgttccgctcccagaagccccgggcggcggaagtcgtcactcttaagaagggacggggccccacgctgcgcacccgcgggtttgctatggcgatgagcagcggcggcagtggtggcggcgtcccggagcaggaggattccgtgctgttccggcgcggcacaggccagagcgatgattctgacatttgggatgatacagcactgataaaagcatatgataaagctgtggcttcatttaagcatgctctaaagaatggtgacatttgtgaaacttcgggtaaaccaaaaaccacacctaaaagaaaacctgctaagaagaataaaagccaaaagaagaatactgcagcttccttacaacagtggaaagttggggacaaatgttctgccatttggtcagaagacggttgcatttacccagctaccattgcttcaattgattttaagagagaaacctgtgttgtggtttacactggatatggaaatagagaggagcaaaatctgtccgatctactttccccaatctgtgaagtagctaataatatagaacagaatgctcaagagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaagccaggtctaaaattcaatggcccaccaccgccaccgccaccaccaccaccccacttactatcatgctggctgcctccatttccttctggaccaccaataattcccccaccacctcccatatgtccagattctcttgatgatgctgatgctttgggaagtatgttaatttcatggtacatgagtggctatcatactggctattatatgggttttagacaaaatcaaaaagaaggaaggtgctcacattccttaaattaaggagtaagtctgccagcattatgaaagtgaatcttacttttgtaaaactttatggtttgtggaaaacaaatgtttttgaacatttaaaaagttcagatgttagaaagttgaaaggttaatgtaaaacaatcaatattaaagaattttgatgccaaaactattagataaaaggttaatctacatccctactagaattctcatacttaactggttggttgtgtggaagaaacatactttcacaataaagagctttaggatatgatgccattttatatcactagtaggcagaccagcagacttttttttattgtgatatgggataacctaggcatactgcactgtacactctgacatatgaagtgctctagtcaagtttaactggtgtccacagaggacatggtttaactggaattcgtcaagcctctggttctaatttctcatttgcaggaaatgctggcatagagcagcactaaatgacaccactaaagaaacgatcagacagatctggaatgtgaagcgttatagaagataactggcctcatttcttcaaaatatcaagtgttgggaaagaaaaaaggaagtggaatgggtaactcttcttgattaaaagttatgtaataaccaaatgcaatgtgaaatattttactggactctattttgaaaaaccatctgtaaaagactgaggtgggggtgggaggccagcacggtggtgaggcagttgagaaaatttgaatgtggattagattttgaatgatattggataattattggtaattttatgagctgtgagaagggtgttgtagtttataaaagactgtcttaatttgcatacttaagcatttaggaatgaagtgttagagtgtcttaaaatgtttcaaatggtttaacaaaatgtatgtgaggcgtatgtggcaaaatgttacagaatctaactggtggacatggctgttcattgtactgtttttttctatcttctatatgtttaaaagtatataataaaaatatttaatttttttttaaataaacaaaatctg

SEQ ID NO: 86649 - DNA, 1496 bp, Homo sapiens
  misc_feature (1482)..(1482): n is a, c, g, or t
ccacaaatgtgggagggcgataaccactcgtagaaagcgtgagaagttactacaagcggtcctcccggccaccgtactgttccgctcccagaagccccgggcggcggaagtcgtcactcttaagaagggacggggccccacgctgcgcacccgcgggtttgctatggcgatgagcagcggcggcagtggtggcggcgtcccggagcaggaggattccgtgctgttccggcgcggcacaggccagagcgatgattctgacatttgggatgatacagcactgataaaagcatatgataaagctgtggcttcatttaagcatgctctaaagaatggtgacatttgtgaaacttcgggtaaaccaaaaaccacacctaaaagaaaacctgctaagaagaataaaagccaaaagaagaatactgcagcttccttacaacagtggaaagttggggacaaatgttctgccatttggtcagaagacggttgcatttacccagctaccattgcttcaattgattttaagagagaaacctgtgttgtggtttacactggatatggaaatagagaggagcaaaatctgtccgatctactttccccaatctgtgaagtagctaataatatagaacagaatgctcaagagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaagccaggtctaaaattcaatggcccaccaccgccaccgccaccaccaccaccccacttactatcatgctggctgcctccatttccttctggaccaccaataattcccccaccacctcccatatgtccagattctcttgatgatgctgatgctttgggaagtatgttaatttcatggtacatgagtggctatcatactggctattatatgggttttagacaaaatcaaaaagaaggaaggtgctcacattccttaaattaaggagaaatgctggcatagagcagcactaaatgacaccactaaagaaacgatcagacagatctggaatgtgaagcgttatagaagataactggcctcatttcttcaaaatatcaagtgttgggaaagaaaaaaggaagtggaatgggtaactcttcttgattaaaagttatgtaataaccaaatgcaatgtgaaatattttactggactctattttgaaaaaccatctgtaaaagactgaggtgggggtgggaggccagcacggtggtgaggcagttgagaaaatttgaatgtggattagattttgaatgatattggataattattggtaattttatgagctgtgagaagggtgttgtagtttataaaagacactctaacacttcattcctaaatgcttaggtatgcaaattaagacgtcttttataaactacancacccttctcacgg

SEQ ID NO: 86650 - DNA, 1628 bp, Homo sapiens
cccaagtgctgggattataggcgtgagccactgtgcccggcctagtcttgtatttttagtagagtcgggatttctccatgttggtcaggctgttctcgaactcctgagctcaggtgatccaactgtctcggcctcccaaagtgctgggattacaggcgtgagccactgtgcctagcatgagccaccacgccggcctaatttttaaattttttgtagagacagggtctcattatgttgcccagggtggtgtcaagctccaggtctcaagtgatccccctacctccgcctcccaaagttgtgggattgtaggcatgagccactgcaagaaaaccttaactgcagcctaataattgttttctttgggataacttttaaagtacattaaaagactatcaacttaatttctgatcatattttgttgaataaaataagtaaaatgtcttgtgaaacaaaatgctttttaacatccatataaagctatctatatatagctatctatatctatatagctattttttttaacttcctttattttccttacagggttttagacaaaatcaaaaagaaggaaggtgctcacattccttaaattaaggagtaagtctgccagcattatgaaagtgaatcttacttttgtaaaactttatggtttgtggaaaacaaatgtttttgaacatttaaaaagttcagatgttagaaagttgaaaggttaatgtaaaacaatcaatattaaagaattttgatgccaaaactattagataaaaggttaatctacatccctactagaattctcatacttaactggttggttgtgtggaagaaacatactttcacaataaagagctttaggatatgatgccattttatatcactagtaggcagaccagcagacttttttttattgtgatatgggataacctaggcatactgcactgtacactctgacatatgaagtgctctagtcaagtttaactggtgtccacagaggacatggtttaactggaattcgtcaagcctctggttctaatttctcatttgcaggaaatgctggcatagagcagcactaaatgacaccactaaagaaacgatcagacagatctggaatgtgaagcgttatagaagataactggcctcatttcttcaaaatatcaagtgttgggaaagaaaaaaggaagtggaatgggtaactcttcttgattaaaagttatgtaataaccaaatgcaatgtgaaatattttactggactctattttgaaaaaccatctgtaaaagactgaggtgggggtgggaggccagcacggtggtgaggcagttgagaaaatttgaatgtggattagattttgaatgatattggataattattggtaattttatgagctgtgagaagggtgttgtagtttataaaagactgtcttaatttgcatacttaagcatttaggaatgaagtgttagagtgtcttaaaatgtttcaaatggtttaacaaaatgtatgtgaggcgtatgtggcaaaatgttacagaatctaactggtggacatggctgttcattgtactgtttttttctatcttctatatgtttaaaagtatataataaaaatatttaatttttttttaaataaacaaaatctg

SEQ ID NO: 86651 - DNA, 1894 bp, Homo sapiens
aggattacaggcgcctagcctaggcagtcattttcaaaaaacaagcatgactcaccaaaagttttaagattttctgtgataatgttcttattgaggcttacattatattacagtttcttgaatctaaaatgatgtaccctcttaggatatatacatcatgcttcattggtctcagggggctgatttttataaggagagatttgctagttttcacaatatgtcctctaagttggcatgtatagctaaacaggctttcataaaaatatacaatttagttaatgaaatttgggatatagtcttttatgattgaaataattttgctaaatagactgtctctgatttattaggtaatcaccactcttattttgttttacttccttaatgtctacatagaaaggaaatgagaaaaatccagaggttgtcatttgacttatgagtctgtttgacttcaggatttggtacatgaaatttcacttaatctttttgatatgtataaaacaaatattctgggtaattatttttatccttttggttttgagtcctttttattcctatcatattgaaattggtaagttaattttcctttgaaatattccttatagccaggtctaaaattcaatggcccaccaccgccaccgccaccaccaccaccccacttactatcatgctggctgcctccatttccttctggaccaccaataattcccccaccacctcccatatgtccagattctcttgatgatgctgatgctttgggaagtatgttaatttcatggtacatgagtggctatcatactggctattatatgggttttagacaaaatcaaaaagaaggaaggtgctcacattccttaaattaaggagtaagtctgccagcattatgaaagtgaatcttacttttgtaaaactttatggtttgtggaaaacaaatgtttttgaacatttaaaaagttcagatgttagaaagttgaaaggttaatgtaaaacaatcaatattaaagaattttgatgccaaaactattagataaaaggttaatctacatccctactagaattctcatacttaactggttggttgtgtggaagaaacatactttcacaataaagagctttaggatatgatgccattttatatcactagtaggcagaccagcagacttttttttattgtgatatgggataacctaggcatactgcactgtacactctgacatatgaagtgctctagtcaagtttaactggtgtccacagaggacatggtttaactggaattcgtcaagcctctggttctaatttctcatttgcaggaaatgctggcatagagcagcactaaatgacaccactaaagaaacgatcagacagatctggaatgtgaagcgttatagaagataactggcctcatttcttcaaaatatcaagtgttgggaaagaaaaaaggaagtggaatgggtaactcttcttgattaaaagttatgtaataaccaaatgcaatgtgaaatattttactggactctattttgaaaaaccatctgtaaaagactgaggtgggggtgggaggccagcacggtggtgaggcagttgagaaaatttgaatgtggattagattttgaatgatattggataattattggtaattttatgagctgtgagaagggtgttgtagtttataaaagactgtcttaatttgcatacttaagcatttaggaatgaagtgttagagtgtcttaaaatgtttcaaatggtttaacaaaatgtatgtgaggcgtatgtggcaaaatgttacagaatctaactggtggacatggctgttcattgtactgtttttttctatcttctatatgtttaaaagtatataataaaaatatttaatttttttttaaataaacaaaatctg

SEQ ID NO: 86652 - DNA, 1237 bp, Homo sapiens
ccacaaatgtgggagggcgataaccactcgtagaaagcgtgagaagttactacaagcggtcctcccggccaccgtactgttccgctcccagaagccccgggcggcggaagtcgtcactcttaagaagggacggggccccacgctgcgcacccgcgggtttgctatggcgatgagcagcggcggcagtggtggcggcgtcccggagcaggaggattccgtgctgttccggcgcggcacaggccagagcgatgattctgacatttgggatgatacagcactgataaaagcatatgataaagctgtggcttcatttaagcatgctctaaagaatggtgacatttgtgaaacttcgggtaaaccaaaaaccacacctaaaagaaaacctgctaagaagaataaaagccaaaagaagaatactgcagcttccttacaacagtggaaagttggggacaaatgttctgcctccatttccttgtggaccaccaataattcccccaccacctcccatatgtccagattctcttgatgatgctgatgctttgggaagtatgttaatttcatggtacatgagtggctatcatactggctattatatgggttttagacaaaatcaaaaagaaggaaggtgctcacattccttaaattaaggagaaatgctggcatagagcagcactaaatgacaccactaaagaaacgatcagacagatctggaatgtgaagcgttatagaagataactggcctcatttcttcaaaatatcaagtgttgggaaagaaaaaaggaagtggaatgggtaactcttcttgattaaaagttatgtaataaccaaatgcaatgtgaaatattttactggactctattttgaaaaaccatctgtaaaagactgaggtgggggtgggaggccagcacggtggtgaggcagttgagaaaatttgaatgtggattagattttgaatgatattggataattattggtaattttatgagctgtgagaagggtgttgtagtttataaaagactgtcttaatttgcatacttaagcatttaggaatgaagtgttagagtgtcttaaaatgtttcaaatggtttaacaaaatgtatgtgaggcgtatgtggcaaaatgttacagaatctaactggtggacatggctgttcattgtactgtttttttctatcttctatatgtttaaaagtatataataaaaatatttaatttttttttaaataaacaaaatctg

SEQ ID NO: 86653 - DNA, 1120 bp, Homo sapiens
ccacaaatgtgggagggcgataaccactcgtagaaagcgtgagaagttactacaagcggtcctcccggccaccgtactgttccgctcccagaagccccgggcggcggaagtcgtcactcttaagaagggacggggccccacgctgcgcacccgcgggtttgctatggcgatgagcagcggcggcagtggtggcggcgtcccggagcaggaggattccgtgctgttccggcgcggcacaggccagagcgatgattctgacatttgggatgatacagcactgataaaagcatatgataaagctgtggcttcatttaagcatgctctaaagaatggtgacatttgtgaaacttcgggtaaaccaaaaaccacacctaaaagaaaacctgctaagaagaataaaagccaaaagaagaatactgcagcttccttacaacagtggaaagttggggacaaatgttctgccatttggtcagaagacggttgcatttacccagctaccattgcttcaattgattttaagagagaaacctgtgttgtggtttacactggatatggaaatagagaggagcaaaatctgtccgatctactttccccaatctgtgaagtagctaataatatagaacagaatgctcaagagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaagccaggtctaaaattcaatggcccaccaccgccaccgccaccaccaccaccccacttactatcatgctggctgcctccatttccttctggaccaccaataattcccccaccacctcccatatgtccagattctcttgatgatgctgatgctttgggaagtatgttaatttcatggtacatgagtggctatcatactggctattatatggtaagtaatcactcagcatcttttcctgacaatttttttgtagttatgtgactttgttttgtaaatttataaaatactacttgcttctctctttatattactaaaaaataaaaataaaaaaat

SEQ ID NO: 86654 - DNA, 1584 bp, Homo sapiens
ccacaaatgtgggagggcgataaccactcgtagaaagcgtgagaagttactacaagcggtcctcccggccaccgtactgttccgctcccagaagccccgggcggcggaagtcgtcactcttaagaagggacggggccccacgctgcgcacccgcgggtttgctatggcgatgagcagcggcggcagtggtggcggcgtcccggagcaggaggattccgtgctgttccggcgcggcacaggccagagcgatgattctgacatttgggatgatacagcactgataaaagcatatgataaagctgtggcttcatttaagcatgctctaaagaatggtgacatttgtgaaacttcgggtaaaccaaaaaccacacctaaaagaaaacctgctaagaagaataaaagccaaaagaagaatactgcagcttccttacaacagtggaaagttggggacaaatgttctgccatttggtcagaagacggttgcatttacccagctaccattgcttcaattgattttaagagagaaacctgtgttgtggtttacactggatatggaaatagagaggagcaaaatctgtccgatctactttccccaatctgtgaagtagctaataatatagaacagaatgctcaagagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaagccaggtctaaaattcaatggcccaccaccgccaccgccaccaccaccaccccacttactatcatgctggctgcctccatttccttctggaccaccaataattcccccaccacctcccatatgtccagattctcttgatgatgctgatgctttgggaagtatgttaatttcatggtacatgagtggctatcatactggctattatatggaaatgctggcatagagcagcactaaatgacaccactaaagaaacgatcagacagatctggaatgtgaagcgttatagaagataactggcctcatttcttcaaaatatcaagtgttgggaaagaaaaaaggaagtggaatgggtaactcttcttgattaaaagttatgtaataaccaaatgcaatgtgaaatattttactggactctattttgaaaaaccatctgtaaaagactgaggtgggggtgggaggccagcacggtggtgaggcagttgagaaaatttgaatgtggattagattttgaatgatattggataattattggtaattttatgagctgtgagaagggtgttgtagtttataaaagactgtcttaatttgcatacttaagcatttaggaatgaagtgttagagtgtcttaaaatgtttcaaatggtttaacaaaatgtatgtgaggcgtatgtggcaaaatgttacagaatctaactggtggacatggctgttcattgtactgtttttttctatcttctatatgtttaaaagtatataataaaaatatttaatttttttttaaataaacaaaatctg

SEQ ID NO: 86655 - DNA, 1488 bp, Homo sapiens
ccacaaatgtgggagggcgataaccactcgtagaaagcgtgagaagttactacaagcggtcctcccggccaccgtactgttccgctcccagaagccccgggcggcggaagtcgtcactcttaagaagggacggggccccacgctgcgcacccgcgggtttgctatggcgatgagcagcggcggcagtggtggcggcgtcccggagcaggaggattccgtgctgttccggcgcggcacaggccagagcgatgattctgacatttgggatgatacagcactgataaaagcatatgataaagctgtggcttcatttaagcatgctctaaagaatggtgacatttgtgaaacttcgggtaaaccaaaaaccacacctaaaagaaaacctgctaagaagaataaaagccaaaagaagaatactgcagcttccttacaacagtggaaagttggggacaaatgttctgccatttggtcagaagacggttgcatttacccagctaccattgcttcaattgattttaagagagaaacctgtgttgtggtttacactggatatggaaatagagaggagcaaaatctgtccgatctactttccccaatctgtgaagtagctaataatatagaacagaatgctcaagagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaagataattcccccaccacctcccatatgtccagattctcttgatgatgctgatgctttgggaagtatgttaatttcatggtacatgagtggctatcatactggctattatatggaaatgctggcatagagcagcactaaatgacaccactaaagaaacgatcagacagatctggaatgtgaagcgttatagaagataactggcctcatttcttcaaaatatcaagtgttgggaaagaaaaaaggaagtggaatgggtaactcttcttgattaaaagttatgtaataaccaaatgcaatgtgaaatattttactggactctattttgaaaaaccatctgtaaaagactgaggtgggggtgggaggccagcacggtggtgaggcagttgagaaaatttgaatgtggattagattttgaatgatattggataattattggtaattttatgagctgtgagaagggtgttgtagtttataaaagactgtcttaatttgcatacttaagcatttaggaatgaagtgttagagtgtcttaaaatgtttcaaatggtttaacaaaatgtatgtgaggcgtatgtggcaaaatgttacagaatctaactggtggacatggctgttcattgtactgtttttttctatcttctatatgtttaaaagtatataataaaaatatttaatttttttttaaataaacaaaatctg

SEQ ID NO: 86656 - DNA, 2199 bp, Homo sapiens
ccacaaatgtgggagggcgataaccactcgtagaaagcgtgagaagttactacaagcggtcctcccggccaccgtactgttccgctcccagaagccccgggcggcggaagtcgtcactcttaagaagggacggggccccacgctgcgcacccgcgggtttgctatggcgatgagcagcggcggcagtggtggcggcgtcccggagcaggaggattccgtgctgttccggcgcggcacaggccagagcgatgattctgacatttgggatgatacagcactgataaaagcatatgataaagctgtggcttcatttaagcatgctctaaagaatggtgacatttgtgaaacttcgggtaaaccaaaaaccacacctaaaagaaaacctgctaagaagaataaaagccaaaagaagaatactgcagcttccttacaacagtggaaagttggggacaaatgttctgccatttggtcagaagacggttgcatttacccagctaccattgcttcaattgattttaagagagaaacctgtgttgtggtttacactggatatggaaatagagaggagcaaaatctgtccgatctactttccccaatctgtgaagtagctaataatatagaacagaatgctcaagagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaagaaaggaaatgagaaaaatccagaggttgtcatttgacttatgagtctgtttgacttcaggatttggtacatgaaatttcacttaatctttttgatatgtataaaacaaatattctggccaggtctaaaattcaatggcccaccaccgccaccgccaccaccaccaccccacttactatcatgctggctgcctccatttccttctggaccaccaataattcccccaccacctcccatatgtccagattctcttgatgatgctgatgctttgggaagtatgttaatttcatggtacatgagtggctatcatactggctattatatgggttttagacaaaatcaaaaagaaggaaggtgctcacattccttaaattaaggagtaagtctgccagcattatgaaagtgaatcttacttttgtaaaactttatggtttgtggaaaacaaatgtttttgaacatttaaaaagttcagatgttagaaagttgaaaggttaatgtaaaacaatcaatattaaagaattttgatgccaaaactattagataaaaggttaatctacatccctactagaattctcatacttaactggttggttgtgtggaagaaacatactttcacaataaagagctttaggatatgatgccattttatatcactagtaggcagaccagcagacttttttttattgtgatatgggataacctaggcatactgcactgtacactctgacatatgaagtgctctagtcaagtttaactggtgtccacagaggacatggtttaactggaattcgtcaagcctctggttctaatttctcatttgcaggaaatgctggcatagagcagcactaaatgacaccactaaagaaacgatcagacagatctggaatgtgaagcgttatagaagataactggcctcatttcttcaaaatatcaagtgttgggaaagaaaaaaggaagtggaatgggtaactcttcttgattaaaagttatgtaataaccaaatgcaatgtgaaatattttactggactctattttgaaaaaccatctgtaaaagactgaggtgggggtgggaggccagcacggtggtgaggcagttgagaaaatttgaatgtggattagattttgaatgatattggataattattggtaattttatgagctgtgagaagggtgttgtagtttataaaagactgtcttaatttgcatacttaagcatttaggaatgaagtgttagagtgtcttaaaatgtttcaaatggtttaacaaaatgtatgtgaggcgtatgtggcaaaatgttacagaatctaactggtggacatggctgttcattgtactgtttttttctatcttctatatgtttaaaagtatataataaaaatatttaatttttttttaaataaacaaaatctg

SEQ ID NO: 86657 - DNA, 1202 bp, Homo sapiens
ccacaaatgtgggagggcgataaccactcgtagaaagcgtgagaagttactacaagcggtcctcccggccaccgtactgttccgctcccagaagccccgggcggcggaagtcgtcactcttaagaagggacggggccccacgctgcgcacccgcgggtttgctatggcgatgagcagcggcggcagtggtggcggcgtcccggagcaggaggattccgtgctgttccggcgcggcacaggccagagcgatgattctgacatttgggatgatacagcactgataaaagcatatgataaagctgtggcttcatttaagcatgctctaaagaatggtgacatttgtgaaacttcgggtaaaccaaaaaccacacctaaaagaaaacctgctaagaagaataaaagccaaaagaagaatactgcagcttccttacaacagtggaaagttggggacaaatgttctgccatttggtcagaagacggttgcatttacccagctaccattgcttcaattgattttaagagagaaacctgtgttgtggtttacactggatatggaaatagagaggagcaaaatctgtccgatctactttccccaatctgtgaagtagctaataatatagaacagaatgctcaagagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaagccaggtctaaaattcaatggcccaccaccgccaccgccaccaccaccaccccacttactatcatgctggctgcctccatttccttctggaccaccaataattcccccaccacctcccatatgtccagattctcttgatgatgctgatgctttgggaagtatgttaatttcatggtacatgagtggctatcatactggctattatatgggttttagacaaaatcaaaaagaaggaaggtgctcacattccttaaattaaggagaaatgctggcatagagcagcactaaatgacaccactaaagaaacgatcagacagatctggaatgtgaagcgttatagaagataactggcctcatttcttcaaaatatcaagtgttgggcgataacatcacgggatcctgctagagtcggc

SEQ ID NO: 86658 - DNA, 1024 bp, Homo sapiens
ccacaaatgtgggagggcgataaccactcgtagaaagcgtgagaagttactacaagcggtcctcccggccaccgtactgttccgctcccagaagccccgggcggcggaagtcgtcactcttaagaagggacggggccccacgctgcgcacccgcgggtttgctatggcgatgagcagcggcggcagtggtggcggcgtcccggagcaggaggattccgtgctgttccggcgcggcacaggccagagcgatgattctgacatttgggatgatacagcactgataaaagcatatgataaagctgtggcttcatttaagcatgctctaaagaatggtgacatttgtgaaacttcgggtaaaccaaaaaccacacctaaaagaaaacctgctaagaagaataaaagccaaaagaagaatactgcagcttccttacaacagtggaaagttggggacaaatgttctgccatttggtcagaagacggttgcatttacccagctaccattgcttcaattgattttaagagagaaacctgtgttgtggtttacactggatatggaaatagagaggagcaaaatctgtccgatctactttccccaatctgtgaagtagctaataatatagaacagaatgctcaagagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaagataattcccccaccacctcccatatgtccagattctcttgatgatgctgatgctttgggaagtatgttaatttcatggtacatgagtggctatcatactggctattatatggtaagtaatcactcagcatcttttcctgacaatttttttgtagttatgtgactttgttttgtaaatttataaaatactacttgcttctctctttatattactaaaaaataaaaataaaaaaat

SEQ ID NO: 86659 - DNA, 599 bp, Homo sapiens
gggtaatttgcgggcccctcagccaatgggagggcgtcgccccggccagctcccttttctggagctccagccgcctcccggggactgcagttgccacctcgagccctgctgtgcgtctcgggccagcaattccgcctgcgcgcgggacccattcctcctccagccgccgcggcccacggcccacggagcgggtgaatcccggcgccgcgccccggacccgcagctccctgcactcctccctcccagccgctttaacacccacaccccacagtctctcccacgcccgcgccttggcggccccactgaatccctacgcggggcccagcggtaccgggagaccgggctagcctatgggagcgcccagataacgcgggttgggggcgcccgcgcccccatccccgccagcatgactcgatcgccgcccctcagagagctgcccccgagttacacacccccagctcgaaccgcagcaccccaggtgagtagagggggagctggaagaaggaagagagcggagccaggtctgtcactcgggcctctgcaaggtttgtgatgtcttgaagtgccgagtgtcattagatgtctgaaggcaagtgaga

SEQ ID NO: 86660 - DNA, 711 bp, Homo sapiens
caggtgtagggaatcgttctggtgctgttcgtctgtgctctgctgctcctcaacccctggacggctggcctcatagtgctggtcctggcgatgatgacagtggaactctttggtatcatgggtttcctgggcatcaagctgagtgccatccccgtggtgatccttgtggcctctgtaggcattggcgttgagttcacagtccacgtggctctgggcttcctgaccacccagggcagccggaacctgcgggccgcccatgcccttgagcacacatttgcccccgtgaccgatggggccatctccacattgctgggtctgctcatgcttgctggttcccactttgacttcattgtaaggtacttctttgcggcgctgacagtgctcacgctcctgggcctcctccatggactcgtgctgctgcctgtgctgctgtccatcctgggcccgccgccagaggtgatacagatgtacaaggaaagcccagagatcctgagtccaccagctccacagggaggcgggcttaggtggggggcatcctcctccctgccccagagctttgccagagtgactacctccatgaccgtggccatccacccaccccccctgcctggtgcctacatccatccagcccctgatgagcccccttggtcccctgctgccactagctctggcaacctcagttccaggggaccaggtccagccactgggtga

SEQ ID NO: 86661 - DNA, 4018 bp, Homo sapiens
gggtaatttgcgggcccctcagccaatgggagggcgtcgccccggccagctcccttttctggagctccagccgcctcccggggactgcagttgccacctcgagccctgctgtgcgtctcgggccagcaattccgcctgcgcgcgggacccattcctcctccagccgccgcggcccacggcccacggagcgggtgaatcccggcgccgcgccccggacccgcagctccctgcactcctccctcccagccgctttaacacccacaccccacagtctctcccacgcccgcgccttggcggccccactgaatccctacgcggggcccagcggtaccgggagaccgggctagcctatgggagcgcccagataacgcgggttgggggcgcccgcgcccccatccccgccagcatgactcgatcgccgcccctcagagagctgcccccgagttacacacccccagctcgaaccgcagcaccccagatcctagctgggagcctgaaggctccactctggcttcgtgcttacttccagggcctgctcttctctctgggatgcgggatccagagacattgtggcaaagtgctctttctgggactgttggcctttggggccctggcattaggtctccgcatggccattattgagacaaacttggaacagctctgggtagaagtgggcagccgggtgagccaggagctgcattacaccaaggagaagctgggggaggaggctgcatacacctctcagatgctgatacagaccgcacgccaggagggagagaacatcctcacacccgaagcacttggcctccacctccaggcagccctcactgccagtaaagtccaagtatcactctatgggaagtcctgggatttgaacaaaatctgctacaagtcaggagttccccttattgaaaatggaatgattgagcggatgattgagaagctgtttccgtgcgtgatcctcacccccctcgactgcttctgggagggagccaaactccaagggggctccgcctacctgcccggccgcccggatatccagtggaccaacctggatccagagcagctgctggaggagctgggtccctttgcctcccttgagggcttccgggagctgctagacaaggcacaggtgggccaggcctacgtggggcggccctgtctgcaccctgatgacctccactgcccacctagtgcccccaaccatcacagcaggcaggctcccaatgtggctcacgagctgagtgggggctgccatggcttctcccacaaattcatgcactggcaggaggaattgctgctgggaggcatggccagagacccccaaggagagctgctgagggcagaggccctgcagagcaccttcttgctgatgagtccccgccagctgtacgagcatttccggggtgactatcagacacatgacattggctggagtgaggagcaggccagcacagtgctacaagcctggcagcggcgctttgtgcagctggcccaggaggccctgcctgagaacgcttcccagcagatccatgccttctcctccaccaccctggatgacatcctgcatgcgttctctgaagtcagtgctgcccgtgtggtgggaggctatctgctcatgctggcctatgcctgtgtgaccatgctgcggtgggactgcgcccagtcccagggttccgtgggccttgccggggtactgctggtggccctggcggtggcctcaggccttgggctctgtgccctgctcggcatcaccttcaatgctgccactacccaggtgctgcccttcttggctctgggaatcggcgtggatgacgtattcctgctggcgcatgccttcacagaggctctgcctggcacccctctccaggagcgcatgggcgagtgtctgcagcgcacgggcaccagtgtcgtactcacatccatcaacaacatggccgccttcctcatggctgccctcgttcccatccctgcgctgcgagccttctccctacaggcggccatagtggttggctgcacctttgtagccgtgatgcttgtcttcccagccatcctcagcctggacctacggcggcgccactgccagcgccttgatgtgctctgctgcttctccagtccctgctctgctcaggtgattcagatcctgccccaggagctgggggacgggacagtaccagtgggcattgcccacctcactgccacagttcaagcctttacccactgtgaagccagcagccagcatgtggtcaccatcctgcctccccaagcccacctggtgcccccaccttctgacccactgggctctgagctcttcagccctggagggtccacacgggaccttctaggccaggaggaggagacaaggcagaaggcagcctgcaagtccctgccctgtgcccgctggaatcttgcccatttcgcccgctatcagtttgccccgttgctgctccagtcacatgccaaggccatcgtgctggtgctctttggtgctcttctgggcctgagcctctacggagccaccttggtgcaagacggcctggccctgacggatgtggtgcctcggggcaccaaggagcatgccttcctgagcgcccagctcaggtacttctccctgtacgaggtggccctggtgacccagggtggctttgactacgcccactcccaacgcgccctctttgatctgcaccagcgcttcagttccctcaaggcggtgctgcccccaccggccacccaggcaccccgcacctggctgcactattaccgcaactggctacagggaatccaggctgcctttgaccaggactgggcttctgggcgcatcacccgccactcgtaccgcaatggctctgaggatggggccctggcctacaagctgctcatccagactggagacgcccaggagcctctggatttcagccagctgaccacaaggaagctggtggacagagagggactgattccacccgagctcttctacatggggctgaccgtgtgggtgagcagtgaccccctgggtctggcagcctcacaggccaacttctaccccccacctcctgaatggctgcacgacaaatacgacaccacgggggagaaccttcgcatcccgccagctcagcccttggagtttgcccagttccccttcctgctgcgtggcctccagaagactgcagactttgtggaggccatcgagggggcccgggcagcatgcgcagaggccggccaggctggggtgcacgcctaccccagcggctcccccttcctcttctgggaacagtatctgggcctgcggcgctgcttcctgctggccgtctgcatcctgctggtgtgcactttcctcgtctgtgctctgctgctcctcaacccctggacggctggcctcatagtgctggtcctggcgatgatgacagtggaactctttggtatcatgggtttcctgggcatcaagctgagtgccatccccgtggtgatccttgtggcctctgtaggcattggcgttgagttcacagtccacgtggctctgggcttcctgaccacccagggcagccggaacctgcgggccgcccatgcccttgagcacacatttgcccccgtgaccgatggggccatctccacattgctgggtctgctcatgcttgctggttcccactttgacttcattgtaaggtacttctttgcggcgctgacagtgctcacgctcctgggcctcctccatggactcgtgctgctgcctgtgctgctgtccatcctgggcccgccgccagaggtgatacagatgtacaaggaaagcccagagatcctgagtccaccagctccacagggaggcgggcttaggtggggggcatcctcctccctgccccagagctttgccagagtgactacctccatgaccgtggccatccacccaccccccctgcctggtgcctacatccatccagcccctgatgagcccccttggtcccctgctgccactagctctggcaacctcagttccaggggaccaggtccagccactgggtga

SEQ ID NO: 86662 - DNA, 353 bp, Homo sapiens
cagttgcaaacctcttctgaatggagaattctttctagaagctccctgggctctccaggatgtatgagaatcagtcctaccttgctgcttccacagttcccaaacacgtccaggcatgtctgcatccactgggtagagacatcttaggccagccttcctgcatgaaggtatgcataggttttatctagaacctgttaaattcagctctaaaatataaagtgtctcatttctataaggccttcctaatactcacaataatctgctatatataaactgggatcacaaattcattcaaatctttttttttaaagatatcttcaggtttcactgtggaacaaaacaggcctactttg

SEQ ID NO: 86663 - DNA, 566 bp, Homo sapiens
caggtagtctggaaagaaatctttttcagatatttggcttctgggtatgattgaatgacagatgacattttccctcccacctgatacagccaagaaaacggacaaaaatatgaaagagctgttttgaattcagaacacaaacataaggtaacaagggacagtgatttctgaaagatgagaaacaaaattatctctctgtaactgcccttagtttttattattttgagtgtttgtaggctgcagcacaggattggggagatacatcctgagctgagataagcacatggaaatcagagaatctgggaaaaccaaggcagctagagttcataatatagacaccaaagaggtggcacaaagagagaacttcagagagctgtagagggtctctcttgaatattaaactgagacatggaagatattagaaaaagactgaaattaaacttctagaggtgaaaactatgatgtctgagatgaaaaacatactgtatggaactaacaacagattagacattgcagaagagaagattaatgaacttgaaaaacagaaattatccaaaatggaacac

SEQ ID NO: 86664 - DNA, 435 bp, Homo sapiens
atgtgacacacctgcacgtgtacgccttgagccgaaaatgaacacgtaacacacctgcacgtgtacgccttgaaccgaaaatgaacacgtaacacacctgcacgtgtacgccttgagccgaaaatgaacacgtaacacacctgcacgtgtacgccttgaaccgaaaataaacatgtggcacacctgcacgtgtacgccttgagccgaaaatgaacacgtaacacacctgcacgtgtacgccttgaaccgaaaatgaacatgtggcacacctgcacgtgtaagccttgagccgaaaatgaacacgtaacacacctgcacgtgtacgccttgagccgaaaatgaacatgtgacacatctgcacgtgtacgccttgagtcgaaaatgaacacgtaacacacctgcacgtgtacgccttgagctgaaaatgaacatgtg

SEQ ID NO: 86665 - DNA, 403 bp, Homo sapiens
accctgggtccaggacccctcatggaacccccagcaaagggctaacatcaggccagaaattactttttggtggacatcccagccaccaaaagccaattccacaaaaatcaattctacgaaaagcaagcccatttgccaaaactgttctctcagtgactcatctgcctgctttgaaaaccaaacaaacaaacaaacatcttgtgattttcctaagggtttcccaagaccctcaccctcagccatttctcctctcattatgggattccttggccttggccagtagaatgccaatggtgctaagctcttctgccaagctgcacatgttcagaaatgcagtttagcattttctctattttggagaactatgctttcttccttcccccacctctgcccttgcccctgt

SEQ ID NO: 86666 - DNA, 296 bp, Homo sapiens
ttacacacttaccttatggaaacctcagaacaatcacgtcttttatagatgagaaaactgaggctttggatgcctctgggggaaccttgggcaagcaatagacagaggagctcctgaacttaagcagtatctgtcacctccctacctttgggtgtcttctggtggccaatgtgctgctgtcaggtccctcgctggctcccaaattggactggggaggctccaaagcagtggagttggtgctagtgccacctccacctcaggattctcagatctgcaggacggcttcacccaccaca

SEQ ID NO: 86667 - DNA, 1986 bp, Homo sapiens
gaggacgcgccaacatccccgctgctgtgctgggcccggggcgtgcccgccgctgctcccacctctgggccgggctggggccgcccgggggccctgttcctcggcattgcgggcctggtgggcagaaccgcggagagggcttcttttccccaagggcagcgtcttggggcccggccactggctgacccgcagcggctccggccatgcctggctggccctgggggctgctgctgacggcaggcacgctcttcgccgccctgagtcctgggccgccggcgcccgccgacccctgccacgatgaggggggtgcgccccgcggctgcgtgccaggactggtgaacgccgccctgggccgcgaggtgctggcttccagcacgtgcgggcggccggccactcgggcctgcgacgcctccgacccgcgacgggcacactcccccgccctccttacttccccagggggcacggccagccctctgtgctggcgctcggagtccctgcctcgggcgcccctcaacgtgactctcacggtgcccctgggcaaggcttttgagctggtcttcgtgagcctgcgcttctgctcagctcccccagcctccgtggccctgctcaagtctcaggaccatggccgcagctgggccccgctgggcttcttctcctcccactgtgacctggactatggccgtctgcctgcccctgccaatggcccagctggcccagggcctgaggccctgtgcttccccgcacccctggcccagcctgatggcagcggccttctggccttcagcatgcaggacagcagccccccaggcctggacctggacagcagcccagtgctccaagactgggtgaccgccaccgacgtccgtgtagtgctcacaaggcctagcacggcaggtgaccccagggacatggaggccgtcgtcccttactcctacgcagccaccgacctccaggtgggcgggcgctgcaagtgcaatggacatgcctcacggtgcctgctggacacacagggccacctgatctgcgactgtcggcatggcaccgagggccctgactgcggccgctgcaagcccttctactgcgacaggccatggcagcgggccactgcccgggaatcccacgcctgcctcgcttgctcctgcaacggccatgcccgccgctgccgcttcaacatggagctgtaccgactgtccggccgccgcagcgggggtgtctgtctcaactgccggcacaacaccgccggccgccactgccactactgccgggagggcttctatcgagaccctggccgtgccctgagtgaccgtcgggcttgcagggcctgcgactgtcacccggttggtgctgctggcaagacctgcaaccagaccacaggccagtgtccctgcaaggatggcgtcactggcctcacctgcaaccgctgcgcgcctggcttccagcaaagccgctccccagtggcgccctgtgttaagacccctatccctggacccactgaggacagcagccctgtgcagccccaggactgtgactcgcactgcaaacctgcccgtggcagctaccgcatcagcctaaagaagttctgcaagaaggactatgcggtgcaggtggcggtgggtgcgcgcggcgaggcgcgcggcgcgtggacacgcttcccggtggcggtgctcgccgtgttccggagcggagaggagcgcgcgcggcgcgggagtagcgcgctgtgggtgcccgccggggatgcggcctgcggctgcccgcgcctgctccccggccgccgctacctcctgctggggggcgggcctggagccgcggctgggggcgcggggggccgggggcccgggctcatcgccgcccgcggaagcctcgtgctaccctggagggacgcgtggacgcggcgcctgcggaggctgcagcgacgcgaacggcgggggcgctgcagcgccgcctgagcccgccggctgggcagggcggccgctgctcccacatcta

SEQ ID NO: 86668 - DNA, 481 bp, Homo sapiens
attttattaaacctatgcaaagaaaggaatcaaggttgactcctagatttttagcttcaatagctggttagacagttgtgctctttactgagatggggaagatgagagaggattaaaaaatcctgtctttgagaattattgtgttattcagccttcaagaattattcctgttataaacctaaccgccatctttatttcttaatgagaatgttaataaaaactcatttgactttcagcattttggaatttgttcatgttttgatgttgaataaacctcataactatgagttagttgaattataaagcagatataatcttcagagaggatatgttaccctttacttctttttttttttattatactttaagttctgggatacatgtgcagaacatacaggtttgttacataggtatacacgtgccatggtggtttgctgcacccatcaacccttcatctacattaggtatttctcctaatgct

SEQ ID NO: 86669 - DNA, 664 bp, Homo sapiens
  misc_feature (609)..(609): n is a, c, g, or t
  misc_feature (624)..(624): n is a, c, g, or t
agttgacactgctcacctgtgatcctctggcataaccaccttgcaaagataacccaagagaaatggaagcctcagggatataccaccagatgaactgacggcaaggtggaggttttcgcattcccatggcaggtttccttatcagcccccatctcccaccacatcagaaaaggagtaaatagatctttcctgatttcaggcccagaactaggctcaagaagaaagaagtgtactctcacgactggctaagacttgctggactgacacctatggctggaagatgacttgttttgctccatgtctcctcattcctacacctattttctgctgcaggatgaggctagggttagcattctagacacccagttgagctcaggcgtagagaagaggaggatgggataagaactggggccatccccatgtcatggtgggtgagagctggggccatccccgtggtcatggagggtgagagctgggggttatccccatggtcatggagggtgagggctggtcgggggaggcatccccaagtcatggtgggtgagagctcggagcatccccatgtcatggtgggtgagatctgggggtatccctgtgtcatggtgggcngtcgcgcagcgggtncggctcgaatcgtatctgtcctgtgtcgggcgtggcaaaa

SEQ ID NO: 86670 - DNA, 2278 bp, Homo sapiens
  misc_feature (1778)..(1779): n is a, c, g, or t
  misc_feature (1783)..(1783): n is a, c, g, or t
  misc_feature (2223)..(2223): n is a, c, g, or t
  misc_feature (2238)..(2238): n is a, c, g, or t
gaattccgcccgcccacggcggcggggaaatacctaggcatggaagtggcatgacagggctcgtgtccctgtcatattttccactctccacgaggtcctgcgcgcttcaatcctgcaggcagcccggtttggggatgtggtccttgctgctctgcgggttgtccatcgcccttccactgtctgtcacagcagatggatgcaaggacatttttatgaaaaatgagatactttcagcaagccagccttttgcttttaattgtacattccctcccataacatctggggaagtcagtgtaacatggtataaaaattctagcaaaatcccagtgtccaaaatcatacagtctagaattcaccaggacgagacttggattttgtttctccccatggaatggggggactcaggagtctaccaatgtgttataaagggtagagacagctgtcatagaatacatgtaaacctaactgtttttgaaaaacattggtgtgacacttccataggtggtttaccaaatttatcagatgagtacaagcaaatattacatcttggaaaagatgatagtctcacatgtcatctgcacttcccgaagagttgtgttttgggtccaataaagtggtataaggactgtaacgagattaaaggggagcggttcactgttttggaaaccaggcttttggtgagcaatgtctcggcagaggacagagggaactacgcgtgtcaagccatactgacacactcagggaagcagtacgaggttttaaatggcatcactgtgagcattacagaaagagctggatatggaggaagtgtccctaaaatcatttatccaaaaaatcattcaattgaagtacagcttggtaccactctgattgtggactgcaatgtaacagacaccaaggataatacaaatctacgatgctggagagtcaataacactttggtggatgattactatgatgaatccaaacgaatcagagaaggggtggaaacccatgtctcttttcgggaacataatttgtacacagtaaacatcaccttcttggaagtgaaaatggaagattatggccttcctttcatgtgccacgctggagtgtccacagcatacattatattacagctcccagctccggattttcgagcttacttgataggagggcttatcgccttggtggctgtggctgtgtctgttgtgtacatatacaacatttttaagatcgacattgttctttggtatcgaagtgccttccattctacagagaccatagtagatgggaagctgtatgacgcctatgtcttataccccaagccccacaaggaaagccagaggcatgccgtggatgccctggtgttgaatatcctgcccgaggtgttggagagacaatgtggatataagttgtttatattcggcagagatgaattccctggacaagccgtggccaatgtcatcgatgaaaacgttaagctgtgcaggaggctgattgtcattgtggtccccgaatcgctgggctttggcctgttgaagaacctgtcagaagaacaaatcgcggtctacagtgccctgatccaggacgggatgaaggttattctcattgagctggagaaaatcgaggactacacagtcatgccagagtcaattcagtacatcaaacagaagcatggtgccatccggtggcatggggacttcacggagcagtcacagtgtatgaagaccaagttttggaagacagtgagataccacatgccgcccagaaggtgtcggccgtttcctccggtccanntgcngcagcacacacctctgctaccgcaccgcaggcccagaactaggctcaagaagaaagaagtgtactctcacgactggctaagacttgctggactgacacctatggctggaagatgacttgttttgctccatgtctcctcattcctacacctattttctgctgcaggatgaggctagggttagcattctagacacccagttgagctcaggcgtagagaagaggaggatgggataagaactggggccatccccatgtcatggtgggtgagagctggggccatccccgtggtcatggagggtgagagctgggggttatccccatggtcatggagggtgagggctggtcgggggaggcatccccaagtcatggtgggtgagagctcggagcatccccatgtcatggtgggtgagatctgggggtatccctgtgtcatggtgggcngtcgcgcagcgggtncggctcgaatcgtatctgtcctgtgtcgggcgtggcaaaa

SEQ ID NO: 86671 - DNA, 836 bp, Homo sapiens
ctcctgcccaccacttaggctcataattactctgcaatgtactcatgaaacaggctagggtgtaaacattctttctgagactgtgcctctcgcacaggcacccagcctggaaatcaatggcacagaaaggatgaggtgagagtttggctcttggcctgtcttgtggagccagccatgctggcttccagaggggacaactgttggctctttaaggatgatgggagtccagctgttcaactttgaatggctgggaaagcagttacaatatgattgtaatcaagaaagggcagcagaaccagctggagaaggtgccccatgaacatactcaggcgccacctctggacagtctcatgttgactcagcagaacctggacgtgtgtgttttgaaagcagttctcgtccagttgggtccatgctgcgtctaccaccggaaactagggctctgcagacttttactcgtataagttcccaggagctgacttgtttcctaacaatcatggtgcagatcagattattctgctcccataccacttttttgactttaaagaaatgtttaagcagtgccctcattgacatccaaaacctttccatttggcattcataatgtgatctgtattagtaaagtatataatggactctttgtttcattattataattataattattattatttttttgctgtcatttgtagctccggattttcgagcttacttgataggagggcttatcgccttggtggctgtggctgtgtctgttgtgtacatatacaacatttttaagatcgacattgttctttggtatcgaagtgccttccattctacagagaccatagtag

SEQ ID NO: 86672 - DNA, 579 bp, Homo sapiens
gaagcttcatctttttaagggctaccttcagagaaggtgaccccattctcagctcagcccatcatgggaaacctaatcctgttgctggtgatttgttcagtagtggacatgacacatgtgggaggttggtgaggctggggtccaggtgcctctagaaaaattctccttgatcttaagaaagagatgcagagagaaagatccttggatattgttgtgtctgggtgtgacctccggggctgtggcagccatcttgcaaccaggaggcaatctggtttgaggacacgactgacagatgcagagaatggcagaaccaaagatggaaaggataggagtccctgatgatgtctttaaggtgtgaaactaaccagccctggagctgccctaacttgggacttctcattagagggagtatacatttccttattacataagccaagtgagttggggttttctgttactcacagcctagatcatcctaatgactactctatgccatagagagaccatatggtctgtgactgtttggagaatacagcagggacatgggctcagctctgccgttgaagagcctgggacatc

SEQ ID NO: 86673 - DNA, 645 bp, Homo sapiens
aagacggaattttgctcttgttacccaggctggagtgcaacggcacaatctcggctcactgcaacctctgcctcccgggttcaagcgattctcctgcctcagcctcctgagtagctgggattacaggcatgcgccacagcacctggctgattatttcatgtttcttatatataaatcagctttaggatggtagagtgaagaaaacaggagttagagtcagaagacttgcttgctagccctgtggcctaacttaggtcacttggccttgttgggacttggtttcctcaagtgtgggatggtagatacgctgcctaccaccactaaactgttgtgtgcatgaggcatagtgcatgtggttaccacacaagctgtggcagtaatgatgccatacttttgatgatctcctaaagaacatgtcaggcttattcctgtatcatcatatggcacacagtagatgctcaatttgtaataaatgaaaaccattattttaaatccactatttccctgaatgaacttctattctgatatctgactgccctttgatcattattgttagcaactacaacacgatcaccttttctaaatgccaagtcagtttctaataatatagttgctttcaacagctcctaatttttcttttttaat

SEQ ID NO: 86674 - DNA, 469 bp, Homo sapiens
gggccggcatctacgttcttgacagccttccgggtgaccctcacatatgctgatggttgaacacactggagtggtatgcttttgagaagaaaagtaacattttacatacttgctgttttcctgatgggcaagttttatcagtgcttgttctataatgttttaactactatgtgaattattaatggcaacaaaattttatttattttatttttaagagggaatctcactctatcacccaggctggagttgcagtgagccgacatagcaccattgcactccagcctgggaaacagagagagactttgtctcaggaaaaaaaaaaaaaaaaagccaggcatgcacttgtagtccaagctactcaggaggctgaggccagaggatcacttgaacctaggaggtttgaggttgcagtgaactatgatcacggcacttgcactctagcctgggcaacagagcaagaccctgtctg

SEQ ID NO: 86675 - DNA, 489 bp, Homo sapiens
cctttagtctcttccaaatgtttaatactgcagagaaaaatacaaccaaaggagatagaacaaaataaacatatatactaatttttatccatttcagttttaatacattccaaaatacgtcaatgtttatgcattccaataatcatcacatttcagatcaatgataatgtactgggttggaataggtgctagaaacaattctagctttggaaaagcttattctttatttcaaaaaagaagaaacagaagaggagaaaagtaccccctttaatttgtcctttagttgaatgttcagttcagaaaaacaaaaaaaatggtatttaaaaaaaacttgctgggcacggtggctctcgcctgtaatcccagccagcactttgggaggccgaggcacaagaatcacttgaacctgggagacggaggttgcagcgtgccgagatcgcaccattgcactccagcctgggcaacaagagtgaaactccgctccatctc

SEQ ID NO: 86676 - DNA, 637 bp, Homo sapiens
attgaagtatgtttatgtcatgatagtaataaaatgtaatatatagtaatataatgatcacatgtagccatgatggcatgggatcataaaatagagtttcaactcttgtaattaaggcccaagaagttattttaatttttttactataatattactatattatgttttcaatatgtaaaatagagaaaagaagaaaaagagatattttgttatcctaattatctctaactcctttttccctgtgcgtctttattctacctctttataattgctatgtagttagcaaaactgttccttttaataattgctatgtagttagcaaaactgttgttacgtagctttttaatttttatttcatctttttgctgtgattttgtgtctacatcatattttattcaattgatgtacatacatttcttggtcatttcagtataatattttctagattgctttactttttaaaattatactgttatactatttaaatcaaactatgatgaatgttttcataaacataatatttttttttgtactattctctaggctatcttcccagaggaagttgttttaaataaagagattttaattttaaatgatactgcattattttataatataatgtaatatattaacaata

SEQ ID NO: 86677 - DNA, 346 bp, Homo sapiens
gctaattttattctcctttctatttagaatttaggtttatctgtttgccttgaatgaagtatgtcttttctcttttgttcttgtttcttttcctatgtatgtgtaactggtcacttcattccaataattgctttgattgtttatttatattttactttaatggcttatcagaaatgaatgactatttaaattacaaaaaagtcaaaatatgttatacatgaaaatcaagccataatagctggttaatagctcaggagcacaagttaataattatcagcgaatgttggcactttgattggaggcttgtacttttccttcataagtcatcataattgtaattacatat

SEQ ID NO: 86678 - DNA, 692 bp, Homo sapiens
ggcctgtggtgtagacctggtgccagctgccctggagactctgtgctgtcctgtggggtctttggcagtagaggaatggcccattttacggagactgccctgtgattttgcttgggaagagaccttgggtctcagttgtgccttgcgggcagcaccgtctcaggggtttccagccgcagggctgtgggagttcacgtttgcctgaggctggatgtaccggctcaggcccccagcacacaacccacatcactcactggctcttgggggatgtgcctcagcacctgacacacaacacctggttctgagtgggctgggtccaggcaccttcgctaagcttcctccaccagcgggacctggttctgggtgggctgggtctgggcaccttcgctaagcttcctccagcaccggggctggcaaggagcgaggcaaaggtgtgtgtggtgccatcctgtaggagccaggctccttggggatggtgtccttcattttgaaaatgtttccttcccatggggagggggcagccagaatgcccactctttaatgcacctgtgccagtggcccacagggacacggtgtcccctccccgcgaccacccctgtgccgcagctgcccttcccagacgcatccgtcgtgagtggctctcgccgtgctgtggctggttgagctgagtgcccagcgctgggcaccctctg

SEQ ID NO: 86679 - DNA, 484 bp, Homo sapiens
caaggagacctggcatctggaacaggactgtgttgagatcagagagacccagtctgtagtctgattgatctctactgactttgaggttatggaagttgtaggaaggttgttgttatggtttatacagcatgtagtatattttcattcattccacattccactcaatatttgagtacctactagacatagttcaaggatttctgtacatgaaatgtgccaaaatgcttctccataaaagcagtgaatcacctttgcatgaattgagttagatgttggttactgggctcccttgagttgtgggttaggagttaactgtggcctgacctggatccctgtgactaggtgatgctctcgagtttgccagcaacagaaccgtctctgcgtccaacatctcctaagcgggacagtagcgtgggctgtggcatgctaggaagatcactctggccagttgtgtacaagataaattgcaggggaaggaagtggg

SEQ ID NO: 86680 - DNA, 361 bp, Homo sapiens
tacctctccaaaatcccaccttttcaaaacatacccctgcacatagcaccaaatcctcacagttactgctgcagccaggcattgagatgaggaagaggagatgaaaacacgcaagacacagactccggttttaaggagctcacagccctccatgtctttgctcctgtccagcatttatagcctctcagaagtttctggaatgttcctcaagattctttccaccttttaaattctagtctttcaaaagtgactcaaattatgtcttctttatgaaggcttttctgaggcagacataattagtctttctcttctgtcagctcccagattatttacgatagggtggccattctgttttatataa

SEQ ID NO: 86681 - DNA, 367 bp, Homo sapiens
gctgggattacaggcacctgccaccatgcccggctaatttttgtatttttagttgagagagggtttcatcttgttggtcaggcggacttgaactcctgacctcaggtgatcagcccacctcggcctcccaaagtgctgggattacaggtgtgagccactgcgccttcatctctcttctgtgtatgtgtacgctgttttttctttagaatgggggacgttatcaggctctacatggtgtgtagtcggctagcatgttgtaagcctttccctgtgtcacaagtgctcatctggaacaggattctaatgactgcctgtggctatgttgggattcctttaactcagctccttctgcccagcatctatcttt

SEQ ID NO: 86682 - DNA, 252 bp, Homo sapiens
tttcctgtggaaaattgaagctttgaagtgtctagctccggctttcgcagacgggcagcaccgccagcgcgagctctcgaaaacaagcgccccggccccacccccttcaaggacagaactgcgggttcaaacctacccaagtcaggccttcaaaacagtggggcatgaagagacgatgatagaacctgctggaaacgacgccctaaactaacaaccccctccagaactgccccccgccagctccatcctgcc

SEQ ID NO: 86683 - DNA, 381 bp, Homo sapiens
tacctgagttcacagctggagggatggtcagtgaaggcacaaatgacctgagaagtagaagcctatcactttccttgctccagagtgcaaagttcaccattttccttatagttaaggtcagttacccacatcaacataagagtaatactctatggattactcagcaacagcaacctaaccacttcaccctggaaacttttaggacacgtttgcataactaattatgtgttatttggattatcagaagagcctgtattccctgagctcacattatttagaacaggcagtccacaggtagctgagaagagaggggatttttttgtttgtttgtttgtgtgtttgtttgttttttgagagagtctcgctctgtcacccaggctg

SEQ ID NO: 86684 - DNA, 1292 bp, Homo sapiens
tttatttttgcagtaattttttaatctcaaaagtgtcttttttgtcttatttcatcttcacagtttcctgttcttattatataaatatatctccctaatctgagtctatggattggagttttatccaatccattcattccaatgattggaatgattggagtcattcacatttctcaatccatttattttccgtttctttgcctggtctttcttttatgtgatgcagctctccttgaatgtctgatacattttcatcctttaaaatgaagccgatgggtgacaggaagacgtgcttccatgaaaggcagtgtttcactccggaacctcagctcccgcacgctggatccagatccacagcatccccaggacctcttctcccctctgggtcctgcccccatctcactggctcccatctcagattccctgtgaggctccacgcttggcttcacatgcaaagtctaggggtgaggggcccctcccagcctctcagctggcagtcctgggcctgtgctgggaaacatgccctccccgcccgcagccggaggagccgcatggctgtcttgagtggaggtcacacatcccctcccagggccaggggagggaacggtcacagatgttcctcatgagccaaaaataagcaaggtctggctgcggtgctgtccactgccggctccagcaccaggggttgcccaagaacccccttgactccttggggtaagcagctcactgctggctgtcctgtgtgtgatggggaagggggactcaacccgagtgtgcagacctatgatgacccccgctcccacctccacgtcccatggccacggcccctcccttccaagctccttctgcctgatgggcagcaccccctcccgtctggagtctgccggggcccttcctgctctccttcttaatttattttctgtcttggagggaagctgggtgcacctgctcaggtggccccctagggccagaagacctgtcagtcactttcaaatacatgttctttccagctcttccttgccaaaggttctaaaaacactgttgtccgtctcacccaaaaagctaagcttctgtccaatccttaacggtagctataaatgagaagcataagcttggtttccttctaacatccggcaagttagaagatagaacgtatttcttcacttattcatcacatatttgcagggcacccctacacgggacagcagaggtcccaggccggtgctgcacccggagccaggctcggagctggccgcgcgccctcagctgaaactcaccggaggcgcggccgc

SEQ ID NO: 86685 - DNA, 1123 bp, Homo sapiens
ataaaggactagtgttcttttctaaaaagggaagatggatattttttctataacctttataattccattataataaaatgaatgataggttataataaaatgaattttttgcatatgattttcaaaaggaaactaatttatttttctataaaatatcgcaaaggaatcgaatacatttttattctatgtaaataataatataattttcacatttaggaggcaatagcaaatctgggaagcagttattctaagttggaagagcattatcccaatgcattgaaaacatttgatgactattttttatgtcttctttattttgatgattataataatgttctaactgggtggccttcgtttttcactctagtcagtccatcttgtttactatgtcaattgttctccaaaaagtagaaatgtcattgttttggggccatagaacatttcagaagctttccagtatctatgcagtaacagtccaaacccctcaacataacacatttacacctgcaagtatggccccaaatcttcaagtggcttctgtcactactccatagtacataccctttgttacagctgtttcacaaatacaggttgaatatcccttatctaaaatgtttgggactaaaagtttcagatttcagatatgtttggattttggaatatttgtacatgtataatgagatactcttagagttgggacccaagtctaaacaaaattcatttatgtttcatatataccttatacacataacctgaaggtaatttatttttcccttgggaacactgaatagactatatgttgtgcacctacattttgactgtgacctatcacatgaagtcaggtgtggaattttccatttgtggcatcatgtcagtactcaaaaagttttggattttggattttgaattttcagattagagatgctcagcctaatagcaaatgttcccatgttatacacctcaacctcccattcccattggctggaacatctctgcttatattaaatgtcttttatgtgaaatctgtgttctcatagccttttgtatagttctctaccatctcatggctcacattgtattgtacttatttgattaaatatctggatcatctactgtgaaaaat

SEQ ID NO: 86686 - DNA, 1227 bp, Homo sapiens
ataaaggactagtgttcttttctaaaaagggaagatggatattttttctataacctttataattccattataataaaatgaatgataggttataataaaatgaattttttgcatatgattttcaaaaggaaactaatttatttttctataaaatatcgcaaaggaatcgaatacatttttattctatgtaaataataatataattttcacatttaggaggcaatagcaaatctgggaagcagttattctaagttggaagagcattatcccaatgcattgaaaacatttgatgactattttttatgtcttctttattttgatgattataataatgttctaactgggtggccttcgtttttcactctagtcagtccatcttgtttactatgtcaattgttctccaaaaagtagaaatgtcattgttttggggccatagaacatttcagaagctttccagtatctatgcagtaacagtccaaacccctcaacataacacatttacacctgcaagtatggccccaaatcttcaagtggcttctgtcactactccatagtacataccctttgttacagctgtttcacaaatacaggttgaatatcccttatctaaaatgtttgggactaaaagtttcagatttcagatatgtttggattttggaatatttgtacatgtataatgagatactcttagagttgggacccaagtctaaacaaaattcatttatgtttcatatataccttatacacataacctgaaggtaatttatttttcccttgggaacactgaatagactatatgttgtgcacctacattttgactgtgacctatcacatgaagtcaggtgtggaattttccatttgtggcatcatgtcagtactcaaaaagttttggattttggattttgaattttcagattagagatgctcagcctaatagcaaatgttcccatgttatacacctcaacctcccattcccattggctggaacatctctgcttatattaaatgtcttttatgccaaaaaaaaaaaaaaaacaaaaaaaatttttcggggctcggcctcagagaaatttttaaaccccttcggttggggcgccgccccccagttatgaaactggccacgggtcccaagaacccggcccaccagggtggttccccaaaaaaacccggcgccccgcttttagacaccaagggtcgggccccggtccacaggccagagcctaacgt

SEQ ID NO: 86687 - DNA, 476 bp, Homo sapiens
catgtcaccataacatgacatgacctgcagtatcacagaattccatgtgagctgtgtcgaaaaagatcagtcctttctagtggtcagttgcctacagaggcctctgttgcactttttactccacgattgaaacttttttagaatttactgatcccatgtagcatcttggatattagactctgtttaagccaaatagagaatacttacagaaagcatgaagctgtgattttgaaccactgctcatggttgggcctgaagttagaggaatggttatgagcgcacttattcagagcggtacctcagcaccagcactcttacaggtgcaccatgatacttttaatcagtgggcaatatttgtcaaggtcccactgtgccatagccttgcttaggtgctgtaggtgaggtgaccatatgatttatcaccagagtcactttgagaaggagagggagctgttaataactatactgaatcataa

SEQ ID NO: 86688 - DNA, 585 bp, Homo sapiens
  misc_feature (582)..(582): n is a, c, g, or t
tccactttgttacttttttcacttaaaggctaatctgattagctttaaaacatttgttcatcttttaattcagtatttgtatgatgcctatggaagacatatggatttaaatagaacttggctaaccatctgccaataagagaaagtgagatgctaaatcagagaggcaggaaagtctatttcagtaaaagctattttgatctgaaatactgtaggcagtcttacagagtattttaattgggaggatattgatgcatgctagtaaaagaagtgtatttgctgatatggttgaagttatgtaatcattaaatttctatataagtttagagatgtggaactatgtgaaattttgatcctgttaattataattttttttcctaaaaaagccatttgtggaaaaaaattttctgatatattttttagagcagtggcacgttttatatctcatgccagaaactagagcataaaatatcaacttttcaaataaattaactagaaataaagaacaatttattcagtgctaatttgttgatacttttttatagtaaactatgttttaaaaatttaactttgggaaaaaanaaa

SEQ ID NO: 86689 - DNA, 226 bp, Homo sapiens
ccgggcagctagtcgtgctcggggcttcactcccgcgcgtgaggcgagcgggcaagttggctgagggcgtgcggcagaggctgcttccctcggcgacgcgacccctcagcaactcaagctatgaactgaagctccctagggacggagaccggagcggagcacggaggcagcagcagcagcagcagcagcagcagcagcagcagccgccgccgccgccgccttagcg

SEQ ID NO: 86690 - DNA, 289 bp, Homo sapiens
ggttcaagagattctcctgcctcagcctcccaagtagctgggattacaggcgtgtgccaccatcccccactaatttttgtctttttagtagagacggggtttcaccatgtcaggctggtcttgaactcctgacctcgggtgatctgcccgcctcagcctcccaaaatgctgggataacaggcgtgaagcaccatgcctggtcttctcttttgttcttaaccctgtctagttgcactcattcattcattaaaacactagtcactgagtgatagttatgtgtcagccatgg

SEQ ID NO: 86691 - DNA, 446 bp, Homo sapiens
acatttctcagcccattgaggcctatagtgatgaacaaaatatcccataatagaagctagaaaaaagctatttccaaaaatgctttgcaatgtgtggatttatcttacagaattaaacctttattttgatttgacagtctgcaaacacttttttttgtagaaagtacagagggacatttctgagaccatcaagaactatagtaaaaaaatcaaacaacctgccttaatatttagaaacaagctatctgttaaaatgctttagaatattttcattcatgtcacagatttcaacctttttttttgattcaacaagataaaaacactcttttagttgaatctacaaaaagatatttcaaagtccgttgaggcctatagtgaaaaactgaatatcccgtgataaaaactagaagtgagccctgtgtgaaaatgctttgtgatgtgtggat

SEQ ID NO: 86692 - DNA, 614 bp, Homo sapiens
actacactgattaaaaagtccagaactgagaagtttggtacaacaaatgcatcttactgacaaattttttcataggtcaaggttttaaaaatttttaacagatggtcaccagaggaaaaaggcataattaaatctactaaaatgcatttttaatcaaaatgtttaggcaagtgaggcacactcatgactatacttcttcttactgatattttctcagatatttgaaaacaactggtatatcttgtctacgcctgctcttctgtatgatatttgccatcaccccagccattcctcaaatgctgtgatgtaacaaaccttcagagctacctccactctttctccaaaagtgatataggatgtgtgatcctacccaaatctcgtattgaaatgtaatctccaatgttaggggaggggcctggtgggagatgattggagaataggggctgatttctcataagtggtttagcaccatcccccttggaactgtcctcatgacagtgagttctcatgaggtcattttaaagtatgtagcaccttcccactctctcttgctcctgtttatgcagtgtggcatgcctgctcctccttaaccttctgccatgattggaagcttc

SEQ ID NO: 86693 - DNA, 376 bp, Homo sapiens
tctcggctcactgcaacctctgcctccctgattcaagtgattcttttgccacagcctccccagtagctgggattactggcactcaccaccacgcccggctacattttgtattttcagtagagatgggttttcaacctgcgggccaggctgctctcgaattcctgacctcgtgtgatccgcccgcctcagcctcccaaagtgttggaatcacaggcatgagccaccgcgcccggccaggaattaaccttcaccaggatagtttgtggaattttatcaagaggcttcgctcccatctcctgctttcttaacagagtttggaagcagcggaccggataggaaaactgcttagggttccaccctcatgccaagtggcaga

SEQ ID NO: 86694 - DNA, 456 bp, Homo sapiens
ccctaagggaaattattccaaccttattgttctacatggtccatgtcattctggatttccttagcttttgacatattatcaatgataagtaggaaattgttactgttagaagtgtgagaaatgtttgtaagtctcctgcttttctatttgatgaaatagtttaccaggtactaatcataaatttttagaggaaattttgcatttgcaaaaactaaattcaaatgttgagctggccagcatttatttttcacatttattttgtatttcataggcttgataccaagcttcttggtattctttatgtgctttgtaagggcggggttcactctgaaattgctcagttcactgtttctaagacattggcaggatttggaaaaggacatgaattcagctgctgggtcagaaatgtcaccatcatgaagttagaagatggaataatgcaacagtgtgctgtac

SEQ ID NO: 86695 - DNA, 1346 bp, Homo sapiens
cattgtcacctcttggttcatggtatgtgattaagagatggtaccattgccctctgattgccttgcttctggtgctccctctcctgaagtggccctttttagtcagatccttaaagctatttcaacatttctccacccgtatccccccaccaccctccaccaaatacacatgctttgcactattacagatgttaacttgtcaaagtccagaagctcctgagaagtcagcaggaagacatggtggattgaggcatagccatgacctgaaggaaataattaaaatgcaggagggttgctgtgagggacacactaacttagtacatctttctctgatgaaatctgtcaggctcttagtttaccaaatgtgggaacttttgtgcttgttttgctcttaggcacaggataggtcccaggagagattccattcattcctcaaagagaaacagaagaaaaagaatgaagtctcactaatagcttgttagaagaattgtgtttactctgagatctgactcaagaaatggacatggaatctcagcaaatccaagctacagatgatatctgttttgcagctgggccatgcagagctcagccatggcttctcctgaccaagggatgttaaagttatctagaacattaagagtgttaatgagtatatacagagagactaattgtgagcaaaatcattaattagggtcatgtttacatttttattgtggctaatctttcatctgtttggactaaggttcttactgtgttccaaaggtgataataatataactaaattcctctgatactaaagtagtcacacttttatttcttaatttacctgagttgattcctggccaccctccccctccttatcacactagagataattttcagtaatgttttctttatgctgttaagtgattcccttcccagtggaacgagaaggtgaatgtacttaatgaaatgattgatctgcattttggcattcgtccaaattgataaaatatagagggacttttccattcattattttgttcatcatttatagaaaatgcggaaacttttgggtaggtttggctttctgccaattaatgttgtcactgttttcctctgatgcatattcacatgagtcaacagaaaccttttcgactaagcagagttagatttagcgagactgcgtacatcacggtatttattggatgtggaaacctaaaataggaggggcgtggtaaaacctcagacagaagtactgacaaagagtttccccaaacaatagaaccgccatagcccgcacacattcccaggacacattctacagaatggacaaagaaatactcatctgtgtcatcacttgctca

SEQ ID NO: 86696 - DNA, 372 bp, Homo sapiens
tagtataccctcttttctcagctccccatcagcccagagccattgataaattatcacatcactggttttcagaattatttttttgaagtatagaatcacttatttcaaacaaaattgagtatacaaaacagataaatatgggtgggttttctaattaaagttggagtgggaggctagtgacctgcctgctctaaacccctttacctcctactcaggtccctgaaacacaaggaaaatgccaaaattaaagaaatgcttttttcaaatgaaatatcgggcaatagaaaatgagagacaaaatgcctaacttaggtcttttgtcttgtgaatcccagagaaatttcattttatttattatgaaagtaattgagg

SEQ ID NO: 86697 - DNA, 274 bp, Homo sapiens
ggtgggtgagtgaacgtggaggcctaaagcattagtgtatgtcctgcacacttagtatacaacactcaacactcaggctacactcatttttaaacactttcttcagtaataaattaacctaagcttactgtaacttgatgtttaaactttttgctttttttaattacactcagtttaaaacacaaatacattgtacagctgtacaaaaatattttctttagaacctcattctacaagcttttatttatttattttttgacatggagtctcgctc

SEQ ID NO: 86698 - DNA, 130 bp, Homo sapiens
atggtttgaagacttttaaaaacactaaagaaaactccagaaactatacaaaaagtagaaaccaaagcagtcacacccttgatggtgaatgagaggacaataggctcacaaatcaatactgaccagcctt

SEQ ID NO: 86699 - DNA, 444 bp, Homo sapiens
actgatgaactaactgtgagagaaagagatgacactggggtagctttatgaaatctgtcctctgttacaaaatgacttatctgaaacatattgaccagagagttagaactcttggaaaaagggtcattacttggggaaaactaaaccctggacattttagtgagtcattgaaaaaggaactctgagtttagacaaataagaagtggtaacggtgtttctgagttctccaggtttctgcatgccaagaacaggacctattttctccattggtagttcctgacccaaggaacaggggaaatttaaaagatgttggctaggccaggcacctggtggcttgtgccaaagcctagccaaaaatcccagcactttgggaggccaagactggaggactgcttgagttcaggagtttgagaccagcctgggcaacgcagtgagaccttgtct

SEQ ID NO: 86700 - DNA, 394 bp, Homo sapiens
cagtaagtctacacctaggtacatgcccaaaagaactgaaaacaggcactcaagcagatacttgtacatgtcaatattagcatagctaaaatttgaactataattaaaataaacattgtcatattactgcatcctaaatatgctaaccaacaaaaaaaaattaaaatcaaattaagaaccaaaaacaagcagattttatgaagattataagtattgatatttttattacagactggctaataaattttaaagcactgattaaataattatacaacagccatatcagttaagctttttaaaaaatataagaaacatacagcttataagctgccatatttgcagtaaacttttgcaaactttgtaaaggaattttgtgacactcccaaagtaatat

SEQ ID NO: 86701 - DNA, 262 bp, Homo sapiens
ttaaccctcaatctatacatcaccaaattgttttaaaatgtaataaaggccaggtttggtggctcacgcttgtaattccagcaccttgagaggccgaggtcagctgatcacaaggtcaggaggtcgagaccagcctggccaacatggtgaaacgctgtctctactaaaaattttttaaaaaattagctgggcgtggtggcacgcacctgtaatcccagctcctcgggaggctgaggcaggagaatcacttaagccctggagg

SEQ ID NO: 86702 - DNA, 563 bp, Homo sapiens
ttttaagctacccaggctgtggcaattggttatagttgccaccagaaactaatatactagattaccttttgttaaatttaattaattccaggctgggcaacatggcaaaaccttatctctacaaaaaatacaaaaacttagccaggcaaggtggcatgcccccgtagttccagctgcttgggaagctgaggtgggaggatctcctgaacccaggagatcgaggctgcagtgagccctgatcactgcattgatgacagagtgagatcctgtctcaaaaaacaaatcaaacaaaaattcatttattcattcatttgaataggtaatacatgcatatagttcaaaacgttaccagtgtaaaggatatatgctgaagaagagatctctctcctttccatggccaggagccacctagttttccaccccggaagtatccaaccattacttgttcaaggtgactaatcttttgcgtgtgactacagaattttgcagagtatctcaaaataatctggaaggtagaatgtggtcatggggtaattaatggaaagacaccttgtccttgcaga

SEQ ID NO: 86703 - DNA, 676 bp, Homo sapiens
ggacatctagatatgagctccatatggtattggcacagaagtatgtaaaaacactgcaattcatataaaaccaagggtgagacagtttggatatttgtccccacccaaatctcatgttgaattgtaatccccaatgctggtaggtgtttggatcatgggggtgggtccttcatggcttggtgatgtctatgtgatagtgaatgagttctcgagatctggtcatttaaaagtctgtggcatctcatcccctactctccccctttctctctctcctctctacttcctctgtctcatactgtcttgctcctacttttgccatgtgacgtacctgctctcccttttgccttctgccatgattgtaagcttcctgaggcctccccagaagctgatgccacgatgcttcctgtacagcctgcagaacctgagccaattaaacctcttttcttataaattacccagtctcaggtatttccttatagcaatgcaagaacagcctaacagaaggagctgccccaaatttgacaacaatcttaaaatattacagacactaccaataaaacgagttgtcaatctcaaacttttctaaactatcaataataaacacaatttgatcagtcatggtagagaaaaaagtacactgttgacatatgaagaagtggtcaaaaagtatacagtc

SEQ ID NO: 86704 - DNA, 259 bp, Homo sapiens
tgcaccagccaagaaatgggtgaaggagctagagaggcaggccagccccaacattgtcactgtacttgtgggtaacaaggcagacctggccagcaagaaagccccagaattccacgaagcacaggactatgcagacgacgacagttgactatggagacatcagtaaagactgcaatgaacgtgaatgaagtttacacggcgagagctaagaagattcctaataagccccagagtgcacctggtgctccaggccaaaact

SEQ ID NO: 86705 - DNA, 402 bp, Homo sapiens
tttgtcttatgtagaattgcctatagtaagaaaacccagtagagaaagtggttttgagaccattcggcagctgctttggacacctggagccatttcttttacagatgaagatgcattgtgtcattgtctcaggatcctcgtcctgttgcttctctggccacaaattgttctttaccaaagatgattttatttcactgtctttgaaaatcattctttataggtagaatatgaagattctctgaaatgattccaaaatgccaaactcaaacactattgtccgatttctttacttgcaacaagagagtagaagggacagtatttgttttgtgatgttggggcgttcatcagggagagaatttgagataagtagaatagcaaatagaaatagtgaaataactagat

SEQ ID NO: 86706 - DNA, 361 bp, Homo sapiens
agaggccgtcagacaaaaggggaagggaccatgccagatacacatgagcagaggcccaaaggcaggaatagcacagcacactcaggggctatagagagctccaaatgctggaatatgcagtataggagaagtaaagaaatgcagtgatggaagggtcagcaggggcccaacccagagagaccctgggtgcccactaaggggacagcactgctgggcagacaagatgcacaaggaatgcagttatgaaactctaggacagggcaattcctaagtatataccctagagaatccaaaacatacatccacataaatgcttgtacatgcatgtttactgcaacattactcacaccacaaagtggaa

SEQ ID NO: 86707 - DNA, 183 bp, Homo sapiens
tccattatcagctcttgctaatggctctctgagaaacaggtggttaatgttaactgctacttcaaaagcatctgttacatgtgaaacaaactccctcagctctccttaaaactgtggtgagcctcttctagccgtgtttattacctgaacttctctcattgcaggtattggctatgtaccttt

SEQ ID NO: 86708 - DNA, 511 bp, Homo sapiens
gtcagtatgaatcctgagtttcctgcttactaactgtgtgatcttgggcaagtcactttactctctgagcctgggttttcttcttggggctaagtataccctgttgatggagtagttgtgaggattaaatgagacaccttatgggaaagtgccgaccatgtacaaggttcttataaggattgtttttccttcccttctgagccccccttccaagctctgctggactggaggcactggagtagagtggaatggaagaaacacacaaactttggattcagaccctggctccacagctaccagctgcatgactttccacaagtcacttaactgcatgaccaggggcaggttatgtatcctctccaactttgttttcttaatggtaaaaagggactacccaactcataacattgttgtgaggattagaaatgatgtaaggcacctactaaggtattgggcttatggtaggtaagccctggaattagactaatttcaaatcctatttccctcctta

SEQ ID NO: 86709 - DNA, 448 bp, Homo sapiens
acaagtctgacataatcaaagctaaggttgtgctgatccttcctgtttgaatgagctgaaggggtttggagcaggaaagctttttggctagacgaatgaaaaacaaggatattatcagacacaggcaccactccccccttaaaaacaactcacttttcacattttattttcctttgttataataaatagatgaagtacatatttttcagaagcattccttgttattttggggttttttaacaactcataggttgtgtttttaattatcactgtcaggagtgaatctcggagagctttttggtatttattctgtctcttgttagccttgtttttatagttcagcattagttgactgtcttgaaacagaagtcaaggcaggtcattttctcttaagagaaaggagcaatcttggagctttctgttcccagtgtgggcatcctcctgctgg

SEQ ID NO: 86710 - DNA, 844 bp, Homo sapiens
cgcgatgggaaggagcccacccaggactgtggatgtttaaccaaagccttcctgtaggaaagcaggaaagactgggtggcctgagggcaagacgacagtactgctgctcagaaaaggtgaccaaagtggccaacattgcaacctggacctgggactcaaacccaaatctgtctgattcctaaactgcaatcttcccaccagattctgcggcctcccactacctgaaaaatggtttttctctgtctcctcacctaggaatggaaatatcactgaaactaaagaaaacgaccctccagtccagtgggtgcaaactggggacttcagctggattcacccctcaggtggcttctgtttggccaccaccttgtttggtaaagctgacagcagccaagtcatagtccctgaaacatgcagcagatgaagacagcggccctcgttggacaaaaaccacatctgcttccctttaaaagaaatgacaaacagaatagctgctcaccattcacagcaacagagtctagaacttaagatgctccaagcatcttaacaccttctcaactcaacgcaccaacggaagggtcaccatgtataaagaaaaatgtgttcttccatttaatgttttccctttcagtaggaccccatcacccttttttaagtaacagctttattaagatataatctacaccatgctaggcatgtttgtggctattatctcatttaatccatatcatcattccattgcactaatttgaaaaccaaagctcagagaagtaaacgttctcagagccacacagttgctccatggtagaggcaggatttgaacctggatcgccccaagtccaatccc

SEQ ID NO: 86711 - DNA, 440 bp, Homo sapiens
tgactgatctgctctagcaaagttttggaactgatagattcctggctgagcttcctcctgaagatcatctaataaaaaggaacccggggcttttgcaaaaaggccatctgataagtatttctttccttggctagtagtttgccaatgtgtataagagaaaaagaaaactataacagaaaagagaaccactgaatgtccaccaaattgacatctagactgacatgttacagtgattatgaccagccagctctgatctgagaagccatcagcatctctaaaacaaatcacaagatagctatcacaacaataaggagaccgagacataggtcatgcttttgatgtggtctctgaaggccaggaagaaagtggtgcacacagttagagaagcagcctgcaatgtcaacataaaggatgagagagagcatgagtagagaacgtca

SEQ ID NO: 86712 - DNA, 823 bp, Homo sapiens
ccaggcgctcattaaaacagcaggttgctccacactgcctcgtgttgtctgttggcacactctcaagagtttgaacggatacaagaatctttcatctggtgccgaaacccgggaggggctccggtcttcgtcccccgtggacctacccctccgccccagaaagcaggccacagcagccggacaaaggaagctcctcagcctccagttgcttctctgtgcatgcacatcagtcactgatctcacctactggcccagtcccaaggcgcaaggccacttgtgccagcagtgtgagtcagcaagatagcagaagcaggaagagagccggccagaagacacctactctgactgggagacacgtacccctgaagattgagaaagaggccatccagggagtgaagatggaatgagaagaacagagaaacaatgacagagtccttacaaacaccatgatacaagaaggcaatggggatatgttatcctaaaggaatcctaaaagaagtgatcaaaaaggtgaacagaaaaccaagtgggagtactgtcactgaggatgagtttccagagagaattaatgctgaagaagctattgcagacactgctgagtatgaagaactaattggagaaggaagccgttgtatagcagatgcagagcagcagcaaaaatggtaatgaaaatagaagataaattagaaaatttggaaaaacccaaacagatcagccatattgaagggaaaaagaaaaacaaaacaaagtgggagggcagaaatgtagaacggtatacactcttttaaccccaaggatgaatgtagccaagaacacagtgggg

SEQ ID NO: 86713 - DNA, 357 bp, Homo sapiens
atctatccagttaaatttttgatctgtatgaaatttatcctagaacaattgtgatatgaatcaaattttagtttttgtatctgttccaatacaattcatgttttgacatattttctttgtcataaaataagatacatgtatatttgagtttgttattgacattctcttttgtaccgttaatttattgtttattaattagcatctatatgctgctgtattattgctagctatttaagaatatcaaatgtataatatgcattttagtatttgcagtgttccatgccactcttacctagtgatcttcctttgtggatttttttcttatgaatatcttccttgtttgttcttccatgtgaa

SEQ ID NO: 86714 - DNA, 437 bp, Homo sapiens
tattatactttaagttttagggtacatgtgcacaacatgcaggtttgttacatatatacatctctttcttatcatcatgatcctgactatgctccaaaactcttgaaaaacaaaaaaatagaaagcaaaacaaaaactgtgttgtcatttattcttgaaaacaaagaaatgaacaaaaaggatgaaccaatctctaactttaagaaaagattataatattcatgcagagttcgggcacataaaatgctgtatagactaagcaaccctaatccaaaagtccaaaatctgaaatgctcaaaaatccaaaactttcagcaccaacatgatgtcacaagtgaaagatgatgaggacactgttaaaactgcaaagtgcctatagatgacatggtgaaaatatgtgatgggtttactgaaggactctaagagcattcattcat

SEQ ID NO: 86715 - DNA, 282 bp, Homo sapiens
gagagagagagagagagagagagagagagagagagagaggagagagagagagagagagagagagagagagagagagagaggagagagagagagagagagggggtttatctggctcttctgcatcccatgtggggaaaagggaagcagaagtgcctctaaagacaaattggagaattgagatgctcatccagctaactcaagccaagtattattttggcctggaatcttagagttctggtggagatggtgttttgtatcaacttccagatatctgtcatatat

SEQ ID NO: 86716 - DNA, 571 bp, Homo sapiens
gatctctagagtccattaaaagcaagctagattgagagctcttggagggcagggactgggcctagctcatggtttacagctcttgagggtgactgcacagtggactcagtcagtcatggctgagttgagttggctttattatctctagaatgtagttctccattcaaatgcaaaacagccttattctctcaactgtagtaaaagaggattctaactagagatgaaaaaggttcttggcacctactgggccacaagactgcttttgcttcccactgtggaagggggcactgttatctaggaaaaacatccagatggcacacctactcagaagtggttccacaaagaaattgagcaagcattcagatgagcagcctcagctcactatctagctgttaataaattttaagtccgttttgttcctttgcaccaaagaaattgaacaatgtcaataaaattccaaacgtgaactgttttatgtaacaccacatcctaaggaagaatgcctgaaacaaacctttgatgtcctcataaaaatgatagccattttggagaaattatggaaaacagacca

SEQ ID NO: 86717 - DNA, 566 bp, Homo sapiens
ccttgggaagtgagaggaaactggagcatccagagaatatccatgcagacatggggagaatacataagctctacacagacagtgaaccccaacgggaatctattggttttttctcatcaacattataatgaaatgacatggaatgaaacgtcgttattcgaagaccggtggtactcagttctaaacatttcagaattaagagatctacacacatcctcctctatataagggagggggtctcttaaaatttccgggcaacatactcttagccggcctagaaaacactttagaatagaacggcattataatacattttcatattctatttatatcttcatatttctccctctacttatgaaggtataatctggtatatgtagtccttcagttccttaacaaggtgaacatatgatctcatgatgtgtgttttaatttcttaagtgtgttgagatgtgggaatgtgaggaggatggaaaggaaagaaaggaactcagcagctacaaaataaatctgacctttaattttttttattgaatttgtttcttgttttatttttccttcctttg

SEQ ID NO: 86718 - DNA, 654 bp, Homo sapiens
  misc_feature (1)..(1): n is a, c, g, or t
nctgcaaggcaactgttaaaataatttctcacaggagtagagttttctttctttcctaaaaatccaaagtgtttcctcagacatgatcacaccagcctccacaatatatttctagttgtttgggggatgttatcctgctttatatatgaggccaggaaagggtaaaatcctctattcacttacctggttttatacccaggtttccctgtatgtactgtaatggggtgatggaaaagtgaactaacattttttcttgttcctattgttaggtgagagagagagatttgtggggagatggagtggggaggattaattcctttaaaataaattcagtttgatgtacctgcgtgacactcagatggggatatcctattgtcatttgaatgattgatctggtgctcagaggagatgaacaggctgcaaataaggatttgagagccattggaggatggatgataatggagcacatggaagcagatgtggcccttcagagagaaggtgcagagtcagagtgaagggttgcaaaagaaatgtaagggactatgggcagctggggagagaagcacagaattgaaacaatgtatacccttccagacacttttactattcatatacttatatattctttacataaaattggatcatactattgaa

SEQ ID NO: 86719 - DNA, 330 bp, Homo sapiens
atttgcacagtctcaaagtatcttcctgtaagatagttattaattacagaaggtaaaacagtaacttctcagtggaaaaacctagcagacaccacttttaatcaagggatcgaagttaatgagatttatcttatcttcatcatgtgcctcctgataacatactggagaggggataacatcacttctgtgccaaaaatgctttagctgaattcaatcatgtggacgtaccaaacaaacccaaatttagaggtgacttcaaaagtactgaggtcatcaaagacaaagaaagaatgaggacctcctctcaggaggagactaacgagatataat

SEQ ID NO: 86720 - DNA, 391 bp, Homo sapiens
aaaaaaaacaattcagacacttcctacacttgaaagcgtcctattattgcatttaatacttctcttttcttatttttttgttttgttttgttttgtttttttttgagacagagtctcattctgttgcccaggccggagtgcagtagtgcaatctcagctcactgcaacatccacctcccgggttcaagcaattctcgtgccctcagcctctggagtagctgggattacaggcatgtgccaccacacctggccagttggtattggttttggttttttttaaaagctagtttcacttaaaagtgttcttggttaggcagtacaagttatttttatggtatttggactttgggcaacacatctttttagtaatctcatatgatataatgggaag

SEQ ID NO: 86721 - DNA, 177 bp, Homo sapiens
ctgagctttctcaccgggctcagtgaccagccttgattttctcttctatagatgtgaattcactgctcgcataaagccaccagcggtgttgagcagacaaaggggttttacattccagaaagaaccaggcaaacaccaagtagggggtattttgcagcaaagcactcagcttcaccc

SEQ ID NO: 86722 - DNA, 202 bp, Homo sapiens
ttttaatcccaacattttacaacacattgtattaatggaacacttttcaatatatatcatctgtaagagccagcagactcactcctcaggtatgtcctacctggtgccttttgcagatcactagagccacaaaagttctagtcctaaaatagtcaattaacacttgttggaatggctggatttgagcactctgcctcagact

SEQ ID NO: 86723 - DNA, 306 bp, Homo sapiens
ttaactgggtaggggtgtgagtgccatgggggcccatgaggatggggacaccagggtggtttatacagtagaagagacaagggattttaacagatggaaagggggaagagaggagggacccggatctgtccggaatcccagacatgtactttggttggccctttgagcatgtctgccctaattcggcatgtttgttttcttctcagcatcctccctttccctctgcctctaagttaaagtcctgaacttctgcccagctgcccttgagctggaaggcccatagttgtcttagctcttccctgtccc

SEQ ID NO: 86724 - DNA, 435 bp, Homo sapiens
gatcactttttagttagtttgaaacctgcttttagtttatatgtagtatttctacatattgttacttaaattgaactaacaatttactttttaatttttcttcttccttttaaaaaaagagtatataatctgacaatgttagtacatcttttagaaggtcactataaagttgctttccctatttatttggaaaggattatttccttattattttaaaaaatcttttaatttttgtcttttcaagtaattttatcattgtcccaagcctaaggatgagtggcaatttaaaagacacaaggtgtgcatcttctatctgcaaatactccaaacagaaattattccagtttgttgatactttgagtggaccagggaaaaatgtgtatgtttttagtgtaactgaattgtcattacaaaaagatgagtaaagttgctgtt

SEQ ID NO: 86725 - DNA, 143 bp, Homo sapiens
ggggagagcgcgagaggctccaggcccggccgcagccccgccccccgcgcctccccgcagcgggccttgcaccccaaattcctgagcctcattgggggggtcctccccccacgggccgggcatgctgccccccggaaggaacc

SEQ ID NO: 86726 - DNA, 755 bp, Homo sapiens
cattgaatttcataaaatgttatatctgttgatcactgagagatgaggaggcaacccacctatacacttgtctgacgtctgcatgagctgaataacacaccggcactgaccagccaatcaccactagtcttcgaaagcagtgatgtcctaatcatgatgcccatctgttatttatgtcatttttttggactaaagagccagcagcaaggtttgcaccttatacaattcgttaaaattccatggcaaatgaagtttgaaccatgctggtggggaggactggagttattaaactaaaatgtggtaagccaaatatgtccatatggggactgggcaaagcaaagactgcccacatacagcaccttagcctttgtatgagttaggaaacaatggactgtttttccttctacattcacactcaacatagaatgcttctgatcaccaaaatgtgtgggtgatcaaacccacacaccaaacaattctctagtggacactaacagggtgtcttataatttaattcaattctgacaccatctacctggagttacagtcagaacccacaggttaagggctcagtcctgcaagactgtgcacacctcagaagccagtcgcaagccgcaggctgtgacctgtgcctctgtccaatgagctataaataggggttcccacaaccccatcctggagtttgataatttctaggccagctcacagaactcagggaaactttacttacgtttacccatttattctaaagacta

SEQ ID NO: 86727 - DNA, 382 bp, Homo sapiens
aaaaagtgctatgaaaataaaagggtatcatgtattaagattttaattgagaacactgggaaacctttaacttatattactaaaagttcttagtcctaagttcaacttttttgcactgacattttcatattattttacacattatgggaaattcaacaacaatcacttagatctgtgatgtgctggcactagctagtactacctcctaagacccaggtgtacatatctccttccaattatgaggatttggtaacttgaaattacccatggtacaagtatgtacaccatggaaactggaaaatggtataaataatataggttattagcctaagtagatatgggcacattgtcaactattttgcagagagatagatatctaatt

SEQ ID NO: 86728 - DNA, 547 bp, Homo sapiens
ttcaaatcccagccaggcatgtgaccacaggcaggcaacttaacttcttagtagcttggttttcccctccgtacaatgggtgtgacactacctccctcgagactgatgggaggatgaactgagttattatgtacaaaatactcagagcttgggcacacagcacgtgctgcctccctgagtctttattgactgggacatcaaagtgtggcattgggctaacacgctgtctcctcaaagttgcttccttctgctaattccacactggaagaaacgacctttgttgtgtctgtatttgtgtgagatcccttcattctcattcctatctcgaagggctttttacctggaggtgtggtttgcaaactgctggatctcactgtttgcacacaaaaaaagtgctgatattcttaaaaatctcccttgtgaggagcgaaaagagataatgcttttttttttttttttctggaagcaaggtcgacaatttatcaccagctgccaaaaccttcctctaaggcatcacttctcaaacttttaaagcattctccctgtc

SEQ ID NO: 86729 - DNA, 702 bp, Homo sapiens
gctatgccctgctgtagtcacaggaggtgtagagaggaccccgggacatctgaaagccaggaaatggaggagtgggctttgctggatatttcccagaggaaactctacaaggaagtgatgctggaaactttcaggaacctgacctctgtaggaaaaagttggaaagaccagaacattgaatatgagtaccaaaaccccaggagaaacttcaggagtctcatagaaaagaaagtcaatgaaattaaagatgacagtcattgtggagaaacttttacccaggttccagatgacaggctgaacttccaggagaagaaagcttctcctgaaataaaatcatgtgacagctttgtgtgtggagaagttggcctaggtaactcatcttttaatatgaacatcagaggtgacattggacacaaggcctatgagtatcaggaatatggaccgaagccataaaaaaatctcactctgtcacccaggctggagtgcagtggcgtgatctcgggtcgctgcaacctctgcctccagggttcgagcaactctcctgcttcagcctcctgagtagctgggactacaggcatgcaccagcacgccaggctaattttaggtataaattggtggagacggggtttcaccatgatggccaggctggtcttgaactccagaactcatgattcgcctgcctcggactcccaagatgctggg

SEQ ID NO: 86730 - DNA, 259 bp, Homo sapiens
agtaagaaagaaaatacaatctagatttgtttttaatgagatgggtgcagtttttacttcttccctagtagaatatcagagggagacagaactgagagccacgaaatgaggcctcaagcccggaataacaataattgtgttatgttgtctactccggactcactgcctcccattccaggatccatactgctattttcataacactctaaatgatttcacatctgtaagtaattagttgcaaaataatctgtcttgggac

SEQ ID NO: 86731 - DNA, 339 bp, Homo sapiens
tcgactctagcaggatctgaaaacaccgcaatcttattttaaaaaagaactattctttgaacatccttgcatggtttttcaaacttaactatatgaccaagcaccacagtcacagtatcacagtttcttcatctgcaaaatgacagtgttatagagcatgcttagaaagataattctgaagtttaaatgatacataatacagagcatatccaactgcctggcacatattaagtactcaataaatattagctatatcaccattattatcactgttattctactactactactattacatcttcttaggataatttcctagaagtgagattgcggtgtttg

SEQ ID NO: 86732 - DNA, 461 bp, Homo sapiens
gaatctcccatttcgcttcttaaactcccagcagtattccactccacccctttcattagtcataaaagtgaggtgtctgcattcaggcatcccaggatcctttgcaactccagctcagctaagcaagagaggggaacttcccaggcaggggcacagcagagagggaggtgacagcagaggttaggtggcctcactacactgaacatcacccaagaggaggcaggggatctgctcacagccagatggtatggagaagcaggcggggcttgaagatgcctgagtgtgggtctctaggtctttctctggtggagaccgtgaagtaaggtcagcttctcaggccacatcccagggataatggtccttgcatgagccaccttctgtccccactgataaagcagtatatttaggtaccagaggagacttggcataaacctaggagcagtccccatgcatccgtattt

SEQ ID NO: 86733 - DNA, 133 bp, Homo sapiens
tcctacattaacgtcctgactttgtcggtatattcacctgttccagtgaacatactccagcttacgctttcaacccctgtcactgggactgttttgggactacattaggacctccagtctattgactcctgta

SEQ ID NO: 86734 - DNA, 385 bp, Homo sapiens
agtccctctgtcacccaggctggagtgcagtggcacgatctcagctcactgcaacctccacctccagggttcaagctattctcctgcctcagcctccccagtagctgggattacaggcacctgccaccatgcccagctaatttttgtatttttcgtagagacgaggtttcaccatgttggccaggctggtctcgaactcctgacctcaggtgatccacctgccttggcctcccccaaagtgttgggattacaggcgtgagccactgcacctagccaaagctaatatcttaaacaatgtataacaggcatattaaagcagatctgtgtcatggagctacaagtcctccctgtaagtctaaattcatgccgaatgaagagatgctat

SEQ ID NO: 86735 - DNA, 673 bp, Homo sapiens
agatccccggaaggtttcttaaactgcagcagaaatggagctatgaagacaaagatcaaaggcctctgaatggcttcaaggaccagctgtgctcactggtattcatggctctaacagaccccagcacccagcttcagcttgttggcatccgtacactgacagtcttgggtgcccagccagatctcctatcttatgaggacttggagctggcagtgggtcacctgtacagactgagcttcctgaaggaggattcccagagttgcagggtggcagcactggaagcatcaggaaccctggctgctctctaccctgtggccttcagcagccacctcgtacccaagctcgctgaggagctgcgtgtaggggagtcaaatttgactaacggagatgagcccacccaatgctcccggcatctgtgctgtctgcaagccttgtcagctgtatcaacacatcccagcatcgtcaaggagacactgcctctgctgctgcagcatctctggcaagtgaacagagggaatatggttgcacaatccagtgacgttattgctgtctgtcagagcctcagacagatggcagaaaaatgtcccccgtacccgtagcgttgtgcatagcgacggccagccccgcttcaccgtctcgccggtccctgtcgagaagcccgtaagtcgcccag

SEQ ID NO: 86736 - DNA, 341 bp, Homo sapiens
tggtattggtgactaaagccactgccccctcacttgcctcttctacttattatcttaaggataagttccttgagagcctaataactcagcttgagaaatcttccaaggtgcaagtaactgggtaccatagtgatcccctctttgccagcttgggccaatatacccctgctctagcaagaagcacacctgggggaacctggcagccaccttagccagtcggacctgttctgtgcatcctgggctggtcatttctcccagcttactccagtgttctcatcaccacccctgaagcagttttatatttttggatggtggaattttacacagtgcttactttttca

SEQ ID NO: 86737 - DNA, 837 bp, Homo sapiens
tattcctccaggaactgtactaagtgctgatgtgccagcgctatgatttatttctgggaagcccagcgggggaacctcacagagcgagtgaagacgcttttcctggctgagaacagcgtgaagctcaagaacttgactggctacacggcctacatggtcagcgtggccgccttcaacgccgctggggatgggcctcggagcacccccacccaaggccagacccagcaagcagcccccagcgctcccagctcggtcaagttcagtgagctgaccacaacctcagtgaatgtgtcctgggaagccccgcagttccccaatggcatcctggagggctacaggctggtgtacgagccctgcagccccgtggatggagtcagcaagatcgtgaccgtggacgtgaaggggaacagccccctgtggctgaaggtgaaggacctggcggagggggtgacctacaggttccgcatcagagccaagaccttcacctacgggccggagatcgaagccaacgtcaccacgggccccggagaaggtgccccaggaccgcctggcgtgcccatcatcgtgcggtacagctctgccatcgccattcactggtccagcggagacccgggcaaagggcccatcacccgctacgtcatcgaggccagaccttcagacgagggactatgggacatcctcatcaaagacatccccaaggaggtgagctcctacacgttcagcatggacatcctgaagccgggcgtgagctatgacttccgggtcatcgcggtcaacgactatggtttcggcacccccagcagcccctcccagtctgtgccaggtaccggcctgggg

SEQ ID NO: 86738 - DNA, 425 bp, Homo sapiens
tgtaggcacacagatcacactctcgatttcaaaatatatatgccttactgccgttaaaagcaatgaggtaagacagctttctaaaatctgcccttgagttgaatattttttatgaactatttttgaattggactccatttaaaagcaaacattggtggagcatggtagctcacacctataattccagcactttgagaggctaagatgggaggatcacttgaggccaggagttcaagaatagcctgggcaacatagcaagaccctgtttctacaaaaaataaaaaattacttagacatagtggtgtgtgcctgtaatcttaactactcgggagggtgaggtggaaggactgcttgagtccagaagttggagactgcagtcagctatgatcacaccagtgtactccagcttgggcagcagagcaaga

SEQ ID NO: 86739 - DNA, 847 bp, Homo sapiens
agggtcttaaggataaaatgcagacaggacctagtgcttgagccttttcagatccagccactacgtaattttctggtctcttctcttgacatcagcccctgttaaagtcataaacttactttcaattctcagaaagcaccttactcttctgttccctcttcttccatccatgtgcctagatctatccattatgtgcttaaatgtaggctcctccaagaagtctcccatgatctgattctgagttcctactgtcatcttggagaaacccagtcacagcttttgttgtatggcattgcctgtggactttgctgtcccctcttcacctcccccccaccgccccactgcaccaagactgtaatatcttggagaacaaagacaattttgttcaactgctacatcctgagaagcctagcatcgtgccccaaaatgtggtgggacttcccataaatatgtgttgaatggttgagatcttaatttctgttagaacggtctcctgagaatgacctcctacccgttgcctcagtaacctcttacgcatggagagcagagctgcaggaaagcaggacacacgtgagtccagccaactcagagcttcaaggaggcgtccaggagaaacctccctcagccccgtttgcggtgcctcctggtcggtaattttccagaagcaatttcttgtttcctccaaatggcctgtagaggtcagaaaagggccttgttttccaatcaccgactgtcctgtctacattagcattcaccccgggtgtctataattaagcaagcctaagctgggcacataggaacggaaatgcattgactttaataaaacagagtgtaaaacaactttaga

SEQ ID NO: 86740 - DNA, 419 bp, Homo sapiens
atgtctgtcctcttcatttctctgtaattacatttgaactttgaaacgcaaaatcatttagattgaggcaatataatttgattgaatgaattatcttgtatttttacattagtaattatatttcattgaatcatggaatgttagggtcaaaagagacttttagagaatagattttccaacctctctaatttagtagatgagggaaatggcagccagatgttgacactgagtcacagggcagtgagagcctgttagggactagagtcaaggtctcctgatgaaaccagggtaattttcactatactataccatctctcttgaccctgtcctgatgtgttacatgaatataaactaaaaaaaaagctcaagagacatgctaaataagtgtagtctgccagatacgaatttactcattgaca

SEQ ID NO: 86741 - DNA, 557 bp, Homo sapiens
agccccatttgtcttagaaagcatgagccatcccaatcctcacacaatcaccccacagcacaccccacagtccccaaccaacagccaaaggcaagatacaaaaaggagctcccttactatcagtcagccctttctgaccaggactcttagaatcagagctgccattgtgacaacgagaacaagtgagcatgaatgcccagggcctaagtcccatcactgaggcaaactctgtgtcttgccccataagagcaatgagcccaggcatcctgatagccttctcaggaggtccatttttttctgcagcaatgaatatagtgtgtcaccttcttcctgaaattcctgccctcccttgtcctcttctcccagggttctctcctggcttttccagttttctgaaggttgcttctctttcttcttcactgatgcacactctacacgtaagtgcttctccagatgttgtccttgtctcattcttccactaatttattcctcttttctagaagcatatgaaccccggacctgggccaagtgttgggcaggcattggccatctatttc

SEQ ID NO: 86742 - DNA, 348 bp, Homo sapiens
tacaattcaccctgcatactgctgccaagatgagtcatccttacatactgcttttgttatatcattatccttcttgagaaccagcggtggattttcagtgtctatcagatgaaatccaaatgctttagcctggcatctaaggcccaggacagtctgtccccacattaccttttcaactcagttctaaccaaactgttctactaacagttccttgaatctgtattcattagttcatttaaaaatactcattcactgattctcctttatgcctaatgctggagataccaacatagaataaggtacccatgatttgtactttactgtagcctctaagtgcaagagacagaa

SEQ ID NO: 86743 - DNA, 557 bp, Homo sapiens
tctacagaataaaagaggaggaggagaaagaaagataggaattcatttaatagtctcctatcttcaagcaagctgcaattgtctttgatattatttaacagtttcagttgaagccaatatgctgtcaatcacatatcattgtaactagcaatatttatttgtcactatgagcaagggtaagctgcaaaaacacataagccccaaatttcaatgacttaatataaaaagtttattttttactccagcaggggctgtgctcctcccggctggtggagattccatcttaatacatgcttctctgaccacctgagcaggggaatacagcctaacagtcatatgctagctcttaaaatttctcaccaaaagcaatactcatcacttctgctcacatttcgttggccaaagtgtgtcttatggccacatcaaatctcaaagggggcacagaatgataatcctaccacataccgagaaggcggagagccagaactatttggtgaactgcactactgaccaccttcatagataaacatccactgataaacaccctcagtcaaaac

SEQ ID NO: 86744 - DNA, 599 bp, Homo sapiens
aaagaacttaaggcatcctctgaaaaactggcccaggttagtgtttattatgaatctttttaacctttctatacttgtttctcctacatctcctacatgctctaactagacatgacagaagagatttaactaatgtagtataaattatatgaaattctatttttgtaagtcaaaaataatcaaatatcagaaatttaataatgttcaaactatatactgtgtggggttaccgagacaatgtggacattgttcacatctcatagggctgaaagtcaatgggcaagtcctggaaactcattgtcttactgcggtcttgtcctcagtttcataggttcacccatcatgccctcagctttccttaattagccatgtctgcttacctcttcctcccatttctctctatttttccccaactatgttgtcatcatttccagaaatctctaaagcttgcacagatccttagcactatgagatccactgaaagagataatatttttctctttgagatagggcctgcctctgtcacccaggctgtagctcagtggtgcgatcgaggctcactgcaacctctgcctcccacactcaagcaatcctccctc

SEQ ID NO: 86745 - DNA, 470 bp, Homo sapiens
cggccgatgtatgaacgtcactgggcaggcggtgcctctaatactggctgatgctagaggtgatgtttttggtacacaggcggggtaagatttgccgagttccttttactttttttaacctttccttatgagcatgcctgtgttgggttgacagtgagggtaataatgacttgttggttgattgtagatattgggcgggatgaggaacgtcaatccgcacacacattctcactcgactcatgtggctctgtcagttaaggcagaattttatgctgtttgcatttttcacacatagtacatataatcttggggaagatggcgcagcttgatcatgtgactctttccctaaaccctgccaaaatcctgcttctagttaggtgaagaaacgaggcagtactgactgcccttccagagcgctctcccctgtatagcactgagtaagggaacatttgtgtcctcatgacatttat

SEQ ID NO: 86746 - DNA, 403 bp, Homo sapiens
gcagggacagagccacctgacatgcctccagaggcagtgtacagggaaggacagagcatttctgcaggattcccaccaaaaatgcatggcctgcctgtagtcacaaggacacgtcagacaaacccagcactgaaagtgccaaggccacaaaagacaaagccagactatgcagtcgcccagattaaggagggcaagcaggccaggcttgatgtgtggtctgatctgatctggacgtctgaggagcacatggaatctggatggtcccgagaggtgatggtcctgtgttggtgattactaccccctgctgcccattgtcccatggctggacaagatgctgacattggcagaatctgggtgaagggtgttgaggaattgtttgtggctttttttttttttttttttt

SEQ ID NO: 86747 - DNA, 283 bp, Homo sapiens
aattctctcacaaaggcctaatttgcacccaagtttatattttctgcaaatgggtccaggctatgctctaagtttaacccacttaaaatacttggttccttggtgacttttctaaaatagcataataagtccttggtacaatgaaaaatatactttagctgggtatggtggtgtgtgcctgtaatcccagctccttggaaggcagattggaatcctcggaaggaggatgcttgaacccaggagtctgagaccagcttgggcaagatagtgagacctcaattct

SEQ ID NO: 86748 - DNA, 452 bp, Homo sapiens
ttgtagagacggggtcccactatattgcccaggctggtctccaactcctagcctcaagtgatcctcccacgtcagcctttatattccattaacagtattttcttatgattttcagaaattaaattattcacatttacattttcaagaaaaacaaatttcagtggtcctaaacagagccattctttattctaatagaaaagactagaagcttggcaaaccactctttgaactctcattctaatggaaaagactagaagatggcaaactgctaacagcacataactcaaaccaatactcatagttctcctgccagatccattcaaatcaccccatttgacacaggaacatggcaggattaacagcataaaaacagaaaaaaaagggtaacagattttcattcaggtgtccattatactaaccaaaagacattggtttccagacttagggtttgg

SEQ ID NO: 86749 - DNA, 1955 bp, Homo sapiens
cccccaccgaagctggcggggacgctgtccgagccgggggcaccgcccccttgtccgcccagcagcagcatgaatgtggcgacgcggactgtcgggagtcccccgaaaacccctgcgactgtcacagggagccgccccccgaaaccccagacatcaaccagctgccgccgtccatcctgctcaaggtgggtctgggcgagaggcgcagggatgctcgctttcccccacccccggcccccgcctccgaggctttctctctcctccccctaagcgcggaggaggggggttccctggcagcctagggacgtcccaaggggagactgggaagccagtggggcctctgcctatggcctattttttgaagtaggagcacttggagtctactgaatgtcttttaatagcttgactctataacccaccattcagggttcagctattattagaatcccaacccagtggtttagaaacttcgcaggtattctgtggaaaaaaaaattttttaatcgaggaatttatacttagtgggtaaaggctttgcatgttggtgtttgaaagtctttaaacattactttcatgtttgatggctggtagttaatgtcaaacggttaacttactgagcatttaccataatcaggcactgcgccagactttatatatataatatcccatttatctagttaacgcttcgagataaatactgttaatatctttattttatacaggaagaaactgatttctccgtgctgtgggccacggtttatagtagtgagtcaggcagaagtggtctttgctcctgtggagctgacagtctagtggggcttgaagtggttgaatgacttgtgcaaggtcacatacagaaagtaaagggtagatctaggtcttgaatgagggaatttaagaccacctgacttaaaaacctctttgtttatgctatgttgtaatgcccttctacattttaacccttgcataaaagcatacagattaccagaggtaagcacagatgtattttttgttgggagatgggtgtcctgcatgaagtttgtgtcattttcaactaccaagaatattttgcagttttgtcaatgctagtgacaaactttagttacataatagagtttttattaagttattattaactttttccctccttttctctcttctcccaccctaccctatttggagcttaataaatataaaccattttcattgtggatgatactagagactagccataaataaccttgataagaatttggctacttttaccgttactgaagtaactgtcattaattacaattgttattgtcaccaatatagtttctttgactagactttttgcatatttacagtactgtgtgtttgggtctgttttacagtgatattattgttcttgtgagtgatacagcaagagggtgggaaaacttacatttccttgtgtcaaaatgtaatgatctaattcttatggaggtctacttgttggaagagtaattgcctactctttgtgtgcagaggtgcattttaggacaaagggaactttcttgagtcctttaaatcactgggtgatatggataaataaaatatcaacaaatatttggtatagaaacttgattgctgtcttcttatttggcaaataagactgtttcaaaatgaaccaaaacaaagccaggtaccttctacttacaaattatttcatgaggtaaaaaacattttaatgccgagaaaaaaaagggacatgatctcataataaagagaaactctaatagaataaaataaacttatcctataccgcgttgttctctttcatattttttcctgaggattgttgaaaactttgtctaaaggacatatgggaattaccatgggcttgccctattgtgtgtatttggacatgttatgtagatttccattccttgtattagaaaattctaataaagattctctgtctgagtctgatg

SEQ ID NO: 86750 - DNA, 445 bp, Homo sapiens
acaggcatgagccaccgcgcccagcccccatcaacattttcttttgggaacactgtgtaatggattttagtcaattctacaggaagtaaaacatcaatatttggaagtgaaaaaaattaactgcatacttttattgagttaaagctttcctttaactcagctttttcatccaggaggcacgttattaaaatcttgagtgcactcattgattatttttcttttatcaggaagtccataatgttatataataatatattatatgaacatatagtacaaattatatctattgagtaataagtaccatcaacatcaaagactatgttatttttcacctttaattttgttctttttttctctttaatatatttacaagttctgcaaacactttctgttgctttgtcatgttattatcaatttgtttgcaagtgtcatgtttggtattcct

SEQ ID NO: 86751 - DNA, 547 bp, Homo sapiens
gtcctacgtgaaaatcaaaccatccaatggtacacaatttcattcatttgggcttgattagcctgaccagtattactcacgataaccagcacaatggaacccaagtataatccctgaaccccacttaaccttattcagtgcatccaagcttgttttcctccagtattttcatccaactctcttcttccaccccttcaatccttagcatctatatgtatttgaagagtaatttgccatatgttatttgtgattttacaataatctgattttgatgattcagttaactttttgcattttcgtttctcaaagtgtttccagatattccagagggtttttttttccatgtgagcaaacttggggaaaaaaatgcagcagataaaaatttctgaacatcaccccggtttttaatttttataaatggagctaagtgaaactaggttaatgaagaaatgtagtgaacacatgtgtttgtgctaaagattattgtttccagaagaatagttttgttttttgttttttggttttttttttgagacagagtatctat

SEQ ID NO: 86752 - DNA, 481 bp, Homo sapiens
gtgctaggattacaggcgtgagccactgcatccagccaagttgtgttctttatatatactgcatataagtcccttattaaatatatgatttgcaaatattttttctaatttctatggcttttaattttattggtggtatcattttcagtacaaaagcttttcatgttgatgtagtccaatttcttcttcttctccgccttcttattcttatcagtgaagcagggttcttgctttgttgcccaacctggagtgcagtggtgtgattgtagctcactgtagccttaaactcctggtctcaagtgatctttttgcctcaacatccccagtaggtacaactgcaagttgtaccaccacacccagctaatttttttggtattttttgtagagttggggtcttactatgttacccaggctgaccttgaacctttagcctcaagcagtcctgcttcagcttcccagagtactgggattacaggtgtga

SEQ ID NO: 86753 - DNA, 126 bp, Homo sapiens
ttgagctgaacattctttattaggcagaagccatacccttgaagtaggcattgtgttcccaagttcagaaaatagaatctagggaaatagggtcttcttatggttatcaggaaacagtccaggatc

SEQ ID NO: 86754 - DNA, 340 bp, Homo sapiens
  misc_feature (246)..(246): n is a, c, g, or t
aataaatatggtgcatcaattcaactagaactattattggaaaacaactgagtactgggctgatgattaagttattgcctctcagcttcaaccttgctttattgtgttttagctttgtgagactgtggctgacactctggaaatacacttctgttttaccagctgctcccttttcggttctgccaagagggggagctagatagtgccagcaagttggaggaaaaaggaggaagggatctctttctnctggtctgtttcctgttactgactgaccccaaagcccagtgacaattgtttacctcgctggaaaaaacagatgtttcagtagcagcggttgctt

SEQ ID NO: 86755 - DNA, 200 bp, Homo sapiens
tgttactcttctatctcaccaattgtaagaaccattaaaacataggaaaggatttagaatcttaactactccctcaaagatggctagtgcgagcctgaatgtcctgttcaggagacagagaacaattaacctgagtgctgagttaagggaagaggtttttactttctgctttatacacttctgcattgttgtaatttttt

SEQ ID NO: 86756 - DNA, 395 bp, Homo sapiens
gaaatttttcatcagctcttgtttcctctcattctttttgaccttgtagatttatccttttttcttaatttattctcacttaatgggatttcaggagcatattgactaagttttcatttttacatgtatactggggagtatgacatagacatctctgtacttagatattactgatgtaagtctactttgaatcaaatgaacagatgtttaaaaagtattgttcccaattgttttaatgatttcttcctgtgagttggggtggtgctgcccatcaccaactcaggacggtatttgaaaatacctggaaaaattgtaacaatgtctggaaaacactgcagatatttaattggcagaggtcagggatgattaacattgcgaaatgtgagggacggtcc

SEQ ID NO: 86757 - DNA, 390 bp, Homo sapiens
tctgatcaggtacttaccaggttggataacatttatggaatacttatatagggacagatgaccacctacagaccttatgccttaaaaactgagtcttctctccagcagaaatgatcattagcccttccctgcaaaatgtgtaatccagcatcctaggctattcctggcacatgaataagcagcgtaatatgtatcagtctccctgtctttgagactagagacaagaaaacctaacaactaggctttttaactgttctgtaagaccttgaccttgtgcttataccctaacacacatacctcattttgattttttgagttttgtatatagttctaaccttatctagaaaacacaagattatggttaatataagcatgaaataaggatagaat

SEQ ID NO: 86758 - DNA, 451 bp, Homo sapiens
tgccttgatggcggcttcgggatgaggccccatgaaggcacttgggagggtaggtcccagggccacccagctctccaggagggcaagtgcatggcagggagggactgcagggacagatggcagatttgtggtgacctgaaggagaggaatctaaactgttagagacaggcctcagccggacttgctttaaagttaactctttcttaataactaagttgaatgttttaaaaatgccagtattcccaaatcatggacaagttgatgctccaaagaatattaggaacatctaattcactgtctctgttttccatatgaggaaattgaggcccagataaacagatgcgatagacacaccaggctgccccttcctgcagagagagaatgtgtagccacaacctttgtttccttgggaaagggctccctccgtagcaggattatggccagtttcctt

SEQ ID NO: 86759 - DNA, 673 bp, Homo sapiens
  misc_feature (389)..(389): n is a, c, g, or t
gtcttagcattactaaagtaaatgcctattatgatattctacttaggggtaggataagtatgtataccaaatatggtttgtttcgatttgatttttgagacagggtctcactgtcactgctgagtgcagtggtgtgatcatggcttgctgcagccttgacctcccgggttcaagctatcctcccgcctcagcctcctgagtggctgggactataggagtgtgccatcacatccagcactttgggaggccaaggtgggcggatcacgaggtcaggagatcgagaccatcctggctaacatggtgaaaccccgtctgtactaaaaatacaaaaaattagccgggcttcgtggcgggtgcctgtagacccagctactcaggaggctgaggcnggagaatggcgtaaacccgggaggcagagcttgcagtgggccgggatcgcgccactgcactccagcctgggcaaaagagactccatctcaaaaaaaaaaaaaaaaaaaaaaaaaaaggaaaaaaacaaaactaacatggtcatttgcagaaggggcagaaaaagggtctctgcctagacctggggaggtcagggaaagtactatggattggtaacaaccggctgggcttcctacaagagaaaaagactatactcacagagccagaccccatctcaaaaaaaaaa

SEQ ID NO: 86760 - DNA, 224 bp, Homo sapiens
aaacaaacaaaatccagggtttgagtttggaactcgagaggcctgatttaatatctttggggacccaaagttttagttacaggtctcccacagacttgctattggtttggggcaagttgccattcttccttctaaggttccggcatttcctggtctgatcaaaaaagggataagaatcgaaccaaactcttcattcaaaaaattattttgttgagtacctatgt

SEQ ID NO: 86761 - DNA, 376 bp, Homo sapiens
gcaacaatcaaaacagtctgtaagtgcaagagtttacatacacatatatactatatagcttgcatttctcaatttacatatcttgcaatatatataatatataagagtaatatgggatataaaaaatagaaaaaagtaaagcagggtgaagagaatcaggaattctaggcatggcagttttcatcttttggtgtttttgttttgagacaaggtctcactctgtcgcccaggctggagttcagtggtgtgatttcccgggctcaaaaaatcctcccacctcagcctctcaagtagctgggactacaggcatgtaccaccatgcctagcaaatttttgtatttttaggggagatggagttttgccatgttgcccaggc

SEQ ID NO: 86762 - DNA, 111 bp, Homo sapiens
atagtattgagctatatgggatggaacagagggagaaaaagagaccaatggctggaatgtgttgtggtttgacgatttctagccctggctcaacttaagaatggaattact

SEQ ID NO: 86763 - DNA, 433 bp, Homo sapiens
ttacccaggttgatgttgaatttgtggcctcaaactgtcctcccacctcagcatcccaaagcatgggtgactcaattttgatttttagttaatgttttttctaaagttatggaataggatttaaggtttaaagatgaaagaaagagagggcttggcacacttgcttatgcctgtaatcacagcactttggaagactaaggtggttggatcacttgaggtcaggagtttgagaccagcgtggccaacatgatgaaacccggtctccactaaaaatacaaaaattagccaggcatggtgatgtgtgcctgtaatcccagctacttgggaggctgaggcaggagagtcacttgaacccaggaaatggaggttgcagtgagccaaaatcccacaactgcactcctgggtgacagagcaaaactccatctcaaaaaat

SEQ ID NO: 86764 - DNA, 953 bp, Homo sapiens
tatttctatactactatgttaaacctactactttaatgatctggctaccgtctgccaaatgtcacttttcaagtgagaacagaagaatgagattgtgaagattctgtggacaatgtctatataatcatttaagtgttaaatataaactaaatgacaatagcagcttgtaaattaatgctaattctggctgggagcagtggctcaggtggctcatgcctgtaatcccagcactttgagaggccgaggcaggtgaatcagctgaggtcaggagttcgagaccagcctggctaacatgatgaaacctctctactaaaaatacaaaaaattagccgggagtggtggcacatgcctgtagtctcagctactctggaggctgaggcgggagaaccgcttgaacctgggagatggaggttgcactgagctgatatcgtgccactgtactccagcctgggagaccgactccgtctcaaaaaaaaaaaaaattaatgttaattttgaacaaacttaatatcacttacatttatatgcacacaattggttgaatttagcattaagaagtttaaatcttacttaagttgttctcttattcaggagaaccaaatcactgaagtcaattagtagtgtcaaaattgctcattctttccatcaaaatctaccacagatcactaagggacagaaagccattataatttctcattatccatctcaattgctgaccaaaaaagagcccatatagccaagacaatcctaagcaaaaagaacagagctggaggcatcacgctacctgacttcaaactatactacaaggctatagtaatgaaaacagcatggtacgggtaccaaaacagggatatagaccaatggaacagaacagaggcctcagaagtaacaccatacatctacaaccatatgatctttgacaaacctggccataaaacaactaagagtgtcgc

SEQ ID NO: 86765 - DNA, 308 bp, Homo sapiens
gggacagaaagccattataatttctcattatccatctcaattgctgaccaaaaaagatagtatgaagattacaattaaatacttggctctgaactgaacatatcaatgtactaatcattattgtattaagtgaaaacacaggaatgtctagggccaagggatgaccaaaatttaaaagattatttcatatcagagtcagggatattaataattttatgtgagaaaatttgcagtttgttttctcctatttgaggaaggaacagttaattatacagcttaaaaagcccctacttacttaaaaagttaac

SEQ ID NO: 86766 - DNA, 533 bp, Homo sapiens
ctacgagaaggccaagagtggtacttgctttgatcactgtttttaaatagaagacacattggtagaaatctttcatataatatgttgctgcttttgggggggtgttggggagtaccagagaggtctgcatgcatctgcagtgtacactggcaaacaaaaggtttgtcattcccgttgtcctgttgtgcttcctttccacctctccctggctgttcccccacccccttgttccttttgtaaaggatgcaggtgtagtcttgtgccagtctgtgacataacacctgaacaatttctatggtatcctacccatttgctcagattcaaaccaggccttaatcgataacaagcaaagagaaaaaaaggtgggatttgtaaataacaattacagcaaaaaaaaaaaaaaaaaaaaaaaacactgagaactctgctattctgcttaaaatagatatattgccataaggagaggtttttagaatgtgtgttttataaagtcctaaaaaaattgtgatggtcattataataggcaaagatga

SEQ ID NO: 86767 - DNA, 711 bp, Homo sapiens
tatatttgtatatttaatattaagtatagatcacatgtggctgcttgacttctgatgcaactctatgtgttttgaaatagatctgaggctccttataggaatagacaatggtctcttcagttgaatttttgctgacttttctcaatatgtgacaatctcttaattttcctgactctaccctatctaggttctcctcttgtgtcttccttcactcctttaataaatcttagttctcagtcctccactgtattttctatataatgccttagatttcatctcagtcactgtagtgctttcactatttctgcacagatgatgctataatatttacttcagccttcaaaattctaaccagctcttctctaaaaccctactagacatttcttcttgggcaacctacctatacctcaagttggatgtatttttaactgaattcatcatgtctctgaaattgtctctgtctcttaattttcttaacactattcctcccgttcattaggaagttcagtctcctttgactcctctcctttcctgactgcatattcatttggtcctatagtattgtctgtttgatcatcttgatatctgcaaagtccatttttccttctggcacttccttttccatctcttcaactggactggcactgcagttcaatacccagaaatgcacatagtaattacttgttgaatcaataaatgaataactttcct

SEQ ID NO: 86768 - DNA, 401 bp, Homo sapiens
tcagataaaatgaaaatgggaaaaacttatcaaagggccccggtctcctaagtgccctgatgttgagtaaaggccaaatgccccagttttacttactcagatctgctttctgtgattaagaagagatgcacactagagagaggcactttgaaaaacacagcccaggcaaaattcttaaaaagactggctctggtggcggggcgggtggtgaaggactcagggacaccgtgcatgcagcattgagggagttaatgcagacttgctagcagacagcttggaacgttctgggataggccctgcctgaagaacatgcagtgtggttagccatcaagttcccatgtgcagaagtgccttgctcagcaggggcaaaatcagcacgtctgtggcaacagcaacaatga

SEQ ID NO: 86769 - DNA, 1010 bp, Homo sapiens
cctgctgaggacatgaggacccgtctttttgcagtgccaggcagggtggccaaagaggactggactctggacctggagccccgtggtccagttcacattcaccccacaagagtttcaggaggcctcccacggtgcctgtgctgggtggcggtggtggtgccaagaggaatggaatgtcctgggctccttcaggagctctctacccaggggcaaggagagcccagagagaagcgccctggtctcttgagcttcctgatctgctcctgtcccccgctctcctccactcccttgcctttccctaggttgtcccctccctgggcttttgtgtgttttgggagatgtcacctaaccaggacattgatattcaatcccatcccccttcctcccaccctgccccactttgatttaatcctttggctgtgggctgaggcctcccagggaagctgggtggggtgggtgttgagaccccctcagaccagcacagagacctgtccttgtgcagtctgcaccctgcactccctcccttgcctgtagatgttctggatgacagtagaggaaatggacaaggtcagtttgaatatcccagaacacagtgctctgtctcctcccaccagtccagttagcttcccttctggaccaatagacgaggggagaccccatggatcctctggctgggaagccactgaccaggtggccagtggggcagggtgggaagaggggttaaggtgcagtgatgatggcctgttttggagtgtgtctgagactgggattgcatttggggtttcccgtgtgcttgggatgctagagggtcacctgcaggaggcctggggccggcgagaaatctcctgtgatgccctgtgaaatggcttgtctcctcccccatcagggcccaccgaaagctcaggggagcacagaagcccatggaagcccagggagatgtccctggggcagacactaaggcaggtgttgaagacaagctgcttgtcaagaagcatttcccggcaagagag

SEQ ID NO: 86770 - DNA, 774 bp, Homo sapiens
ctggagcagctgtaacttttcatgggctccacagttcagtgaggggtggcagcattcccagacaactcctgtgtattaattatacatatatttgagtgccaattgcaccccaaatccagacttcctggtgccagacaacttgttcattccccaatcaagtccactttctcatgcttactctatgaaaagggcacccatgatagggtcggggtcccccctctagaatgcagacccacactgggacccaagacctccttacttgagaacagagatctccccaggctgccctcttggaagaacagagggcagaagccttactgagccaaatgtcctggtatctggagaagggcaagcgcaacatctcattttgagaggggacaagtggagatatccctggtttggtcagctgaacttgaagaccaaagccaagagtaactcattcaatgctggttactcagtgacccaggttccaagcaagtctctcacaaagctttaatgagtacctgcccctagagtaaagtaatgaagacaataccaagtgctgtatgggtcatgcctcacttaacaacagggatatgatctgagaaatacatctttaggcgattttgccattgtagggacatcatagagtacattttcataaatctagatggtatggcctaccacacacttaggctatatggtctagcctattgttcctaggctctaaacctgtgcagcatattactacactgaatgctgtaggcaatgataacataacggtaagtatttatg

SEQ ID NO: 86771 - DNA, 338 bp, Homo sapiens
tgcttgctgcttgctgtgcctgtccttgcatcctaacagatgtcgtacgagtgctccccacaaagaaggctgtaatatggacagcagggagaaaacatcaaaaaatcatcctaatggtccataagtgccaggaaagcagacaggtggcaggccgctgctgaggccagatgccatcctgcccacagtaccggtactggctcagacaaaggctggaggccttccagcgagtgggatcagacagcctccctcacctgccagagtatccgattctccaggatgctctgagtgtcctcagtcgggtggtagcagcacaccccttcctccccatctcccctccc

SEQ ID NO: 86772 - DNA, 562 bp, Homo sapiens
catggtggcgggcacctataatccccgctactcaggatgctgaggcaggagaatcacttgaacccaggaggcagaggttgtagtgagccgagatcgcaccatcgcactccagcctgggcgacagggcaagactgactctaaataaataaataaataaataaatccaaaatgaagcacagagaagactgaaaaaatggacaaagcatttgtaggacaaactcaagatgtctaacatcccagaaaaaaaggggactacgtgaagaaatacttgaaatatttctaaatttgaggaaactataaattcacactatgtaagcccacactcactgcaagctcaattaacccaaagcacactaaacacaaagcaaagcacgctgaggcccatcacagtcaaactgctgaaaaccagtgacaaagtgcaaatctcagaagcacagagaggaaaacgagtcaccttacatatgcaggagcaaagataaggacgacaacgtgtttctcatcacaaactggagaggccacgaaagaaatgaccaacaacctcaaattccaaacagaaatatct

SEQ ID NO: 86773 - DNA, 697 bp, Homo sapiens
ttatcattctagatttatcagtgatgaaattggacacactcgattttcctcccactggtaatatttgcagtcagcatgaatagactttctcagtacagttttcaactcctggcacaacagtatcctttttccaaactatagcataaatcacagaaaagtatctcctcatttgtttgggatgagttttaattcagaaacaatttatagtaatattctaagagactgactgaatttgctttcccaactgaaaaaggaatcaactatttgttattatttaatgaagctttgaagcatgaggaagtcaattattcttcagtgcagtgatgtacaaaggggactcctgcattttccctgttccctgaagagattaagaacttctgagtggagacaaacgggaaaaaatattgtttgtggaaccttgcctaggcttgatgagaaggaggaaagagctcttacagctaaaactaatcagtaactgtggtttctccaaacatggaagaattttccatcaacagtcacaatggggagtgtctagttggaccatcatggaagatggatgggcctcaagaaggttagcaggattaaatgaagcaaaaaggatggagccctaattcaataggaatgatgtgattataagaagagaaagagacaccaaagcacagaggcaagatggtgtgaggacacaatgggaaggtgg

SEQ ID NO: 86774 - DNA, 1178 bp, Homo sapiens
gcctccgtcaaagaacctcaccattctagcccacagttgagatgcctaaggctcttccctcactgcctatgctctatcacaagttggacataacaatcttaaattgtttctctatattttcattgctcctttatttggatagaagaactcttgattctctaacgtctttcctttgtaacattcttccaagattgcagtggaatgttgaaattctttggtaatacttttgcgatgattctagctttttacctgcaaaagccatagcttctaagagttagtgatttgattgacttgagcgttacctcctctttctttcggaggtgctaatgagagcagcaggaaggaagaagagaaaattaagtgtctgggaagcctccagattagcaataaagatgtggcttcttagaatttgacttactctactgattaggttttttcttgaatgcctgaaggttttaaaagttcatgctaaaattccacgctgaaaattacacttggaacactgtagattgtgcacattattctgatgctgattttccaactatttgcagcaaaatatgggcagtgaaatgcatccacgaggaagaaacattacttcatattgtcttccccaataactcccaaaccataaatccagtctgtttttaggaaattgcacataccttcatggtgtggtggaaaaaaggaggcattcaaaagagatggagttggaaacctgactttatattaattaagttaagagctgtggaactttagatacattccttaacattactgtatctcagtttgcctttctgtaaaatgggtatgataataagtacttcattaaattattgtgaggtttgtgtgagaccatatgactaataataaataatgtataaatatatgaaataccctgtttggccgggcgcggtggctcaagcctgtaatcccagcagtttgggaggctgaggcgggcggatcatctgaggtcaggagttcgagaccagcctgaccaacatggagaaaccccgtctctactaaaaatacaaaatgagctgggcatggtagcacacgcctgtaattccagctattcaggaggctgaggcaggggaattgcttgaacccgggaggtggaggttgcagtgagccgagatcacgccattgcactccaacctgggcaataagagcaaaactcc

SEQ ID NO: 86775 - DNA, 1112 bp, Homo sapiens
ccttagggagtcaatgtgtgtgttgctgcttatttaaatacagttcagttggagccccaagagtgccaatgtgctcctcacaattcccaaatgcctctcttcctgaacaccagaagtggtgggcacctgagtgggaaatttcaggcaacttaatttagttcctcagtgcctactcttgaagaactgggttttcattctagagaggaaactcagggaagggcgtgttgcctatcacaggttcgcatactaagttttaaaaacttttcttggtgtgacttatgccaaggaattatgaagactttttccttgagcattgcatgaaggctacaaagttggaacaggcatgtcctgggtgtgaaagtttaatttccctacctcatttatttatttaatttagagatgggggtctcactatgttgcccatcccggcttccaactcctgggctcaagcaatcctcccacgtcagtctctcaaatagctgggactacaggcccacgccaccatgccctacttcctcatttattttaaattttttgtaccacagtctctctttttaattttatgactgctgaattaatcctagactctgtcttaaaactaagaattgatgtattggcaggaacagctggacattcaagatgtttttgtgattccttttttaaaaatctccttttgtacctgtaatatctacaatatataatctttctttatcgacttaaggaggaaggagaaaggaagaacctgacttctgtgtgaaggaccttactgtcgatcaagactgttactcaaagttctatctcttagtcattgcacctgacctgatccaaaacatatatatatatttgtatgcacccctagagacagctgtatatatatacggttttgccaggttgtacgtttttttctcgagttgtaagtgaacacagtagcactcgtttacattgtcaaggggacatctttagagaacacattttctcactgttgagctaataatgctttgtgaatgtatgatctaaggagaaacccttgtagttatacccgatgatgctgtctgttggaaagtaaattttgaatgtctttttccaaaaataaaaaataaaaacatgctttc

SEQ ID NO: 86776 - DNA, 347 bp, Homo sapiens
tatttttattgttttttgttgttgttgtttgcatcccaggaaatgcacacatgggcagtctatagctaacagtgtcctcagggactcaactgcctgcttttctgctctctctgtctttgcacgtttcctttaggaagttacctcatggacatcaggaaggagaaaggctggaaaaggacttcctcagctgtgtttccctttaaggagccttcccaaaagacaggtccaataactagagctcacatctcagacagaacagcacatggtcactcaaagcttcaagagaggccaagaattgttgtccctcatttgggcacattgccagatccagtagcacaggccactgc

SEQ ID NO: 86777 - DNA, 313 bp, Homo sapiens
gttccaacacatttccgccacacctaagtaaaattccttacccattaagcaatttcttcctatccttcccatcccccaggccctggcaaccaccaatctgtgttctgtctctatggatttatttatcctgggtatttcatataaatgaaattagacaacatgtaaccttttgtgtctggcttcttttatgtagcgtaattttttaaaggaccacccacattgcagccatacttcattcttctttatgactgaatgatattttatagtattatcatcataatatttgtgtgccacaaattatccattcatccac

SEQ ID NO: 86778 - DNA, 2328 bp, Homo sapiens
  misc_feature (9)..(10): n is a, c, g, or t
  misc_feature (12)..(12): n is a, c, g, or t
gacggccgnncngagcgaatgcaggcgacttgcgagctgggagcgatttaaaacgctttggattcccccggcctgggtggggagagcgagctgggtgccccctagattccccgcccccgcacctcatgagccgaccctcggctccatggagcccggcaattatgccaccttggatggagccaaggatatcgaaggcttgctgggagcgggaggggggcggaatctggtcgcccactcccctctgaccagccacccagcggcgcctacgctgatgcctgctgtcaactatgcccccttggatctgccaggctcggcggagccgccaaagcaatgccacccatgccctggggtgccccaggggacgtccccagctcccgtgccttatggttactttggaggcgggtactactcctgccgagtgtcccggagctcgctgaaaccctgtgcccaggcagccaccctggccgcgtaccccgcggagactcccacggccggggaagagtaccccagccgccccactgagtttgccttctatccgggatatccgggaacctaccagcctatggccagttacctggacgtgtctgtggtgcagactctgggtgctcctggagaaccgcgacatgactccctgttgcctgtggacagttaccagtcttgggctctcgctggtggctggaacagccagatgtgttgccagggagaacagaacccaccaggtcccttttggaaggcagcatttgcagactccagcgggcagcaccctcctgacgcctgcgcctttcgtcgcggccgcaagaaacgcattccgtacagcaaggggcagttgcgggagctggagcgggagtatgcggctaacaagttcatcaccaaggacaagaggcgcaagatctcggcagccaccagcctctcggagcgccagattaccatctggtttcagaaccgccgggtcaaagagaagaaggttctcgccaaggtgaagaacagcgctaccccttaagagatctccttgcctgggtgggaggagcgaaagtgggggtgtcctggggagaccaggaacctgccaagcccaggctggggccaaggactctgctgagaggcccctagagacaacacccttcccaggccactggctgctggactgttcctcaggagcggcctgggtacccagtatgtgcagggagacggaaccccatgtgacagcccactccaccagggttcccaaagaacctggcccagtcataatcattcatcctgacagtggcaataatcacgataaccagtactagctgccatgatcgttagcctcatattttctatctagagctctgtagagcactttagaaaccgctttcatgaattgagctaattatgaataaatttggaaggcgatccctttgcagggaagctttctctcagacccccttccattacacctctcaccctggtaacagcaggaagactgaggagaggggaacgggcagattcgttgtgtggctgtgatgtccgtttagcatttttctcagctgacagctgggtaggtggacaattgtagaggctgtctcttcctccctccttgtccaccccatagggtgtacccactggtcttggaagcacccatccttaatacgatgatttttctgtcgtgtgaaaatgaagccagcaggctgcccctagtcagtccttccttccagagaaaaagagatttgagaaagtgcctgggtaattcaccattaatttcctcccccaaactctctgagtcttcccttaatatttctggtggttctgaccaaagcaggtcatggtttgttgagcatttgggatcccagtgaagtagatgtttgtagccttgcatacttagcccttcccaggcacaaacggagtggcagagtggtgccaaccctgttttcccagtccacgtagacagattcacagtgcggaattctggaagctggagacagacgggctctttgcagagccgggactctgagagggacatgagggcctctgcctctgtgttcattctctgatgtcctgtacctgggctcagtgcccggtgggactcatctcctggccgcgcagcaaagccagcgggttcgtgctggtccttcctgcaccttaggctgggggtggggggcctgccggcgcattctccacgattgagcgcacaggcctgaagtctggacaacccgcagaaccgaagctccgagcagcgggtcggtggcgagtagtggggtcggtggcgagcagttggtggtgggccgcggccgcactacctcgaggacatttccctcccggagccagctctcctagaaaccccgcggcggc

SEQ ID NO: 86779 - DNA, 1637 bp, Homo sapiens
  misc_feature (9)..(10): n is a, c, g, or t
  misc_feature (12)..(12): n is a, c, g, or t
gacggccgnncngagcgaatgcaggcgacttgcgagctgggagcgatttaaaacgctttggattcccccggcctgggtggggagagcgagctgggtgccccctagattccccgcccccgcacctcatgagccgaccctcggctccatggagcccggcaattatgccaccttggatggagccaaggatatcgaaggcttgctgggagcgggaggggggcggaatctggtcgcccactcccctctgaccagccacccagcggcgcctacgctgatgcctgctgtcaactatgcccccttggatctgccaggctcggcggagccgccaaagcaatgccacccatgccctggggtgccccaggggacgtccccagctcccgtgccttatggttactttggaggcgggtactactcctgccgagtgtcccggagctcgctgaaacccttgctggactgttcctcaggagcggcctgggtacccagtatgtgcagggagacggaaccccatgtgacagcccactccaccagggttcccaaagaacctggcccagtcataatcattcatcctgacagtggcaataatcacgataaccagtactagctgccatgatcgttagcctcatattttctatctagagctctgtagagcactttagaaaccgctttcatgaattgagctaattatgaataaatttggaaggcgatccctttgcagggaagctttctctcagacccccttccattacacctctcaccctggtaacagcaggaagactgaggagaggggaacgggcagattcgttgtgtggctgtgatgtccgtttagcatttttctcagctgacagctgggtaggtggacaattgtagaggctgtctcttcctccctccttgtccaccccatagggtgtacccactggtcttggaagcacccatccttaatacgatgatttttctgtcgtgtgaaaatgaagccagcaggctgcccctagtcagtccttccttccagagaaaaagagatttgagaaagtgcctgggtaattcaccattaatttcctcccccaaactctctgagtcttcccttaatatttctggtggttctgaccaaagcaggtcatggtttgttgagcatttgggatcccagtgaagtagatgtttgtagccttgcatacttagcccttcccaggcacaaacggagtggcagagtggtgccaaccctgttttcccagtccacgtagacagattcacagtgcggaattctggaagctggagacagacgggctctttgcagagccgggactctgagagggacatgagggcctctgcctctgtgttcattctctgatgtcctgtacctgggctcagtgcccggtgggactcatctcctggccgcgcagcaaagccagcgggttcgtgctggtccttcctgcaccttaggctgggggtggggggcctgccggcgcattctccacgattgagcgcacaggcctgaagtctggacaacccgcagaaccgaagctccgagcagcgggtcggtggcgagtagtggggtcggtggcgagcagttggtggtgggccgcggccgcactacctcgaggacatttccctcccggagccagctctcctagaaaccccgcggcggc

SEQ ID NO: 86780 - DNA, 1761 bp, Homo sapiens
agccggagagcaagcggcctgtgcccagatcctgggagaaccccagccgagcccagcctagcccgagcccagcccgagcggagccggagccccaagcccgagccgcgcccagcccgagcagagccctccagccgctcaccccgcgtgccaccccagcgaccctcagccgctctctgcccttctctcggccccgcgcccgccctcgcggcccctctgcccaatgaaactggccgcgatgatcaagaagatgtgcccgagcgactcggagctgagtatcccggccaagaactgctatcgcatggtcatcctcggctcgtccaaggtgggcaagacggccatcgtgtcgcgcttcctcaccggccgcttcgaggacgcctacacgcctaccatcgaggacttccaccgcaagttctactccatccgcggcgaggtctaccagctcgacatcctcgacacgtccggcaaccacccgttccccgccatgcggcgcctctccatcctcacaggagacgttttcatcctggtgttcagtctggacaaccgcgactccttcgaggaggtgcagcggctcaggcagcagatcctcgacaccaagtcttgcctcaagaacaaaaccaaggagaacgtggacgtgcccctggtcatctgcggcaacaagggtgaccgcgacttctaccgcgaggtggaccagcgcgagatcgagcagctggtgggcgacgacccccagcgctgcgcctacttcgagatctcggccaagaagaacagcagcctggaccagatgttccgcgcgctcttcgccatggccaagctgcccagcgagatgagcccagacctgcaccgcaaggtctcggtgcagtactgcgacgtgctgcacaagaaggcgctgcggaacaagaagctgctgcgggccggcagcggcggcggcggcggcgacccgggcgacgcctttggcatcgtggcacccttcgcgcgccggcccagcgtacacagcgacctcatgtacatccgcgagaaggccagcgccggcagccaggccaaggacaaggagcgctgcgtcatcagctaggagccccgccgcgctggcgacacaacctaaggaggacctttttgttaagtcaaatccaacggcccggtgcgccccaggccgggagcgcgcgcggactggcgtctcccctcccggcgatccgcccccagcactggggaggcgccactgaaccgagaagggacggtcatctgctccggaaggaaagagaacgggccaagactgggactattccccacccccggtcccccattgaggcccgccacccccataactttgggagcgagggcccagccgagggtggatttatcttctcaaagacctaagagtgagcgcggggtgggggagggatgtgaagttatccagcctctgctaggcttcaagaaaccgtcatgcccgcttgagggtcaggacccacggggcattatcttgtctgtgattccgggttgctgtgacagccggtagagcctctgccctcccgaaactaagcgggggggcgtgggtcaaatcatagccaagtgacttgtttacatgtgagtgaaactgcacaaaggaacacaaaacaaaacttgcactttaacggtagttccggtgtcaacatggacacgaacaaaaccttacccaggtgtttatactgtgtgtgtgtgaggtctttaaagttattgctttatttggttttttaatatacaataaaataatttaaaatggaaaaaaaaaaa

SEQ ID NO: 86781 - DNA, 477 bp, Homo sapiens
aaaaaaaaaaaaaaaaaaaaggggggggggggggggggccttctttttggggggggaaaaatttttatcttctcaaagacctaagagtgagcgcggggtgggggagggatgtgaagttatccagcctctgctaggcttcaagaaaccgtcatgcccgcttgagggtcaggacccacggggcattatcttgtctgtgattccgggttgctgtgacagccggtagagcctctgccctcccgaaactaagcgggggggcgtgggtcaaatcatagccaagtgacttgtttacatgtgagtgaaactgcacaaaggaacacaaaacaaaacttgcactttaacggtagttccggtgtcaacatggacacgaacaaaaccttacccaggtgtttatactgtgtgtgtgtgaggtctttaaagttattgctttatttggttttttaatatacaataaaataatttaaaatggaaaaaaaaaaa

SEQ ID NO: 86782 - DNA, 1563 bp, Homo sapiens
tgctgaggtgactctagaggacccgccacaagccgcgatgatcaagaagatgtgcccgagcgactcggagctgagtatcccggccaagaactgctatcgcatggtcatcctcggctcgtccaaggtgggcaagacggccatcgtgtcgcgcttcctcaccggccgcttcgaggacgcctacacgcctaccatcgaggacttccaccgcaagttctactccatccgcggcgaggtctaccagctcgacatcctcgacacgtccggcaaccacccgttccccgccatgcggcgcctctccatcctcacaggagacgttttcatcctggtgttcagtctggacaaccgcgactccttcgaggaggtgcagcggctcaggcagcagatcctcgacaccaagtcttgcctcaagaacaaaaccaaggagaacgtggacgtgcccctggtcatctgcggcaacaagggtgaccgcgacttctaccgcgaggtggaccagcgcgagatcgagcagctggtgggcgacgacccccagcgctgcgcctacttcgagatctcggccaagaagaacagcagcctggaccagatgttccgcgcgctcttcgccatggccaagctgcccagcgagatgagcccagacctgcaccgcaaggtctcggtgcagtactgcgacgtgctgcacaagaaggcgctgcggaacaagaagctgctgcgggccggcagcggcggcggcggcggcgacccgggcgacgcctttggcatcgtggcacccttcgcgcgccggcccagcgtacacagcgacctcatgtacatccgcgagaaggccagcgccggcagccaggccaaggacaaggagcgctgcgtcatcagctaggagccccgccgcgctggcgacacaacctaaggaggacctttttgttaagtcaaatccaacggcccggtgcgccccaggccgggagcgcgcgcggactggcgtctcccctcccggcgatccgcccccagcactggggaggcgccactgaaccgagaagggacggtcatctgctccggaaggaaagagaacgggccaagactgggactattccccacccccggtcccccattgaggcccgccacccccataactttgggagcgagggcccagccgagggtggatttatcttctcaaagacctaagagtgagcgcggggtgggggagggatgtgaagttatccagcctctgctaggcttcaagaaaccgtcatgcccgcttgagggtcaggacccacggggcattatcttgtctgtgattccgggttgctgtgacagccggtagagcctctgccctcccgaaactaagcgggggggcgtgggtcaaatcatagccaagtgacttgtttacatgtgagtgaaactgcacaaaggaacacaaaacaaaacttgcactttaacggtagttccggtgtcaacatggacacgaacaaaaccttacccaggtgtttatactgtgtgtgtgtgaggtctttaaagttattgctttatttggttttttaatatacaataaaataatttaaaatggaaaaaaaaaaa

SEQ ID NO: 86783 - DNA, 201 bp, Homo sapiens
tttttttccattttaaattattttattgtatattaaaaaaccaaataaagcaataactttaacggtagttccggtgtcaacatggacacgaacaaaaccttacccaggtgtttatactgtgtgtgtgtgaggtctttaaagttattgctttatttggttttttaatatacaataaaataatttaaaatggaaaaaaaaaaa

SEQ ID NO: 86784 - DNA, 1756 bp, Homo sapiens
caggctggtacggcccggggtgttatggatggagaacccagccgagcccagcctagcccgagcccagcccgagcggagccggagccccaagcccgagccgcgcccagcccgagcagagccctccagccgctcaccccgcgtgccaccccagcgaccctcagccgctctctgcccttctctcggccccgcgcccgccctcgcggcccctctgcccaatgaaactggccgcgatgatcaagaagatgtgcccgagcgactcggagctgagtatcccggccaagaactgctatcgcatggtcatcctcggctcgtccaaggtgggcaagacggccatcgtgtcgcgcttcctcaccggccgcttcgaggacgcctacacgcctaccatcgaggacttccaccgcaagttctactccatccgcggcgaggtctaccagctcgacatcctcgacacgtccggcaaccacccgttccccgccatgcggcgcctctccatcctcacaggagacgttttcatcctggtgttcagtctggacaaccgcgactccttcgaggaggtgcagcggctcaggcagcagatcctcgacaccaagtcttgcctcaagaacaaaaccaaggagaacgtggacgtgcccctggtcatctgcggcaacaagggtgaccgcgacttctaccgcgaggtggaccagcgcgagatcgagcagctggtgggcgacgacccccagcgctgcgcctacttcgagatctcggccaagaagaacagcagcctggaccagatgttccgcgcgctcttcgccatggccaagctgcccagcgagatgagcccagacctgcaccgcaaggtctcggtgcagtactgcgacgtgctgcacaagaaggcgctgcggaacaagaagctgctgcgggccggcagcggcggcggcggcggcgacccgggcgacgcctttggcatcgtggcacccttcgcgcgccggcccagcgtacacagcgacctcatgtacatccgcgagaaggccagcgccggcagccaggccaaggacaaggagcgctgcgtcatcagctaggagccccgccgcgctggcgacacaacctaaggaggacctttttgttaagtcaaatccaacggcccggtgcgccccaggccgggagcgcgcgcggactggcgtctcccctcccggcgatccgcccccagcactggggaggcgccactgaaccgagaagggacggtcatctgctccggaaggaaagagaacgggccaagactgggactattccccacccccggtcccccattgaggcccgccacccccataactttgggagcgagggcccagccgagggtggatttatcttctcaaagacctaagagtgagcgcggggtgggggagggatgtgaagttatccagcctctgctaggcttcaagaaaccgtcatgcccgcttgagggtcaggacccacggggcattatcttgtctgtgattccgggttgctgtgacagccggtagagcctctgccctcccgaaactaagcgggggggcgtgggtcaaatcatagccaagtgacttgtttacatgtgagtgaaactgcacaaaggaacacaaaacaaaacttgcactttaacggtagttccggtgtcaacatggacacgaacaaaaccttacccaggtgtttatactgtgtgtgtgtgaggtctttaaagttattgctttatttggttttttaatatacaataaaataatttaaaatggaaaaaaaaaaa

SEQ ID NO: 86785 - DNA, 399 bp, Homo sapiens
aataaagcagattgccctccctaatgtgggcaggccccattcaatcagtttaaggcctgaacagaacaaaaaggcttactttcctgcaagtaagagggaatttcgacttgcctggttaccctgagttgggacattggtttggatgcacaccgaaacatcagctcttcctggcttggaggcctttgggctggaactaaataatgcgtattagctctcctgggtcaccaggttgctgacagcagatcttgggacttgtcagcctctgaaattgtagatttatcccaaggaattggctaaaacgattatggaggctgacatatatatgtgggtgtatatgcatacatacatattcatagagatttatcataaggaaaacacacacacacacacacacataca

SEQ ID NO: 86786 - DNA, 584 bp, Homo sapiens
taacctaacttacctagttacttaagtacacatcaaaaccaggcagctaaatcaggagctcctaacctagggcccaggaagcaaaagagtacagaaactacatacaaaagccaaagtttaggtaaacattgtgtactcatagctttcccaaccaaaactgggattggctggcaggttaaggggggatttgtaatgaaaaatagcaaaggaatggtaaccaggataactaggtcaccaacgagctaaagacacataatcaacaaaagggtatactaagtaatgaaaccaaggaaaagttctgccaaggcaccaaaacagtagatgaggaaaggacagaacctactcctagtcagtctgatagctaggtaaaattatcaaggcaacctttattttaggttatcaaacttagacaaagtaaagcctggtaagcctttctactccagagagcagaaatggcaagactcaaaaggaagcagtattacagtaagtcactatatggcatgaatcaaaggtgaagctttcagataaaatcacaagagatttccttgtgtgatacatcttcagagtattctggacattcttga

SEQ ID NO: 86787 - DNA, 815 bp, Homo sapiens
gtttatatgtgctccatctttgaccaaaacgtcattatgggtgcatgactacatttatataagtattcattcttgagcttcagtttatggacaagctaaagttcacgaggagaaatacaaatattgtgtatactacctaatggaaaaagttgggcatacaaattgttcaaatactgagagtaggcccagcatggttgctcacacctataatcccagcactttgggaggctgcaggagttcaagaccagcctgggcaacatagtgtgacccccatgtggaaaaataaaatacagagtaaattgttatgatacaactaacacacattgtaaatcgacggattatccgctttaacattactttagtgtttttttttgtttgttttttgtttttttttgagacggagtctcgctctgtcacccaggctggtgtgcagtgacgcaatctcggctcacattgcaagctctgccttccgggttcatggcattctcctgcctcagcctcctgagtagctgggactacaggcacccgccaccatgcccggctaattttttttattttttagtaaagatggggtttcaccatgttagccaggatggtctcgatctcctgacctcgtgatccgcccacctcagcctcccaaagtactgggattacaggcgtgagccactgcgcctggcctgctttagtgttttttgatacattttatggaaaaggtggtaataaaaattgaaagtgtttttagtttatttaaaaaccagttgtcatagtaaatagtgaattccattcttttttgcattttaagttaaataacaaac

SEQ ID NO: 86788 - DNA, 370 bp, Homo sapiens
agtgtggaagccactggaaaaaatatgagacttagatacataatttgagtaaaaatggctcaaagtcatgagggtaaagttttttgtatttccattttattcgagcggcatcgtttttaaaaatcattatgaatttgaccctatatagatgtttccaaataattctttttcaccttcataaaattccttcctgtggctgtgagatgccttgcctatcagttttcaagcttagttgtctttctcatcctttaccattttagctttaaaaaacaaaagtgacaattagaacttcctgcctgctgggcctcactgaaagaccgatattggcctgataaggagatatttattttgttttagtggcttcagaaat

SEQ ID NO: 86789 - DNA, 542 bp, Homo sapiens
  misc_feature (238)..(238): n is a, c, g, or t
gcaaaagatgcagtagtgggcatcccctctccattcagagcgattcagcactcattcattgagtatctacctactctgtaccaggctcttttggtgctggagagaccgtggtaagaacattatttcacccttccaggaaaaagaaacgtttctaagcctgtacatccaagagacagcccaggagtacaagttgcgccatgacatgggcatggagggagggagaagtcctctggggagngctgcatcacacaacatcaaatgctgagaaccatctcatgttcacgctacatatttactgtctcctatgaataaaattccagacagggtttcagagaacaccaatgcaaatggacctgtatcaggtaatatgccacctttcttcatgtgacctgtccatgcagcagctcttgtgaggtggtagcaagatcggagatggagtcttgctctgttgccaggctggagtgcagtggtgcgaccttggctcactgcaacctccacctcctgggttcaagcaattctcctgcctcagccacctgagtagc

SEQ ID NO: 86790 - DNA, 707 bp, Homo sapiens
  misc_feature (258)..(258): n is a, c, g, or t
gaggtttaagggctaccctgctctatttgtcctgcacaagaactaggcacagagtgaaagcaggtccagtgggcctgattttccacatggaagtcatcagccctctgctgcatgagaagaaaggatattataggctgggcatccaggctgtcaattacctacctctgaaggaagcatgccggaggctatatgagagttcttcctgtgtgcggaacactcactgaatcagatttctagggctctgtgtaagtgagcagnttaagggctacccaaatggccaatacacatatatatatatcagaaggggctcagtttcattagtcatcaaggatatgcaaatttaaaccaaaatgctatgccactacatatccaacacaatgatttaaatgaaatagaagagagtacaagtgtgggcaaagatttgaagcaaatggaactctggaactcctggtggaagaggaaaactgatagtaaccactaatggcaaacacggaaatactctatgacctagcatttctactgctaagtatatacccaacagaaaagtgaatatgcatgccaaagtgccattatttgtaatagccccaaaccagaagcaactcaatgtccaccaacagtagaacgaaccagaagcaacccaaagtccaccaacagtagaacgaacaactcgaagcatattcatgcagtaagaatgaatgaacttacag

SEQ ID NO: 86791 - DNA, 339 bp, Homo sapiens
tcagttctatatccacatatttgtaacttgtaaattaccagtaatagactgaaccacattttttccttttctggttttgaattgaaaaattactgctttatttgtttttttccttttagaactggttttatgagaattggaagttaactttggggatggcttatttctgtgctcagtttttgtttagggatatatacatccttgtataaggatacatatataaatatatacatatgactagaggtctctgcattttttttttccattttttgagatggagttttgctctcgttgcccaggctggaatgcaatggcacgaacccgactcactgcaacttc

SEQ ID NO: 86792 - DNA, 224 bp, Homo sapiens
tgctctgtagctttttaaagatacagctacaatcaacaaaggactggcacatttcagaccacagctacttttctactacaatgtgacttcatatttatttagtcctatcctgtcccaaacaaggtttgttaagacagcttacaaaaatacacacagaataaaccataaaattatttataagggattgacaatttgtcgacgcggccgcgaatttagtagtagta

SEQ ID NO: 86793 - DNA, 531 bp, Homo sapiens
tgatcatatgcttgcatttgttcatctgtttcagtaatactagtcctgttttctagtttagcaaggacttgttccatgacttcaacataatctgtttcattgtcagccactggttcagtataatcttcctcatcctctgctttatagtaatagggctccgtgtagacatcagagtcaagtgtggtacttgactcatttgcagttgattgagataatgtccgaaatctccccattaatgaagagccactgtcctcatacccactcagactctgtgtgcttttgttccatactacttccaaggctgatttagccctctgcagtgtagatccaaattttgggaagctgaaagtcttatcagaaaggtcaatgcttaatcgactatgccatgatttgggtggggcatcctctgaatcatcactttgcaattcactttgacttcgatacatcatggacaactggttttgattttggtatagctcattagaattagctccctgataagaatcatattggccaacccactggccttgt

SEQ ID NO: 86794 - DNA, 232 bp, Homo sapiens
ccgcgcccagcctcagttaagtcttaacttgagtatggtcctagctgtgctgtggagtactagggggtgaggccactcataaggggaacatcggctgctagggaaagccggttgtaggcccccaagaggtgaaagcaaagaatgaagcattgcttggggttccataacatacctggggagggcagcctggtcaaagagggcatttctgccttcaactggcaaggcctgcacc

SEQ ID NO: 86795 - DNA, 354 bp, Homo sapiens
tcttgtctggacttctgctttaatgttttaactggtctcactgtggccattgttgcccccacccccaacaatctattttcatataatagctagcataaacataaatcacatcattacttcccttcttaaaactctccatggttggccaggcgtggtggctcacgcctataatcccagcacttcgggaggtggaggcaagtggatcatgaggtcaggagttggagactagcctgaccaacgtggtgaaaccctgtctctactaaaaatacaaaaattagctgggtgtggtggcgcgtgcctgtaatcccagctactcaggaggctgaggcagcagaatcacttgaacccaagaga

SEQ ID NO: 86796 - DNA, 320 bp, Homo sapiens
tcctgggaccttctgccccttttggctgtagccatccctgcaggctataatcctacggcttccaaccagcctgcttggacgcaggtgggaaagagggctaggcaccatgcaagggattgcttacttctttcctctgctcccacctctgcctcctgccatttcccctgatgttttattgttttggtggttgttctcactgatggtaatagttagaatattcattatgtgtttggcttgctcgttagaacttaaattctttgaattacatcatttcaatagaaccagtacaatatttctatacttgctctatctcccagcag

SEQ ID NO: 86797 - DNA, 404 bp, Homo sapiens
acaaagatttacacctccgttttattctaagggttttatagttttagctctgaaatttaggtctttggtgcgttttgagttaatttttgtctatggtatgaaggaggagtttaacttcattcttctgcctgtggctgtctagtcctagtaccatttgttcaaaagactacctattgaatggccttagcacttctgtcaaaactcagttgaccataaaatatgggtttatttctgaactctcaactctattccatggacctatatgtctctctctatgccagcagcacacagtcttgattattgtagctttgtagtaagttttaagattggaaagtgtgagtccttcaactttggtctttttatttattttggttattcctggtcccttgcattttcatatgatt

SEQ ID NO: 86798 - DNA, 370 bp, Homo sapiens
gtatattcaaacaaaagaaaagaaattattattttggcagattatcaacgatgactgtagtgttagtgtgtaaattgaaaagtggttgatcaggacaaaaatgtaaaactattattagatactgatagaactaagaaagtgacttctaaatcctagttggaaggattaccctttgtttagggcagttaatttgcttaagttacacagtcagggtgggtgattagcccaaagaagatgttttgtgtcggtggattgagaactctgttgacaaaatagttgacaaaaatagcctcacaaaagcacaatctgaaataggccttattattcatggaaaactctggtaattattatcagcctttttaaaagaaaa

SEQ ID NO: 86799 - DNA, 1989 bp, Homo sapiens
agcttcgggggcgagcgctcgtgtgtgtgagtgcgcgccggccagcgcgccttctgcggcaggcggacagatcctcggcgcggcagggccggggcaagctggacgcagcatgatgcgcgcagtgtgggaggcgctggcggcgctggcggcggtggcgtgcctggtgggcgcggtgcgcggcgggcccgggctcagcatgttcgcgggccaggcggcgcagcccgatccctgctcggacgagaacggccacccgcgccgctgcatcccggactttgtcaatgcggccttcggcaaggacgtgcgcgtgtccagcacctgcggccggcccccggcgcgctactgcgtggtgagcgagcgcggcgaggagcggctgcgctcgtgccacctctgcaacgcgtccgaccccaagaaggcgcacccgcccgccttcctcaccgacctcaacaacccgcacaacctgacgtgctggcagtccgagaactacctgcagttcccgcacaacgtcacgctcacactgtccctcggcaagaagttcgaagtgacctacgtgagcctgcagttctgctcgccgcggcccgagtccatggccatctacaagtccatggactacgggcgcacgtgggtgcccttccagttctactccacgcagtgccgcaagatgtacaaccggccgcaccgcgcgcccatcaccaagcagaacgagcaggaggccgtgtgcaccgactcgcacaccgacatgcgcccgctctcgggcggcctcatcgccttcagcacgctggacgggcggccctcggcgcacgacttcgacaactcgcccgtgctgcaggactgggtcacggccacagacatccgcgtggccttcagccgcctgcacacgttcggcgacgagaacgaggacgactcggagctggcgcgcgactcgtacttctacgcggtgtccgacctgcaggtgggcggccggtgcaagtgcaacggccacgcggcccgctgcgtgcgcgaccgcaccgacagcctggtgtgcgactgcaggcacaacacggccggcccggagtgcgaccgctgcaagcccttccactacgaccggccctggcagcgcgccacagcccgcgaagccaacgagtgcgtggcctgtaactgcaacctgcatgcccggcgctgccgcttcaacatggagctctacaagctttcggggcgcaagagcggaggtgtctgcctcaactgtcgccacaacaccgccggccgccactgccattactgcaaggagggctactaccgcgacatgggcaagcccatcacccaccggaaggcctgcaaagcctgtgattgccaccctgtgggtgctgctggcaaaacctgcaaccaaaccaccggccagtgtccctgcaaggacggcgtgacgggtatcacctgcaaccgctgcgccaaaggctaccagcagagccgctctcccatcgccccctgcataaagatccctgtagcgccgccgacgactgcagccagcagcgtggaggagcctgaagactgcgattcctactgcaaggcctccaaggggaagctgaagattaacatgaaaaagtactgcaagaaggactatgccgtccagatccacatcctgaaggcggacaaggcgggggactggtggaagttcacggtgaacatcatctccgtgtataagcagggcacgagccgcatccgccgcggtgaccagagcctgtggatccgctcgcgggacatcgcctgcaagtgtcccaaaatcaagcccctcaagaagtacctgctgctgggcaacgcggaggactctccggaccagagcggcatcgtggccgataaaagcagcctggtgatccagtggcgggacacgtgggcgcggcggctgcgcaagttccagcagcgtgagaagaagggcaagtgcaagaaggcctagcgccgaggcagcgggcgggcgggccgggcgggcccgagggcggggcgagcgagacggcgcttggc

SEQ ID NO: 86800 - DNA, 1948 bp, Homo sapiens
agcttcgggggcgagcgctcgtgtgtgtgagtgcgcgccggccagcgcgccttctgcggcaggcggacagatcctcggcgcggcagggccggggcaagctggacgcagcatgatgcgcgcagtgtgggaggcgctggcggcgctggcggcggtggcgtgcctggtgggcgcggtgcgcggcgggcccgggctcagcatgttcgcgggccaggcggcgcagcccgatccctgctcggacgagaacggccacccgcgccgctgcatcccggactttgtcaatgcggccttcggcaaggacgtgcgcgtgtccagcacctgcggccggcccccggcgcgctactgcgtggtgagcgagcgcggcgaggagcggctgcgctcgtgccacctctgcaacgcgtccgaccccaagaaggcgcacccgcccgccttcctcaccgacctcaacaacccgcacaacctgacgtgctggcagtccgagaactacctgcagttcccgcacaacgtcacgctcacactgtccctcggcaagaagttcgaagtgacctacgtgagcctgcagttctgctcgccgcggcccgagtccatggccatctacaagtccatggactacgggcgcacgtgggtgcccttccagttctactccacgcagtgccgcaagatgtacaaccggccgcaccgcgcgcccatcaccaagcagaacgagcaggaggccgtgtgcaccgactcgcacaccgacatgcgcccgctctcgggcggcctcatcgccttcagcacgctggacgggcggccctcggcgcacgacttcgacaactcgcccgtgctgcaggactgggtcacggccacagacatccgcgtggccttcagccgcctgcacacgttcggcgacgagaacgaggacgactcggagctggcgcgcgactcgtacttctacgcggtgtccgacctgcaggtgggcggccggtgcaagtgcaacggccacgcggcccgctgcgtgcgcgaccgcaccgacagcctggtgtgcgactgcaggcacaacacggccggcccggagtgcgaccgctgcaagcccttccactacgaccggccctggcagcgcgccacagcccgcgaagccaacgagtgcgtggcctgtaactgcaacctgcatgcccggcgctgccgcttcaacatggagctctacaagctttcggggcgcaagagcggaggtgtctgcctcaactgtcgccacaacaccgccggccgccactgccattactgcaaggagggctactaccgcgacatgggcaagcccatcacccaccggaaggcctgcaaagcctgtgattgccaccctgtgggtgctgctggcaaaacctgcaaccaaaccaccggccagtgtccctgcaaggacggcgtgacgggtatcacctgcaaccgctgcgccaaaggctaccagcagagccgctctcccatcgccccctgcataaagatccctgtagcgccgccgacgactgcagccagcagcgtggaggagcctgaagctgcccgccagcccaacaccttccaggctgaggggttgtcactccttcctggggctgcagagaaggaaggagccagatgctggggatacagaaggaggcttgggcacagggtcgcacaagcagaatgcagggggcccaggagctgggcgtgggggagaatcacatcttcattttcattcgcctctaactaaaaatttagcatttcctccatggcaaagagaggccgcagaccgcagcatgcggccaagcctgcaccgtggtcactggcggaagtcacagcggtttacacatcacattctagctggtgcagatatcataaatatcgttcatgctggttattgcttctcaaaacgacagaagttactagacctgctgctagatcctgatttataatcattaataaagaagcactcgcgtaacgtaaccat

SEQ ID NO: 86801 - DNA, 399 bp, Homo sapiens
gtgcagtggcacgatcttgggatctcagctcgcggcaacctctgcctcctgggttcaagtgattctcatgcctcagcctcccaagtagctgggattacaggtgcccaccacaacacacccggataatttttatatttttagtagagacagggtttcaccatgttggccaggctggtcttgaacttctgagctcaggcaatccacccacctcggcctcccaaagtgctaggattaagagcatgagcccctgcgcctggcctgtagtttaactgatgttttatttagcatgtgctaataaagcaaaaaggggataggaaagaatgtacctttttctgcagtatcttattcaccctcctttaacactaaatactttataatcacacaaatattatactccat

SEQ ID NO: 86802 - DNA, 330 bp, Homo sapiens
aaaatcttcacctagcattgttgggattatatggttacatcatctgaagttgacagaccaaaatatagaggcttcagaggtctccaaatagaactaaacatgtaattcagattgttaggaggtagtataaatgagctaaatctcatctttattacggtagagttaatgggtgatgtctaaagttgtctgaagtctataaatcatgacaaattatgatgtggtgattgtattcaacagtctttcagttgcagggataaaaccccagtttaaactagagtaagagaaagaatgtgttggtttaagctcctggaaagtgcaggcaagggtagt

SEQ ID NO: 86803 - DNA, 275 bp, Homo sapiens
gtttggattgctaccagttctactgttcactttttgacaatgttgctttccccattgccaaagccctgaacccataacctgtatttgtgctttgccccaaagttgaccatcttattcgtatatgattcttaaagttgaaaatccataaggccgggcgcagtggctcatgcctgtaatcccagcactttgggaggccgaggcgggcggatcacgaggtcaggagatggagatcatcctggctaacaccgtgaaaccccgtcttttctaaaaattcc

SEQ ID NO: 86804 - DNA, 372 bp, Homo sapiens
tccaggcagatctagacacattccaaggtgatacctggaatggggcaatgaagcagttttgtccactcattcatcatatgtgaacggagcaaacaaatcaaccaaggccctgccttcatggagtgtgtgtcccaggaccgggctgagcgataaaggagccacacagttcatccgaaggtttcatgctgtggaggaatataacacggggcacatccaagaggggggctggagctccgattttctaaatatcaggactgcttcactgagaaggtgatgtttgagcagatacccaaagtgagagaaggatccacgcagcacctggaaggataaagccaggcaaagggaatgacaaaaatgtggaggttgcagtta

SEQ ID NO: 86805 - DNA, 176 bp, Homo sapiens
aaaaaatataaataaataaatacatacatacatacagacgtaaagtattaagtatttaatccttctggaatttaattagcttcacaaacagaaatgtatgctgcataaactgcattcacaggataagcatctatgggatttttctttcttttttttttaagacaagagtcttgctc

SEQ ID NO: 86806 - DNA, 267 bp, Homo sapiens
cttcaccttaaagtttgagaaccactgctgtaaactgatagaatacatttgtcaacaaccattacatcctagtggaagtcaagcaaaagtcttctctgttttaagcttaaagaataagacagtatctttgcagtgtgatcctagtttatctcagaagtggaaaatggaagcttcatttaatttctgacaggtggatgtcactatggtctcatctcagttattattcaaaattcttacagtttgaagtttttgaaaatattagagaat

SEQ ID NO: 86807 - DNA, 313 bp, Homo sapiens
tgtcatttcagagagacgatttgtcttttaaacagacagcataaacatatacaatactgaaaatgtattttgcaaatgattttcttattttctttagctttattgtaagaatacagtatataacctacaaatagttaaatgattggttatattattggtaaagcttctgatcaccagtgtgctattagtagttaaaattttgaggagtcaagttatacacagattttcaactctgggctatccatgcccctaattctcaccttgttgaaggctcaactgtagttcatccaaaaggtagatacagttttatgtt

SEQ ID NO: 86808 - DNA, 693 bp, Homo sapiens
cagggcttatctaagattgggaaggtcagcgatactgaaattccctacagctttcagtcccatcctgttttacttgcttgtggacattgcttaagcccagtgggtttgtgatgctatttagaacttaggtgggtatgtttcacataccttcagtgctatctcacctggacctttacgcggcccagtgaggaggttgggttaatgtaactcctaagtaaaggaccttctggatcctggctgggatctttccactatatgttgctggacttgggctggtctgtttctgatttcataggtaaattgtagaaggttcctgtcctgtccaggccctcaccaaaaagtttccagaaggaaaagtcaaatacgatgaatttggtctgattattccacattgttaaacatattttcttatgtgaacgcttagtctggcaattgccttgacctttctggtttaattaccatatcagattgatttatttcttccttgttctggatgttctcagtgcttacctgaccttaacactgagttccctccaaaaatcagtgctcacatctctcctaacagaggactagaatgacctactcttccctgaccttttctctgtctcataaaaatgtaatagtctcgtcatttctggtcctgctccagcgctttctgtataactttcatggactataaatctggtatcttgg

SEQ ID NO: 86809 - DNA, 153 bp, Homo sapiens
gtgtttatatgcatgatttcaaaagtaaatgacaaatgtaatgacaggagttagtctaccatcctcaccataatcaaaaacaacagcaacaaaaccaccttcacttaggatactggtaaaccctcgtacattcatatctacccctcagaagac

SEQ ID NO: 86810 - DNA, 795 bp, Homo sapiens
cacgcccagccaattatttgtttgtttgtttgtttgttttttcatagaaatggggttttgccaggttgcccaggctggtctcaaactcctgagctcaagtgatctgcctgcctcagcctcccaaagtgctgggattacaggcatgatgagccactgtgcctggactactttctctctgagggtgagatgaacagagacccagtaagacatgtgttcgttattttaaactgctgacatttgtggcattgtttgttactgcggtataacctatcctaccctgtttaaggccccctcttaatactactttacatctcatttgtacaggatgtgttcagaatggatgcgcaatgaatccttcttaagttgaggtaaactccatcaactgaattgcttcagggctgcagaagctgaaatgggtattttcatctcttcatccagaaaggcttcatttgggacacctgtgggaatgcctgttccgctttcacgttagccaatctttaaagctttcattagctatgataaattattcaaaaaggaggaacacttgaaacctctttagaatattgacgtggaccgacagtaaatgaatggaaaagtacctccaggttcgaggctaactttcatttaattttttagaggaaccagtcgagttgttaaaatgatcagaaacgggcctggccagagccagctcttcaaagaggggatgttattacctccttgaccattcacttaatcagatctggtcgatgtcaagaaaacaaaattcctcgtgcgatggtgggctcaggatataat

SEQ ID NO: 86811 - DNA, 427 bp, Homo sapiens
gaaactgaatggaataagagctcctgatgaattagatgagtcgtagagactgaaaagatgggcttcgtcattgccctcagtatgataacacaagcttctaaatacttctcttaaatcaatttttttttgtaattacaaatacttgctaggtaataaaataacattaaaattatcagtaaaatatgtttacaaaataatgtgaaaaactttagtttttcagtgtttttgtatttcatttgccaagtgctttgaggaagaagtggcaagatttttttgaaataactttaaataacaaaagctaaatgcctttcatagtgctcattttagaaagtatggatagttcaacaacacaaaaagaaaattgaaatgacacattactacaaattctgtaatattttttactcttcagtagattgcaagctttttc

SEQ ID NO: 86812 - DNA, 333 bp, Homo sapiens
cctgcctcagcctcccaagtagctgggattacaggcgtgcaccaccatgcccagctaatttttgtatttttaatagagacagggtttcaccatgttggccaggctggtctcgaactcctgacctcaaatgacccacctgcctcagcctcccaaagtgctgggattacaggtgtgagccactgcacttggctgtaaatgatcttattcaggtgctaaatggtgggctaggagcctgagagagaataattggttcttttctctgtacggttggtcccatagggccacttccatctcttatttacctatgccttttttctagtcttgatgattgac

SEQ ID NO: 86813 - DNA, 747 bp, Homo sapiens
ggccatttattaaattgccaacacctggaacccctttctaccacatgcgttttggtggcagacaaagaatttcacctagatttgtttaatcaaagccacactacatacagttggatatagagagatagagacaaatgtacatggacaacaaaaaaaatagtgcaaatgcagttgaggcaaaaacattaagatcccagcatgtgcatcctgtatctacaacaatgccattgaaagtatgagctgtgtcattggaagtacagcagcggaaacagccactcatgaagttcctgttgggaaaggatttgggctgctggctggctgctttacttccttgtgttcctgccattattttctagctgatttctccaccttccctaccatttctatactggaatcaatatccattcaataacattttacattgcaacccaaagccctagatgttcaaaagtgtaacaaaagagatagtagaaaagggtactgaacagagtgatcaagggaagaagcaggagagaactagaaagctgagtgttgtggatggacataaagagagtacaatatttaagaaaaagttatcaaaagtaaagattgacaagtgaaaggaaaaaaggcataggaaatgtggaaatggaaatttgcctaggtgaaataaaacaaggagaaaaaaattagtcacagaataatcacatcatagatggtaaatgcgagaaagacaagtcagtaaagaaggagacagaaagaagtacc

SEQ ID NO: 86814 - DNA, 359 bp, Homo sapiens
tttttttgacaaaaatagtatatatttattatgtacaacatgtattttgagacatgtatacattgtggaatgtctaaattgagctaacaaatacattatctcacataccatgtttttttgtggtgacaacattcaacaatatagaccatttcacaaatttgcatgttatctttgtgcaggggctatgccaatcttctctgtattttttcaatcttggtgtatgtgctgctgaagcacacaccctaattcctttcatttaaggatctagttaacctttctcttaagtataaccatgtattttgttaagcaatatctttttattacaaaaatgccatttttttctggttagaaaattgatt

SEQ ID NO: 86815 - DNA, 456 bp, Homo sapiens
gtgggcatatagtagaaagtggggcttgttgttgaaaaaattttggttgttggtgttgaaaagaacagcggtctgtatgccaaggacaatttcttttagaatgtcccgattggctgcataggaagcatttgccagggaattgtccaggcattcgaatagagaccatggcttgtgccatgaccattgctgtacgcagagttcccctcacgccttcacagactttaatgtatgaggtgagtacatcaccccctggtggaattttgcctttaatggggcaaatagccacctgacagtctggatttacttgttcataagccataagttctataacaagtcattggccctggctatcagggatagctttttctgctgcgtcttgaagatggacaataaagtctggatacggttcatgttgtccccgtctgacggctgtaaaacatgggcatagtttgtcat

SEQ ID NO: 86816 - DNA, 331 bp, Homo sapiens
gaacaaacaaacaaacaaacaaacaaaaaacagggtaccagggagtggcttttgtgtgtgcctgggaggggtacctagtccatgctccagccccatccgtggcctccatggtgcccaactttcctgagaagtatgctctgctcttatttctttagggattatccaggaaagtcatgggtgttggattaaatgctagtctgttttcctagcaagagtccccacaatggtcctctaaaatgatttaccctcagtaactggctagttggtctgctaatcacctttggctagtcgatctgctaattaccttttctccctaagcttaataagattc

SEQ ID NO: 86817 - DNA, 342 bp, Homo sapiens
gtggctcatgcttataatcccagcactttgggagactgaggtgggaggattgcttgagcccaggagttcaagaccagcctggggcaacatagtgaaaccctgtctgtacaaaaataaataaataacaattagccaggcatggtggcatgtgcgtgtagtccctgctgttttggaggctgaagtgggaggatcgtttgagcccaggaggttagggctgcagtgagccgtgaccatgccactgcactccagcctgagcaacagagcaagaccctctctcaaaaaaatcaatctctttgtctaaaaaaacatagtagagttgagcttgttttattccctataaaa

SEQ ID NO: 86818 - DNA, 423 bp, Homo sapiens
agtgcctttgcatgtacaggtctgtctgcaggaacattctgctgacttctgtccatcccttttcactcagctttcgtcaatccaactgattttcagtccacagaccccaagcctgcaggaagctcttcagagactaagtaagcccttgtagcaagcctgaaaagattctgaagtccggtgaaacagctgacgccaaccagtttgaagaccccacataggaacagaatcagcatgaggacagtttcttcatctgtctgtcctatgatttcaccctgcactctttgaccaatcaacaatcttcacacttctgcctgttctaaaactcttataaactttagccccaaactcctcacggaggtggatttgaggtttcctcccatctctttattcggtagccctccaattaaatctctttctcctgca

SEQ ID NO: 86819 - DNA, 555 bp, Homo sapiens
ctctcaaaagttctatcttcagcccaaacctctctcatagtgtccaaatttgtataatataatctctacttcacatctcaaatgtttcatattcaaaaaaaagctccttgtcttccccccacttaatgatgtcacaccctgcaaagcactccccatctcagttgatgctagtttcatccttaaacttactcaggccaaaatcttggagccaatacctatagccaaaacctatagccaatctgacaggaaattattttggctccgcctataaaatataaccagaatccaaccatttctcacaatatccaagctatgataaggatcatcatatctctcacctggattactatgctagccctctaacttcatctccctgctacacttgcttcctatggtctattctcaacataatgtccagagaaaaataattttcaatcataaaaaactcaaaacccaggcatggtggctcacacttgcagtcccagctacttgtgatgctgaggcaggaggactgcttgaacgcgggagatgaagttagagagtctccgtcgaact

SEQ ID NO: 86820 - DNA, 490 bp, Homo sapiens
catttattaaggactctctgctccagcctctcactctcactctcctccgctcaaactcagctcacttgagagtctcctcccgccagctgtggaaagaactttgcgtctctccagcaatgcatctccttgcgattctgttttgtgctctctggtctgcagtgttggccgagaactcggatgattatgatctcatgtatgtgaatttggacaacgaaatagacaatggactccatcccactgaggaccccacgccgtgcgcctgcggtcaggagcactcggaatgggacaagctcttcatcatgctggagaactcgcagatgagagagcgcatgctgctgcaagccacggacgacgtcctgcggggcgagctgcagaggctgcgggaggagctgggccggctcgcggaaagcctggcgaggccgtgcgcgccgggggctcccgcagaggccaggctgaccagtgctctggacgagctgctgcaggcgacccg

SEQ ID NO: 86821 - DNA, 1174 bp, Homo sapiens
atttgggacagagtctcactctgttgcccaggctggtgtgcagtgtcacagtcatggctcactgcagcctcaacctccctgggctcagttgatcctcccacctcagcctcccaggtagctgggactacaggcacacgccaccacatgcagctaatttttttgtattttttggagatgggtttttgctgtgttgcccaggcttgtcttgaactcctgggctcaagtgatctgcccgctttggcctcctaaagtgctgggattacaagtgtgagctactgcatcccacagtatcttggatttttataaggccagacatttacctctggtaatctcttgagccatgtgtttcatttttatgctcacagaataatttggtgtaatggggcttatcaacccaaatttcagaactttaaattcatgtatctttttctacactgatgactatactcaaagcatcttactttaattatataaatgtatatactgtctttctcaactggggtttcaagagagaattaagcccaaaataaaataatttgtgtatcttattttctcatttttctctaggatgatacacagctaatacccttctagatgcatagaaaaaagttaatttattatatacaatggataccttaaggcaagagttgacaaacttttcctgcaaaggaccagatagtaaatattttaggcttcgtgggtcataaagtgtctattgtaactgtttaaccctaccttgtagcatgaaatacttaaacaaatgagtgtggctcaaataatataaaattttattcatagacactgaaagttgaatttcagataactttaacatgtcacagaatactcttaaatttttttcaaccattaaaaaatgtaaaaaacgatccttttatatagttcatgatcatgattaggtgttcatgcacgtatgtgaaagatgccacccttgaaccttgttactattaatacgtcagcacattacctgtctgacccgaaaaaaaaaaaaaagggtaaaaaacactcctagttcacaggaatcataaaaagaggcagcaggccaaatccactaagtgttgtttgctggctagcctccaccttagagaatgagagcttattttttagcagaattctaattggtaagggctgaatcatatatgaaagtatagatgatact

SEQ ID NO: 86822 - DNA, 833 bp, Homo sapiens
cagggctggtgcacaaatatggccaattcaaggagaaacagggcagataatcccacagagccggtgacacgcccatcctattcctgagtagacagagccatttccatcactctcaggcctctgtgggtaattggagctgacaaggtcccatgcatagcagatgagattagtcccagctggacgtttcccagaaatggtcctggggtttccagtaacctctcagatgagatcacttgtctagagatcactctggaatatgtctcatataaggcaaggagtcatggaaactgaatcatgttgagagaggatgttgtaggaatagaagcttctggacaaagaatgaggaagactctggagatctagagagtggggatttgtgagtggtttcaggttttgtttttgtttttcttctcttggcacccccaagcactaggcttatttgctggacagaaatagatcttaagtggagactgcaagttcttccgacgtgatgcactggaggagatgcatgcctggaaaagctctgccacttgctggctgggtggcctgggaacctctgggtctcaggctcctcatccataaaatggggataataactaattctcattaaataagaaacacaagattgatttgtggtaagcttaataagtaacaactactcgagaaaatagccttttaaagaactgacaaccattgctaagtgtctaccctaaaaaaagaaataccagagatataagaaaaggtatacgtgcaaaaaaaaagttcattgtttaatggaaaatattagaaatatattcaacaaagggaatgttcagtaccccctccccaccaaa

SEQ ID NO: 86823 - DNA, 293 bp, Homo sapiens
catggaggtggtttcccccatgcggttctcatgatagtgagtgagttctcatgagagctgatggttttaaagtgtggcacttcctggttcgttctctctctctctctctctctctctctgtctcacctgctgctatataagatgtgccttgcttcccctttgtcttccacaatgattgtgaatttcctgaggccttcccagccatgcagaactgtgagtcaattaaatctcctttctttataaattacccagtctctggtggtatttttttttttgaggtaagactctcactc

SEQ ID NO: 86824 - DNA, 384 bp, Homo sapiens
aaaagtcagaagagcatacatttaagtagtatctagggcaatcaatcagcatccttggcatctgatagggataaaaattattaaattttccaatctaattagaagtgatggtgattgtgcattaagttgtggtattagcatcatcattatctgaatgataaccatggtcctcatggactgagcccaggcgccctgacagctcagcacatatgacaaccccagcaggcaggtgcgtatcatgaccctcatcttccagatgaacaccggtgatcaaaaatacgaagcgatgtgactcaggccccacagccagtaagaagcacacacaaaatgtcagcctgagttcctgctcccacccatgcttatcacaaggctgtctccccttcc

SEQ ID NO: 86825 - DNA, 446 bp, Homo sapiens
atttcagttacatcacatactctgtcctcttgcggtgcgggtcttccccagttgattatacacagataatcaatgactttatttgggagggattggagctatagaataatctatcttaccaatctgatggaccatttgtaagagctgttggtcaaattggatcttcatttgacaaataaatactagagctgcagaaagtaaagtttactccaacccaattaatcattaatacatccacaggaaaaatacattttctccacatggaatattgatttttctatgaatattacctccacattgaaaaacgagtgagtcactgcagttaagccagtgtaccttgatgttgaattccctgaagaaggtacaattatatttacattcccttagcaagaatttggctaagtgataagcacttttctcttttcttttctttttttttttttttt

SEQ ID NO: 86826 - DNA, 384 bp, Homo sapiens
gttttacatgatcgatttttctttgctctgattagtgatttgaaagatggtgatggaataatctgatttttatagactgatttccaagtattcttgtgaatgcgtattatttaccacaaaactttttttttaatgtgcctttcaaagatgagggccaatcaacagacatttaaactggaaaatctttaccccaaattaatttgcttcttggttgatgactactgtttactaattgtgtcatctgtgtctcaccaaagcagaaggtacactcttcttgcaactgggtagttgatgtcaatgaggagttattgcattttctgtgaaaacaataaaatcatagggttcaatcccaagctatttcctttcctacaatgttccctttgt

SEQ ID NO: 86827 - DNA, 348 bp, Homo sapiens
ctggctgctcaccctcccctcaccccttactgcggctcagcccaggtgtgtgctcaaccctctcctcttctgctttctctttattcccatggtttcaactactatttccacaacaatgattcctacaatcatcctaacatgtccaacagactgttgaatattctcatccggataaaacccagccttctcctgatatgaccactatggcctttttcttcttctctgctcacagtcagattgccagatcttgtcaattctcaacttctcaagaatcttttttttttttttttaattcctagttagcattcccactcagcttcatatttcctgatccctgggggatgaaaa

SEQ ID NO: 86828 - DNA, 364 bp, Homo sapiens
tgacattttggatgctgagttggtgccgtagtgagtccagaattctgcggaacttggtttcggttaatgaattttgtaggtgagatagtcttaaatctttagagtttagaaagtggaatgtcctacccagcataaaaatcccccagtgatgtacatgtcctagttcccagaacctatacataggttaacatatatggcaggcgtgattacgattaaataatttgatatgagtagattattgtcaaggtggtcccaatctcatcacagcagtcctaataagcagaaaacctttccaggcttccctgttgtcagtgaaccagggaagcctggtgtgtgggaagaactctattcgccattggttgct

SEQ ID NO: 86829 - DNA, 196 bp, Homo sapiens
tactctagaggtatccccgcgtttaccttctgctctccgtcgaccttctgcaatccatgtcttagtttcactaaggcataaattagtgaaagcaagtccttgcccaaggggcagatgttcagagaagggagaggtgtgaggttcaggggcactggtggaagttaagggacaagggtgttacaggggagaatgtggt

SEQ ID NO: 86830 - DNA, 442 bp, Homo sapiens
cattttcatcattatgagtggcagcttttgtaaaacttctctttatccatcttccaagggataacctaaacatcttaattactaacctttccatttcccagaatgccatcagtatttagttttgaaatatcccttttaaaataatgtgccagttaccttttaaaaaaaattgttttagagatgggttctcactatgttggcctggttggtcttgaactcctggcttcaagcgttccttccgtcttggcctcccaaagtgttaggattacaggcatgaactaccacggttggcccaccttttgatgcattataattttcatgttttttaaaaatgtaaatatacatgtggttcaacagagaaaaatctgaagaaaaacttaaagcatttttggtgatgatttgcccttactcatacaaaatcataattgttgacttaatgaac

SEQ ID NO: 86831 - DNA, 513 bp, Homo sapiens
aatgcaagggaatggtttctccttatccccacctccatcctcacccctgggagatacatgcctgcttaccaggaccaattttctacttatttagctaaaaataattgacctttgaaagtcataacccaagtaattgaatttgaactaaaatctaaagataaacctaatctttcaggcattctttcctcccactcttttgatctttttgacccccactaagtcttaccaggtatattggagtagaggaaatttcatactagaatacagtactgtgtcatgtttcattaatgtcaaagatttcatgtagtaaatagaacaagaaggtaccactttgtataatattcaaaatctatacagcacattgctaagcagagtatacactcaagaaatgtagaattggtaatattatactagaaaatgaacttccagtattgctattattttactaatatgcatagtcactgacctgtgaagagtgaacagtatgtagaagtgcctttgagataggaaatt

SEQ ID NO: 86832 - DNA, 266 bp, Homo sapiens
ctcctgctctgctctcctccctcaggtaccccttagcaaacacatgtctttcatgtgctctttctaaaatgcaaatctggttacttcacaagctcaattaaatgccctcagctgtccttaggaatgagactaacctttcctgatctggtcctcgctacctctctagcctcctcatctacttgctccttgctctgtgcctaatcacacactccttctgggttctggctgccctctgactgaaattcctgttattcccggtctgccta

SEQ ID NO: 86833 - DNA, 732 bp, Homo sapiens
ctcagtaaatgttggctagttatgtgaaccagaacttgagatggaagtgaagcagaaacgatagggagttgttcaaaaatacctgatctgctagggaaatattttttaaaacaaggctgcttttcacaaggaggggtaggcacacttgaattaagatcagattgattatatgtttttgttcagctttgatgttgaattgtttaatcaaatggcagactctgccccgcttccaggaagagctcaactccaactaggaggaagcaggtaatgtgagccatggcatcttccccgtttagatttcctgactctttgtttatcttctttgtcaatgtgcgtctgaaccttcccaacagagtttaaaatgttcaacttcaaagctaaattctgatggaaaacacttcctaagaggctgaaggcttactctaggggtgaaagaagaggaaaggcgatggatcacaccacatttgtggaaaatgttaatgctatgtgatcttgcctccttagacccagatagatgcaaaggataaggaactcggtttatagcaacagatactccaaaagtgctttgcatcctgttctgacactaactggttgtgaatcacttgttaaagataaggataacaacaataccatttcttgagcccttactgggtgtctggtattgtgcaaagtactgtctatatattacctcagtttccacaacaaccttatgaaatatttcttccttttgtg

SEQ ID NO: 86834 - DNA, 721 bp, Homo sapiens
aaggaaccctgcagcagacctcgaataaaatgtgacttgatgtttgttgccacttcctcaacttggttagcaaattcaagttttgaaagacgattcgtctcagagaagttgatcctgaacctccacgtcacattttagtcggttgctattaggtgggtaatgcctaataacatgggttcctcaaatcacaaaggagaatgctctcaagtcctcatgttaactttagtaagtcagttaactttacagcaactaaagagatcaattaaaaagaacccttaagtctgactgtcccaggtaactttacttgctgtacagatagtgcacagatatggatgagggctgcacatggctgatttgaaaacccatgtggggccgggtgtggtggctcacgcctgtaatcccagcactttgggaggccaaggcgggtggatcacgaggttagttcaggaccagcctggccaagatggtgaaaccccatctctactaaaaatacgaaaattagctgggcttggtggcagatgcctgtaattcctgctactcgggaggctgaggcagagaattgcttgaacccgggaggcggaggttgcagtgagccgagattgcgccactgcactccagcctgggcgacacagtgagactctcctcaaaacaaaaaaaaaagaaagaaaacccatgtgggccgcatgtgcacagcctggggctgctttccacaggcctggat

SEQ ID NO: 86835 - DNA, 3571 bp, Homo sapiens
ggtttacaaacacgggctcccggcaggtgcgcgccgccccgcccgtgcgcggccggggttcgagggtggctcccgcgggcctcggggtgcccggacgggggctgcggtgctggctgcgtgcccgcttcttccatgccgtcctggggcaccggaaaatccgccgccaggcgctgtccccgacacgggctgtcgcctggttgggcccggaaatgggacgtcgcgctttctcagggagcgtagaagcagccagggcctctccaagccgctgctgtgacagaaagtgagtgagctgccggaggatgtccaccgccacgacagtcgcccccgcggggatcccggcgaccccgggccctgtgaacccaccccccccggaggtctccaaccccagcaagcccggccgcaagaccaaccagctgcagtacatgcagaatgtggtggtgaagacgctctggaaacaccagttcgcctggcccttctaccagcccgtggacgcaatcaaattgaacctgccggattatcataaaataattaaaaacccaatggatatggggactattaagaagagactagaaaataattattattggagtgcaagcgaatgtatgcaggacttcaacaccatgtttacaaattgttacatttataacaagcccacagatgacatagtgctaatggcccaagctttagagaaaatttttctacaaaaagtggcccagatgccccaagaggaagttgaattattaccccctgctccaaagggcaaaggtcggaagccggctgcgggagcccagagcgcaggtacacagcaagtggcggccgtgtcctctgtctccccagcgaccccctttcagagcgtgccccccaccgtctcccagacgcccgtcatcgctgccacccctgtaccaaccatcactgcaaacgtcacgtcggtcccagtccccccagctgccgccccacctcctcctgccacacccatcgtccccgtggtccctcctacgccgcctgtcgtcaagaaaaagggcgtgaagcggaaagcagacacaaccactcccacgacgtcggccatcactgccagccggagtgagtcgcccccgccgttgtcagaccccaagcaggccaaagtggtggcccggcgggagagtggtggccgccccatcaagcctcccaagaaggacctggaggacggcgaggtgccccagcacgcaggcaagaagggcaagctgtcggagcacctgcgctactgcgacagcatcctcagggagatgctatccaagaagcacgcggcctacgcctggcccttctacaagccagtggatgccgaggccctggagctgcacgactaccacgacatcatcaagcacccgatggacctcagcaccgtgaaaaggaagatggatggccgagagtacccagacgcacagggctttgctgctgatgtccggctgatgttctcgaattgctacaaatacaatcccccagaccacgaggttgtggccatggcccggaagctccaggacgtgtttgagatgaggtttgccaagatgccagatgagcccgtggaggcaccggcgctgcctgcccccgcggcccccatggtgagcaagggcgctgagagcagccgtagcagtgaggagagctcttcggactcaggcagctcggactcggaggaggagcgggccaccaggctggcggagctgcaggagcagctgaaggccgtgcacgagcagctggccgccctgtctcaggccccagtaaacaaaccaaagaagaagaaggagaagaaggagaaggagaagaagaagaaggacaaggagaaggagaaggagaagcacaaagtgaaggccgaggaagagaagaaggccaaggtggctccgcctgccaagcaggctcagcagaagaaggctcctgccaagaaggccaacagcacgaccacggccggcagacagctgaagaaaggcggcaagcaggcatctgcctcctacgactcagaggaagaggaggagggcctgcccatgagctacgatgaaaagcgccagcttagcctggacatcaaccggctgcccggggagaagctgggccgggtagtgcacatcatccaatctcgggagccctcgctcagggactccaaccccgacgagatagaaattgactttgagactctgaaacccaccactttgcgggaactggagagatatgtcaagtcttgtttacagaaaaagcaaaggaaaccgttctcagcaagcgggaagaaacaggcagccaagtcgaaagaggagctagctcaggaaaagaagaaggagctggaaaagcgtctgcaggatgtcagcgggcagctgagcagcagcaagaagcccgcccggaaagagaagcccggctcagcaccctcagggggcccgtccaggctcagcagcagcagctcctccgagtctgggagcagcagctccagcgggtccagctctgacagcagtgactcagaatgaactggcttcggacagaacaggacagatggatgtcgcacacgccgagactctgccgtacccctctgtggttcatattactacttctgttccatggtgtgcaggtctgcttcttaattcagtgttatgatatcttccagtttttgctttcataggtcagagatctatcttgtgtgtgcgttagacttgatgagaaggtgtgaactctgcagaaagtctcttcttcatcactgaattcagtcacttggagatgacaacttcaaatgctaacccgatgaccccagaaaaccgtgtgagattcgtaccgaagaaccttgtggaatccctttgcttaggcccaacctggtcgatagctcgagaaagaattttttccaaggaaatgtctcggatatgggtactgtatttgaaagctgttagctttgtcaacacgcattgtccttgtcatttgggccccgagctctgaccctcgtgtctgacgcggccacctctttctggaggggctgaggacagatgtgcctgcttgtggagaccaggctgggcctaagcgaagggtcatcgcagccccagcccggagcgtggagcccttggggggtggtcgggtgggatgtgcgttctccgctcgtggtgatgtcaggagctcctcggagggaacagagcggctgtgtatgcagcctgcaggtttccatacactgaagcttttacctcaactttaaaaaaaaaaaaagaagaaaagatttaaaaaaaaaaaaaaaggagactttttttgtaaggttcggcaattttctacggaagtccagcccgctgtgagtccccgcctggctagcgctgcccctgctgctgctgccgcgccacccttgggaaccacttcccgagcttatgtgtatataaatagttatttattaacatcattggtcatttttaaaaaaaagaaaataagaaaaaaccgcagaagaaatgcattcacacagtcgcagagatgcaggccttgccagtggtgtgccgggcgcgggtcctgtctggcggcggcctgtcgtctccaggtgctaactcctgccaccgcgcggtgctcacccacgtctgttcgcgcgctcgcc

SEQ ID NO: 86836 - DNA, 1736 bp, Homo sapiens
  misc_feature (7)..(7): n is a, c, g, or t
  misc_feature (10)..(10): n is a, c, g, or t
  misc_feature (32)..(32): n is a, c, g, or t
cccaacntgntcgatagctcgagaaagaattntttccaaggaaatgtctcggatatgggtactgtatttgaaagctgttagctttgtcaacacgcattgtccttgtcatttgggccccgagctctgaccctcgcatctgcctcctacgactcagaggaagaggaggagggcctgcccatgagctacgatgaaaagcgccagcttagcctggacatcaaccggctgcccggggagaagctgggccgggtagtgcacatcatccaatctcgggagccctcgctcagggactccaaccccgacgagatagaaattgactttgagactctgaaacccaccactttgcgggaactggagagatatgtcaagtcttgtttacagaaaaagcaaaggaaaccgttctcagcaagcgggaagaaacaggcagccaagtcgaaagaggagctagctcaggaaaagaagaaggagctggaaaagcgtctgcaggatgtcagcgggcagctgagcagcagcaagaagcccgcccggaaagagaagcccggctcagcaccctcagggggcccgtccaggctcagcagcagcagctcctccgagtctgggagcagcagctccagcgggtccagctctgacagcagtgactcagaatgaactggcttcggacagaacaggacagatggatgtcgcacacgccgagactctgccgtacccctctgtggttcatattactacttctgttccatggtgtgcaggtctgcttcttaattcagtgttatgatatcttccagtttttgctttcataggtcagagatctatcttgtgtgtgcgttagacttgatgagaaggtgtgaactctgcagaaagtctcttcttcatcactgaattcagtcacttggagatgacaacttcaaatgctaacccgatgaccccagaaaaccgtgtgagattcgtaccgaagaaccttgtggaatccctttgcttaggcccaacctggtcgatagctcgagaaagaattttttccaaggaaatgtctcggatatgggtactgtatttgaaagctgttagctttgtcaacacgcattgtccttgtcatttgggccccgagctctgaccctcgtgtctgacgcggccacctctttctggaggggctgaggacagatgtgcctgcttgtggagaccaggctgggcctaagcgaagggtcatcgcagccccagcccggagcgtggagcccttggggggtggtcgggtgggatgtgcgttctccgctcgtggtgatgtcaggagctcctcggagggaacagagcggctgtgtatgcagcctgcaggtttccatacactgaagcttttacctcaactttaaaaaaaaaaaaagaagaaaagatttaaaaaaaaaaaaaaaggagactttttttgtaaggttcggcaattttctacggaagtccagcccgctgtgagtccccgcctggctagcgctgcccctgctgctgctgccgcgccacccttgggaaccacttcccgagcttatgtgtatataaatagttatttattaacatcattggtcatttttaaaaaaaagaaaataagaaaaaaccgcagaagaaatgcattcacacagtcgcagagatgcaggccttgccagtggtgtgccgggcgcgggtcctgtctggcggcggcctgtcgtctccaggtgctaactcctgccaccgcgcggtgctcacccacgtctgttcgcgcgctcgcc

SEQ ID NO: 86837 - DNA, 3468 bp, Homo sapiens
agcggatgtgccggggccggcgagccaaagaggagccggccgcgcgggccgggaggggacggccgccggagccgcgaggccaactgtcgcctggttgggcccggaaatgggacgtcgcgctttctcagggagcgtagaagcagccagggcctctccaagccgctgctgtgacagaaagtgagtgagctgccggaggatgtccaccgccacgacagtcgcccccgcggggatcccggcgaccccgggccctgtgaacccaccccccccggaggtctccaaccccagcaagcccggccgcaagaccaaccagctgcagtacatgcagaatgtggtggtgaagacgctctggaaacaccagttcgcctggcccttctaccagcccgtggacgcaatcaaattgaacctgccggattatcataaaataattaaaaacccaatggatatggggactattaagaagagactagaaaataattattattggagtgcaagcgaatgtatgcaggacttcaacaccatgtttacaaattgttacatttataacaagcccacagatgacatagtgctaatggcccaagctttagagaaaatttttctacaaaaagtggcccagatgccccaagaggaagttgaattattaccccctgctccaaagggcaaaggtcggaagccggctgcgggagcccagagcgcaggtacacagcaagtggcggccgtgtcctctgtctccccagcgaccccctttcagagcgtgccccccaccgtctcccagacgcccgtcatcgctgccacccctgtaccaaccatcactgcaaacgtcacgtcggtcccagtccccccagctgccgccccacctcctcctgccacacccatcgtccccgtggtccctcctacgccgcctgtcgtcaagaaaaagggcgtgaagcggaaagcagacacaaccactcccacgacgtcggccatcactgccagccggagtgagtcgcccccgccgttgtcagaccccaagcaggccaaagtggtggcccggcgggagagtggtggccgccccatcaagcctcccaagaaggacctggaggacggcgaggtgccccagcacgcaggcaagaagggcaagctgtcggagcacctgcgctactgcgacagcatcctcagggagatgctatccaagaagcacgcggcctacgcctggcccttctacaagccagtggatgccgaggccctggagctgcacgactaccacgacatcatcaagcacccgatggacctcagcaccgtgaaaaggaagatggatggccgagagtacccagacgcacagggctttgctgctgatgtccggctgatgttctcgaattgctacaaatacaatcccccagaccacgaggttgtggccatggcccggaagctccaggacgtgtttgagatgaggtttgccaagatgccagatgagcccgtggaggcaccggcgctgcctgcccccgcggcccccatggtgagcaagggcgctgagagcagccgtagcagtgaggagagctcttcggactcaggcagctcggactcggaggaggagcgggccaccaggctggcggagctgcaggagcagctgaaggccgtgcacgagcagctggccgccctgtctcaggccccagtaaacaaaccaaagaagaagaaggagaagaaggagaaggagaagaagaagaaggacaaggagaaggagaaggagaagcacaaagtgaaggccgaggaagagaagaaggccaaggtggctccgcctgccaagcaggctcagcagaagaaggctcctgccaagaaggccaacagcacgaccacggccggcagacagctgaagaaaggcggcaagcaggcatctgcctcctacgactcagaggaagaggaggagggcctgcccatgagctacgatgaaaagcgccagcttagcctggacatcaaccggctgcccggggagaagctgggccgggtagtgcacatcatccaatctcgggagccctcgctcagggactccaaccccgacgagatagaaattgactttgagactctgaaacccaccactttgcgggaactggagagatatgtcaagtcttgtttacagaaaaagcaaaggaaaccgttctcagcaagcgggaagaaacaggcagccaagtcgaaagaggagctagctcaggaaaagaagaaggagctggaaaagcgtctgcaggatgtcagcgggcagctgagcagcagcaagaagcccgcccggaaagagaagcccggctcagcaccctcagggggcccgtccaggctcagcagcagcagctcctccgagtctgggagcagcagctccagcgggtccagctctgacagcagtgactcagaatgaactggcttcggacagaacaggacagatggatgtcgcacacgccgagactctgccgtacccctctgtggttcatattactacttctgttccatggtgtgcaggtctgcttcttaattcagtgttatgatatcttccagtttttgctttcataggtcagagatctatcttgtgtgtgcgttagacttgatgagaaggtgtgaactctgcagaaagtctcttcttcatcactgaattcagtcacttggagatgacaacttcaaatgctaacccgatgaccccagaaaaccgtgtgagattcgtaccgaagaaccttgtggaatccctttgcttaggcccaacctggtcgatagctcgagaaagaattttttccaaggaaatgtctcggatatgggtactgtatttgaaagctgttagctttgtcaacacgcattgtccttgtcatttgggccccgagctctgaccctcgtgtctgacgcggccacctctttctggaggggctgaggacagatgtgcctgcttgtggagaccaggctgggcctaagcgaagggtcatcgcagccccagcccggagcgtggagcccttggggggtggtcgggtgggatgtgcgttctccgctcgtggtgatgtcaggagctcctcggagggaacagagcggctgtgtatgcagcctgcaggtttccatacactgaagcttttacctcaactttaaaaaaaaaaaaagaagaaaagatttaaaaaaaaaaaaaaaggagactttttttgtaaggttcggcaattttctacggaagtccagcccgctgtgagtccccgcctggctagcgctgcccctgctgctgctgccgcgccacccttgggaaccacttcccgagcttatgtgtatataaatagttatttattaacatcattggtcatttttaaaaaaaagaaaataagaaaaaaccgcagaagaaatgcattcacacagtcgcagagatgcaggccttgccagtggtgtgccgggcgcgggtcctgtctggcggcggcctgtcgtctccaggtgctaactcctgccaccgcgcggtgctcacccacgtctgttcgcgcgctcgcc

SEQ ID NO: 86838 - DNA, 3232 bp, Homo sapiens
agcggatgtgccggggccggcgagccaaagaggagccggccgcgcgggccgggaggggacggccgccggagccgcgaggccaactgtcgcctggttgggcccggaaatgggacgtcgcgctttctcagggagcgtagaagcagccagggcctctccaagccgctgctgtgacagaaagtgagtgagctgccggaggatgtccaccgccacgacagtcgcccccgcggggatcccggcgaccccgggccctgtgaacccaccccccccggaggtctccaaccccagcaagcccggccgcaagaccaaccagctgcagtacatgcagaatgtggtggtgaagacgctctggaaacaccagttcgcctggcccttctaccagcccgtggacgcaatcaaattgaacctgccggattatcataaaataattaaaaacccaatggatatggggactattaagaagagactagaaaataattattattggagtgcaagcgaatgtatgcaggacttcaacaccatgtttacaaattgttacatttataacaagcccacagatgacatagtgctaatggcccaagctttagagaaaatttttctacaaaaagtggcccagatgccccaagaggaagttgaattattaccccctgctccaaagggcaaaggtcggaagccggctgcgggagcccagagcgcaggtacacagcaagtggcggccgtgtcctctgtctccccagcgaccccctttcagagcgtgccccccaccgtctcccagacgcccgtcatcgctgccacccctgtaccaaccatcactgcaaacgtcacgtcggtcccagtccccccagctgccgccccacctcctcctgccacacccatcgtccccgtggtccctcctacgccgcctgtcgtcaagaaaaagggcgtgaagcggaaagcagacacaaccactcccacgacgtcggccatcactgccagccggagtgagtcgcccccgccgttgtcagaccccaagcaggccaaagtggtggcccggcgggagagtggtggccgccccatcaagcctcccaagaaggacctggaggacggcgaggtgccccagcacgcaggcaagaagggcaagctgtcggagcacctgcgctactgcgacagcatcctcagggagatgctatccaagaagcacgcggcctacgcctggcccttctacaagccagtggatgccgaggccctggagctgcacgactaccacgacatcatcaagcacccgatggacctcagcaccgtgaaaaggaagatggatggccgagagtacccagacgcacagggctttgctgctgatgtccggctgatgttctcgaattgctacaaatacaatcccccagaccacgaggttgtggccatggcccggaagctccaggacgtgtttgagatgaggtttgccaagatgccagatgagcccgtggaggcaccggcgctgcctgcccccgcggcccccatggtgagcaagggcgctgagagcagccgtagcagtgaggagagctcttcggactcaggcagctcggactcggaggaggagcgggccaccaggctggcggagctgcaggagcagacagctgaagaaaggcggcaagcaggcatctgcctcctacgactcagaggaagaggaggagggcctgcccatgagctacgatgaaaagcgccagcttagcctggacatcaaccggctgcccggggagaagctgggccgggtagtgcacatcatccaatctcgggagccctcgctcagggactccaaccccgacgagatagaaattgactttgagactctgaaacccaccactttgcgggaactggagagatatgtcaagtcttgtttacagaaaaagcaaaggaaaccgttctcagcaagcgggaagaaacaggcagccaagtcgaaagaggagctagctcaggaaaagaagaaggagctggaaaagcgtctgcaggatgtcagcgggcagctgagcagcagcaagaagcccgcccggaaagagaagcccggctcagcaccctcagggggcccgtccaggctcagcagcagcagctcctccgagtctgggagcagcagctccagcgggtccagctctgacagcagtgactcagaatgaactggcttcggacagaacaggacagatggatgtcgcacacgccgagactctgccgtacccctctgtggttcatattactacttctgttccatggtgtgcaggtctgcttcttaattcagtgttatgatatcttccagtttttgctttcataggtcagagatctatcttgtgtgtgcgttagacttgatgagaaggtgtgaactctgcagaaagtctcttcttcatcactgaattcagtcacttggagatgacaacttcaaatgctaacccgatgaccccagaaaaccgtgtgagattcgtaccgaagaaccttgtggaatccctttgcttaggcccaacctggtcgatagctcgagaaagaattttttccaaggaaatgtctcggatatgggtactgtatttgaaagctgttagctttgtcaacacgcattgtccttgtcatttgggccccgagctctgaccctcgtgtctgacgcggccacctctttctggaggggctgaggacagatgtgcctgcttgtggagaccaggctgggcctaagcgaagggtcatcgcagccccagcccggagcgtggagcccttggggggtggtcgggtgggatgtgcgttctccgctcgtggtgatgtcaggagctcctcggagggaacagagcggctgtgtatgcagcctgcaggtttccatacactgaagcttttacctcaactttaaaaaaaaaaaaagaagaaaagatttaaaaaaaaaaaaaaaggagactttttttgtaaggttcggcaattttctacggaagtccagcccgctgtgagtccccgcctggctagcgctgcccctgctgctgctgccgcgccacccttgggaaccacttcccgagcttatgtgtatataaatagttatttattaacatcattggtcatttttaaaaaaaagaaaataagaaaaaaccgcagaagaaatgcattcacacagtcgcagagatgcaggccttgccagtggtgtgccgggcgcgggtcctgtctggcggcggcctgtcgtctccaggtgctaactcctgccaccgcgcggtgctcacccacgtctgttcgcgcgctcgcc

SEQ ID NO: 86839 - DNA, 340 bp, Homo sapiens
ggggtagagtgtgtactgtacaaaagttcatggatttcaactgaggaagaggttttgcaaaattgcttcaaaaatgagggggaagccatgcctggctaattttatatttttagtagagacggggtttctccatattggtcaggctggtctcgaacttgtgacctcaggtgatccgcccgcctcagcctcccaaagtgcctgtaatcccagctgctggggaggctaaggcaggagaattgcttgaaccagggaggtggaggttgcggtgagccaagatcgagccattgcactccagcctgggcaacaagagtgaaactccatctcaaaaacaaaacaaaca

SEQ ID NO: 86840 - DNA, 369 bp, Homo sapiens
aaaaaactgttatccaaaatgaaacatttgttaaaagaagtggattatgctattaaagatgtgccccccacccccatgtgtttgttcctatcgtagtaatgctgattgttaatggatggcatagtaactttaattgtgttcacaggcctttgttcttaaaattatgcactcttccctgttttttcttagcattttatcaatttgcatagaagagaaaatgatttgtaacaggtttctctggtcacatcactgaggagagtcaacaaaagaagtcattcaattgaggttaaatctttacacaaagaaggcattaatagcttaaaagaataaagaaatcctgatatggttattgtgacttttccatttatc

SEQ ID NO: 86841 - DNA, 436 bp, Homo sapiens
ggaatgattcaacactatgtggccagtttaaacaagactctgggaggtgtggttgggtgacttggtctgcgtggctgagcattacatcttctctatgtggaaagattggtgtgtatggaggtgtggattaagacctaattaaaaaaaaatttgaggtggaatggaatctataggaggaatctatgaagacgccctgcatcagacatcctgtccaaagggcctagttttctcatctctgtggtgcttagtaagtgtttctctaaggagacatcacagccactgccgaaaacaacctcatcttagcagcagagagaggcccacactctcacaccatgcacctcttcctcttgatcccagagtaccgaaaaagagttttggactaagaaacctgggaggttgctaccgatctggactaggccttgtgctcttgttaatg

SEQ ID NO: 86842 - DNA, 486 bp, Homo sapiens
ctgctctcccatctttgagtgctatgtttactaagagtctattaggttcattcccaggcttgtttatgctcactgtatttcttattgtcattatgtaccttaatgtaatgtgagtcagaaaaaaaacatatttctgtgaagactggatagaacgctttggaaagatttgataaaagcaagttactaaaaagagtgttggcagacctgtaacaaaaaattgacaaaagttatggtctatgtggaacctgccctcagaatgttcttttagtttcccaaggcttcacattctgtgttaaagaaacaaactgaaattcatggacaatgcattgcgagtgtgatttatacaagaaaggcaatctagacgtcttagcaatggaatgtaaccatgttttttaaaagcctaagtcatatatcaaatgattgtcaaaacgataacccaaaacaatgtataggttttgtgttaaaataaaatgaaatatttaaagt

SEQ ID NO: 86843 - DNA, 620 bp, Homo sapiens
cccccccccactttttagagctttttgtatctaataggcaaaacagggctgttagggaaggcttcagtttttaaaatacaagctgttaaactccaaaaggtgtaatacttaagtacaagggtaaagaaagctcaagaaggaatgtgaagtggtatacaaaaaggctgagtggaaaaaatggctaaaaatgttttgtcatattctgttgaattcacaagagctagtaaattgggaaaaatttaaatgttgtctgattctatcaaaacactttcatatgttgtaaagtatccatttgggcttaaaacctaactaaaattcaaaattgttaatactgaatatgtaattcttatgacattggtttcaaaaataatattcctccccaaatttgaataaaggagatagctttaaaatattagttctacccgggctcggtggttcacacctgtaatcctggcactttgggagtccgaggcaggtggatcacttgaggtcaggagttcgagaccaacctggcgaacatagtgaaaccccacctccattaaaaatacaaaaattagctgagcatggtggctcatgcctgtaatcccagctactcaggaggctgaggcaggagaattgct

SEQ ID NO: 86844 - DNA, 266 bp, Homo sapiens
gtacctctcttctgtttcccatgccatcccaaaccagaggcctgaggctctggattttttttgcatcaaatcaaatcagcgaacatgagggtaaacctgttgtaaagagatttccattaagtacctgttaggtaccatatgcaggaaaggcttagaaatgacccccgggcatccagcatgcaccccaggggctgacagcagactcctcaagtgcaccttagtgaaagtgagtgcccctggccggccatctggtccatcgttgccag

SEQ ID NO: 86845 - DNA, 149 bp, Homo sapiens
gatcaacggtacttgttttaaagaagcttatgtggactttgtcttttctcgttgccacaacctcttttaatgtgcctatagtccactatagcatgcatatctcaaattgcaattccttgcaattctggaataaacgctttattttggag

SEQ ID NO: 86846 - DNA, 418 bp, Homo sapiens
ctaatttttgtatttttagtagagatgggggtttcactatgttggcccaggctggtctcaaactcctgaccttgtgatccgcccacgttggcctcccagagtgctgggattataggcgtgagccattcgcccctggcctgttttcacattttctttagtaggaagtgctgtacagatatctcacgttgaggaaatgctttatattgcctttgtcttaatatttcaagggcaaaccaaaagagatactagcttaactaatgatccacttctgcatgctttatttggatctaggataaatcagtaccccaccccccggagtttaagtgatgattggtaaatgtcagagaaagatttcataccaaacaaaatgtattctatttatttaaaatagtttatttttattttcatttacttattt

SEQ ID NO: 86847 - DNA, 431 bp, Homo sapiens
tggcccttgtatgtgtagttgttaagaagtggggtgaaggtaaattgtgtagtggagagaaccaaggtggcagaattccagctatagcattgtttcttgctggtgagttgttagcttgtttgtgagtgctgttttcatgttctgtcagtttcattaatagacaaaacagtgaaattaatgaaagtctactggcatcttcttttttattttttatttttattttttggttaagatacaggcggaagtgcagtggtgcgatcataagctcactgcagcctcgaattcctgggcttgaggaatcctcctccctcagctactcaagaggctgaggctggagggatcgcttgagcccaggaagttgagactgtaatgagctatgattgtgccactgcaatccttggctgcaaagtgagatcctatctcttaaaatt

SEQ ID NO: 86848 - DNA, 398 bp, Homo sapiens
ggtaactggagacaaagttataagcaaagacttctgtcattttggcatgttttgaactttgaaccacaagaagatataatatattccaaaaattatacatctaattaagtgaaaaaggtagaaagccatgctagcgtgcctgtgtaaggaaactgaacagacacatacccttgtacacgtatacagtctcgatgaaaggatattcaaagaatggataattatggctgtttcttggaggggacttgagttctggagaaaactggtgtgagggcgacttatttcttactgagtgtcctttgtacatttttaatttgtatttcaaaataataatgaaactagctaatttgatacttgaaaaaaattaaaattttctaaaattgtgtgcattctttcaggca

SEQ ID NO: 86849 - DNA, 450 bp, Homo sapiens
tcgatctagaggatcccgttagtttaagggctactcaagcatcaaggctgcgttggtttgatttcttctgaggtctcttcactggtagatagccatcttctcactgcgtcctcagatggtctttttttctgtgttggcacccctggttctgctctctcattataaagacatcagtcatactagattaggtaaaatgaataattttaccttaattacttctttaacaaccctatctccaaaaacctgacacattctgagcttgtggctatgtttatgtctcatctgcctggctatgttaacttttcccagcaggaaaagatggcacactcaaagaagtaattgaggagagttgaatgaagggactattgtatgggtagggttaagggagccaacaaggaatggttaaaaaccctgagtaatctgcatgtggtggtgcatacctatagtccc

SEQ ID NO: 86850 - DNA, 652 bp, Homo sapiens
atagggtgtgaccacccacaccacctggccaggatctgctgcagccattcctcacgacgacctcacccaggttcaccaccaccaggaggtgatcctggtgcaggcatgccaggaggtggtgggtagcgacgacttggatggggaaccagatactcatcctggtgccagagctggccagcggcgaccaccaccaccacctcgagcaggccctggtcaccatcgtgggggctggcaagggtggatgtggcaccatcttgggcaacaagaagtgggggcagaagcgagtgcagatcaggaacctggagggcaagttatctgtctccatgtggtactcggatgaaaacaaaaagacattaaccataaaatagtggttgagaaacagatcactggagagaactcacctcctgattattcagagtatatgacaggaaagaaacttcctccttggaggaatacctggcattgacagctcagatcccaaaaaactgcagaattcgccagaatgaagccaagaaaaatttaaaagatgatgttccatgaacaatagctggccctcgccaaggctgcacaaagatgttcaaggataactgacatgagaaaacatctgcacactcactgtcacggagtccacttctgcacagaatgtagaaga

SEQ ID NO: 86851 - DNA, 581 bp, Homo sapiens
gcgagcgatcgcgatgggagcagtggatgcgagagtgaaattgatgcaggagctggggccgcgacgggagcttgtgtgtgtgtgtgtgtatgtgtgtgcgcacgcgcacacgacgttgacaggcgctgtgtgtgaccctaatggactatttaaatgtgactgtatgtacgtgattatgactgcgtcgcgttgtgcgtgaccacgttcgtaaaggtggtgatagcagccgctatggggccaaaaacaaagaattgagctttgcgttgagtgacaggcatagtccttcgtgaatgtgtggggagcagtttttgtgctggcccgtagctggattggagtgggggcaacctagaaggaggggagaagaatgggacacagtgtagacaacatagttcaagagtttctccgtaaattagagcagagaaatggagcagcaggttggggtagagggctggggaagacggctggggaacaaccacccatcaacatgttgttggaaatgagccacgagaggggggaaaagtccaggcaagggtaagtaaacaaggctcatctgtgtgggtgtagttaaaaatgcaagaatt

SEQ ID NO: 86852 - DNA, 368 bp, Homo sapiens
ttagggcgtgttcaaggaagtggttgaagataaaagaggagttggttgttaatgaattatgaattccattatgaaggcatacaggaaaagtgttgaaagttgggaagaatgagaaaaggggacaaatgttatttcacttaaattccctaatttcttataagctttggcctattttcatatattgggaacttgtatgatttttcttctacgagttgactatctgttcctttgtccattttgtgtgctatttaaacagcagactttacactatcaatgtcccaaatcatcctctgacacccttcaggcccctgtggctggtcccttgagtagctgaggggcaaagcagggcccatgggtgaaagagcaag

SEQ ID NO: 86853 - DNA, 492 bp, Homo sapiens
caagaattaaaaaaaatagaaaagggtaatcgcgctgcagagagtaaaccatgagctgaagatttcagatatagggggaaaataccctgtgtttggtagaggtcaacaaaagtgagatgtggtgagttatatacaatctcatggcaggaaattcaaaactagagtttgtggagggaggaagaaaggtctgaaggtagtgaacaacaaggaggccggccatctgttccattttcagacccactggtaagaggctgtagctggggaaatgttgagagggctgcagagtcctccagatacagcctagtttctgttagactcagaatgttagggcgtgttcaaggaagtggttgaagataaaagaggagttggttgttaatgaattatgaattccattatgaaggcatacaggaaaagtgttgaaagttgggaagaatgagaaaaggggacaaatgagacttgatggtatacaatgtccgaaaagacagttgacta

SEQ ID NO: 86854 - DNA, 324 bp, Homo sapiens
gggccagaaggacctggtgccgacacaccacaccatgggccagaaggacctggtgccgaccacaccacaccacaggggatagaaggacctggtactgaccacaccacaccacgggccagaaggacctggtgccgacacaccacaccatgggccagaaggacctggtgccgaccacaccacactcataggggccagaaggacccggtactgaccacaccacaccacaggggccagaaggacctggtactgaccacaccacaccacaggggatagaaggacccactactgaccacaccacaccacaggggctagaaggacctggtg

SEQ ID NO: 86855 - DNA, 654 bp, Homo sapiens
ggcttattttatggggtagggggccgctggtaggcgaagattgtccgagggagagggggaggatgaagccagtgcgtggcggaccctgcagccgcgagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaaccttaaaaaaaa

SEQ ID NO: 86856 - DNA, 577 bp, Homo sapiens
ggcttattttatggggtagggggccgctggtaggcgaagattgtccgagggagagggggaggatgaagccagtgcgtggcggaccctgcagccgcgagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacgccacgtgctgcgaaaaactggtggcgcatgaatagcgaggtgccgactgaatagcgaggtgccgatgaatagcgaggtcccgagtgaataggt

SEQ ID NO: 86857 - DNA, 656 bp, Homo sapiens
  misc_feature (223)..(223): n is a, c, g, or t
tccgccacgagggaatgtgtgtagatgctctcttaagagaagaaccccgcgaggttggcccacatttatatgaacactccctctgtttaaaggagagggagagtccctgtgtggccccacagaaagagagttgtcccaccacatgcctaagccaccccgcgaggtctggccacagacccacagagatgttgcccacaccctgtcacatgtccactgaaggccncactggcacgttcttctcccagttcccgagggctaacgctgagaggagaccacgctttgccctcggagaccacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaaccttaaaaaaaa

SEQ ID NO: 86858 - DNA, 212 bp, Homo sapiens
gatcttggcacagtaacttagttcctcatgaactacatttgtcgtaaaatggtcaaaatgaaaagaccagagtcacgtaaaaactcttatcagctgctgttttcttagagtacataaccttaggatatattatcgtgcatattctttaatggtaggtttgttgaaaatcagtcatagcccaaacagaaataaatgtgacatgctaagaaatg

SEQ ID NO: 86859 - DNA, 722 bp, Homo sapiens
atttcgctggctttgttttctcatctctccaggtagatgcttagctcattgtgatgattttaaagcacttgcaaattctttaacattctttccttcaaaaaatggagtcaaattttcctccacttgaatgttggccagacatagtgacttcttatgaacagcctgtggcagaagtgatggtatgtgactttcaagaataggtcaccaaaaagaatcatttctgcctgactttctcttggatcacttatttgggagaacctagtcgtcacgtgagaatacatgagcgtccctctggagaggcccatgtagagaagacaaccatgtgagtaaacttcctgggaagtggatgcttctattctgtcaaaccttcaaacgattgcagctttggccaacatgtgactgcagcttcatgagagacctcaagccagaactatccagccaagctatttttgaattcctgacccataaaaactatgagagataataaatatttgttgtttcaagccactaactttaggggtaatttgttttacagcactagaaagctaatatactcattagtcatcggccatttttctgctctaatacaagcatttaaatgctatagatttctctctacattagctgaatctcacaagtttggatatgcaggatcatttggatttaaatattttctgatttctattattattatttttaacttacgagttacttagaattgt

SEQ ID NO: 86860 - DNA, 895 bp, Homo sapiens
aagtttctaatcatgccttggtctttccagttagcccccaagctgaacccatcggaaatccaagagttgccttattagaacaaagacatgcatcactaaggaaattccaatgggtttaacagctctgtgtcaggaacaagtgtcaaagaccaaatatgataagaaaagatgctcttagcacccttatccctcaggaattctccaaggtttggggagctctctgctagtcattgaggatgaagaccagatacatatttatcatgatatcacaaggcttattatacaaaatttgagtatttcttgcagaagtgaataaaatagaacataagaatcatctccagtaaagcaagtgtggttgtcctttccaggtcctgtgaaaatgaagggaagagagtgtctgctcagctccactaggggctcccaccatcacggtcaggagaccactctctccctgatgtaggtgagctggggcacgtgtaatagaggcctctgcttgaaggaatatcatcaggaaacagcagtcagggcactagtggcccctgacaaacacagggcagagccccgggtctagtctgggtgtaggtggcttctgggtgatagtggcttctcttcctctaggaactgtttggaaactgaagagtgtctggcctggacagcacctacacctccctctaagtttgaagccatctcaggatggctgcgctttggatgtgactgttcattttctatggctgagtctctctagatttggcagttccctgtggctcagtgaattagaaacagttctctcctgtttgtaccttctttaaacatgaggattaatctgagtgacaagtgcctgaatgtctgaactggtcattggagagaatcgtaaatacaaactatcttttttttt

SEQ ID NO: 86861 - DNA, 340 bp, Homo sapiens
ataaagcatctgtcctcttcaaggaaacaaggaatgtctggttctcctttctagcctgtgaagtaggagatggtgtcatttgttgtacagaagcaggagccccatgttactgggctgcaactactgactgctttggttaacatactgaaaatttcatcagttgtctttaataaaagaccatgtgtatagggaaagatctgagcagttgtcattgagtttctcttccccagcccatgagctacagctggcagagagcaaggacaccagtatgtaatccaacagccagttacctgaaatttttgcatttcagtattagagttaggtagactttgagtctgtt

SEQ ID NO: 86862 - DNA, 516 bp, Homo sapiens
aggaagagttcattctatgattagtgttattttttacccctcaaatgcttggtagaattttccactgaagtcatctctgggaccagcattttgtttgtggagagattttagattattattattgtattctattgtgtcattttaaaattttatacatgtgtgtgtttatctataatattccctttcttctgttttctttgtgtttgttttatctagcttcttgagatggatgtaaattttttagcctcatttcttctaaaatgtatacttaagactagaaatttccctctactacattacctatattccatacactttgatttgtggtatttttgttaattcagttcaaaatgccttctaatttcatgatgatagcttctttgactacaggttatttagaagtgtgtttcatggatgggtgcagtggctcaagcctgtaatctcagcactttgggaggctgaggtgggagcatcatttgagcccaggagtttgagaccagcccaggcaacatagca

SEQ ID NO: 86863 - DNA, 3502 bp, Homo sapiens
agttttacaaaactgtccttgctcttcctgcgtttgcccagtcaagggtatttttgcctgaggtcggaatgatgctgttagtcctggtgatatgattgcatagcaacacagagcagctctgagaggggaggaggaggagaagaaggaagacagggaagtgggagagacagagggagagtgtcttacagctgccgcctgcttctcagacctgacggaatcagaagctacataatattcgccgtgtgagtggctatcgtaatagataacatttgaatatctactaaatgccagaaactatgaattaactcctctcaacaaagctaagaggtgcttaatgatcaatagttggtgcaaccctcccacgatgtcatgactggcaggcagctgaccagttccatcatagcagcagcctccgaagcacctgcccccaccctcaggttagagctgctgtcaccagccctgcacctcctcaagatggtgctggggttccctgcctaagcctaaagctgttgaacgggtctgttggtgcctctggacccctggaaccaccagccatgaatctgtgttggaatgaaataaaaaagaagtctcacaacctccgcgctcgcctagaggccttctcagaccacagtggaaagcttcagctccctcttcaagagattattgactggctcagccaaaaggatgaggagttgtcagctcagctgcccctacagggggatgtggccctggtgcaacaggagaaggagacacatgcggcctttatggaagaagtcaagtctcgggccccctacatctattctgtgctggagtcagctcaggccttcctgtcccagcacccatttgaggagttagaggagcctcattctgagagcaaagatacctccccgaaacagcggatccagaatctcagccgctttgtatggaagcaggcgacggtggccagtgaactgtgggagaagttgacagcccgctgtgtggaccagcaccgtcacattgagcggactctggagcagctcttggagattcaaggggcaatggaggaactaagcactactctaagccaagctgagggagtccgagccacttgggagcccattggggatctcttcattgattcactcccagagcacatccaggctattaagctgttcaaagaagaattctcccccatgaaagatggagtaaagttggtgaatgatctggcccaccaacttgccatttctgatgtgcacttgtcaatggagaattcccaggccctggaacagatcaacgtccgatggaaacaactacaggcgtcagttgagtgagaggcttaagcagctccaggatgcccaccgggactttgggcctgggtcacagcactttctctcctcctctgtccaggttccctgggaaagagcaatttcacccaataaagttccctactacatcaaccaccaggctcagaccacatgctgggaccatcccaagatgacagagttataccaaaccctagctgatctgaacaacattaagttctcagcttatcgcactgccatgaaactccgcagagtccagaaagccctgcgcttggacctggtaactttaaccacagccctggaaatcttcaatgagcatgatctgcaggccagtgagcacgtgatggatgtggtagaggtcattcactgcctgactgccttatatgaacgtttggaggaggaaagaggcatcctggtcaatgtgccactctgtgtggacatgagcctcaattggctcctcaatgtttttgatagtggtcgcagcggaaagatgcgggcattgtcttttaagactggcattgcatgcttgtgtggcacggaagtgaaggaaaaacttcagtacctcttcagccaagtggccaactcaggcagccagtgtgaccagcgccaccttggtgtcctgcttcatgaggccattcaggtgccccgtcagctgggtgaagtggcagcctttgggggcagcaatgtggagcccagtgtccgtagttgcttccgttttagcaccgggaagccagtcattgaagcatcccagttcctggagtgggtcaacctggagccccagtccatggtgtggctgcctgttctgcatcgggtaaccattgctgagcaagtgaagcatcagaccaagtgctctatctgtaggcagtgccccatcaaggggttcaggtaccggagtctgaagcaattcaacgttgacatctgccagacctgcttcttgacaggcagggccagcaaaggcaataagctgcactaccccatcatggagtattacacaccgaccacatccagtgagaacatgagggactttgccacaaccttaaagaacaaattccgctccaagcattatttcagcaaacaccctcagcgaggttatctgcctgtgcaatcagtgctggaggctgactacagtgagacgccggcttcttccccgatgtggccacacgccgacacacactcccgaattgagcattttgcgagcaggcttgctgagatggaaagtcaaaattgctccttctttaatgacagcttgtccccagatgacagcatagacgaggaccagtacctgctgcggcactccagccccatcacagaccgggagccagcctttggacagcaggctccatgcagtgtggctacagaaagcaaaggggagctacagaagatcctggcccacttggaagatgagaaccggattctccagggagagctgaggcgcctgaagtggcagcatgaggaggcagctgaggcacccagtctggctgacggctccactgaggcagcaacagaccaccgcaatgaggagcttctggccgaggcccgtatccttcggcaacataagagccgcctggagacgcgcatgcagatcctcgaagatcacaacaagcagctagagtcccagctgcagcgtctgagggagcttctcctgcagccacccaccgaatcagatggcagtggctctgcaggctcgtccctagcttcctctccacagcagtcagaaggcagtcacccccgggagaagggacagaccactccagataccgaggctgcagatgatgtggggtcaaagagccaggatgtcagcctgtgcttggaggacatcatggagaaactccgtcatgccttccccagtgtgcgaagttctgatgtgactgccaacaccctgctggcctcttgatggagccagatccccatcctatagttcatagtcctctcctggttccggtcaaagcctttcctcagccttcacccaacctttccagtttccactggccccacattcctcaactagtattatttgggctctgggcagcagcagggatctggtggtatgtgaggtgcatgcgggcagtgatgggagaaggggaggcatgattcttctgaccctagaaatgttccctttaatcttcaagttcgagatcagccctttaagtacctttctgttgcagcccaggcaaatatcacttggccattcagatggggag

SEQ ID NO: 86864 - DNA, 3652 bp, Homo sapiens
agttttacaaaactgtccttgctcttcctgcgtttgcccagtcaagggtatttttgcctgaggtcggaatgatgctgttagtcctggtgatatgattgcatagcaacacagagcagctctgagaggggaggaggaggagaagaaggaagacagggaagtgggagagacagagggagagtgtgcatacagcagctgtcgggcatccctgtctcagggacttcttcgctgattcacagaggcagcccagccccggcctcccagcttacagctgccgcctgcttctcagacctgacggaatcagaagctacataatattcgccgtgtgagtggctatcgtaatagataacatttgaatatctactaaatgccagaaactatgaattaactcctctcaacaaagctaagaggtgcttaatgatcaatagttggtgcactgcctatcctcatcccccccatgagccttggtttttatgcaacctatggtcatgcagggatgcccttacaccctcccacgatgtcatgactggcaggcagctgaccagttccatcatagcagcagcctccgaagcacctgcccccaccctcaggttagagctgctgtcaccagccctgcacctcctcaagatggtgctggggttccctgcctaagcctaaagctgttgaacgggtctgttggtgcctctggacccctggaaccaccagccatgaatctgtgttggaatgaaataaaaaagaagtctcacaacctccgcgctcgcctagaggccttctcagaccacagtggaaagcttcagctccctcttcaagagattattgactggctcagccaaaaggatgaggagttgtcagctcagctgcccctacagggggatgtggccctggtgcaacaggagaaggagacacatgcggcctttatggaagaagtcaagtctcgggccccctacatctattctgtgctggagtcagctcaggccttcctgtcccagcacccatttgaggagttagaggagcctcattctgagagcaaagatacctccccgaaacagcggatccagaatctcagccgctttgtatggaagcaggcgacggtggccagtgaactgtgggagaagttgacagcccgctgtgtggaccagcaccgtcacattgagcggactctggagcagctcttggagattcaaggggcaatggaggaactaagcactactctaagccaagctgagggagtccgagccacttgggagcccattggggatctcttcattgattcactcccagagcacatccaggctattaagctgttcaaagaagaattctcccccatgaaagatggagtaaagttggtgaatgatctggcccaccaacttgccatttctgatgtgcacttgtcaatggagaattcccaggccctggaacagatcaacgtccgatggaaacaactacaggcgtcagttgagtgagaggcttaagcagctccaggatgcccaccgggactttgggcctgggtcacagcactttctctcctcctctgtccaggttccctgggaaagagcaatttcacccaataaagttccctactacatcaaccaccaggctcagaccacatgctgggaccatcccaagatgacagagttataccaaaccctagctgatctgaacaacattaagttctcagcttatcgcactgccatgaaactccgcagagtccagaaagccctgcgcttggacctggtaactttaaccacagccctggaaatcttcaatgagcatgatctgcaggccagtgagcacgtgatggatgtggtagaggtcattcactgcctgactgccttatatgaacgtttggaggaggaaagaggcatcctggtcaatgtgccactctgtgtggacatgagcctcaattggctcctcaatgtttttgatagtggtcgcagcggaaagatgcgggcattgtcttttaagactggcattgcatgcttgtgtggcacggaagtgaaggaaaaacttcagtacctcttcagccaagtggccaactcaggcagccagtgtgaccagcgccaccttggtgtcctgcttcatgaggccattcaggtgccccgtcagctgggtgaagtggcagcctttgggggcagcaatgtggagcccagtgtccgtagttgcttccgttttagcaccgggaagccagtcattgaagcatcccagttcctggagtgggtcaacctggagccccagtccatggtgtggctgcctgttctgcatcgggtaaccattgctgagcaagtgaagcatcagaccaagtgctctatctgtaggcagtgccccatcaaggggttcaggtaccggagtctgaagcaattcaacgttgacatctgccagacctgcttcttgacaggcagggccagcaaaggcaataagctgcactaccccatcatggagtattacacaccgaccacatccagtgagaacatgagggactttgccacaaccttaaagaacaaattccgctccaagcattatttcagcaaacaccctcagcgaggttatctgcctgtgcaatcagtgctggaggctgactacagtgagacgccggcttcttccccgatgtggccacacgccgacacacactcccgaattgagcattttgcgagcaggcttgctgagatggaaagtcaaaattgctccttctttaatgacagcttgtccccagatgacagcatagacgaggaccagtacctgctgcggcactccagccccatcacagaccgggagccagcctttggacagcaggctccatgcagtgtggctacagaaagcaaaggggagctacagaagatcctggcccacttggaagatgagaaccggattctccagggagagctgaggcgcctgaagtggcagcatgaggaggcagctgaggcacccagtctggctgacggctccactgaggcagcaacagaccaccgcaatgaggagcttctggccgaggcccgtatccttcggcaacataagagccgcctggagacgcgcatgcagatcctcgaagatcacaacaagcagctagagtcccagctgcagcgtctgagggagcttctcctgcagccacccaccgaatcagatggcagtggctctgcaggctcgtccctagcttcctctccacagcagtcagaaggcagtcacccccgggagaagggacagaccactccagataccgaggctgcagatgatgtggggtcaaagagccaggatgtcagcctgtgcttggaggacatcatggagaaactccgtcatgccttccccagtgtgcgaagttctgatgtgactgccaacaccctgctggcctcttgatggagccagatccccatcctatagttcatagtcctctcctggttccggtcaaagcctttcctcagccttcacccaacctttccagtttccactggccccacattcctcaactagtattatttgggctctgggcagcagcagggatctggtggtatgtgaggtgcatgcgggcagtgatgggagaaggggaggcatgattcttctgaccctagaaatgttccctttaatcttcaagttcgagatcagccctttaagtacctttctgttgcagcccaggcaaatatcacttggccattcagatggggag

SEQ ID NO: 86865 - DNA, 259 bp, Homo sapiens
ttcacaaaatcatttttagtatttatggcatttaccaaggagacagtgtattacacatgggaaagtgcaccacagaactcagccacggatgagcagcccaatttgcccaggatgtggctaacaagagtatcaataatcacacagggtgctaacagccatacaggaattaccttttttgtcttaggtttcatgggtatattcggttttggacttagcttggctaccgcaaggtggaactgttcactgcctggtcatcttc

SEQ ID NO: 86866 - DNA, 949 bp, Homo sapiens
tcaaagtttgatgagctttacattggaaactcaaaagcttgcactctcattttggctcagatgccaatttgctgggtgcccctgtggtgagtcatgaaacctccttgggccgcaatttcatcatctctaaaaacagaaattatcatacaacctacctcctgggaggtgctgcacaagaagcagctgatggaagtttcaaaatccaatttgtggccgagcgcggtggttcacgcctgtaatcccagcactttgggaggccgaggcaggtggatcacctgaggtcgggagtttgagaccagcctgacatacatggagaaaccccgtctctaccaaaaatacaaaaattagctggggcgtggtggcaggcgcctgtaattccagctacttgggaggctgaggcaggagactcacttgaacccgggaggcggaggtttcagtgagccgagatcgtgccattgcactccagcctgggtaacgagcaaaactctgtctcaaaaaaaaaaaaaaaaaaaatccaatttgtaacccattaaggccatctacagcaatggtacagcaaacttcttttgccattgtgattcataagagaggctcagagtcccagaacacaatgacatgtgttgatgcaactcagaggtggagagaatggagcaaataatgagaaaaaaaatgctttaaatgagtttattttgacctcaaaatacattgtaagagcaacatcctacgttaataaatgttctagcccggtcttcgcgaacatttatgtgcatacaaatcacctgggatcttgttagaaggcagtaggtctggggtggggcctgagattctgcatttctaaccaggtcctgggagatgctgatgctatcgagccacaaccacactttgagtagcaacctctggcctatccttattgtttgttatattaaaatgctgcctctcagtcttctgt

SEQ ID NO: 86867 - DNA, 639 bp, Homo sapiens
gcacacagtgcccatcctctcccctgagctcactctgttcctgtcttctgactcgtttagtgctttgccgtgctttatagttatttgcatgcgtgggagccctgatggccgctggattctatccccgtgcatgggaaaaagcctgaagagtgttcacctgggtaacgagcaaaactctgtctcaaaaaaaaaaaaaaaaaaaatccaatttgtaacccattaaggccatctacagcaatggtacagcaaacttcttttgccattgtgattcataagagaggctcagagtcccagaacacaatgacatgtgttgatgcaactcagaggtggagagaatggagcaaataatgagaaaaaaaatgctttaaatgagtttattttgacctcaaaatacattgtaagagcaacatcctacgttaataaatgttctagcccggtcttcgcgaacatttatgtgcatacaaatcacctgggatcttgttagaaggcagtaggtctggggtggggcctgagattctgcatttctaaccaggtcctgggagatgctgatgctatcgagccacaaccacactttgagtagcaacctctggcctatccttattgtttgttatattaaaatgctgcctctcagtcttctgt

SEQ ID NO: 86868 - DNA, 480 bp, Homo sapiens
aaacacacatttctaggttcattccagacctgtttagtcagaatctctgaccatagagcttgagaatttgcatttaagcaggttcttccaggtcattcctttgttggtccctattaggcaacagcctccctaggggaaaaaggaggtgaaagtcatcttgtgtttcctgctggaaggaccactttaatttgggctccaagatttgagagctatcaacaaatgggatcttcagatccagatattgaggaggatcagatatgattgtgggcccggcgcagtggctcatgcctgtaatcccagcactttgggaggccaaggtgggtggatcatgaggtcaggagttcaagaccagcctggctaacatggtgaaaccctgtctctactaaaaatacaaaaaaattagccaggcatggtggcgggcacctgtcatcccagctacttgagaggctgaggcaaggagaatctcttgaacctgggagg

SEQ ID NO: 86869 - DNA, 422 bp, Homo sapiens
cagaccttggcagtgtggagggagagagcctggttcttctgccgagccctgggcagccttctggtgtcccatgatagaagaaagactcacatttctttgcaccattgagcccatcactgcagcaccagagcatctgacatctgcaaaacaacatcattaggtaggtgttaacttttccccactggtaggcctggtgctcgtaaatgtactgtgacgagtgtaatgtgtttatgagaatgcgcataaattatcagaaataggctgcatttttaatatcacttaatatatcaagttggcctctaagcagccacacgctatattgcaaatgctgagctgacttgctggcatcagtgctccatcatgctctccatgccgaggccatagcgtatgccaagaaggaggcaggggacccctagagtggt

SEQ ID NO: 86870 - DNA, 501 bp, Homo sapiens
accgcacccagcggtgactctttctccactttctctttattttcctctttgtcattgtatttcctaagtatcctgagatgcatttatgatcacaaaaaaaagatgataagcctcactcaggtaataaagcagcacaaaacacgtgttcccttgttcggacagagcactgtggttatttctaaggctacagttgtctgagccacttgggaaaggtgagtctcagctcgtctatctataaaacaatagttaatataatagtgggtatttattgagaaattgttacattctaagcactgtctatatttatctgtaatccacgtgaccactgtgtgaggtaggtatttcttaggttggtgcaaaagtaattgcggtttttgctgttgaaagtaaaaccacaattacttttgcaccaacctgatacctgattttacagataaggaagcttatgttgcccaggttacaccggagctggaaagaggtaggaatggagattccaatcca

SEQ ID NO: 86871 - DNA, 581 bp, Homo sapiens
ttctgccccggtcactgcagagcccacagtcacagactcgttctaacagtggattcacccacacgttccctaggctcatcattacagcctctgctgagttacaggcaacccgcaccttcacacaccttttgcctaactgacctatttattatttccatcatataactcatgcttttctcaatctaggtcttcattaatttctgttctcaggcctagaatgtccttttatccattgtcccatgactaacttccatacagactcaaagactcagcccacacacgccttgctccttaaattttcccctgatccttgacactggaaataattgaattctcatagcacttctgtttatacacagtctatctagacttgagggcaggatctagacttgagggcagtgccttcaatccctcatatgtggtcagcagtcaagcaggtgatggatagacaaatgaataagtggagatttttattgtcattagttatacgtaagttaatgaaactaggaatagctttctttttctttcattgacaaatctctttcagatctctagctcatttctctccctaatacttcttt

SEQ ID NO: 86872 - DNA, 657 bp, Homo sapiens
gcttatagatttattcaacctgtaatcagtagctactgagtacagagtatggggcagaggaaacagattctgccttgaagggagatttaatgtttatttattcagctaatatttgagggtctgctatttgccaggcaccattctaagcactcagatatgggagtatataggcagtttctcccgctctgattgatttttttttcttcccagactaagtcagtgctacactttgaggattttgaaagcagagggcctggaaagttggccaatttttttttaaagtaaatgaaggtaaatatatttaaccatagatgccatatcaaaaaagtactcatttgtcttgctttattataaagtctaaactagaacagtttatttttgagtttcaaaaatcatgagttggttcaaataattgtaaacttacattttaattaatcagaactcaagtaattagaatcctctatttaatccagaattatttaacttgattttaaggggatgatggctcattgtgaactgcagcaatgcctactagaatttgtttttgtttttgttttttgagagggagtctcactgtgttgcccaggcagagcttgcagtgagccaagatcgcaccactgcactccagcctgggcagcagagtgagactctgtctca

SEQ ID NO: 86873 - DNA, 2104 bp, Homo sapiens
  misc_feature (2095)..(2096): n is a, c, g, or t
  misc_feature (2098)..(2103): n is a, c, g, or t
aagccggagagaagagagagcccggccagacccactgcgatgagacagcaggacgcgcccaagcccactcctgcagcccgccgctgctccggcctggcccggagggtgctgaccatcgccttcgccctgctcatcctgggcctcatgacctgggcctacgccgccggggtgccgctggcctccgatcgctacggcctcctggccttcggcctctacggggccttcctttcagcgcacctggtggcgcagagcctcttcgcgtacctggagcaccggcgggtggcggcggcggcgcgggggccgctggatgcagccaccgcgcgcagtgtggcgctgaccatctccgcctaccaggaggaccccgcgtacctgcgccagtgcctggcgtccgcccgcgccctgctgtacccgcgcgcgcggctgcgcgtcctcatggtggtggatggcaaccgcgccgaggacctctacatggtcgacatgttccgcgaggtcttcgctgacgaggaccccgccacgtacgtgtgggacggcaactaccaccagccctgggaacccgcggcggcgggcgcggtgggcgccggagcctatcgggaggtggaggcggaggatcctgggcggctggcagtggaggcgctggtgaggactcgcaggtgcgtgtgcgtggcgcagcgctggggcggcaagcgcgaggtcatgtacacagccttcaaggcgctcggagattcggtggactacgtgcaggtctgtgactcggacacaaggttggaccccatggcactgctggagctcgtgcgggtactggacgaggacccccgggtaggggctgttggtggggacgtgcggatccttaaccctctggactcctgggtcagcttcctaagcagcctgcgatactgggtagccttcaatgtggagcgggcttgtcagagctacttccactgtgtatcctgcatcagcggtcctctaggcctatataggaataacctcttgcagcagtttcttgaggcctggtacaaccagaagttcctgggtacccactgtacttttggggatgaccggcacctcaccaaccgcatgctcagcatgggttatgctaccaagtacacctccaggtcccgctgctactcagagacgccctcgtccttcctgcggtggctgagccagcagacacgctggtccaagtcgtacttccgtgagtggctgtacaacgcgctctggtggcaccggcaccatgcgtggatgacctacgaggcggtggtctccggcctgttccccttcttcgtggcggccactgtgctgcgtctgttctacgcgggccgcccttgggcgctgctgtgggtgctgctgtgcgtgcagggcgtggcactggccaaggcggccttcgcggcctggctgcggggctgcctgcgcatggtgcttctgtcgctctacgcgcccctctacatgtgtggcctcctgcctgccaagttcctggcgctagtcaccatgaaccagagtggctggggcacctcgggccggcggaagctggccgctaactacgtccctctgctgcccctggcgctctgggcgctgctgctgcttgggggcctggtccgcagcgtagcacacgaggccagggccgactggagcggcccttcccgcgcagccgaggcctaccacttggccgcgggggccggcgcctacgtgggctactgggtggccatgttgacgctgtactgggtgggcgtgcggaggctttgccggcggcggaccgggggctaccgcgtccaggtgtgagtccagccacgcggatgccgcctcaagggtcttcaggggaggccagaggagagctgctgggccccgagccacgaacttgctgggtggttctctgggcctcagtttccctcctctgccaaacgagggggtcagcccaagattcttcagtctggactatattgggactgggacttctgggtctccagggagggtatttattggtcaggatgtgggatttgaggagtggaggggaaagggtcctgctttctcctcgttcttatttaatctccatttctactgtgtgatcaggatgtaataaagaattttatttattttcaannannnnnna

SEQ ID NO: 86874 - DNA, 2108 bp, Homo sapiens
  misc_feature (2)..(2): n is a, c, g, or t
  misc_feature (4)..(5): n is a, c, g, or t
  misc_feature (8)..(9): n is a, c, g, or t
  misc_feature (24)..(24): n is a, c, g, or t
  misc_feature (2099)..(2100): n is a, c, g, or t
  misc_feature (2102)..(2107): n is a, c, g, or t
gnannccnngcgcccgggactcangccccttcctttcccctctcgctcccagcaggacgcgcccaagcccactcctgcagcccgccgctgctccggcctggcccggagggtgctgaccatcgccttcgccctgctcatcctgggcctcatgacctgggcctacgccgccggggtgccgctggcctccgatcgctacggcctcctggccttcggcctctacggggccttcctttcagcgcacctggtggcgcagagcctcttcgcgtacctggagcaccggcgggtggcggcggcggcgcgggggccgctggatgcagccaccgcgcgcagtgtggcgctgaccatctccgcctaccaggaggaccccgcgtacctgcgccagtgcctggcgtccgcccgcgccctgctgtacccgcgcgcgcggctgcgcgtcctcatggtggtggatggcaaccgcgccgaggacctctacatggtcgacatgttccgcgaggtcttcgctgacgaggaccccgccacgtacgtgtgggacggcaactaccaccagccctgggaacccgcggcggcgggcgcggtgggcgccggagcctatcgggaggtggaggcggaggatcctgggcggctggcagtggaggcgctggtgaggactcgcaggtgcgtgtgcgtggcgcagcgctggggcggcaagcgcgaggtcatgtacacagccttcaaggcgctcggagattcggtggactacgtgcaggtctgtgactcggacacaaggttggaccccatggcactgctggagctcgtgcgggtactggacgaggacccccgggtaggggctgttggtggggacgtgcggatccttaaccctctggactcctgggtcagcttcctaagcagcctgcgatactgggtagccttcaatgtggagcgggcttgtcagagctacttccactgtgtatcctgcatcagcggtcctctaggcctatataggaataacctcttgcagcagtttcttgaggcctggtacaaccagaagttcctgggtacccactgtacttttggggatgaccggcacctcaccaaccgcatgctcagcatgggttatgctaccaagtacacctccaggtcccgctgctactcagagacgccctcgtccttcctgcggtggctgagccagcagacacgctggtccaagtcgtacttccgtgagtggctgtacaacgcgctctggtggcaccggcaccatgcgtggatgacctacgaggcggtggtctccggcctgttccccttcttcgtggcggccactgtgctgcgtctgttctacgcgggccgcccttgggcgctgctgtgggtgctgctgtgcgtgcagggcgtggcactggccaaggcggccttcgcggcctggctgcggggctgcctgcgcatggtgcttctgtcgctctacgcgcccctctacatgtgtggcctcctgcctgccaagttcctggcgctagtcaccatgaaccagagtggctggggcacctcgggccggcggaagctggccgctaactacgtccctctgctgcccctggcgctctgggcgctgctgctgcttgggggcctggtccgcagcgtagcacacgaggccagggccgactggagcggcccttcccgcgcagccgaggcctaccacttggccgcgggggccggcgcctacgtgggctactgggtggccatgttgacgctgtactgggtgggcgtgcggaggctttgccggcggcggaccgggggctaccgcgtccaggtgtgagtccagccacgcggatgccgcctcaagggtcttcaggggaggccagaggagagctgctgggccccgagccacgaacttgctgggtggttctctgggcctcagtttccctcctctgccaaacgagggggtcagcccaagattcttcagtctggactatattgggactgggacttctgggtctccagggagggtatttattggtcaggatgtgggatttgaggagtggaggggaaagggtcctgctttctcctcgttcttatttaatctccatttctactgtgtgatcaggatgtaataaagaattttatttattttcaannannnnnna

SEQ ID NO: 86875 - DNA, 404 bp, Homo sapiens
cctcaggtgatccacccgcctcggcctcccaaagtgctgggattacaggtgtgagccacggcgctcggccccaaatgcctcttaaaggtcctaccatctctcagcactgttacgttggggatgaagcctcaacatgagttttggggacaaacaatatttaaatggtagcagtagccaagtggtatactacaacttctcaaagtagtttcaaatccactctccctccccatcatccctgaagcatccacagcagggatccatacccctttttacagataggaatggggccctgacatggggcacactgtgcttgaggtcaggaagctctccagtggtgcagggtagcagaactatccctctgggggccagtcattccctgtgcttctctcccaccaccagaggct

SEQ ID NO: 86876 - DNA, 380 bp, Homo sapiens
tggcaattaatacaacataggatccaagattaagtcctgaaacagaaaacgaacattagtgggaaaactggaaatagctgaattaagtctgtagttcagttactactattgtaacattgttaaatcattacctttgataattgtattataattatctaagatgtggacataaggggaacctaggtgaaggatagatgggaatcttttgcctattttctgtaactttaaaattttttcacaataaaaatgaagagagtatgtttgcttagtattgtgtatacactgcaacagtttagtattcaagaatatataaaatccccacttagccaaccttttcaggatgtgcccgccctgcccaatacacttttatattctagcca

SEQ ID NO: 86877 - DNA, 3116 bp, Homo sapiens
ggcggggaggaggaggaggacggacggacagggccagcctgctgtccggctgccgcccgccgtggtgtgagggggtttctgcgcacccacagtcgccaccgtcccacctgggctgccggagcctccccctggacccctggtgcccactgccaccctcatccggtgtgagagcgctgcttccgcttcgcggacgccgcgggcatggactattcgtacgacgaggacctggacgagctgtgccccgtgtgcggggacaaggtgtccggctaccactacggactgctcacgtgtgagagctgcaagggcttcttcaagcgcacggtgcagaacaacaagcactacacgtgcaccgagagccagagctgcaagatcgacaagacgcagcgcaagcgctgtcccttctgccgcttccagaaatgcctgacggtggggatgcgcctggaagccgtgcgcgctgaccgtatgaggggtggccggaacaagtttgggccgatgtacaagcgggaccgggccctgaaacagcagaagaaggcacagattcgggccaatggcttcaagctggagacagggcccccgatgggggtgcccccgccgccccctcccgcaccggactacgtgctgcctcccagcctgcatgggcctgagcccaagggcctggccgccggtccacctgctgggccactgggcgactttggggccccagcactgcccatggccgtgcccggtgcccacgggccactggctggctacctctaccctgcctttcctggccgtgccatcaagtctgagtacccggagccttatgccagccccccacagcctgggctgccgtacggctacccagagcccttctctggagggcccaacgtgcctgagctcatcctgcagctgctgcagctggagccggatgaggaccaggtgcgggcccgcatcttgggctgcctgcaggagcccaccaaaagccgccccgaccagccggcggccttcggcctcctgtgcagaatggccgaccagaccttcatctccatcgtggactgggcacgcaggtgcatggtcttcaaggagctggaggtggccgaccagatgacgctgctgcagaactgctggagcgagctgctggtgttcgaccacatctaccgccaggtccagcacggcaaggagggcagcatcctgctggtcaccgggcaggaggtggagctgaccacagtggccacccaggcgggctcgctgctgcacagcctggtgttgcgggcgcaggagctggtgctgcagctgcttgcgctgcagctggaccggcaggagtttgtctgcctcaagttcatcatcctcttcagcctggatttgaagttcctgaataaccacatcctggtgaaagacgctcaggagaaggccaacgccgccctgcttgactacaccctgtgccactacccgcactgcggggacaaattccagcagctgctgctgtgcctggtggaggtgcgggccctgagcatgcaggccaaggagtacctgtaccacaagcacctgggcaacgagatgccccgcaacaacctgctcatcgaaatgctgcaagccaagcagacttgagcctgggccgggggcggggccgggactgggggcgggactgggggcggggcctgggcggggccgcagccacaccgctggctccgcatggttcattttctgatgcccaccgaggagccccagccccgtcccagaggccgctgcccctgagttctgacactgtgtgtttgggaaggtgggtgaggctgggcagggcctggcggaggtggagtggccactggcacttgcctgctgcttggagtgccccaaggaggtggctgttaaccacccgccccgccccctccctgctcccagctctctctcctggagtctgaagcctgcaggtccggggaggaggttcgggattccctggtgggcctcgacgtcccttggatcagaggtcatcccttcctcctctcctggaaacagacagggagaagttgagcaggtatcaactaggggaggagagagggtctccagtgttccccccatagagaccaggagggagagcctctgttttgtaaactaaggataaccgagtttgctaaattgagaggggctattgggccctagaggacactaggagactggttaggacaaaaagaccttctccctagcccttctaccccacctgacctctgcaagagggggcattgatacatcatcgggaaaaaactttgctccaggcatcactgattccctctcccacccaaggagaacgtttggtacaatcgacatcctagccccacccagaggtggccctcccaggctggtatttatctgcaaggttgtagtcaagaggtttttctccccgctttttgtttttaagcttctagacactccttgaaatgtgtgtgtgatggagggaaggggacagatttgaggactgaagctggggcttggggattgccactaagtacagctgacggtttctccccggacactcgcctactaagtacccttggggtggtgctgggtcattacttctgagccccagccccaatccagagaagcgctgttgcccgccctccacccactaggtgaacagcaggatgccctgttgggggcttcaggtctctgtgggtgggaatgcaagtgaacttgggagggggcacgggcctgtagatcagggatagcgctgttgatcccctctctgtggctccaacccgttgggtcccttgctgcaaacccatgaagctggccctcagctccctgaccccctgtcctaggtcatgaaggacactctgcagggtgaagcaccagggagaggcctcggctgtctcctgtccccggcggggtgcctgctgtccgtcccgctttcatgttactgttgcagcttgtgctgagcctgcccagttggaggagactgggcacccctgcctcctgcctcccgcctcccgccaccctgtctcagtacctcccctccccgccccctgaaacatgtgcccctgccaaggccggagacccacagccctgaaacgagaagtgcccttaaggatcaccccagcccccacagccctggaataaatttcgcaattagtttccaaaaaaaa

SEQ ID NO: 86878 - DNA, 2267 bp, Homo sapiens
gtggaggaggaaggagatgtgtcaaacagaggagtggagctgctgcagctggagccggatgaggaccaggtgcgggcccgcatcttgggctgcctgcaggagcccaccaaaagccgccccgaccagccggcggccttcggcctcctgtgcagaatggccgaccagaccttcatctccatcgtggactgggcacgcaggtgcatggtcttcaaggagctggaggtggccgaccagatgacgctgctgcagaactgctggagcgagctgctggtgttcgaccacatctaccgccaggtccagcacggcaaggagggcagcatcctgctggtcaccgggcaggaggtggagctgaccacagtggccacccaggcgggctcgctgctgcacagcctggtgttgcgggcgcaggagctggtgctgcagctgcttgcgctgcagctggaccggcaggagtttgtctgcctcaagttcatcatcctcttcagcctggatttgaagttcctgaataaccacatcctggtgaaagacgctcaggagaaggccaacgccgccctgcttgactacaccctgtgccactacccgcactgcggggacaaattccagcagctgctgctgtgcctggtggaggtgcgggccctgagcatgcaggccaaggagtacctgtaccacaagcacctgggcaacgagatgccccgcaacaacctgctcatcgaaatgctgcaagccaagcagacttgagcctgggccgggggcggggccgggactgggggcgggactgggggcggggcctgggcggggccgcagccacaccgctggctccgcatggttcattttctgatgcccaccgaggagccccagccccgtcccagaggccgctgcccctgagttctgacactgtgtgtttgggaaggtgggtgaggctgggcagggcctggcggaggtggagtggccactggcacttgcctgctgcttggagtgccccaaggaggtggctgttaaccacccgccccgccccctccctgctcccagctctctctcctggagtctgaagcctgcaggtccggggaggaggttcgggattccctggtgggcctcgacgtcccttggatcagaggtcatcccttcctcctctcctggaaacagacagggagaagttgagcaggtatcaactaggggaggagagagggtctccagtgttccccccatagagaccaggagggagagcctctgttttgtaaactaaggataaccgagtttgctaaattgagaggggctattgggccctagaggacactaggagactggttaggacaaaaagaccttctccctagcccttctaccccacctgacctctgcaagagggggcattgatacatcatcgggaaaaaactttgctccaggcatcactgattccctctcccacccaaggagaacgtttggtacaatcgacatcctagccccacccagaggtggccctcccaggctggtatttatctgcaaggttgtagtcaagaggtttttctccccgctttttgtttttaagcttctagacactccttgaaatgtgtgtgtgatggagggaaggggacagatttgaggactgaagctggggcttggggattgccactaagtacagctgacggtttctccccggacactcgcctactaagtacccttggggtggtgctgggtcattacttctgagccccagccccaatccagagaagcgctgttgcccgccctccacccactaggtgaacagcaggatgccctgttgggggcttcaggtctctgtgggtgggaatgcaagtgaacttgggagggggcacgggcctgtagatcagggatagcgctgttgatcccctctctgtggctccaacccgttgggtcccttgctgcaaacccatgaagctggccctcagctccctgaccccctgtcctaggtcatgaaggacactctgcagggtgaagcaccagggagaggcctcggctgtctcctgtccccggcggggtgcctgctgtccgtcccgctttcatgttactgttgcagcttgtgctgagcctgcccagttggaggagactgggcacccctgcctcctgcctcccgcctcccgccaccctgtctcagtacctcccctccccgccccctgaaacatgtgcccctgccaaggccggagacccacagccctgaaacgagaagtgcccttaaggatcaccccagcccccacagccctggaataaatttcgcaattagtttccaaaaaaaa

SEQ ID NO: 86879 - DNA, 2840 bp, Homo sapiens
ggcggggaggaggaggaggacggacggacagggccagcctgctgtccggctgccgcccgccgtggtgtgagggggtttctgcgcacccacagtcgccaccgtcccacctgggctgccggagcctccccctggacccctggtgcccactgccaccctcatccggtgtgagagcgctgcttccgcttcgcggacgccgcgggcatggactattcgtacgacgaggacctggacgagctgtgccccgtgtgcggggacaaggtgtccggctaccactacggactgctcacgtgtgagagctgcaagggcttcttcaagcgcacggtgcagaacaacaagcactacacgtgcaccgagagccagagctgcaagatcgacaagacgcagcgcaagcgctgtcccttctgccgcttccagaaatgcctgacggtggggatgcgcctggaagccgtgcgcgctgaccgtatgaggggtggccggaacaagtttgggccgatgtacaagcgggaccgggccctgaaacagcagaagaaggcacagattcgggccaatggcttcaagctggagacagggcccccgatgggggtgcccccgccgccccctcccgcaccggactacgtgctgcctcccagcctgcatgggcctgagcccaagggcctggccgccggtccacctgctgggccactgggcgactttggggccccagcactgcccatggccgtgcccggtgcccacgggccactggctggctacctctaccctgcctttcctggccgtgccatcaagtctgagtacccggagccttatgccagccccccacagcctgggctgccgtacggctacccagagcccttctctggagggcccaacgtgcctgagctcatcctgcagctgctgcagctggagccggatgaggaccaggtgcgggcccgcatcttgggctgcctgcaggagcccaccaaaagccgccccgaccagccggcggccttcggcctcctgtgcagaatggccgaccagaccttcatctccatcgtggactgggcacgcaggtgcatggtcttcaaggagctggaggtggccgaccagatgacgctgctgcagaactgctggagcgagctgctggtgttcgaccacatctaccgccaggtccagcacggcaaggagggcagcatcctgctggtcaccgggcaggaggtggagctgaccacagtggccacccaggcgggctcgctgctgcacagcctggtgttgcgggcgcaggagctggtgctgcagctgcttgcgctgcagctggaccggcaggagtttgtctgcctcaagttcatcatcctcttcagcctggatttgaagttcctgaataaccacatcctggtgaaagacgctcaggagaaggccaacgccgccctgcttgactacaccctgtgccactacccgcactgcggggacaaattccagcagctgctgctgtgcctggtggaggtgcgggccctgagcatgcaggccaaggagtacctgtaccacaagcacctgggcaacgagatgccccgcaacaacctgctcatcgaaatgctgcaagccaagcagacttgagcctgggccgggggcggggccgggactgggggcgggactgggggcggggcctgggcggggccgcagccacaccgctggctccgcatggttcattttctgatgcccaccgaggagccccagccccgtcccagaggccgctgcccctgagttctgacactgtgtgtttgggaaggtgggtgaggctgggcagggcctggcggaggtggagtggccactggcacttgcctgctgcttggagtgccccaaggaggtggctgttaaccacccgccccgccccctccctgctcccagctctctctcctggagtctgaagcctgcaggtccggggaggaggttcgggattccctggtgggcctcgacgtcccttggatcagaggtcatcccttcctcctctcctggaaacagacagggagaagttgagcaggtatcaactaggggaggagagagggtctccagtgttccccccatagagaccaggagggagagcctctgttttgtaaactaaggataaccgagtttgctaaattgagaggggctattgggccctagaggacactaggagactggttaggacaaaaagaccttctccctagcccttctaccccacctgacctctgcaagagggggcattgatacatcatcgggaaaaaactttgctccaggcatcactgattccctctcccacccaaggagaacgtttggtacaatcgacatcctagccccacccagaggtggccctcccaggctggtatttatctgcaaggttgtagtcaagaggtttttctccccgctttttgtttttaagcttctagacactccttgaaatgtgtgtgtgatggagggaaggggacagatttgaggactgaagctggggcttggggattgccactaagtacagctgacggtttctccccggacactcgcctactaagtacccttggggtggtgctgggtcattacttctgagccccagccccaatccagagaagcgctgttgcccgccctccacccactaggtgaacagcaggatgccctgttgggggcttcaggtctctgtgggtgggaatgcaagtgaacttgggagggggcacgggcctgtagatcagggatagcgctgttgatcccctctctgtggctccaacccgttgggtcccttgctgcaaacccacagccctgaaacgagaagtgcccttaaggatcaccccagcccccacagccctggaataaatttcgcaattagtttccaaaaaaaa

SEQ ID NO: 86880 - DNA, 1302 bp, Homo sapiens
tgttcctgtgttagtttgctgagaatgatggtttccagcttcatccatgtccctgcaaaggacatgaactcattcttttttatggctgcataacttttgtttcttatgctgggacaaatacagcttatttgtacactgctgggaatgatctaacacagggaaagtcatagtgcaggaaagagaaggaataaatataacataataaaagataaggattatttagtaatgtctaaagagaaaatgtgtgcttatttgcaggtttgaaaagcagagatgatgtcccaaaactagtgactgagttcctggcaaagaaatttgacctggaccagttgataactcatgttttaccatttaaaaaaatcagtgaaggatttgagctgctcaattcaggacaaagcattcgaacggtcctgacgttttgagatccaaagtggcaggaggtctgtgttgtcatggtgaactggagtttctcttgtgagagttccctcatctgaaatcatgtatctgtctcacaaatacaagcataagtagaagatttgttgaagacatagaacccttataaagaattattaacctttataaacatttaaagtcttgtgagcacctgggaattagtataataacaatgttaatatttttgatttacattttgtaaggctataattgtatcttttaagaaaacatacacttggatttctatgttgaaatggagatttttaagagttttaaccagctgctgcagatatataactcaaaacagatatagcgtataaagatatagtaaatgcatctcccagagtaatattcacttaacacattgaaactattattttttagatttgaatataaatgtattttttaaacacttgttatgagttaacttggattacattttgaaatcagttcattccatgatgcatattactggattagattaagaaagacagaaaagattaagggacgggcacatttttcaacgattaagaatcatcattacataacttggtgaaactgaaaaagtatatcatatgggtacacaaggctatttgccagcatatattaatattttagaaaatattccttttgtaatactgaatataaacatagagctagagtcatattatcatacttatcataatgttcaatttgatacagtagaattgcaagtccctaagtccctattcactgtgcttagtagtgactccatttaataaaaagtgtttttagtttttaacaactacactgatgtatctatatatatctataacatgttaaaaattcttaagaaaattaaaaattata

SEQ ID NO: 86881 - DNA, 2105 bp, Homo sapiens
atgtgaaggcacaagctgctgttatatacaacagagtgaactgagcatcagtcagaaaaagtctatgtttgcagaaatacagatccaagacaaagacaggatgggcactgctggaaaagttattaaatgcaaagcagctgtgctttgggagcagaagcaacccttctccattgaggaaatagaagttgccccaccaaagactaaagaagttcgcattaagattttggccacaggaatctgtcgcacagatgaccatgtgataaaaggaacaatggtgtccaagtttccagtgattgtgggacatgaggcaactgggattgtagagagcattggagaaggagtgactacagtgaaaccaggtgacaaagtcatccctctctttctgccacaatgtagagaatgcaatgcttgtcgcaacccagatggcaacctttgcattaggagcgatattactggtcgtggagtactggctgatggcaccaccagatttacatgcaagggcaaaccagtccaccacttcatgaacaccagtacatttaccgagtacacagtggtggatgaatcttctgttgctaagattgatgatgcagctcctcctgagaaagtctgtttaattggctgtgggttttccactggatatggcgctgctgttaaaactggcaaggtcaaacctggttccacttgcgtcgtctttggcctgggaggagttggcctgtcagtcatcatgggctgtaagtcagctggtgcatctaggatcattgggattgacctcaacaaagacaaatttgagaaggccatggctgtaggtgccactgagtgtatcagtcccaaggactctaccaaacccatcagtgaggtgctgtcagaaatgacaggcaacaacgtgggatacacctttgaagttattgggcatcttgaaaccatgattgatgccctggcatcctgccacatgaactatgggaccagcgtggttgtaggagttcctccatcagccaagatgctcacctatgacccgatgttgctcttcactggacgcacatggaagggatgtgtctttggaggtttgaaaagcagagatgatgtcccaaaactagtgactgagttcctggcaaagaaatttgacctggaccagttgataactcatgttttaccatttaaaaaaatcagtgaaggatttgagctgctcaattcaggacaaagcattcgaacggtcctgacgttttgagatccaaagtggcaggaggtctgtgttgtcatggtgaactggagtttctcttgtgagagttccctcatctgaaatcatgtatctgtctcacaaatacaagcataagtagaagatttgttgaagacatagaacccttataaagaattattaacctttataaacatttaaagtcttgtgagcacctgggaattagtataataacaatgttaatatttttgatttacattttgtaaggctataattgtatcttttaagaaaacatacacttggatttctatgttgaaatggagatttttaagagttttaaccagctgctgcagatatataactcaaaacagatatagcgtataaagatatagtaaatgcatctcccagagtaatattcacttaacacattgaaactattattttttagatttgaatataaatgtattttttaaacacttgttatgagttaacttggattacattttgaaatcagttcattccatgatgcatattactggattagattaagaaagacagaaaagattaagggacgggcacatttttcaacgattaagaatcatcattacataacttggtgaaactgaaaaagtatatcatatgggtacacaaggctatttgccagcatatattaatattttagaaaatattccttttgtaatactgaatataaacatagagctagagtcatattatcatacttatcataatgttcaatttgatacagtagaattgcaagtccctaagtccctattcactgtgcttagtagtgactccatttaataaaaagtgtttttagtttttaacaactacactgatgtatctatatatatctataacatgttaaaaattcttaagaaaattaaaaattata

SEQ ID NO: 86882 - DNA, 359 bp, Homo sapiens
tgaacgtaacagcacttggtaaactgtgggatattattattttattttaaaaagttatgctatgtccttgagactagtgttataatgttccaaaatagataacttttctgtaaccacaaagcatgagtgatacaggcttttgctgtgttctgggtaaactcattccacctcagtggcttctgtccattggagcagcagcagtgacgcatatgggcttgagtgaggatagtattattcttggtccttctcaacatggagagtcctcagctccatttccacaactatacattttctagggagttgttaacatctcagtgcagatgtgggatatttttaagcactttttttaagtggcgaaa

SEQ ID NO: 86883 - DNA, 227 bp, Homo sapiens
gacctgcggggcctgtccggacccgaggcggcgctcgggatggtctcccgtggagcagaaacgccgtttcctgggtgaggactcttagtcgcccacctggacggcggcggagacatccgcgccacctgctccccaaatccacctggacgcgcactcagcaggggtgcgggggaggggcttccttccttgggggcctcgcctagagcccccgcccctgggatgcccag

SEQ ID NO: 86884 - DNA, 1268 bp, Homo sapiens
  misc_feature (669)..(669): n is a, c, g, or t
  misc_feature (1082)..(1082): n is a, c, g, or t
atttactaataacatcttttttcagaagcagatggatcaataaaggaaatacggccaactcttaactctgagcaaaaaggtagaacccattaataaagtggaaatgaggtgaaccttgggagacagtagctacagtggacatcggttgttcttcagcattctatcatgtattcaccccactacaggtaattgcatctcaatttcctctgggagcattaccacctccccattgcctgtagccttattggacatgtaaatcagagttccctagcctcccctagccaagggataggcatctgacctatgctgggccaatcagactcactgcttctcttaagatttttaatctgaagtatatgaagtgtcttcaaattgttcatggaagtgaatattatgaaaaaactgagtgaatttcaattttgtgtaccaaaataaacttgtactaacttgttataacatatctgaatagggtctagtttgaggcatgtgaagaaggataagacttcagtttgaaaagaggccatatcagagcaacatgaaatctgctaaaaatgaagaaagaacaaacatcaaatttatgatgaagcttgggtggaagaatggtgaaatcattgatgctttacaaaaagtttatgggcacaatgatgctttctaaagatttggggccanaaaatatacaaaaagtttatggcctcaaataaatcagcagtttacaaatggataactcattttaagaagggatgggaccgtgttgaagatgaagccagcagtggcagaccatccacatcaatttgcaaaaaaaaaaaaaatcatcttgttcttgccataattgacgagggccaacaattaagtgccctaattgaacagggctgataataacagctgaaataatggccaacaccacaaacatctcaactggttcagcttatacatgtgactgaagaattaaaattgaacaaactttccattcaatgagtgccaaaactgttgtgcccagatcagctgaaacaagagcagagctttcaatggatattttaaacaagtgggatcaagatcctgaagcatttctttgaagaactgtnacagaaaatgaaacatggctttaccaggacaatcctgaagacaaagcccaatcagagcaatggctaccaagagtggcccagtcaagagcaaaggtcatggcaacagtgttttgggatgctcaactcacttagctgttgactttctggagagccaaataacaacagtgtctgcttattatgagagtg

SEQ ID NO: 86885 - DNA, 542 bp, Homo sapiens
ctaagaaggttatattttgtttctttgacttgaaggacccatattaactaaaaacaaattgccaagacaattattcatctctccctcccacctaatcaagaattatgtgaaagttctaagtgcctctgtccctcctctttctctctgtctggattccttgggactgacatcatagacatggaggagtctctgactttttaaagtttttgacagtcttgaatgttgtggttttccagtgagttatgggaagagttggagaggactcaaatgcagctctaatgcttcagtggaatcaggagacggttagagagtgaaactctggaagctttgggggatgttgtaaatgagagaatgtacggtcagtagtttctctggcattttaatagagggttattatccatggtctttaattttgggtcatttttctctgttattaagtaagttggacacttggaatatgcagactgattttaatattactctgagctaaacaatgtttaggaagagaaatttgttgcaaataaagtcgtataacaatctta

SEQ ID NO: 86886 - DNA, 316 bp, Homo sapiens
aaaacttaattcccactgcattctcttagtgctttataaataacttgggaatgagatgaactctaaaggtacataaaactgccccagattaagacaaaaatgttttcattaaagtagggaatcagttttaagtagtttgcaaacatgggtggaattttataaggagttttattttgggggtgtggggggacagtgagcttaaagtaaaaatgaaaaaggatctatcctatcactcaagaaaaaccagacgcttgaggtcaggagttcaaggtcagcctggccagatggtgaaaccccgtctctactaaaatacaaa

SEQ ID NO: 86887 - DNA, 415 bp, Homo sapiens
gtctatattacctggctccattatctatgagcatgtttaagctagatacaaattcataaaatctaaagctagataaaaagtttcagaatccacctatcaggaaactaagacacactttctatttggaaagcacattccaaaaacactagctttgttttcgcaatcagaaagccaattcctgtcactagaaaaaacaaaagttgatgcagtttcaatttcgtaacatgcagatgtaatttaggttttctttattaaatgtgtggttgcagacattactgagccatctcaactactgacagcctgactacttgtgaaagatggcttttgtgccaccagaattttaggcttaggggaaattagtgaaaatgcaaccccatgggaagccaaggtaacctggaaaaacaaaactaacagc

SEQ ID NO: 86888 - DNA, 153 bp, Homo sapiens
atgtgttgagtgaagggatggaagggaattatacatctgcatgcccacatcttaatttaaatatgtgaacaaaaatttcaaataagcacccaacaaggccattatatttatctattaaattaactttcctgctctctgagacaattatttgac

SEQ ID NO: 86889 - DNA, 309 bp, Homo sapiens
ggagatcgtgtatataaggcctgatttaaactgtgaggtcaataaaggtttcaatgcagaagtaatacttggaaaggatgagttagaattagaaaggtcacaaagaatgcctaaaggtgttaagagtgagaagtgctttgagacagagcaaaaggaaatatttgagaggataatcaaggcttagtgactaattaatgtgtaaggaaggggaaaacaaaagaatcaaaagaccttttacattttaagtccagaggtctgaaagaatgatgttctgtcaacagaactagggaaattagaagtaagtgaaga

SEQ ID NO: 86890 - DNA, 425 bp, Homo sapiens
gacttgctctggaggtgttgtactctcagtcaaggcccagaggcagtgagcagtcagctcacccctactctgaatgcctgtcagaaggagccctgcttgccctcatgcggggacagcctcggtgccctttaatccagattctaatcgtgcatttgctttttccaagtgctagcacttcctccagtgggcttgagagagcaaacctagttggttttattttgtcaacagtaattctttcgcttatgcttgaagtcctccgaaatgaatttgtagggtcctgagtgagcacaatggtaaaggaattgagtagacatctctgctgtcatggttttaggccacagactgtagtggaaagagcacgtacttcagacgtgggcagacccgaggtcagggtcctgtcgtatcacttccagcagcgtgatctt

SEQ ID NO: 86891 - DNA, 119 bp, Homo sapiens
ggatcgatcgagccggtaccagcaataaaagaattatcacagaattgcaggggaaaccccatagagaagactcattcttagatgagtatacaatccatgggggtctttaggatatttaa

SEQ ID NO: 86892 - DNA, 556 bp, Homo sapiens
ggacaaaacgatttcagattaaatcatcagtgaagcttagtttagtgtcctgctcaggcagtgacccaatgcctacaaccctatctagacaggatggtggaagattctttttggaagcatgcagactgtgactctccaatgagggtagtaaccgggatttgctaaaggcaaagaccctgtaggatagtgaagatatatgagaatgcagtctgtgttcagactattctgtaaaatccatcacttatcatttcttcacctttacaaagtccattgaaatagaggtgactctaaataaagggctgtatcttgtttagcatagaatcccctacagccaatggttttacatctcacatatggtaagcacgtagatactggatggcgagaaggacagagggatggatggacaaatgaatggtgaccagaggaaatgtgtatagaccagctaggcaggactccattcattcaacacattttcagtgagccgctgctatgtgtcaggcactgcccttggtgctggagaaacagcctctccaatcattgaccctggagatcacgt

SEQ ID NO: 86893 - DNA, 737 bp, Homo sapiens
acaaatatacagttaaatagaaggaatacgttttagtattttatagcacagtcggattagtgtaatcaacaacaatatgtctttcaaaataattagaatacatgatttgaaatatttccaacatgaagaaatgataaatgtttgagatgataaatatcctaaataccttgatttgatcattacatattgaatatgtgtatcaaaatatcatgtgtgccccttaaatgtgtacaattattatgtaacaaaaaattgtaaaaccgaaagtttgttcatttctttatatatcttattgacaagggaaggtatcaccaacagaatggacttgatattgataagaggtagatctgctcaacaagacttgggaaggaggatggaataaactgtatggtgtttgagaaatatacaccagacacatacaaatgtgtatctgtgtgtatgtgtttatacatctcacatgtattgtaatagtgcccttaatgaaaacactctgcctctggcaaaaaacaaaaaacaaaacacccctctttttgtttttccacatgactgcgaaacaattacagcttctagtaggagggcttctcctgttcctgggaaaagagctgggttggttggcatttgcataatcgtctttggggccattgtgggtgggtttgggctgctgacacagagctgcagactggccacctgtccaaaacaaatgaactcagcctttgtgtaacattatctggttatcc

SEQ ID NO: 86894 - DNA, 403 bp, Homo sapiens
tctggtatatctccatcagagctcttgggtgaccaggtgcaatgagcaatgtcagtgagcaatgagtagtattttgaacggaatcttttattctgagctacagtctcaacagtggacttaaaatattcggcaaaccatgttgttaaatagatgtgctttcatcaaggctctgttctgtttgtactgcacaagccagagtagatttagcttatttcttaagggccctacaatttttggaatgataagtgatcattgttccacttggaagtcaccagtagcattggctcctaacatgctgagtcagcctatcctttgaagtttggaagccaggtattgacttatcgtttctagctaggaaagtactacatggcttcttcttccagtagagagttatttcatctca

SEQ ID NO: 86895 - DNA, 229 bp, Homo sapiens
ttatcatcaccatgggtgctccatccccctactgagtcaaatgcagagtctcacaatcattgtattcttcctcccccaggagcacccattctctctttacaccaattggccactgccagggatgaagagggatgatggtgctccatcccccgaggtggaaaaaagttccaggctgaggaaacagcatatgtgaaggtccagtggggacagagatttgaagagatgaaag

SEQ ID NO: 86896 - DNA, 432 bp, Homo sapiens
taaacaccgcatctcataaatatcctgtgcgtctctctaaaaggcaaggacttttttaaaaaaaacttaagccttatacaattgtcacatctaaaaatgtaattccttaatattacaaaaaattcagagactttaaaaatttgttttagttgttaaatttggtttatttgcattaggatccaaaaaaagggaccaacatagtatctggttaatgtttcctaagcttctttatctgtagcttccctcactcttcttcccctcaatttatcttaaaaagaaacttggttgtttgtcctatagtttcttacattctggattttgctaattgtgtccattcagagtgcaaggaagagtgttcctttaccttgaattttatgtaaacttgtagttatatccagaggaggcttgatctaattcagattgcggtgtttt

SEQ ID NO: 86897 - DNA, 400 bp, Homo sapiens
catatttcaatgcccatctgcctcctctatagattgcaagctccatgaggagggtgcacctgtcattcaaggttgcatcctcattgcctagggcagtgcctgatacatcatccggttcagtaaatatcaacggaatgagttaaaacaggaaagcttattagcacagaaaccaaagcagcacacatgccctcttgagattgacaaaattgtgctgtagtcctgcgctgcttgttgttaagtgactttagggaagtcatcgtggccatctacagattgaggaaatcaacgtaattatctctgaggtccctcccaaattctcatgtgtagttgacatctgttatctattgcttatatgtcactgaattggcaggtatgcataaatagaatttgcatctaacta

SEQ ID NO: 86898 - DNA, 505 bp, Homo sapiens
aagcagttatttggctgggcagaaatctgaaatcacaaacccattctgattggttagttaattaggatactgccagctgagggatattgaaggctggaggatacagactttagttgtttgtcgaagtctgttggaacattctgtggtttgaccttcagcaggggtaactgcagtcctctcccaatctcccaactccactttagaaagccttagtcttagttacttaattttcttttgttcggttataggtgctgatatgatttggctctgtgtccccacccaaatctcatcttaaattgtaatccccgcatgtggcggaacagacctgtaatccccacttgtggagggagtgagctgataggataatgggggcagtttctcccatgctgttcttgtgacagtgagtgagttctcacgagatctgatggttttataagtgtttgacagcttttccttcacatgctaacacactctcctgccaccttgtgaagaaggtgcctgcttc

SEQ ID NO: 86899 - DNA, 176 bp, Homo sapiens
tgcgtgtggaggtgtgtgcctatgtgcgttcccgcatctaacatgtgcctgcccacatctccttcttcaagagagccttgcaagttctccgcattgggactgggtgcgtcgcctgcgtgtgcaccaatagtctggtcacaaagtttcttgctacgtgtgtactttctcatccccct

SEQ ID NO: 86900 - DNA, 416 bp, Homo sapiens
tagggacagtcctacagctagtcctgcctcaagcagagaaaattagtatattcccaccctggcttccttagttagcttggcataatattttcaaggctgaaatttagatttctgacttaaaagtgggctaatctctttaaacttggatccagtattgaggatccaaacttagcacctagaactaaggaataccattataattgataaaaacattaagatccagtggataaactggcaaagaaaagacaaaggacattcatagaaaacatcatgactagtaaatatgtagggaaaaaaattaaacctattaagaagaccataacaataataaaatattctatcctgggaagaataggaaagaagaaactagaaatctcatatattgccggtggcaatataccttggaataagcctta

SEQ ID NO: 86901 - DNA, 246 bp, Homo sapiens
ctaatttcttcttttttccttcaattattgatcacctaacaagagtttattataggaaagtaataaaaagctgcaagaactagtattacagttaacaagaaacaataaagatgattatatgtgaagatttcaatgctgagatcttcaaaagcatttcaaactgaagccaaaaattagctaatattcagtttttaataaattcattgttaaaattttattccaaattttaatgctgatcaataaccc

SEQ ID NO: 86902 - DNA, 430 bp, Homo sapiens
ataacccaaagcttccccaaatgcatgctaccaacaggttaccaggtgagcagccagaggcctttgctacaagcagtctcatccaccacacaaagattaccattttctatcaatttacgacatgaaaaagcttgaaagcactgctgtcaagtcagatttgccactgagtcaaaataaaggcattttcagacattcaagaactgaaattttacttatatgaaaaaactgaaaaggtaaagtggcaaaacaacaaagaaaacacaacacgacctggaagaaacagtggcagctgagtatgaaccagaagtaacaagtgaaaaagaaaacaacagtatacccttgtcactgacagtgggagattctcctttaataacaagttaaatgacagtattatttccttcctcagggtagcccttaaactgcgggtacc

SEQ ID NO: 86903 - DNA, 857 bp, Homo sapiens
aacgttgggcccatgcaaataatctttttatactgtggggatggggcccaccttaaggtcgatcccatctctacaaaacaaaattagctgggcatggtggtgcacacctgtagtccctattactcaggatgctgagcaggactgcttgagcccaggttgttgaggccacagtaagctgagatcatgctactgcactccagcatgggtaacaaagtgagaccctgtcccaaaaatataacttaaaagggatgttcacaccaacctagaattttaggcccagccagaagtaatgtacaacagttgttttcaaagatgcaggggctcaaaaataagagtgatgccttacttaacgatgggtatacattctgagaaacacgcgggtgatttcattgttaatgtcagcctactacacacctgggtcaaaggtagggcctgttcattgctcccaggctactcacctgcacagcctgttactatactgaatgcaacaggagttctaacagtggtatttgcgtatctgtacacagaaaaggtacagtaaaaataaggtgcagtcacacactatcatacatgcaatacactgttgactaaaatgtcattacatagtgcatgactacgtacttccaactctctcaagggatttcttggagaaaccattcaggatgaagtaaatcaaaaaagggaatgtggatgcaggaaatgaagaccagcacctaagagaggtgcagatcagatgactccaggaaaatgggtattggcaaaataacaacacatctgaatatcttgagaggtttagacaatagatgaaagttcacagctgaggccgtgcacagtggcttatacctgtaatcccagca

SEQ ID NO: 86904 - DNA, 711 bp, Homo sapiens
aaaaaaaaaaaaaaaatttttgagatgggcgtctcactattgccacccaggctggagcacagtggcacgatcttggctcactgcaacctcgtctcccaggttcaagcaattctcctgcctcaggctcctaagtagctgggattacaggcgtgcaccaccacgcctggctgattcttgtatttttagtagagacggtctcaccatgttggccaggctgctctcgaacccctgacctcaaatgatctgtccaccttggcctcccaaagtgctgggattacaggcatgagccactgcgcctggccaaaaataaatttttttaaccgaagggaggctgggtgcagtgggccaagcctgtagtcccagctacttgagagcctgcagtgggaggatcacttgagcccaggagtttgagtctaagcctggtcaacatagcaagagcctgtctcaaaagaagaaatctgcagcctaagcaacatagtcagatcccatctctacaaaacaaaattagctgggcatggtggtgcacacctgtagtccctattactcaggatgctgagcaggactgcttgagcccaggttgttgaggccacagtaagctgagatcatgctactgcactccagcatgggtaacaaagtgagaccctgtcccaaaaatataacttaaaagggatgttcacaccaacctagaattttaggcccagccagaagtaa

SEQ ID NO: 86905 - DNA, 386 bp, Homo sapiens
ttttttttaattggtagagctggcttatgtgttttgccatgaactgccatggtgctctaggccaatgccaaaggtagcatctttgttcttcttaaatgtctatgttctgtgctagctttccctggaacagaccttcagcatccaggcagcagacacagacaagttcttagcccacaggaggagattaataattggctgttgataatatgagtgaatggttctcagagtgtttccccccagcagcagcagtatcacctgggaactagataaaatgcaaattattggaccccaccatagacttactgaatcagaaatgctggaagaggggtctagcaatgttttatcaagacctccagatgattctgatgcatgctgaagtgtgagaa

SEQ ID NO: 86906 - DNA, 347 bp, Homo sapiens
catccctcacacccactcccagcctcagactcacagctatctccctccgcactcccggagggacggttggatgccctggccttcagcacacggcatggccctctgtccccattttgggttctgtgcacagtgggacacacgtgcatgcagtcatagttacacacacacacacacgacactccctcacggtgcctgtgtctgcatgactctgcacacacaaccacacagagactcacatagacacacacaggcctgtctagagacagacgtcacacacacaggcgtgcacagacacacatgggcagacacactcacggacacaaacaccgcacttgcggggggataga

SEQ ID NO: 86907 - DNA, 362 bp, Homo sapiens
cttggcgaagaatgggagaggtcaaaggtgggagcgaggccgctggctggtgagtagagccccaccagagcagatgagctggaagtgcagcagagttagagcctgggctggactgtcggtggggtagagtctaagttgtttccggtctgagccttcaagttgctgggctgtccttggcgtggcgagtcccaggagaaccagtgagacaagactggtggttctcaaagactcatatgtcccttacaggcgcctgcccccgcaaccgattcgaccactccctagatttggtgagactaattccaccccattttctttctcctacatgcccactccccacccctcaattcctgagtctgagccct

SEQ ID NO: 86908 - DNA, 726 bp, Homo sapiens
atggctgtgtttctgcagctgctaccgctgctgctctcgagggcccaagggaaccctggggcttctctggacggccgccctggggaccgggtgaatctctcctgcggaggagtctctcatcccatccgctgggtctgggcacccagcttcccggcctgcaagggcctgtccaaaggacgccgaccgatcctgtgggcctcttcgagcgggacccccaccgtgcctcccctccagcctttcgtcggccgcctacgctccctggactctggtatccggcggctggagctcctcttgagcgcgggagactcgggcacttttttctgcaagggccgccacgaggacgagagccgtacagtgcttcacgtgctgggggacaggacctattgcaaggcccccgggcctacccatgggtccgtgtatccccagctcctgatcccgctgctgggcgctgggttggtgctcggactgggagctttgggcctggtctggtggctgcacaggcgcctgcccccgcaaccgattcgaccactccctagatttgctccacttgtgaaaaccgagccccagaggccagtaaaggaggaagagcccaagattccaggggacctggaccaggaaccgagcctgctctatgcggatctggaccatctagccctcagcaggccccgccggctgtccacagcggaccctgctgatgcctccaccatctatgcagttgtagtttga

SEQ ID NO: 86909 - DNA, 459 bp, Homo sapiens
tttggtcccaatgtaaaatgaagtctcagaacccacggctcagccattttgagagtgagatgaggaggcccacgcccacagaggcccctccggcgcacagctgccatgacaatatgggccagtgcccaggaataggaaggatcaagttaaatgtttgtgatccaataacaaaaccacaacatgggccccattaagcaaggtttaggtagaagctaatgaactgaatctaattttcttttgaccatctttgacaaggaataagctctgctataatgagtttcttaggcaattcaaatatagacattacagtggggctcaataaaaaaaaacaactctcacaaaggagctgatctcctcaaatagactctaaggtggtttaactgggaagcatatatatatttctttaaaactcttccgtgaataatcaggaataattatcaattttaaaatactttttat

SEQ ID NO: 86910 - DNA, 446 bp, Homo sapiens
gtaatattagaactttctattggacttataatgaactgaaatctttggacttttttgtttcttttcttcacttcagcagttttcttctccctggcattcttcctatcttgtttttcagtttttgtctgaaaaggactttatattcattcatgttaaataaatttttcttgtttcgttgtgtcaaacagtgtgactgctgacttacccattattagctcttcctcttagctttgtgttttctgtgcattttgacaagcctgtggcatcctgtgaatccatgccatcagagcccctggccacaagagctgagcttgtccagagctcttcaggctgaatgcccagttgtcttgtctgggaagtgattctccaccctgtgcacagaggcacatggttcctcttcctgaacttgtcctgagagccattggattgcaaggctgacctgccgt

SEQ ID NO: 86911 - DNA, 320 bp, Homo sapiens
ggtatagacacaacttgcacatcacctactttcaccagggagacccaacaactccaattacagcatcaagagaaatcagagataacacaggaaatatagcctcataatttacaaagaaagactaccttcagactcactctggtatgtgagggaatatcacataaccagtaattacttttaatttaatctaatgtgaaaatataattgttcattctctaaaatagattttatctttccagcaattgctagaagagcattatggtattttatataaggtcactagcaatgtgaaaggaactttagaagtattaataataaca

SEQ ID NO: 86912 - DNA, 1007 bp, Homo sapiens
gatcataacactactccagtctgggtgatgaagtgagacctgtctacaaaaaaaagaagcccaaactaaacctaaagcaagcagaaagaagaaaaaaaaaaagaggcagaaaataaatgcaattgtaaacaaattaatagaaaacaatcaaaaaactaatttttgaaaagagcagtaaaattgataaacctctggcaaaattgacaaaaaaagagaaggaattccaatctttgattccaatcttaggaatcaaagaaaagataacagtatagatcctcattagaacgacacaaagaaaataccatgaacaactctatgcacataggattagatgaaccaattccttgaaaggcatacagtacccaaacttaaataaacctcaataaattctctatttttaaaaattgaaccattgtttaaaaccttactagcaaattcataaaacatttaaagatataacaaattctacaaatctcttccagaaagaataatcactttgcaattcattttacaagaccagaattaacatgataccataccaagataaagataacacaaggaaaaaacaaacaaaaacaattgcacaatatccaaaatgaacacagacataaaaatcctcaaaaaataaaaatctagatacataagctgaataatgtaccatgaccaagtttggggttgggaggaaatataagctgtttcaaaattctggaatcagtaaaatccatgattttaacagtctaaacaaaaagaatgaccaaactgatacagaaagagcatagaaaattcagcatccactcatgaaactctgctaacaacaaattaatagatgggaacttgctcaacatgacaaagggaatttaagaaaagcctacagcttgcatacataatggtcaaaaacaatgctttcaaaatcctaagatccagaacaagactgagatggccactttctccatgttattgttctggccactgcaatcaggcaagaaaaatcatagactaaaaagaat

SEQ ID NO: 86913 - DNA, 747 bp, Homo sapiens
tccccactcccggaccgggaaagttgtaaatatggggacgatcagggcacatttgctgttagttgtattgtttccgcctccccactagctacggctccactcccgggcgaggcctgtcaccgaccagcagtcgctccgctcagcccggagctctcctaatccccgagctcaagtagattccgctggcccgcggcctgcactctccgccgggcctacgcctccccggccgcccagcaggagcccagtccccgccaccggagccggccgggagagggtacaaaaccaccgctacccaaggcggctgccaccagagaggagcgaactctagactcgcctgtggaagagacctggggccgctaaggaaacggcggggaggggagcgaggaggagagacgctgaggacctggcgccggcgccgccgccgccgccgccgaaataaagagcaggaatttacctgggcgaatcggcgtctgaatccaaggggaggccgaggccgctgtggcgagagactataatccgggccgggagggggggtggctacggctcctcttccgtctcctcagtgcggggaacatgtagagccggggggagaccagccgagaagacaaatcgttgcttcttcttcctcctcctcctccttctcccacatagaaacactcacaaacacccgaccacgggcccgagctaccgggggggcatcgccgcgggcccgggaaccaattctcctgtcggcgggggcgtccctcc

SEQ ID NO: 86914 - DNA, 266 bp, Homo sapiens
gatctcatcagcgtgcaaacctagcatcttctgtggccacaagccacacacttgctttttttgaatgtgatgtaaaatttgtacagtaaagtttttatattttctatcaactacatttgtcttccagacatgctattaatttaaattaaaatggttagtattaacaaacatgctgtatcgggtttttttgccactggcaagaacatgccctctgtgctaagccaggcctgggtgtctggagtttgtgaataaagttataccaaggt

SEQ ID NO: 86915 - DNA, 757 bp, Homo sapiens
gtctaacgcagctgtctgtgcagctcccgggaggggtgagaacagccagccacctggctgaacttgctgggaaccgacgtcaggagcaggagctaggctgcagtgggcctcacgggggcctggacggggagagcggctccgtgggctctggggccttccctctccacgcaattgcgatcccagtgatgggtgggacagagatccccgttgtccctgtcaccgctcccgcctccacttgccgggcctgaggacaattgaggggctctgcgagccctgggcgcccccccagcccaaccctcctccctggggccccgccggcccccaggcctcccctggcctggccttccttgctgagggggcgggccagcgggaggaagtcatccgctgtattgtcgtcttaatgcctgtgcgatgaggtgtgaaattctatgttcccaaaatttgttatcagcctcgctcctgtcctccggagcgggctgtgcggaggcagccgggagaacagtcggctccgaggacaagagtgatgggagcgccccggccccgcggaatccatcattccggagggaaccttcggcaggcttcattaggctcgaaacgatcatgaatatcctcccctcacctgttctcattaataatggctcccctcttatcttttttttgccacacgtatcattcttttaagaaacatacacaacccagggagaaagcccggcgcctgcccgggagcccagccgcagcctctgcgtcccgcccctcc

SEQ ID NO: 86916 - DNA, 112 bp, Homo sapiens
tcctggctttcacacattcgtgcagtcccctttcacaatacaccagggctgacccatgggaccaacagaatatggcagaagtaacagcacatcactttcatactagattttc

SEQ ID NO: 86917 - DNA, 513 bp, Homo sapiens
tacttgcaggtaaaatccatgttcttcagcaggccccaagcactttgtgatccactggaggaatctgtgatgcaactgccctcttccatgcccctgtgattgcacacagcttcttccctctgccaggacctccctgctacctaggaaaccggctggcagagcaacccttccattcctgtgttacagaaacaccttgcacacattgcagttgttgtatgtatcacactttactgtatcttccccatgtctgtctcccctaagaggcaacgtgattcttgaggtcaaggggcaaccgtcaatacactccctggcaccagagaagtcttccttaaatgttgatgagctggtggccccaccagtcaataggtcaaacaacttaaccatccctcctgccacctggcttaaaaccgacccctaaatccctacatccaccacacagctgccctgtccctgtaaaaaccttaccaccccctaccccctcatgcccaaggctaacttgcaacaatgttcatt

SEQ ID NO: 86918 - DNA, 492 bp, Homo sapiens
tgagatggagtctcactctgttgcccaggctggagtacagtggtgagatcttggctcactgcaacctccacctccctcctgaccaagcgattctcctgcctcagcctcctgaatagctaggattacagacgtgtgccaccatgtctggctaatttttttgtatttttagtagacacggggtttcaccatgttggctaggctggtctcaaactcctgacctcaggtgattcgcctgccttggcctcccaaaatgctgggattacaagcgtgagcaaccgcgcccggctataacaggttatttcaaaaacctatcaacaaaattaaagttaccagtacttactcttaaacagtatgctacacagtttattacaaagtagtattttagcttattgcctaattatattttctatgtgtagtataaatacatatgccatgtgagaggttttatcttttatacaaactgcaggaagacagaagcaactgtggggtaac

SEQ ID NO: 86919 - DNA, 729 bp, Homo sapiens
ctataataaaataattctgtcaaaattttagacatgagaaacatcagttcctcttttaacatatgacaagtactcctaatgtctagaatgtagaatgaccacttattcgtctgtcatgtagattccactattaattttgaaatccatacggcattttataggaaattgaataaaactcaaatgtttctgattaaattttgcttacctcttgaatcttttctttcctgaaaactcatcaaactgaaatgcctttgtaagaacttcttgattgtgtcttttggaaaatagaaagccacattctgtaaaaagatataaacaacattactttctcaaaaactctaattcaatatataaatagtataccttcacattcatgaatcctactgtgttcaaagtttactagttttctagttattcctttattcatatttatgtagaatatttcagaataagtaatatttaattttaaagaatatgtttcacaaggtattttctgatgttttaaacttgttttatcaacagaagatacatgctcagagtaaattgtgtgttttcaacctcagcgctactgaaatgtgtgttggattgtttttgttgcgagagggctgtcctctgcatcacaggatgtttagcagaatctctggcatctacccactaaatgccagtctcacccccaccctcaatcctgacaaacaaaaatatctccaaacattgtcaaatgtccccttc

SEQ ID NO: 86920 - DNA, 788 bp, Homo sapiens
gagccggcgggtccctgggcggtagctgttttactcttgtaaaagcgctgccttttgcctgtgctggctctgtttctgtgaacttccgggctgccgagcctttctttttatttactgcttgctcggctgcacggctttcggctcctaatgccttttttcttatctttttataaacatacacctgattgccttgccgattctgcattactgggcagagtaagagctctgcttctaatgctgcccgcttaagacagggactgatagctgtagcatatcctaggtcttttttcctatctattggaggaggaggctcaggtataaacccccgtttcctctgttatttcggcccggtgatattagggtggagggaagaggaggtgataaggcaggtgacattttctcctccttgctctttttaggctcttctgcgtgtaacagagctaaggctgctctaattaaagcctataacgttaaagctgttactgggacctgttgcctttgcacatgttaagatttctccccatttgttcccagagttctacgtctagcgttccttcttccgggaaccacgggcttgggatcacaagagtttgcattgcaacagtttgtctagcatggatgattaggtcccttaattgagcctgtgaaactgaggctccgctagccttaagtaactgttttaatactttcatataatgtttctgctgtgctaataactgtggtcccatgatgaaaactcagcttgacccaacttcccccagaacttggtaactttgagtgggcaccaa

SEQ ID NO: 86921 - DNA, 716 bp, Homo sapiens
ggatcacaaatgcatgccaccatgcctggctaattttaaaaatatatattttgtagagacaggctcttcctacattgctcagactggtctgaaactcctgggctcaagcagtcctcctgcctttgcctcccaaagtgctaggattccaggcatgagttaccatgcctggctcttactgattttttttaaagcactacataaatacagtcaacgcagtcaccatattgtagaaaaacagaagtatatacagttaaatgttttatgttggatgtacacatttgaagaggaacatagaaaaaaagtatggaaaaggaatgttgaccgagcttttatgcttaagcagcagatgaagatagaaccaagatcactgaaagcaagtgtttagaacagcaaaaagagtatcccaacatttcagcattggaactacagaaagttttcagacagaggggaagttaccaattttaaatgctaagtaaagcatgagattttgctgcttgatcttgcagatactgaccagattagttctaacaaaatatggaaggagtggcatacggtggaagaaagaaggcagtagctgctgttgtagttattcatgttagcctcagaggatggtgagacatccagatgaagaggttggtacgcaattctagaattgaggaggtgtctagatagagatataaattgtagtgacatcagtaaagagacaataacaggct

SEQ ID NO: 86922 - DNA, 354 bp, Homo sapiens
gagggttacccgactagcccgacagtcccgagctatacgacagtccccgactagcccgacagccccgactagcccgacagccccgaatagcccgacagccccgactagcccgacagcagaggggacccaggttctctcctggacatggaagaaggccatgaggcctatcattgaagatggtggtcttggaagatgaccccttccctgcagcccagcagtagtgaggggcctctccccacgtccaccagctgggccttccttggaggaccagagacatacgggaacttggatgtgtgccccccaggacctgaaccaggccttcgttactcacccacatacctgagcacagctgca

SEQ ID NO: 86923 - DNA, 542 bp, Homo sapiens
tgcctcctctcttccacatgtttaacttccagattacaagaatgccaaagttacaatgcagtcccttggggccactgtttaggaaaggtgcatttctttcactttcaaccacggtctacaagatgtggctacaaggcaatccttccccactggcaaaaggacgtcatcaacacagttgtccctttctgcgatggtaatgtctcgctttacagactcgacaggtgcagtgctctaatgcggcccgggaggctcctttgtagaatggatgagtctgccaactcctgtctgcagacactttgaagtcccaaggcagatgaggctgcaaatggaccaaacactgaacaatgctggccgtcccgtgtgtggctcagaaattaagagcacacaccagataagtgggcttattctcctgtgagagcacaggcagcatgaacacaataccgaagagtgttcctttcagcggctccttgagtagggcttttctttcccctgaggcattcctcctggtggcacaatgctcacctgtcatttccacctgtctg

SEQ ID NO: 86924 - DNA, 436 bp, Homo sapiens
ttaggtgggtagttctgatttagaatctctagtagccagaaatctgagatggcctccatgactcctgactcctagtattcaaacctttacgtaaacctcttttaatcaatagaatatggcaaaagtgaaaggattttccagatatgattaaatctctaatctattgtctttaagttaatcaaatggagattatcctgcataggtctaacctatttggatgaatgaccttgaagaagcaagcaaccatgaattctacagttgcaaggaaataaattctgtcagaagcatcttggaagaatacctgagctccttaaatcagtgaagcttagccttaatttagccctgtgtaaccctcaacagagaaccctcttaagctgtgtctgaaatcttgattcatgaaaaacataagataataaatatatgctgttttatgcca

SEQ ID NO: 86925 - DNA, 184 bp, Homo sapiens
ccagaataggagatacaatgatacaggattagtgccttttggacagtagactgttctgtaattaaaatgtagtatactgcttttttgtacagttttgttttaataaaacttttttttaatttgtgtttattttagtattgtacctattagagaataaaatgtataactgaaaaaaaaaaaactg

SEQ ID NO: 86926 - DNA, 1322 bp, Homo sapiens
cagagagggaccatgaattctaataatctatttgtaagagcagcaatctggaatttaatagctcactagtatggccttcagtgattagtgctatatttgttacaaacagaaagatccaaattgttggttttatatcaatcactgcaggtttgatcatcatcaccagcaatcttattaatagaatgaatagaattctcagtgatgaaaaacattttttgtgctttttacttgttgaatcataagattatcaactgaaaatctttggacctatatccattcagtgtctacttaaatacaatttacctctattttatcatgagcccctcccccagtttcctcccacgaatgttctgcctccccttgccccagcatgtctctctgtgactaaagaattcttccaatccactaataacatttcttatttctgcacatctaggatgacagtacgagccatagtgaccaccaagaccccatctcattagctgtggaaatggcagcagtcaaccacactatcttggcattggcccgacaaggagccaacgaaatcaagacagaggccctggatgatgactgatcagggaggttaaacatgacaagttaacttagtttagacgtagcaccttagcagactttcctcggtccttaacatgtgttcttacagtataacttgcagtttcttgtatgtcaggtagctgttagggtcttgttctgtgaagatggcatggtgccctcagcctttgcatatactctctcagtattaactcccagtaaataataaccaaccaaccaaccaaccaaacttccctctcccagcccccgaggctagaaaatcttgctgctccgtcttagcattccaagaaagtgcttccaggtatttagatagccctcagttctcaaatattagactacgtgtaaaatcttgggtacctttagattcttgtaacactagtctgtactcccttttccttccccaagactgataggatgcaagctgaggtcgtggcacaggaatgacagacaccatttggggagtatccacagagtcaaaggaacactagaatccccacctcagcgtgaggataattgatttccagctgcaataagccgtgcctcattatagccacactgtggctagattatacttctttgggtgctgtgctaagaatgtcaatggaaaaagccgatctcagattttgtttgaagttaacatgcctgacacagacatcctttcctctcacaagctgtgtgacttagtagataaaatactgccttctgcctttgggaccatgattaaaaacaaagacaaaaaccaaaagtcatta

SEQ ID NO: 86927 - DNA, 2327 bp, Homo sapiens
gccagacaaagacagtcagtctgatgtgattgagacaagggaggtttttcagggggagactgggagataggggcctcccctcccccttctcctcttcctgcgccggcctcaacccctccccagtcccctcccgacgggcgccccacgcggaagacacccctccccctcccgccttccctcctccctatctcagcccttcgtactgggacgttggggagggggctgtgccgggcggagagaactcagcgaggattctgagaatggtagataacgcagatcatctctggaaaggatattgatccgcctcatgtaaagtatgcttagttcctttccagtggttttgctggaaaccatgtctcattatacagatgaacccagatttaccatagagcagatagatctgcttcagcgacttcggcgtactggaatgactaaacatgaaattctccatgccttggaaactttggaccgtcttgatcaagagcatagtgacaagtttggaagaaggtccagctatggaggaagttcatatgggaatagtactaacaatgtcccagcatcttcctctacagctacagcttccacacagacgcagcattcgggaatgtccccgtcacctagcaacagttatgatacttccccacagccttgcactaccaatcaaaatgggagggagaataatgagcgattatctacatccaatggaaagatgtcaccaactcgctaccatgcaaacagcatgggtcagaggtcatacagttttgaagcctcagaagaggacctagatgtagatgataaagtggaagaattaatgaggagggacagcagtgtgataaaagaggaaatcaaagcctttcttgccaatcggaggatttcccaagcagttgttgcacaggtaacaggtatcagtcagagccggatctctcattggctgttgcagcagggatcagacctgagtgaacagaagaaaagagcattttaccgatggtatcaacttgagaagacaaaccctggcgctacactaagtatgagaccagcccccattccaatagaggaccctgaatggagacaaacgcctcccccagtctctgccacatctggtactttccgactgcgacgagggagtcgatttacctggagaaaggagtgcctggctgttatggaaagttacttcaatgagaatcaatacccagatgaagcaaagagggaagaaattgcaaacgcttgcaatgcagttatacagaagccaggcaaaaagctgtcagatctggaaagagttacctccctgaaagtatataattggtttgctaacagaaggaaggagatcaagaggagagccaatattgaagcagcaatcctggagagtcatgggatagatgtgcagagtccaggaggccactcaaacagtgatgatgtcgacgggaatgactactctgagcaggatgacagtacgagccatagtgaccaccaagaccccatctcattagctgtggaaatggcagcagtcaaccacactatcttggcattggcccgacaaggagccaacgaaatcaagacagaggccctggatgatgactgatcagggaggttaaacatgacaagttaacttagtttagacgtagcaccttagcagactttcctcggtccttaacatgtgttcttacagtataacttgcagtttcttgtatgtcaggtagctgttagggtcttgttctgtgaagatggcatggtgccctcagcctttgcatatactctctcagtattaactcccagtaaataataaccaaccaaccaaccaaccaaacttccctctcccagcccccgaggctagaaaatcttgctgctccgtcttagcattccaagaaagtgcttccaggtatttagatagccctcagttctcaaatattagactacgtgtaaaatcttgggtacctttagattcttgtaacactagtctgtactcccttttccttccccaagactgataggatgcaagctgaggtcgtggcacaggaatgacagacaccatttggggagtatccacagagtcaaaggaacactagaatccccacctcagcgtgaggataattgatttccagctgcaataagccgtgcctcattatagccacactgtggctagattatacttctttgggtgctgtgctaagaatgtcaatggaaaaagccgatctcagattttgtttgaagttaacatgcctgacacagacatcctttcctctcacaagctgtgtgacttagtagataaaatactgccttctgcctttgggaccatgattaaaaacaaagacaaaaaccaaaagtcatta

SEQ ID NO: 86928 - DNA, 2096 bp, Homo sapiens
gtggaatggaacagtgaagaagcattggaatggtagataacgcagatcatctctggaaaggatattgatccgcctcatgtaaagtatgcttagttcctttccagtggttttgctggaaaccatgtctcattatacagatgaacccagatttaccatagagcagatagatctgcttcagcgacttcggcgtactggaatgactaaacatgaaattctccatgccttggaaactttggaccgtcttgatcaagagcatagtgacaagtttggaagaaggtccagctatggaggaagttcatatgggaatagtactaacaatgtcccagcatcttcctctacagctacagcttccacacagacgcagcattcgggaatgtccccgtcacctagcaacagttatgatacttccccacagccttgcactaccaatcaaaatgggagggagaataatgagcgattatctacatccaatggaaagatgtcaccaactcgctaccatgcaaacagcatgggtcagaggtcatacagttttgaagcctcagaagaggacctagatgtagatgataaagtggaagaattaatgaggagggacagcagtgtgataaaagaggaaatcaaagcctttcttgccaatcggaggatttcccaagcagttgttgcacaggtaacaggtatcagtcagagccggatctctcattggctgttgcagcagggatcagacctgagtgaacagaagaaaagagcattttaccgatggtatcaacttgagaagacaaaccctggcgctacactaagtatgagaccagcccccattccaatagaggaccctgaatggagacaaacgcctcccccagtctctgccacatctggtactttccgactgcgacgagggagtcgatttacctggagaaaggagtgcctggctgttatggaaagttacttcaatgagaatcaatacccagatgaagcaaagagggaagaaattgcaaacgcttgcaatgcagttatacagaagccaggcaaaaagctgtcagatctggaaagagttacctccctgaaagtatataattggtttgctaacagaaggaaggagatcaagaggagagccaatattgaagcagcaatcctggagagtcatgggatagatgtgcagagtccaggaggccactcaaacagtgatgatgtcgacgggaatgactactctgagcaggatgacagtacgagccatagtgaccaccaagaccccatctcattagctgtggaaatggcagcagtcaaccacactatcttggcattggcccgacaaggagccaacgaaatcaagacagaggccctggatgatgactgatcagggaggttaaacatgacaagttaacttagtttagacgtagcaccttagcagactttcctcggtccttaacatgtgttcttacagtataacttgcagtttcttgtatgtcaggtagctgttagggtcttgttctgtgaagatggcatggtgccctcagcctttgcatatactctctcagtattaactcccagtaaataataaccaaccaaccaaccaaccaaacttccctctcccagcccccgaggctagaaaatcttgctgctccgtcttagcattccaagaaagtgcttccaggtatttagatagccctcagttctcaaatattagactacgtgtaaaatcttgggtacctttagattcttgtaacactagtctgtactcccttttccttccccaagactgataggatgcaagctgaggtcgtggcacaggaatgacagacaccatttggggagtatccacagagtcaaaggaacactagaatccccacctcagcgtgaggataattgatttccagctgcaataagccgtgcctcattatagccacactgtggctagattatacttctttgggtgctgtgctaagaatgtcaatggaaaaagccgatctcagattttgtttgaagttaacatgcctgacacagacatcctttcctctcacaagctgtgtgacttagtagataaaatactgccttctgcctttgggaccatgattaaaaacaaagacaaaaaccaaaagtcatta

SEQ ID NO: 86929 - DNA, 2519 bp, Homo sapiens
gccagacaaagacagtcagtctgatgtgattgagacaagggaggtttttcagggggagactgggagataggggcctcccctcccccttctcctcttcctgcgccggcctcaacccctccccagtcccctcccgacgggcgccccacgcggaagacacccctccccctcccgccttccctcctccctatctcagcccttcgtactgggacgttggggagggggctgtgccgggcggagagaactcagcgaggattctgagaatggtagataacgcagatcatctctggaaaggatattgatccgcctcatgtaaagtatgcttagttcctttccagtggttttgctggaaaccatgtctcattatacagatgaacccagatttaccatagagcagatagatctgcttcagcgacttcggcgtactggaatgactaaacatgaaattctccatgccttggaaactttggaccgtcttgatcaagagcatagtgacaagtttggaagaaggtccagctatggaggaagttcatatgggaatagtactaacaatgtcccagcatcttcctctacagctacagcttccacacagacgcagcattcgggaatgtccccgtcacctagcaacagttatgatacttccccacagccttgcactaccaatcaaaatgggagggagaataatgagcgattatctacatccaatggaaagatgtcaccaactcgctaccatgcaaacagcatgggtcagaggtcatacagttttgaagcctcagaagaggacctagatgtagatgataaagtggaagaattaatgaggagggacagcagtgtgataaaagaggaaatcaaagcctttcttgccaatcggaggatttcccaagcagttgttgcacaggtaacaggtatcagtcagagccggatctctcattggctgttgcagcagggatcagacctgagtgaacagaagaaaagagcattttaccgatggtatcaacttgagaagacaaaccctggcgctacactaagtatgagaccagcccccattccaatagaggaccctgaatggagacaaacgcctcccccagtctctgccacatctggtactttccgactgcgacgagggagtcgatttacctggagaaaggagtgcctggctgttatggaaagttacttcaatgagaatcaatacccagatgaagcaaagagggaagaaattgcaaacgcttgcaatgcagttatacagaagccaggcaaaaagctgtcagatctggaaagagttacctccctgaaagtatataattggtttgctaacagaaggaaggagatcaagaggagagccaatattgaagcagcaatcctggagagtcatgggatagatgtgcagagtccaggaggccactcaaacagtgatgatgtcgacgggaatgactactctgagcaggatacttggcaagtacgcaatggggaggaggaggagggaagaagttcagagggaggcagagaagcagagaaggatgacagtacgagccatagtgaccaccaagaccccatctcattagctgtggaaatggcagcagtcaaccacactatcttggcattggcccgacaaggagccaacgaaatcaagacagaggccctggatgatgactgatcagggagctgcagtatctctcttcctgaggtccagaggccattaaagaataaacatggggcttagaggtgtcttgggccaccaaacacaggaagggacacaggatctctctgaactttggaacagaccctcatattctggggccagaagtttgcccagaaagcagcaggtggctctgcctggctgtagagcccagctcattggctgtccctgggcttcgtctccctcttccgagtagttgctgcctttcttcagatcaggttaccacaatgcctccccgctgctgacgcttcatcccccacacctccagccccagttacctggagcttctcagaacccactttgccggtgctaaaacacaagagggggtgaaagtggctgccagtaatggccagaaaccaaccaccagaggccaggctgaaagacaagctccgggtgtccaggggctgacgggccaaccatgtggcaggtcccaggccccacccactgcgccatccgcctctgagctccacagtggtcccactaatgggaacctcctctagggagagtgatactgcaccttcacccgtaggactcatatttataacaatgtgtaatggctgtagcaaaaagcccttgtttctagatgtaaatggtcaaagaaacaagcgctctattgttttgaataaaatagttcaaatgagtcctgtatcattgtatctcctattctggattagtgccttttggacagtagactgttctgtaattaaaatgtagtatactgcttttttgtacagttttgttttaataaaacttttttttaatttgtgtttattttagtattgtacctattagagaataaaatgtataactgaaaaaaaaaaaactg

SEQ ID NO: 86930 - DNA, 2432 bp, Homo sapiens
gccagacaaagacagtcagtctgatgtgattgagacaagggaggtttttcagggggagactgggagataggggcctcccctcccccttctcctcttcctgcgccggcctcaacccctccccagtcccctcccgacgggcgccccacgcggaagacacccctccccctcccgccttccctcctccctatctcagcccttcgtactgggacgttggggagggggctgtgccgggcggagagaactcagcgaggattctgagaatggtagataacgcagatcatctctggaaaggatattgatccgcctcatgtaaagtatgcttagttcctttccagtggttttgctggaaaccatgtctcattatacagatgaacccagatttaccatagagcagatagatctgcttcagcgacttcggcgtactggaatgactaaacatgaaattctccatgccttggaaactttggaccgtcttgatcaagagcatagtgacaagtttggaagaaggtccagctatggaggaagttcatatgggaatagtactaacaatgtcccagcatcttcctctacagctacagcttccacacagacgcagcattcgggaatgtccccgtcacctagcaacagttatgatacttccccacagccttgcactaccaatcaaaatgggagggagaataatgagcgattatctacatccaatggaaagatgtcaccaactcgctaccatgcaaacagcatgggtcagaggtcatacagttttgaagcctcagaagaggacctagatgtagatgataaagtggaagaattaatgaggagggacagcagtgtgataaaagaggaaatcaaagcctttcttgccaatcggaggatttcccaagcagttgttgcacaggtaacaggtatcagtcagagccggatctctcattggctgttgcagcagggatcagacctgagtgaacagaagaaaagagcattttaccgatggtatcaacttgagaagacaaaccctggcgctacactaagtatgagaccagcccccattccaatagaggaccctgaatggagacaaacgcctcccccagtctctgccacatctggtactttccgactgcgacgagggagtcgatttacctggagaaaggagtgcctggctgttatggaaagttacttcaatgagaatcaatacccagatgaagcaaagagggaagaaattgcaaacgcttgcaatgcagttatacagaagccaggcaaaaagctgtcagatctggaaagagttacctccctgaaagtatataattggtttgctaacagaaggaaggagatcaagaggagagccaatattgaagcagcaatcctggagagtcatgggatagatgtgcagagtccaggaggccactcaaacagtgatgatgtcgacgggaatgactactctgagcaggatacttggcaagtacgcaatggggaggaggaggagggaagaagttcagagggaggcagagaagcagagaaggtagaagaagagaggaggatctgatccaaacaagatgacagtacgagccatagtgaccaccaagaccccatctcattagctgtggaaatggcagcagtcaaccacactatcttggcattggcccgacaaggagccaacgaaatcaagacagaggccctggatgatgactgatcagggaggttaaacatgacaagttaacttagtttagacgtagcaccttagcagactttcctcggtccttaacatgtgttcttacagtataacttgcagtttcttgtatgtcaggtagctgttagggtcttgttctgtgaagatggcatggtgccctcagcctttgcatatactctctcagtattaactcccagtaaataataaccaaccaaccaaccaaccaaacttccctctcccagcccccgaggctagaaaatcttgctgctccgtcttagcattccaagaaagtgcttccaggtatttagatagccctcagttctcaaatattagactacgtgtaaaatcttgggtacctttagattcttgtaacactagtctgtactcccttttccttccccaagactgataggatgcaagctgaggtcgtggcacaggaatgacagacaccatttggggagtatccacagagtcaaaggaacactagaatccccacctcagcgtgaggataattgatttccagctgcaataagccgtgcctcattatagccacactgtggctagattatacttctttgggtgctgtgctaagaatgtcaatggaaaaagccgatctcagattttgtttgaagttaacatgcctgacacagacatcctttcctctcacaagctgtgtgacttagtagataaaatactgccttctgcctttgggaccatgattaaaaacaaagacaaaaaccaaaagtcatta

SEQ ID NO: 86931 - DNA, 1654 bp, Homo sapiens
cagagagggaccatgaattctaataatctatttgtaagagcagcaatctggaatttaatagctcactagtatggccttcagtgattagtgctatatttgttacaaacagaaagatccaaattgttggttttatatcaatcactgcaggtttgatcatcatcaccagcaatcttattaatagaatgaatagaattctcagtgatgaaaaacattttttgtgctttttacttgttgaatcataagattatcaactgaaaatctttggacctatatccattcagtgtctacttaaatacaatttacctctattttatcatgagcccctcccccagtttcctcccacgaatgttctgcctccccttgccccagcatgtctctctgtgactaaagaattcttccaatccactaataacatttcttatttctgcacatctaggatgacagtacgagccatagtgaccaccaagaccccatctcattagctgtggaaatggcagcagtcaaccacactatcttggcattggcccgacaaggagccaacgaaatcaagacagaggccctggatgatgactgatcagggagctgcagtatctctcttcctgaggtccagaggccattaaagaataaacatggggcttagaggtgtcttgggccaccaaacacaggtaagccaacagagttcggctcccgtacgtggtgtggtgggacctggggcctggagccacttgtactcctggggtgggactgagggagggaaagggctcccccacttcaggctggtcactgtatgttgacttccctctgggaagcaaaattccacttgtaaaaatcagcttccaagacaaaagatgatccgatgtcacttctgggtcaccaggaagggacacaggatctctctgaactttggaacagaccctcatattctggggccagaagtttgcccagaaagcagcaggtggctctgcctggctgtagagcccagctcattggctgtccctgggcttcgtctccctcttccgagtagttgctgcctttcttcagatcaggttaccacaatgcctccccgctgctgacgcttcatcccccacacctccagccccagttacctggagcttctcagaacccactttgccggtgctaaaacacaagagggggtgaaagtggctgccagtaatggccagaaaccaaccaccagaggccaggctgaaagacaagctccgggtgtccaggggctgacgggccaaccatgtggcaggtcccaggccccacccactgcgccatccgcctctgagctccacagtggtcccactaatgggaacctcctctagggagagtgatactgcaccttcacccgtaggactcatatttataacaatgtgtaatggctgtagcaaaaagcccttgtttctagatgtaaatggtcaaagaaacaagcgctctattgttttgaataaaatagttcaaatgagtcctgtatcattgtatctcctattctggattagtgccttttggacagtagactgttctgtaattaaaatgtagtatactgcttttttgtacagttttgttttaataaaacttttttttaatttgtgtttattttagtattgtacctattagagaataaaatgtataactgaaaaaaaaaaaactg

SEQ ID NO: 86932 - DNA, 2399 bp, Homo sapiens
gccagacaaagacagtcagtctgatgtgattgagacaagggaggtttttcagggggagactgggagataggggcctcccctcccccttctcctcttcctgcgccggcctcaacccctccccagtcccctcccgacgggcgccccacgcggaagacacccctccccctcccgccttccctcctccctatctcagcccttcgtactgggacgttggggagggggctgtgccgggcggagagaactcagcgaggattctgagaatggtagataacgcagatcatctctggaaaggatattgatccgcctcatgtaaagtatgcttagttcctttccagtggttttgctggaaaccatgtctcattatacagatgaacccagatttaccatagagcagatagatctgcttcagcgacttcggcgtactggaatgactaaacatgaaattctccatgccttggaaactttggaccgtcttgatcaagagcatagtgacaagtttggaagaaggtccagctatggaggaagttcatatgggaatagtactaacaatgtcccagcatcttcctctacagctacagcttccacacagacgcagcattcgggaatgtccccgtcacctagcaacagttatgatacttccccacagccttgcactaccaatcaaaatgggagggagaataatgagcgattatctacatccaatggaaagatgtcaccaactcgctaccatgcaaacagcatgggtcagaggtcatacagttttgaagcctcagaagaggacctagatgtagatgataaagtggaagaattaatgaggagggacagcagtgtgataaaagaggaaatcaaagcctttcttgccaatcggaggatttcccaagcagttgttgcacaggtaacaggtatcagtcagagccggatctctcattggctgttgcagcagggatcagacctgagtgaacagaagaaaagagcattttaccgatggtatcaacttgagaagacaaaccctggcgctacactaagtatgagaccagcccccattccaatagaggaccctgaatggagacaaacgcctcccccagtctctgccacatctggtactttccgactgcgacgagggagtcgatttacctggagaaaggagtgcctggctgttatggaaagttacttcaatgagaatcaatacccagatgaagcaaagagggaagaaattgcaaacgcttgcaatgcagttatacagaagccaggcaaaaagctgtcagatctggaaagagttacctccctgaaagtatataattggtttgctaacagaaggaaggagatcaagaggagagccaatattgaagcagcaatcctggagagtcatgggatagatgtgcagagtccaggaggccactcaaacagtgatgatgtcgacgggaatgactactctgagcaggatacttggcaagtacgcaatggggaggaggaggagggaagaagttcagagggaggcagagaagcagagaaggatgacagtacgagccatagtgaccaccaagaccccatctcattagctgtggaaatggcagcagtcaaccacactatcttggcattggcccgacaaggagccaacgaaatcaagacagaggccctggatgatgactgatcagggaggttaaacatgacaagttaacttagtttagacgtagcaccttagcagactttcctcggtccttaacatgtgttcttacagtataacttgcagtttcttgtatgtcaggtagctgttagggtcttgttctgtgaagatggcatggtgccctcagcctttgcatatactctctcagtattaactcccagtaaataataaccaaccaaccaaccaaccaaacttccctctcccagcccccgaggctagaaaatcttgctgctccgtcttagcattccaagaaagtgcttccaggtatttagatagccctcagttctcaaatattagactacgtgtaaaatcttgggtacctttagattcttgtaacactagtctgtactcccttttccttccccaagactgataggatgcaagctgaggtcgtggcacaggaatgacagacaccatttggggagtatccacagagtcaaaggaacactagaatccccacctcagcgtgaggataattgatttccagctgcaataagccgtgcctcattatagccacactgtggctagattatacttctttgggtgctgtgctaagaatgtcaatggaaaaagccgatctcagattttgtttgaagttaacatgcctgacacagacatcctttcctctcacaagctgtgtgacttagtagataaaatactgccttctgcctttgggaccatgattaaaaacaaagacaaaaaccaaaagtcatta

SEQ ID NO: 86933 - DNA, 1128 bp, Homo sapiens
attcggcacgtgggaagcagagaaggtagaagaagagaggaggatctgatccaaacaaggacttaccctttccaaagctctttgatacggagttcccctgaagatgacaggtgagaaacataccccttatttgtaacaccatcttcagtgcctgacgtacatcctgcaatgccagcttccttcacagctttattgtttaacacattgagtgcgcggggaggacagcttcacactagttctaggatgacagtacgagccatagtgaccaccaagaccccatctcattagctgtggaaatggcagcagtcaaccacactatcttggcattggcccgacaaggagccaacgaaatcaagacagaggccctggatgatgactgatcagggaggttaaacatgacaagttaacttagtttagacgtagcaccttagcagactttcctcggtccttaacatgtgttcttacagtataacttgcagtttcttgtatgtcaggtagctgttagggtcttgttctgtgaagatggcatggtgccctcagcctttgcatatactctctcagtattaactcccagtaaataataaccaaccaaccaaccaaccaaacttccctctcccagcccccgaggctagaaaatcttgctgctccgtcttagcattccaagaaagtgcttccaggtatttagatagccctcagttctcaaatattagactacgtgtaaaatcttgggtacctttagattcttgtaacactagtctgtactcccttttccttccccaagactgataggatgcaagctgaggtcgtggcacaggaatgacagacaccatttggggagtatccacagagtcaaaggaacactagaatccccacctcagcgtgaggataattgatttccagctgcaataagccgtgcctcattatagccacactgtggctagattatacttctttgggtgctgtgctaagaatgtcaatggaaaaagccgatctcagattttgtttgaagttaacatgcctgacacagacatcctttcctctcacaagctgtgtgacttagtagataaaatactgccttctgcctttgggaccatgattaaaaacaaagacaaaaaccaaaagtcatta

SEQ ID NO: 86934 - DNA, 2930 bp, Homo sapiens
gccagacaaagacagtcagtctgatgtgattgagacaagggaggtttttcagggggagactgggagataggggcctcccctcccccttctcctcttcctgcgccggcctcaacccctccccagtcccctcccgacgggcgccccacgcggaagacacccctccccctcccgccttccctcctccctatctcagcccttcgtactgggacgttggggagggggctgtgccgggcggagagaactcagcgaggattctgagaatggtagataacgcagatcatctctggaaaggatattgatccgcctcatgtaaagtatgcttagttcctttccagtggttttgctggaaaccatgtctcattatacagatgaacccagatttaccatagagcagatagatctgcttcagcgacttcggcgtactggaatgactaaacatgaaattctccatgccttggaaactttggaccgtcttgatcaagagcatagtgacaagtttggaagaaggtccagctatggaggaagttcatatgggaatagtactaacaatgtcccagcatcttcctctacagctacagcttccacacagacgcagcattcgggaatgtccccgtcacctagcaacagttatgatacttccccacagccttgcactaccaatcaaaatgggagggagaataatgagcgattatctacatccaatggaaagatgtcaccaactcgctaccatgcaaacagcatgggtcagaggtcatacagttttgaagcctcagaagaggacctagatgtagatgataaagtggaagaattaatgaggagggacagcagtgtgataaaagaggaaatcaaagcctttcttgccaatcggaggatttcccaagcagttgttgcacaggtaacaggtatcagtcagagccggatctctcattggctgttgcagcagggatcagacctgagtgaacagaagaaaagagcattttaccgatggtatcaacttgagaagacaaaccctggcgctacactaagtatgagaccagcccccattccaatagaggaccctgaatggagacaaacgcctcccccagtctctgccacatctggtactttccgactgcgacgagggagtcgatttacctggagaaaggagtgcctggctgttatggaaagttacttcaatgagaatcaatacccagatgaagcaaagagggaagaaattgcaaacgcttgcaatgcagttatacagaagccaggcaaaaagctgtcagatctggaaagagttacctccctgaaagtatataattggtttgctaacagaaggaaggagatcaagaggagagccaatattgaagcagcaatcctggagagtcatgggatagatgtgcagagtccaggaggccactcaaacagtgatgatgtcgacgggaatgactactctgagcaggatgacagtacgagccatagtgaccaccaagaccccatctcattagctgtggaaatggcagcagtcaaccacactatcttggcattggcccgacaaggagccaacgaaatcaagacagaggccctggatgatgactgatcagggaggttaaacatgacaagttaacttagtttagacgtagcaccttagcagactttcctcggtccttaacatgtgttcttacagtataacttgcagtttcttgtatgtcaggtagctgttagggtcttgttctgtgaagatggcatggtgccctcagcctttgcatatactctctcagtattaactcccagtaaataataaccaaccaaccaaccaaccaaacttccctctcccagcccccgaggctagaaaatcttgctgctccgtcttagcattccaagaaagtgcttccaggtatttagatagccctcagttctcaaatattagactacgtgtaaaatcttgggtacctttagattcttgtaacactagtctgtactcccttttccttccccaagactgataggatgcaagctgaggtcgtggcacaggaatgacagacaccatttggggagtatccacagagtcaaaggaacactagaatccccacctcagcgtgaggataattgatttccagctgcaataagccgtgcctcattatagccacactgtggctagattatacttctttgggtgctgtgctaagaatgtcaatggaaaaagccgatctcagattttgtttgaagttaacatgcctgacacagacatcctttcctctcacaagctgtgtgacttagtagataaaatactgccttctgcctttgggaccatgattaaaaacaaagacaaaaaccaaaagtcattaaaaaaaaataattgatttccagctgcaataagccgtgcctcattatagccacactgtggctagattatacttctttgggtgctgtgctaagaatgtcaatggaaaaagccgatctcagattttgtttgaagttaacatgcctgacacagacatcctttcctctcacaagctgtgtgacttagtagataaaatactgccttctgcctttgggaccatgattaaaaacaaagacaaaaaccaaaagtcattaaaaaaaaaaaacccagcttgagagcattggaaaaaaaaaatatgagctgaatgtctaatggatgctaagtccagttttcagaaccactgtacattccatggcacagttagcagtgcctgcctggaaaagttttggaggtcatcgtggaagttgctttgcctcctgtcagtgtcccctttccctgctaccaaaaaagtctttcaaggatggagctaaggtcaaaaatgagtgaaaaaacttgcagtgtttgtatccattaaacggaagccccctcactctgagaggtcactagaggacttcatagtggggttgtgctgcttatcacagatgcagacacttgcccagataggagc

SEQ ID NO: 86935 - DNA, 629 bp, Homo sapiens
tccacttaagtatttttgctggttattagcatttgcttggacttagcttagcaaatcatttgttctcactaaatgaggttgtagagaattcctaggtctgtttagctaatatttggtaaataatataatacaaactatttttttcagtaattttccattaatactctaatgtagagtaatacacttgagatgggcaaaacacttctgagttatcacgtagcctgggcttattgcactccatgtacctaatctattgttctggtattatttacataactaaaattttggttctgatatttaccaaaattgaggaaaatgtaaattgtatgccatatgaaattaggttttatgttacacctatgttcacctactaatacatttagtatctgtaccaatccatttgccatggcacaatcattctagcatgggacataccttcattttcaatacagaagcttatgtagaaatattgcatcttctgagcattctgtataatatgtgctttggtagatactgtcaataaagagacttctttttatctctttttttttagtttgctggaaaccatgtctcattatacagatgaacccagatttaccatagagcagatagatctgcttcagcgactt

SEQ ID NO: 86936 - DNA, 3372 bp, Homo sapiens
tagagcacggtcacaggaaggcctctgctgggccgagtctgcggtccctgagccatcacagcactggcgtcttcagacacaccctggctgcaaggcaggacactccccctgccgagagacaccatgtgcgtcatcattgcctcccctggaagagcccacagccttctatgatctcccccccgggctcgccctgccttccacggccatggtcacgttgggtatgcagtacttttcaaggataaatttttgtttatgttttttaagtgcctaagcaagatacagacctctggaacctgccagagagtcggcctatgccctgtccccatccctccccaccctgcactggcccttgagggtgggcacagggcggctgcccctctccagtgtccctggcgttctgcaggcagaacaaggcaaggacaagctagcgggagagatcgcttcacagccatatcaggctggcttcgtcactgttttccagcgtttctttctttagggccgtttctgtttatgtggtttggtcttggttcatagagaatttaagagtctgcttagggaaatctcagtagccactaagaagacaggagagcaagacagcctcagagcagcattccagctctggctttggtaggagttggaaatgtgtccacatccaagagggcgaagcgtcgaatcatcctagctcatgagcctgctgactcacctgccagcgtgagccaccggagccccagctgcctttccgagccctctctgcctagactagagggatcagggtgtctgctcgggagggcttgggaaagccagcaatcaggcgttcagatcccaagtgtgtctttggaaatgagtgtgagagtatttgtttcttttttaaaaaataatttaagtctgacctaaatatggggcctttattctgtgatgggtgtacgacagattattttgtgactgcagtctgttcaaatcacatcactaagcagcgctgagatgatttgttggtgcattaaaaggttttgcatcatggaacaatccatacccaggcactttattttcattaataatccagcatttttgttcagacaatgtaataacccaaacactgggtattcatatttgacacatgggcaaacttgccagtggaatggaattgtgacctgacagagaagggaaggcaggctgacgaaggtgatcgaatgggagaacagtgctgtggtgatcatgagaatgaggcttttctgtagcatgtaaaccaaaccggacccttggcagttcgtcgtccctcagttctccagatgctattttttgcaggttctaccaagtgcttgttgattaccctagttgtaattatctagggaagagatgaatgtaagtgagagtgcagagcactggggagggtgacagtgaaatgcgattagaggcagcaagagagtcctagtctgttctcacataaccggacttgaacgctccagtgcgagcagagtgctgggggtggattccactgccgaaccacggcagctttgctttactcttcagcatgggggtggtaactagctgcacagcaagttatgaaatggaaagcaagcttaacagctgtaatctcatcggataccctggagcaaatgccttgggattgcctgaagtgaagtgtttagcatccaccaaatagttgagtttctaagatgggccatgcgggatccctgccacacgggtgtgggggcagcgcgctcctccctgcctcggctgctgtgtgtcttagtcttcatgtttccccttggcgtctcctctggtccctgtccatcttgtgcaccatgtgtccctgagggcgagtcacacctgtgtcttgagtctgctgtaaggtgttcagtctacctcaaggggtcatcatggtaagctctatcccacggcatcctccgtccatcaccacacacactggaatgtatcccccccgccctgccccttcgataacctcctgaccttgtctttcctataatcaccacaaactcctagtgcaaattggatgctgctttaaatgtgaaaacaattgttcaaaagctataaaacctgaatgaaagctgaagctgaatttataagccttgttgcatatgagccaaaagtgcaaaaagctctatataatgaactaacctgccactcgtataaatataaatatatataaatatattaaaatcagactgttctacaaaattgtgtatttgtatttttgtgtacgtacaattttctgctaagcagaaggaggatgtagtataggatgctgtgagaagagatttggtttaatcctatttctttgttacttatttttgttaacatcagatgcctgtctttgtcttatatgtgtatgacactgtttgggaaagctgcagtatctctcttcctgaggtccagaggccattaaagaataaacatggggcttagaggtgtcttgggccaccaaacacaggtaagccaacagagttcggctcccgtacgtggtgtggtgggacctggggcctggagccacttgtactcctggggtgggactgagggagggaaagggctcccccacttcaggctggtcactgtatgttgacttccctctgggaagcaaaattccacttgtaaaaatcagcttccaagacaaaagatgatccgatgtcacttctgggtcaccaggaagggacacaggatctctctgaactttggaacagaccctcatattctggggccagaagtttgcccagaaagcagcaggtggctctgcctggctgtagagcccagctcattggctgtccctgggcttcgtctccctcttccgagtagttgctgcctttcttcagatcaggttaccacaatgcctccccgctgctgacgcttcatcccccacacctccagccccagttacctggagcttctcagaacccactttgccggtgctaaaacacaagagggggtgaaagtggctgccagtaatggccagaaaccaaccaccagaggccaggctgaaagacaagctccgggtgtccaggggctgacgggccaaccatgtggcaggtcccaggccccacccactgcgccatccgcctctgagctccacagtggtcccactaatgggaacctcctctagggagagtgatactgcaccttcacccgtaggactcatatttataacaatgtgtaatggctgtagcaaaaagcccttgtttctagatgtaaatggtcaaagaaacaagcgctctattgttttgaataaaatagttcaaatgagtcctgtatcattgtatctcctattctggattagtgccttttggacagtagactgttctgtaattaaaatgtagtatactgcttttttgtacagttttgttttaataaaactttttttta

SEQ ID NO: 86937 - DNA, 3438 bp, Homo sapiens
tagagcacggtcacaggaaggcctctgctgggccgagtctgcggtccctgagccatcacagcactggcgtcttcagacacaccctggctgcaaggcaggacactccccctgccgagagacaccatgtgcgtcatcattgcctcccctggaagagcccacagccttctatgatctcccccccgggctcgccctgccttccacggccatggtcacgttgggtatgcagtacttttcaaggataaatttttgtttatgttttttaagtgcctaagcaagatacagacctctggaacctgccagagagtcggcctatgccctgtccccatccctccccaccctgcactggcccttgagggtgggcacagggcggctgcccctctccagtgtccctggcgttctgcaggcagaacaaggcaaggacaagctagcgggagagatcgcttcacagccatatcaggctggcttcgtcactgttttccagcgtttctttctttagggccgtttctgtttatgtggtttggtcttggttcatagagaatttaagagtctgcttagggaaatctcagtagccactaagaagacaggagagcaagacagcctcagagcagcattccagctctggctttggtaggagttggaaatgtgtccacatccaagagggcgaagcgtcgaatcatcctagctcatgagcctgctgactcacctgccagcgtgagccaccggagccccagctgcctttccgagccctctctgcctagactagagggatcagggtgtctgctcgggagggcttgggaaagccagcaatcaggcgttcagatcccaagtgtgtctttggaaatgagtgtgagagtatttgtttcttttttaaaaaataatttaagtctgacctaaatatggggcctttattctgtgatgggtgtacgacagattattttgtgactgcagtctgttcaaatcacatcactaagcagcgctgagatgatttgttggtgcattaaaaggttttgcatcatggaacaatccatacccaggcactttattttcattaataatccagcatttttgttcagacaatgtaataacccaaacactgggtattcatatttgacacatgggcaaacttgccagtggaatggaattgtgacctgacagagaagggaaggcaggctgacgaaggtgatcgaatgggagaacagtgctgtggtgatcatgagaatgaggcttttctgtagcatgtaaaccaaaccggacccttggcagttcgtcgtccctcagttctccagatgctattttttgcaggttctaccaagtgcttgttgattaccctagttgtaattatctagggaagagatgaatgtaagtgagagtgcagagcactggggagggtgacagtgaaatgcgattagaggcagcaagagagtcctagtctgttctcacataaccggacttgaacgctccagtgcgagcagagtgctgggggtggattccactgccgaaccacggcagctttgctttactcttcagcatgggggtggtaactagctgcacagcaagttatgaaatggaaagcaagcttaacagctgtaatctcatcggataccctggagcaaatgccttgggattgcctgaagtgaagtgtttagcatccaccaaatagttgagtttctaagatgggccatgcgggatccctgccacacgggtgtgggggcagcgcgctcctccctgcctcggctgctgtgtgtcttagtcttcatgtttccccttggcgtctcctctggtccctgtccatcttgtgcaccatgtgtccctgagggcgagtcacacctgtgtcttgagtctgctgtaaggtgttcagtctacctcaaggggtcatcatggtaagctctatcccacggcatcctccgtccatcaccacacacactggaatgtatcccccccgccctgccccttcgataacctcctgaccttgtctttcctataatcaccacaaactcctagtgcaaattggatgctgctttaaatgtgaaaacaattgttcaaaagctataaaacctgaatgaaagctgaagctgaatttataagccttgttgcatatgagccaaaagtgcaaaaagctctatataatgaactaacctgccactcgtataaatataaatatatataaatatattaaaatcagactgttctacaaaattgtgtatttgtatttttgtgtacgtacaattttctgctaagcagaaggaggatgtagtataggatgctgtgagaagagatttggtttaatcctatttctttgttacttatttttgttaacatcagatgcctgtctttgtcttatatgtgtatgacactgtttgggaaagctgcagtatctctcttcctgaggtccagaggccattaaagaataaacatggggcttagaggtgtcttgggccaccaaacacaggtaagccaacagagttcggctcccgtacgtggtgtggtgggacctggggcctggagccacttgtactcctggggtgggactgagggagggaaagggctcccccacttcaggctggtcactgtatgttgacttccctctgggaagcaaaattccacttgtaaaaatcagcttccaagacaaaagatgatccgatgtcacttctgggtcaccaggaagggacacaggatctctctgaactttggaacagaccctcatattctggggccagaagtttgcccagaaagcagcaggtggctctgcctggctgtagagcccagctcattggctgtccctgggcttcgtctccctcttccgagtagttgctgcctttcttcagatcaggttaccacaatgcctccccgctgctgacgcttcatcccccacacctccagccccagttacctggagcttctcagaacccactttgccggtgctaaaacacaagagggggtgaaagtggctgccagtaatggccagaaaccaaccaccagaggccaggctgaaagacaagctccgggtgtccaggggctgacgggccaaccatgtggcaggtcccaggccccacccactgcgccatccgcctctgagctccacagtggtcccactaatgggaacctcctctagggagagtgatactgcaccttcacccgtaggactcatatttataacaatgtgtaatggctgtagcaaaaagcccttgtttctagatgtaaatggtcaaagaaacaagcgctctattgttttgaataaaatagttcaaatgagtcctgtatcattgtatctcctattctggattagtgccttttggacagtagactgttctgtaattaaaatgtagtatactgcttttttgtacagttttgttttaataaaacttttttttaatttgtgtttattttagtattgtacctattagagaataaaatgtataactgaaaaaaaaaaaactg

SEQ ID NO: 86938 - DNA, 2731 bp, Homo sapiens
gccagacaaagacagtcagtctgatgtgattgagacaagggaggtttttcagggggagactgggagataggggcctcccctcccccttctcctcttcctgcgccggcctcaacccctccccagtcccctcccgacgggcgccccacgcggaagacacccctccccctcccgccttccctcctccctatctcagcccttcgtactgggacgttggggagggggctgtgccgggcggagagaactcagcgaggattctgagaatggtagataacgcagatcatctctggaaaggatattgatccgcctcatgtaaagtatgcttagttcctttccagtggttttgctggaaaccatgtctcattatacagatgaacccagatttaccatagagcagatagatctgcttcagcgacttcggcgtactggaatgactaaacatgaaattctccatgccttggaaactttggaccgtcttgatcaagagcatagtgacaagtttggaagaaggtccagctatggaggaagttcatatgggaatagtactaacaatgtcccagcatcttcctctacagctacagcttccacacagacgcagcattcgggaatgtccccgtcacctagcaacagttatgatacttccccacagccttgcactaccaatcaaaatgggagggagaataatgagcgattatctacatccaatggaaagatgtcaccaactcgctaccatgcaaacagcatgggtcagaggtcatacagttttgaagcctcagaagaggacctagatgtagatgataaagtggaagaattaatgaggagggacagcagtgtgataaaagaggaaatcaaagcctttcttgccaatcggaggatttcccaagcagttgttgcacaggtaacaggtatcagtcagagccggatctctcattggctgttgcagcagggatcagacctgagtgaacagaagaaaagagcattttaccgatggtatcaacttgagaagacaaaccctggcgctacactaagtatgagaccagcccccattccaatagaggaccctgaatggagacaaacgcctcccccagtctctgccacatctggtactttccgactgcgacgagggagtcgatttacctggagaaaggagtgcctggctgttatggaaagttacttcaatgagaatcaatacccagatgaagcaaagagggaagaaattgcaaacgcttgcaatgcagttatacagaagccaggcaaaaagctgtcagatctggaaagagttacctccctgaaagtatataattggtttgctaacagaaggaaggagatcaagaggagagccaatattgaagcagcaatcctggagagtcatgggatagatgtgcagagtccaggaggccactcaaacagtgatgatgtcgacgggaatgactactctgagcaggatacttggcaagtacgcaatggggaggaggaggagggaagaagttcagagggaggcagagaagcagagaaggatgacagtacgagccatagtgaccaccaagaccccatctcattagctgtggaaatggcagcagtcaaccacactatcttggcattggcccgacaaggagccaacgaaatcaagacagaggccctggatgatgactgatcagggagctgcagtatctctcttcctgaggtccagaggccattaaagaataaacatggggcttagaggtgtcttgggccaccaaacacaggtaagccaacagagttcggctcccgtacgtggtgtggtgggacctggggcctggagccacttgtactcctggggtgggactgagggagggaaagggctcccccacttcaggctggtcactgtatgttgacttccctctgggaagcaaaattccacttgtaaaaatcagcttccaagacaaaagatgatccgatgtcacttctgggtcaccaggaagggacacaggatctctctgaactttggaacagaccctcatattctggggccagaagtttgcccagaaagcagcaggtggctctgcctggctgtagagcccagctcattggctgtccctgggcttcgtctccctcttccgagtagttgctgcctttcttcagatcaggttaccacaatgcctccccgctgctgacgcttcatcccccacacctccagccccagttacctggagcttctcagaacccactttgccggtgctaaaacacaagagggggtgaaagtggctgccagtaatggccagaaaccaaccaccagaggccaggctgaaagacaagctccgggtgtccaggggctgacgggccaaccatgtggcaggtcccaggccccacccactgcgccatccgcctctgagctccacagtggtcccactaatgggaacctcctctagggagagtgatactgcaccttcacccgtaggactcatatttataacaatgtgtaatggctgtagcaaaaagcccttgtttctagatgtaaatggtcaaagaaacaagcgctctattgttttgaataaaatagttcaaatgagtcctgtatcattgtatctcctattctggattagtgccttttggacagtagactgttctgtaattaaaatgtagtatactgcttttttgtacagttttgttttaataaaacttttttttaatttgtgtttattttagtattgtacctattagagaataaaatgtataactgaaaaaaaaaaaactg

SEQ ID NO: 86939 - DNA, 2860 bp, Homo sapiens
tagagcacggtcacaggaaggcctctgctgggccgagtctgcggtccctgagccatcacagcactggcgtcttcagacacaccctggctgcaaggcaggacactccccctgccgagagacaccatgtgcgtcatcattgcctcccctggaagagcccacagccttctatgatctcccccccgggctcgccctgccttccacggccatggtcacgttgggtatgcagtacttttcaaggataaatttttgtttatgttttttaagtgcctaagcaagatacagacctctggaacctgccagagagtcggcctatgccctgtccccatccctccccaccctgcactggcccttgagggtgggcacagggcggctgcccctctccagtgtccctggcgttctgcaggcagaacaaggcaaggacaagctagcgggagagatcgcttcacagccatatcaggctggcttcgtcactgttttccagcgtttctttctttagggccgtttctgtttatgtggtttggtcttggttcatagagaatttaagagtctgcttagggaaatctcagtagccactaagaagacaggagagcaagacagcctcagagcagcattccagctctggctttggtaggagttggaaatgtgtccacatccaagagggcgaagcgtcgaatcatcctagctcatgagcctgctgactcacctgccagcgtgagccaccggagccccagctgcctttccgagccctctctgcctagactagagggatcagggtgtctgctcgggagggcttgggaaagccagcaatcaggcgttcagatcccaagtgtgtctttggaaatgagtgtgagagtatttgtttcttttttaaaaaataatttaagtctgacctaaatatggggcctttattctgtgatgggtgtacgacagattattttgtgactgcagtctgttcaaatcacatcactaagcagcgctgagatgatttgttggtgcattaaaaggttttgcatcatggaacaatccatacccaggcactttattttcattaataatccagcatttttgttcagacaatgtaataacccaaacactgggtattcatatttgacacatgggcaaacttgccagtggaatggaattgtgacctgacagagaagggaaggcaggctgacgaaggtgatcgaatgggagaacagtgctgtggtgatcatgagaatgaggcttttctgtagcatgtaaaccaaaccggacccttggcagttcgtcgtccctcagttctccagatgctattttttgcaggttctaccaagtgcttgttgattaccctagttgtaattatctagggaagagatgaatgtaagtgagagtgcagagcactggggagggtgacagtgaaatgcgattagaggcagcaagagagtcctagtctgttctcacataaccggacttgaacgctccagtgcgagcagagtgctgggggtggattccactgccgaaccacggcagctttgctttactcttcagcatgggggtggtaactagctgcacagcaagttatgaaatggaaagcaagcttaacagctgtaatctcatcggataccctggagcaaatgccttgggattgcctgaagtgaagtgtttagcatccaccaaatagttgagtttctaagatgggccatgcgggatccctgccacacgggtgtgggggcagcgcgctcctccctgcctcggctgctgtgtgtcttagtcttcatgtttccccttggcgtctcctctggtccctgtccatcttgtgcaccatgtgtccctgagggcgagtcacacctgtgtcttgagtctgctgtaaggtgttcagtctacctcaaggggtcatcatggtaagctctatcccacggcatcctccgtccatcaccacacacactggaatgtatcccccccgccctgccccttcgataacctcctgaccttgtctttcctataatcaccacaaactcctagtgcaaattggatgctgctttaaatgtgaaaacaattgttcaaaagctataaaacctgaatgaaagctgaagctgaatttataagccttgttgcatatgagccaaaagtgcaaaaagctctatataatgaactaacctgccactcgtataaatataaatatatataaatatattaaaatcagactgttctacaaaattgtgtatttgtatttttgtgtacgtacaattttctgctaagcagaaggaggatgtagtataggatgctgtgagaagagatttggtttaatcctatttctttgttacttatttttgttaacatcagatgcctgtctttgtcttatatgtgtatgacactgtttgggaaagctgcagtatctctcttcctgaggtccagaggccattaaagaataaacatggggcttagaggtgtcttgggccaccaaacacaggtaagccaacagagttcggctcccacccactgcgccatccgcctctgagctccacagtggtcccactaatgggaacctcctctagggagagtgatactgcaccttcacccgtaggactcatatttataacaatgtgtaatggctgtagcaaaaagcccttgtttctagatgtaaatggtcaaagaaacaagcgctctattgttttgaataaaatagttcaaatgagtcctgtatcattgtatctcctattctggattagtgccttttggacagtagactgttctgtaattaaaatgtagtatactgcttttttgtacagttttgttttaataaaacttttttttaatttgtgtttattttagtattgtacctattagagaataaaatgtataactgaaaaaaaaaaaactg

SEQ ID NO: 86940 - DNA, 1788 bp, Homo sapiens
gccagacaaagacagtcagtctgatgtgattgagacaagggaggtttttcagggggagactgggagataggggcctcccctcccccttctcctcttcctgcgccggcctcaacccctccccagtcccctcccgacgggcgccccacgcggaagacacccctccccctcccgccttccctcctccctatctcagcccttcgtactgggacgttggggagggggctgtgccgggcggagagaactcagcgaggattctgagaatggtagataacgcagatcatctctggaaaggatattgatccgcctcatgtaaagtatgcttagttcctttccagtggttttgctggaaaccatgtctcattatacagatgaacccagatttaccatagagcagatagatctgcttcagcgacttcggcgtactggaatgactaaacatgaaattctccatgccttggaaactttggaccgtcttgatcaagagcatagtgacaagtttggaagaaggtccagctatggaggaagttcatatgggaatagtactaacaatgtcccagcatcttcctctacagctacagcttccacacagacgcagcattcgggaatgtccccgtcacctagcaacagttatgatacttccccacagccttgcactaccaatcaaaatgggagggagaataatgagcgattatctacatccaatggaaagatgtcaccaactcgctaccatgcaaacagcatgggtcagaggtcatacagttttgaagcctcagaagaggacctagatgtagatgataaagtggaagaattaatgaggagggacagcagtgtgataaaagaggaaatcaaagcctttcttgccaatcggaggatttcccaagcagttgttgcacaggtaacaggtatcagtcagagccggatctctcattggctgttgcagcagggatcagacctgagtgaacagaagaaaagagcattttaccgatggtatcaacttgagaagacaaaccctggcgctacactaagtatgagaccagcccccattccaatagaggaccctgaatggagacaaacgcctcccccagtctctgccacatctggtactttccgactgcgacgagggagtcgatttacctggagaaaggagtgcctggctgttatggaaagttacttcaatgagaatcaatacccagatgaagcaaagagggaagaaattgcaaacgcttgcaatgcagttatacagaagccaggcaaaaagctgtcagatctggaaagagttacctccctgaaagtatataattggtttgctaacagaaggaaggagatcaagaggagagccaatattgaagcagcaatcctggagagtcatgggatagatgtgcagagtccaggaggccactcaaacagtgatgatgtcgacgggaatgactactctgagcagactgataggatgcaagctgaggtcgtggcacaggaatgacagacaccatttggggagtatccacagagtcaaaggaacactagaatccccacctcagcgtgaggataattgatttccagctgcaataagccgtgcctcattatagccacactgtggctagattatacttctttgggtgctgtgctaagaatgtcaatggaaaaagccgatctcagattttgtttgaagttaacatgcctgacacagacatcctttcctctcacaagctgtgtgacttagtagataaaatactgccttctgcctttgggaccatgattaaaaacaaagacaaaaaccaaaagtcatta

SEQ ID NO: 86941 - DNA, 594 bp, Homo sapiens
gcctatgagttatttagcaacttaaaattttttcccaaatatttgggattttttggtcattttgcttgtaacttctatcttaattgtcttatagattgtggtctgtatgctacgctctaaatctctgaggcttccattagggtttactacacaatcagtttttgcatacattccatgtatacttgagaaaaaatatgttctcagagttgcatccatgagtcggtaatagcatatattgtttggatctccatatacttgctggattgtttattgtttccatttgacctatcaacaagtgaaagaggtgtacagaaacttcctaatttcccactgtggtgatggatttatcaatttcttccttaagtatcaatatgtgctttgtctatttttgaggaatttaattatatgcataatgtttaaaactattatatctttttgattaactcaaccttttattattatagcaactttcccttccttaataatgcttttgtcctaaagtctattttacctgatattaatatagctattatagctttttgttagtattttcatgatatgtgtcttttaatttcaacttttatatacctttat

SEQ ID NO: 86942 - DNA, 274 bp, Homo sapiens
ctggaggagcactaagcccaggagttccaggctgcagtgagctgtgatcttgcactgcactccagcctgggtgacagagcaagaccttgtctctaaaaagacaaaaaaggagaagcaaggtgcagtaggagaaagaggcagaggaattttactagtacgtctgagctggattgtttcctttgatcctccacacctatctgtgctctgctccatatgccaagaggccagcccctcacactgactgtccaggctctatgccgtctgccttgtgcct

SEQ ID NO: 86943 - DNA, 1999 bp, Homo sapiens
gggaggcggaggttgcagtgagccgagatcgcaccactgtacgacagagcaagactccgtctcaaaaaaacaataaaaagaattgctggaggagggaagtgaggggcggctggcgggggactgctgggctggtgcagagggagtcaaggatccctaagagagaggcaggggtgttcagctctcccacctctgctggatgaacttgcagagcctccttggtgacccagccggtgcagagactctgctcaggacaacacccttgcctgggacccccacatctctggccccagcagcagcccttgggggggtccctttatcttcctccactcctacccaggcttcctcagcaggagatgaggcaggacatttccactccctttctggaaggttcagaaggttaatgagagctaagcacgtaagtccatttagggggatgaacttctgggaagagaggaacctgggtctgggctgacgtccaagggcgggctgggtgacggtccctctgatcacggaccctgtccacccactgcccagggccctgcctcgacccctctgaccagccaccgagccccagagggatctccatgaatgtcagagacattgactggaggccttatctccagtgggagaccccttctcttcccactgtgggccggttccagcctgggctgtccaggaagtgacctctcagggcctgggaagggtgtggccagtggttcttggttgtactcaactcatctgccttgggtctaaggctggggtgaatggaagggcccacctggaccctggagggacaccaggctcatactaaaatcccaaaaagtgaaaagctttccccaggcccaagcagagaaactggaccttgaagctacatctctggacttagtcctcaaagtaggagacatttgcctctaagctgttctctcccaccccacctttctgtgagccgccggttccctgttgtccacatcaagctgtgtgctgggcactgggtgcaggaatagcttgaccacagtctctatcctgggggtaaaggggtgaccagcccacagagggatggactgcaaacagacagtcccaaagtgccatgagagaagctctcagggcctgggcgtgatggttcatgcctggaatcccagcactttgggaggccgaggtgggtggatcagttgaggtcaggagttcgagaccagcctggccaataaggtgaaactccatctctactaaaaataaataaataaataaataaataaataaataatacaaaaattagccgggcatggtggcatgcacctgtaaacccagctacttgggaggctgaggcaggagaatcacttgaaccccagaggcagaggctgaagtgagccaagattacgtcactgcattccagcctgggtgacagagcgagactccatctcaaaaaaaaaaaagaaaaaaaaagagagagagagagacagagagaggctctcagcctgcaggaaagggctctctccttgttggccaaaccagtgggccctttagctgtgacgggtgtgccctgggcccaccaggacaggagcaaggtcaggagggctgctctgctctgcaaaacagaggctgatggatctgaagtttctgttactgggagaataaagggaggtgaaggagacacgtggtaggtcccctgggaaggtggtgggaatgcgtgtgaaatgctcggagaggcacagtaagaaccggcctgtttagaatccagtgttctacgcctgccccaggccccagcaattctgcttctagacatctccccatgagaaatgagcactgagcctcccaaacatgtcttttgggaggccaaggggagcggatcacttgaggtcaggagttcgagaccagcctggccaacatattgaaaccccgtctctactaaaaatacaaaaattagccaggcctggtggtgggtgcctatagtcccagctactcgggaggctgaggcaggagaatcgcttgaacccgggaggtg

SEQ ID NO: 86944 - DNA, 639 bp, Homo sapiens
gatttatcaaagagaccatggtttcctctttgctgaggtgatctctgcctcttggttcatttgtcttttcttgcatcaataccatactatcttaatttatgttgctttgtaatatttttggaaatctggtagtgaaagccttccaacttttttattctttaagattgtcttgccttctctgttccccatgtttcctaaattaattttggaatctcaggattaattttcacaaatgaatttttggtactatgcctgtaattgcattggttttataaaataacctgaggataattgacatctttacaatatcgagttttccagttgatgaatatggtataattgtccatttacctaggttgtctttaacttttctcaagagtgttttatagttttcattgtagaaatcttgatttgtttaatttatttctagtatattttgctttgtatttttaatttgtttttcaatgtttttggctagtacgtagaattgcaatatctttttgtatattgactttatagctggtgacatttataaattcaattatttattccaatactttgtggattttggattttctatatatatataatcctgttaataccaataaaagaaagtcttacctaacgtctaaactttat

SEQ ID NO: 86945 - DNA, 676 bp, Homo sapiens
  misc_feature (21)..(21): n is a, c, g, or t
aatcgagctcggtaccatatnggttggacgatgaaggtaagaaattctggggtgggtaggtgggagagagtgggccacttcacagctgtggtggccacatgtctcagattttctggaaccatctagctctaaaatattctctatggttttagaccttaaatcctgaattttggcatggaaaatgaggctcaagtgacgtctgctcacgtgtctcttgcgttagttatctgtataacaggcctcttacatgatatttctaccctcaccaaaaaaggagaaaatgagaagaagatttaggttaaaaaaatatatattccccacccagcctctgcttgaaatgtgaggttttggttttggacagcggcgttggttgttgacgtcattgatccaactattttatttcccacttcactttgcttgcccaggtgtggtccaaggagtatgagggctgttaagataaaaccaggctccggaaattcaaatgaaatgtctacctgaacctcctcaagtctttcctgtgggctgtgtatttatttataagcctattgggctttggcagcagaaaaaaagaagaaaggaggaatttgtttctaaaatgaaaaccaaatttagttaatataaatgctacccatgtgcaactcgtccaacctatatggtacgagctcgattcgtatct

SEQ ID NO: 86946 - DNA, 847 bp, Homo sapiens
  misc_feature (21)..(21): n is a, c, g, or t
aatcgagctcggtaccatatnggttggacgatgaaggtaagaaattctggggtgggtaggtgggagagagtgggccacttcacagctgtggtggccacatgtctcagattttctggaaccatctagctctaaaatattctctatggttttagaccttaaatcctgaattttggcatggaaaatgaggctcaagtgacgtctgctcacgtgtctcttgcgttagttatctgtataacaggcctcttacatgatatttctaccctcaccaaaaaaggagaaaatgagaagaagatttaggttaaaaaaatatatattccccacccagcctctgcttgaaatgtgaggttttggttttggacagcggcgttggttgttgacgtcattgatccaactattttatttcccacttcactttgcttgcccaggtgtggtccaaggagtatgagggctgttaagataaaaccaggctccggaaattcaaatgaaatgtctacctgaacctcctcaagtctttcctgtgggctgtgtatttatttataagcctattgggctttggcagcagaaaaaaagaagaaaggaggaatttgtttctaaaatgaaaaccaaatttagttaatataaatgctacccatgtgcaactcgtcctgccagatcccagtaaatgtacaaatatcaaaataacacaatagataaaaatcacggtggaaaaagagaaattgagacacttctgtgttttgcagggccagaataatctacacagtttactccttccaccatgcatattttacatactacattattatctgattttatataatattcacattgtaatttctgaatcaactct

SEQ ID NO: 86947 - DNA, 279 bp, Homo sapiens
gtcgagttcactaacgtttagctttcaggtgctccctagcctttctggagatgcacaacagttcagtcacagagcctgtttctgtaggtgaccaggtgcactgcagtggcctggcgtttgacactggaatggctgattttgaatcctggcaaagccccccagctggttgtgtttgaccttgagccagtcacattgcctctcagaaacttggtttctttatttataaaatgggaataaaaacagagacgttttgctctgtaaaccatggggctgctctga

SEQ ID NO: 86948 - DNA, 200 bp, Homo sapiens
tctacatgtgaaagatacaacaataaacacaactatagctccttacctgatgaagcttacggtcaagtggagagaattcagacactaggctgggtgcagtggctcacgcctgtaatcccagcactttgggaggctgaggtgggtggatcacaaggtcaggagatcaagaccatcctggctaacatggcgcaatcccacct

SEQ ID NO: 86949 - DNA, 466 bp, Homo sapiens
taagccctgaagaatcagagtacatataatgctctacacctttttccacttaatttatctcagaacaaagatctaacctttcaaagaacagctgttgtagtgagaattccactctttggaaatgtataaatcagacacaaattcaaaatgcagtattttttgtgtcagccttgtaatcctttaacagtgagtcctatgggaatttaaaaattacgatagtatcagctaatatttcattgaggcattgtgccatgtctggccctggactaaccccttttctttacctctcacaacgaccttagaaggaagctgagtgtccacagtcgtgtagctgagaggccttaggaaggtaaattctcttcaccaatgtgcagagccaagaggtagcacagccaagattttaagccagatctgtctgattctactaccacctactacaaagagctttcttgtcataggataaagg

SEQ ID NO: 86950 - DNA, 638 bp, Homo sapiens
actcctacaaggttggacacaatgcagcctagggatgaacagtcatgaattttgtactgaaaaaatttacatttcattaacattttaaattacaaaggcaggtctacaaataccgatttgtgtgtttgtgtgtgtgtgtgtgctcattgcattttccaagcaaacaagtgaataatgtgctaactgtatcctttgtttttttatttttgatttctctttttattgtaaaacgtaagctgtgatgtgtagtgacattaattttagtaaaacctactttacgttctctatagataatatgcacataaagtctacataatgttttcttatgtaataaatgctttgggataatgaagggtacttcgagcatcattcctcagctgtttagtaaaccagctctacagagacttgcctttctaattctgcagctacatgggtagaaattaatctacttgaaaatgaattagcaatataaaaatgtaatattttatgattaatattaactagaaattaagactgaattattcaacttcagtttgccattctttgaaagaagttacattttgggaagttctgtgaagttagaaaaagtttgaaagtgtgttgcgggaaatagtggctgactagtgtaatgaattgaa

SEQ ID NO: 86951 - DNA, 361 bp, Homo sapiens
cttccctccttagagcaagtgctgcagaggctggtggaactgaagatgagccaagctgcctttgcatctttgcaagtttactgtgaccatggaacctggtgtttccttgacaatgcctacaactgaatctaataggtcagagcaagggttcagttgctggccaggcattagccttgagggaaggctggcactcctagcaatggaccctgctaggctttagggccctcctggcatcttcggttcccactgatctctaggattagacacaagaatgctcagaggaagggaattttttttttttttttttttttttggaaatggcgggtttgggggacccgaccacaattacgaaatcatggta

SEQ ID NO: 86952 - DNA, 203 bp, Homo sapiens
atatttggcaaatctgtaccctagttttgtttagttgtgtgtgggcgtggggttatattcagcactggaaattgtgggagcccagctgtgcatcaacagcttctccatccagttagggagagtgggagctccccatctaagtttaaggttgcagctcttcctcccatagatctgtggtttaccctcagccccagcccctgcaa

SEQ ID NO: 86953 - DNA, 261 bp, Homo sapiens
  misc_feature (24)..(26): n is a, c, g, or t
tagtcaccagcagcagaggactgnnngaaccgatgaagagcagaaggtcgacgccgtcgaccttctgctctggaagtacagggcagaaagcgctacaagaaggattgagtagtgaactctgtgatatgctgccaactggtcaagaaaggagacaaagagctgaccattagatttgacgagactgagtttgttggcaacgctgggaagaatagtcaccgtagagtcgtagggaatatggttgacgagagcagaaggtcgacg

SEQ ID NO: 86954 - DNA, 539 bp, Homo sapiens
ggaatcaggggctcccttatcaaagctgggaaacttagaacaacagctgtgccgctcatggacctgtagtctctcctgttaagcagagtgctgagttcatgtgatagcaaacacagctctgccagaccacagggtcaccaggcaggcactccatccctccctccagggggagaccacggcatgccttggatgaggtgacttggccaactgtcttgtggccccagctcctgacattacaatgtgatgactgtgacacttggaagagaaatgtctcaggtatcgtggtcctgggtcctgtggtacaggaccttgtctctgcggtcctgtacttttgcttcacaattagaagaattgaaagcttcaggttgtttcaggtatgttttttcaagaagtgcaatagtagtgtgtttatagatgttttccttagagttagttttgggggagagaagatgactgcccttccatcctgcaggtggattggctggggaatgaggccatctcttttcagagtgagcagtgaaccatttttgtctgtacac

SEQ ID NO: 86955 - DNA, 270 bp, Homo sapiens
gcttctgaggcagaggaaacagcaggtgcaagcctttacacaggattgtgcttgggatgacttgaggaacagcaagaaggccagtgatggagcaaataaaaacagcagcaaaggatgagcttacatagggatctgtaggtcatggtaagaattttggattttactaagggagatggggaccactagaagatatggagcaaaagaatggcataatctgacttacattttaaaaggatcactctgctacttgtggaaaactgtagcagggta

SEQ ID NO: 86956 - DNA, 406 bp, Homo sapiens
ttggtttggtctgttgagcctagtgcaggagctcagtccaaaccaatgaacttctataaattttatttaacggaggcttgtattagtttccaatgactactgtaacaaattaccacaacattggtgactttggtaattcagtcacatctgctaagtctttgtcacagttgggatcacgtggaataatcgcttgaacccaggaggtgaaggttgcagtgagctgaggcgacggccactgccctccagcctgggagacagagcgagattccatcttaaatttaaacatggggcagctatcaaccaaagtcaaaagagaaacaaaaatataaggcatctgttaaaacattactttcaagtaaatgtaagcaggttttgaaaaattaattggctgcgtgtggtggcccac

SEQ ID NO: 86957 - DNA, 264 bp, Homo sapiens
  misc_feature (5)..(5): n is a, c, g, or t
  misc_feature (9)..(10): n is a, c, g, or t
  misc_feature (13)..(15): n is a, c, g, or t
  misc_feature (109)..(109): n is a, c, g, or t
  misc_feature (261)..(261): n is a, c, g, or t
caaangagnncannngatggctaccctcccaagtgtctaggtccccttgaccctgtggtactaatagcttgccattcctctgtcaccactgctttctgcttagcacacntcccctctgcccatgtgctatgcttgccttttcgcttgccaaagggaagtggttccgccaaaagcgtgtgtcccatcccctctggcccccagggtctccaggtgtggtgttgctgcgacagcccagctacaccccgtcctatgcagagctgnctt

SEQ ID NO: 86958 - DNA, 385 bp, Homo sapiens
ttctttttgtgagagaaacacttttgtgatttgaagttaatttccaaaaagatttataattctggattttttaaagtttttctctataaacattgttttaaaaacacataacataatatttaccatcttaaatttattgatgtgtatacttcagggccaggcatggttgtggctctcatctgtaatcccaagattttgggaggccaagacagggggatccctggagcccaaaagtttgagaccagcctgggaaacatagggagacccctctctataaaaagaaaaaattaatgatagccgtgtatggtggtgtgaagctgtggtcccagctacatgggagattgaattgtgccactacactccagctcgggtgaccctgtctcaa

SEQ ID NO: 86959 - DNA, 102 bp, Homo sapiens
agtgtcctgcagcagcagtgcaatgtgattgatttcagaaatttaaaaaatatttgctgacactgcactccagcctgggcgacagagcgagactccgtctca

SEQ ID NO: 86960 - DNA, 314 bp, Homo sapiens
cccaacacgatattcctactgctttctgtgccttcagtaataaaatccttttccttcaacccatggatgtcttctgccagcatccatgaaaccataacaggtcagcttattagctccagtagggcaaaagcaaatctcagatcctgataaccagccaatcctttctgagtccaatcctctgttatgggacatgattatttatttaaaatcttccctgttcagattaccctgtgatttctgtctcccaactggactctgtctgatacatcacagcagcagacgcatcctccttaggtggctattcatagtcctta

SEQ ID NO: 86961 - DNA, 217 bp, Homo sapiens
gatcaaatttttgagacaatccttggtctggattggttaatgaaaatgtcttgtttaagaggttctattaaaaaatatttctagtgtattagtcataattgtttttgtggagtgggggtaaaccacaccattaagggaataaaatgtaatttgaaagaggtgattataagatttgtttcaggccccaaaatataaataaaaattggtgtggaatctc

SEQ ID NO: 86962 - DNA, 594 bp, Homo sapiens
cgcccgcactttcccgcggcgttacgaggggccaactccgggtgcccgagcccgaacccctccccggccgagaaagtgcgcggggcccggctcagccgccacacgtcggggcttctgagccgctggcacttaaggcgctcctccctcgtcccggggctgggctttcaagagagctcaaggctgccagagagtgatccgagagatggatgacttcgcaaagccgcgcccacagacggcccagcggggtgagcgcgtcgcagcccgcactcaaggaggtcttggggcgcggcgaaggggctccgggtcccagcccgaaggcgacctcagttcccccgagagcggccccgtgactaggcacatttttgccggcaccgaggcgggggagccggcagccccggaaggccgggccgcgcgctcagacggccagcgtccgccccctcttgccccgccgcccaccggccgctcaaacttaggggctccggagtcccagctctcgggcccggggacgcggctggattctcccccaaggcccacgcgagcgggctcagtccccagaccttcccgcaacttcccacccgttcgccctcgggctcg

SEQ ID NO: 86963 - DNA, 233 bp, Homo sapiens
ataccactaattaccccctaccactgtggcaatgctaccacagattttgttcttttttttaaagacagggtctttctatgtcacccaggctaaagtacggtggctattcacaggcatgatcacagtgcactgtagccttaaactcctggactcaagccatcctcccaagtggctagtactacaggaacttgccactgtagccagctagattttgttcttttttctcaaaaaga

SEQ ID NO: 86964 - DNA, 398 bp, Homo sapiens
tttcaatgcgtgcatttgttttttataatgatcttttctatgatactgggtgagataaaaaccaacttatttgcctttaagagcttctttgttttctgccatttgtgctagcaacagtcagagaaaactttttttttatagcaaattgtttttctcaacacattctgtctggaaaagaatgttctctagttaccacctctttggtctaagggcatctccttggtttctgtgttacagcctctttgtgttaattataagttgctttgctttacagactcaaaatgaatgttacagtgactgataaaagccaggatcctgagttcaagatcctgaccaattgggtgcttcatttgaaatcagaatctgtgttcactgtggtttacttggggtatgtgtta

SEQ ID NO: 86965 - DNA, 489 bp, Homo sapiens
attttgtaatgcactttaaaatatttgtgccatttaaataatgacaaagcaatcaatgcatacatttcaatggagacagtatacaaagttaaagcaactgatacatatatttcagtggagacagtaggataacagtgttagcaaatatgtgtcatctctttaaatttgggaggaatcagaagctaaagatttaaaacaaataaaacatacctgaagaaaagtagcaatttctgaaattgtagtaatcttggaatggttatcaaacctagcaaataatacttaataagtgttacctaatatacctaattggaatgtttgtttaaaatattaaattaatttatactgaaagttttaactgcaatttcataattcatgaattctataaaagaaatctccctcactaaaaatatgatcaatcaaaactaccagttttgcacaccaatcccaagtttaagcatattttgtatttaaagttataatttaattatg

SEQ ID NO: 86966 - DNA, 389 bp, Homo sapiens
tctcattcacatgcttaagggagttctacatctagaagtgaaaggtcagtgcacccgagtgaatttgtcaagggaaacagagcagcggtctcatgaggaaatgaggaaatggcatgaggaaatggtttcatggaagacagtttttccacagaccagggtgtggggaggatggttttgggatgaaactgtttcaccttagatcatcaggcattagacaggttctcataaggagcatgcaacctacatcccttgcatgcacagttcacaatagggtttgcgttcctatgagagtctaatgccactgctgatctcacaggaggcagagctcaggcagtaatgctcgcttgcctaccactcgcctcctgctgtgtggcccagtggctaacagg

SEQ ID NO: 86967 - DNA, 138 bp, Homo sapiens
gcaagatggcacctctacactccagcctgggtgacagtgcaagactccatctcggaaaaaaaaacgaaaaaggaatatggacattttaatgtggtataggccatgtataaggcctataggtttttatttgttttggtt

SEQ ID NO: 86968 - DNA, 321 bp, Homo sapiens
ttaaactagcatttcatattatgaggttatatgaataaaattctatgactagacatcttaagttttgaacctataacctactattttatttcctttgtgtagtcagatagatttactgtccaatgtattgaaatcaatactaataaatgggacgtgcatcaaagagggatttaactggacactgattcccagaacacgtttcaaatatgggcaaaagaaaaaaggctatggctgaagcccattagaacactgtgacctctggcactgtgaacaggcctaacaactcttaagttcaaatcccgcttctgtcacagacttgct

SEQ ID NO: 86969 - DNA, 429 bp, Homo sapiens
cggtcaacttaagcaaatgaatagaagaaaggaaagatctggagagcataaatgttcactgttgttccatgttcttagattccctttccttcttttgcacatggatcctatttacatatattttattacattttttattactgctgtagcaaattaccacaaatttaatgacaaaaaaaaaccccacaagcctctttttttacagatctggaggtcagaagtctaaatcaaggtgtcagcaggactgttctcctcctgaggctttgagagcagaatctgtttctttgatttttttttcagcttccagaggctacctgtattcctttcctatgatccttttctcaccttgtcattcaaacttctactactgactgaccctcttcctcccctctaacaaatacttttgtgattacattgggtctaccggga

SEQ ID NO: 86970 - DNA, 386 bp, Homo sapiens
cacaaagtaagtaagattggtttaaggaagggaaggaaagactaaatacaaggtcaaatgtcactataattggtgtctgcacatgggattaaacaagtaagattgatgtgaattttattctttcattttttatgtagactcactgattgggtaactgtggaaataatgtcacagtgcctttttaagttaagaacatgtagttgtgatcaggagcggtggctcacgcctgtaatcccagcagtttgggaggctgaagtgggtggatcacctgaggtcaggagttcaagaccagcctggccaacatggcaaaaccccgcctctactaaaaatacaaaaagtaggtgggcgcctgtaattccagctactggggaggctgaggcaggaga

SEQ ID NO: 86971 - DNA, 358 bp, Homo sapiens
ccctttccaataacatggccacctggtttttattttcccagcaggatgcctgttggcttttaatgaccaaatttccatcagatcccctagaataaggccacatcccccccagacttcccagggcagggccatgccttcttcagtgcccctcacacccgcccttctcctcaccagagcaaactgtgtccctccaggacatggtcacctcagtttagaacccccagggtggaccatgttctctcagagtccccagacttcctaaaacacaggtacagtacatttctcagctggcaattacaaaggaaaactcagtcactccgtgttgtaactcaatacgtttctaacaaagcaagccgta

SEQ ID NO: 86972 - DNA, 898 bp, Homo sapiens
cacagctcttccatgttgtagcaggtgttagaatgttattcttttatggctgaataatattccattctatggctaggccacacgtttctttacatattcctttttatggctgaataatactggagcctcttgaaccatcatctttgaaatctgtgaagttccaaagaagactttggacagcccaactgccctgtgcttcccttgaagaagccaatattggaccatattttggttttgttaggaacacagcacccattatataagagctagttcaaagtcactgcttcttgaagagagaatactttcaaatctgtctcctcgtcgacgcccgtcctgactagttgggtccctgcgaacaatgaccaagctctccctggtgtgggtagagggtgattctcccagctggaggtcacctggggcaagatcctcatgaagcccaagcagatttagggttcccagccaacaggcagtcctcacatctgggctcgctagaactgcacatggagcttaccagatttaccgagacccccgagatctcagccacagctggctcccctggggtcacacacctgtccggagccagtgagcagcaccctcttcacctgtccaggtgagcacggctgggtgcagcttgtggtcctgtggtcctgctgtggatgctgaggtcaagggctgcaagtggcgggctctacaggacttggctggcccagcagagtggtgtttcaaagaaatgaagtgaaatcttacccagagcccctgtgtgtgaagcagacgagaagggggctagtctgtttggagcacagggagcccctcaatgcccctcggactccaggatcaaggaacccacctcagatcaggtgcagcctggctaggaagggtgaggcgccagggaggacac

SEQ ID NO: 86973 - DNA, 337 bp, Homo sapiens
ctcaatctcccaggctcaagcaatcctcccacctcagcctcccaagtagctgggactacaggtgcatgccaccacctctggataattttttttttttttttgtagagacaggatcttgctatgttgctcaggctggtctcaaactcctgacctcaagtgatcctcctgcttggcctccaaaagtgctgggattacaggcatgagctgccatgcccagcctcaaatttctttaaaatgatttttatctttcttcaacgataaggttcttgcctatattttaccagagagcaactagtttcctgcgtatccctctattttatctttctttgtatattta

SEQ ID NO: 86974 - DNA, 366 bp, Homo sapiens
  misc_feature (177)..(177): n is a, c, g, or t
  misc_feature (236)..(236): n is a, c, g, or t
  misc_feature (241)..(241): n is a, c, g, or t
  misc_feature (347)..(347): n is a, c, g, or t
  misc_feature (358)..(359): n is a, c, g, or t
gaattcttatgttttaccagtacacttttcaaaataaaattatttatttgtactatatcccaccctctgtagaagagctttcaagataattttagaatatggtcatttatggagaagtctgaagaatccatgtcatacctaatatattttccattccctgagacctactttaacatnttgttatcatgttcactgttatattgacttcatcatcactaacagcagagaatatattngcttntttcatgcaacataaaaactagttattaggccggacgtggtggctcatgcctgtaatccagcacttctggaggctgaggcaggcagatcacctgaagtcaggagtncgagaccagcnnggccact

SEQ ID NO: 86975 - DNA, 547 bp, Homo sapiens
cacataaatgagactgttgttaaattatcctttttcctgggggaggagaatgctgtgctgtctccttccctttgattgaagccttccttactgttatcttgacaggtgacagaatgaatatcagctgtggaacttatagatatgtgggtccatatgtgtttacacatatccccatgtacacgtatggattcattgcttgcactttcatttatacacactgcaggccacatgtagagaaagcagtaggaacatttcaaggaaactctgtgcttcctgatactcctttcctagcaccgttccttggctccatagctctgcaatcccaattcaagcatgggaagtgatgacagtatgtaaagtgtcagtttcccttaccacacagaaactcttccaggccaggatcttgaaatgcttctagtcctgcactgtctgctatggtagctaccagccagatgtggctcttgagccctggaagcgtggctagctagccccaatcaagataggccatatgtataaaatatatgctggcatccaaagacttagtaga

SEQ ID NO: 86976 - DNA, 390 bp, Homo sapiens
gatggtctgcaaggttgggaattcaatttgcattgtaattcagccactgccaggatgagatcctacttctggttttcagccatctcagctctgcatctatgggacataagggcagacatagaaacttttgattcattcatgtggtgcttgagctgggaatttgaatccctgaattcattcttcttttttcccccactttgtctagtacaattaggagcaaccaaccactctcgttatacttgttaattttacaaaaatgtttaaggtatctgctacacacccacctagaaccttgcctcttagaagcctttgggagtatttaataatattttctgtgtctctattgtcccatcatgccctgtactctcctctttttactactggacgtag

SEQ ID NO: 86977 - DNA, 507 bp, Homo sapiens
tatgataggtccgggtagtaggaggtgtacactctggtccaatcagatgtggccaggtgaaggtgtcaggtgggtgcctctgctgtgtgtgggctagagagcatctcagagaagtcatgcaggtagggaagcacctctctggttcttggtggagctctctggagtggtatggctaaacactgaagaagatgatgaggatgtcgctgctgtgctcaaaagggcccagccttcttgtcataatcgtatacttgttatcctatttaacactcatgatcatccagtgaagggttaacactattctacagaagagacaactgagatacagaaaggtggaaaaacattgcttcaaaagttatttttatgaaatgttaattgtctcacatatctggattccaacctgagggaaaatgtcaccccagataatagcctggagttccatagccaaagtaattatcgcttctctctccttctcacttaacatactccagccacacaggtattcttctg

SEQ ID NO: 86978 - DNA, 851 bp, Homo sapiens
gtcttgggctggcacgaagagctgcccggccagagcatcccggccaggtgagtgtcagaagacaaattgaagtattcagctaaataagcaactgcaaaactgaatttattcctcttcaagaactactcttcttgtatgttgagtgaccatttggctgccaagagaaactgctttgcctaggaaataatatggactgaaaaatcagtttcaaacacaaatgaaaaatattccttatgtttggtcatcttctttccacatcaaatatacatgtaaagatgtatataagatataatctgaagataatcaaacagctattaactggatttctgcatttcgcctatccttcaaaaccagcctcaagtctacctttatgttgagagagtgtatctttaactcatggtgttctctttctcctttcacatttcctgtaaactcatcatgaattgccttgtttattgttttgatttctcattcaacaacaccagaatactctgtgtttagggtaaccttagacttcagttttcctgaggagtttcagtttacacgtcttgcaccggtacaattaacagtgcccctttcaggttaaaaagtgtctcagtgtagttcataaattatatagtcaccccatgtgtgcagcaatcagagctttttcaatgcaaagttgattatgatgggcataaatgaatcataataaaaagttctagtatgatcccatctgactgggcttcttgtgatggcccatttcaacaccatgggtgtcattagtggcttcacaatggttcttcttgtaaattccctcatgacctagagttttgatttatgccatcctagcccactttaagctctgactc

SEQ ID NO: 86979 - DNA, 1542 bp, Homo sapiens
cctagcactaaatttgcttagctttatagtaggatacaggacaggaaattaagcatgcatgatgcttgggtccctcctcacctgcctaaagagcgtgcatgagcttgtggtatttggatgaggttgtggtatgtgggggtttgccttgatgcaaagaagcttctatgtgggtttcccaccagtcatataggcctacggttcacaggtctcccagccccatgtactgtcccatagattgtaggtttcacagtgcacaaaatggatgtctgtccctggtacccaatattccaaatttatcttaatttgggtcatttacaagaaactcgtgctgggataagacaaacctaaaatttcccaagcaggcatagttctgggagaaaaatggtacagacctgctattaactctttgctcacacatacataaagaaaagtacacaaatcatgagtatgtaacatcattgatattggcaaagtgaatacatctctgtaaccagactcagatcaagaaatgatacattctggccaggtgtggtggctcatgcctgtaatctcagcactttggcaggccaaggtgggtggatcacttgaggccaggagttcgagaccagtgtggccaacatggtgaaaccccacctctactaaacacacatacacacccacaaattagccaggtgcagtggtacattcgtgtaatcccagctacttgggaggctgaggtgcacaagtgagaatcgcttgagcctgggaggcagatgttgcagtgagccaagatggtgccactatactccagcctgggcaacagagtgaaactctgtcaaaaaaagaaaaagaaaaagaaaaagaaaaagaaaagaaaagaaagaaagaaaacattctagaattccagaagccattctcattccctatttaagtcactaacccaagagtaattaatatcctgagttccaacaccttggatttgtatgggttatttttaaaccttctataaatggaattttatgatatgtttgtttgatccacctatgttgtatgtagttgtatttcatttattcccatttctgcattgtcttgaattgtacaactattttacatatttatctattctaatttcaatggatatttgagttgtttccaatttttaactattttttaaaattatactctaagttcaataaacatacatgtgcatgtgtctttatagtagaatgatttataatcctttgggtatatacccagtatatacccaagtaatgggattgttgggtcaaatggtatttctgattctagatccttgaggaatcaccacactgtcttccacaatggttgaactaatttacactcccaccaacagtgtaaaagcatttctatttctccacatcatctccagcatctgttgtttcctgactttttaatgattgccattctaactggtgtgtgatggtatctcattgtggttttgatttgcatttctctaaagaccagtgatgatgagctttctttcatatgtttgttggccaaataaatatcttcttttgaaaagtg

SEQ ID NO: 86980 - DNA, 396 bp, Homo sapiens
cccccacttttatttttagaaactttgatatagcttgtaaaagccaagacaaatttctaccagaattagagatatggcattcatccagccagccatcaaacatttttgaaaaccaactatctgctaggcaccatgctaagaggtagaaaaagctgcctccctacaagagatagaacctttaacctccatacgaaagagctcttaatcttttgcttgaattctccaaagttcagcatctccaactgacattaatatatttttgattcgatgacctgaagacaaccaaaactttaatgagctcagtctttatccctaacctacctctcctactatttcctctcctggttgatggctgatattaatctgtgctagaaacttaataggctgtcaatatat

SEQ ID NO: 86981 - DNA, 434 bp, Homo sapiens
taaagttgagtgttcctcaatcagaaattgcaatattttatttaaatgagacagagatctcttagtttgagttgtaatagcaaacctcagagatagtcccatatagcctgggcaacataaggagactctgcctctatgaaaaatttactttttaaattattttattttgtagatatggggttttgccatattgcccaggctgttcttgaactcctgaactcaagctcacccctcggcctcccaaagtgctgtgattacaggtgtgagccaccatgcccagctcctacaaaaaattttaaaattagccagtcatagtggtgcgttcctgtaatcccagctacttgggagaagggggtgtggacactgaggcagaaggatcacttgagcccaggaggtcaaggctgtagtgagccatgatcatgctactgcactgc

SEQ ID NO: 86982 - DNA, 398 bp, Homo sapiens
aatagtcttccagatgtgtgacaactttgagcttagctacagccattatctacattttggaaggggagtggaaaactgagttcattatttaaattatacgggaaaattgaattcttattgccttcctggcctgattgcctcgggaaaaggtagttttattttattttttgcctttctaccaatttcttcaacactgtatttgacctgacgaatgtaaacacagtagaactttccacagtaccttgcatttgccataagaaagatgttattgccaccaaggggtgacatttcttgactgtggaagtagtctagttatttagaattcaacttttattttgtgcttactttccctagttcttgatattaactatacttaatatgtaccaatctgcccagtt

SEQ ID NO: 86983 - DNA, 487 bp, Homo sapiens
caacaaagcattggtaagcatggaaacttgcttaatgcaaccaagaaaacacgagtcctacagagattaatgctggcagcaccaatcacaaaatacaacttagtaaaaagaattttctgttttctggattaggctgagaaaagtgtcttctgatatgtatcatcatgcacatacaaatatataaagccacacagaatagacaaatgataaacaaggcacagtggcaatagctacttcagaaagcctgctacattagaaatcgaacttaagtgtgcaaagggggagaatgctaagtagataaatacttaagtaataggctgttcaataggtctttcccatttagagcactgagacattttctcttccctctctttgtgggagagaagggaggtgctccaatgcaaatcaaaccagggaggaagctagaaaaccacttgcaggacagtaaaatgcttaccagaaaggaagattgacatcttacttcact

SEQ ID NO: 86984 - DNA, 452 bp, Homo sapiens
tacaaatagcacaaaccttcttccaagctccaggttttcccatggcctcttctcttagattaactgctatctcccttaaatgtccatagttggaagcatgggacatgcttggccctctgcagacaccctatattggagtgcaccttctggctgaaaagtaacagaggcattcaggccccatggtagcagcagcagcttgatacaggccgcatggggccataggaagagcacaggcccttgagtcaggagtcttggttctgtttcagccaagtagggtgatgtcagacaagtcctttgcctctcttggtctcagtttcctcatctgtaaactaggatttcggtgaggcttgaaagacaagatagttcccaaattattaccaaatcagactctaaacccattaacatatttaattgaaacagatacatacccacatccagacttttaccagatg

SEQ ID NO: 86985 - DNA, 290 bp, Homo sapiens
gctattcttgaactcctgagctgaagtggtcctcccgcctcggactcccaaagtgctgggattacagacatgagccattgtgccaggccagtatttcctttaaatcgttgttttcaatttcttttcttaccagatttttttttttttaagaaaatgctggccaggtgcagtggctcacacctgtaacaccaacactttgagaggccaaggcaggaggattgcttgcacccaggagtttgagaccagcctgggcaacatagggagaggagaccctgtctctacaaaaagat

SEQ ID NO: 86986 - DNA, 535 bp, Homo sapiens
ggggagagcagccagcaggcagggcacctgtgtacgtcgatgactgaccaccccatggtaccccagatctatctccccaaaacactattctttctgcctgggacccacagctcggggaccgccaagccccccttccagctttcagaccagctacaacagcaggacccgccagggcccgccagcagctcggcacccaccctgggccttctccccgccatcgccaccaccatcgctgtctgcttcctgctgcatagccttgggccctcctgacctcggccaccccaagtggagaagccagagaaatgacacaggggtcttcggccacacccaactgctcctgccaccacctccagggggtgcccaacacgtcgagggcagtccacatgggattggctagacactctagagctttactgtacccaagttacatcttcttttttgtagaaggatcttaatttcccatagtgctatggggctcttttgtaaaatacgtgtccatattaaaaaagaaaaatgtatttattctaccgataaa

SEQ ID NO: 86987 - DNA, 199 bp, Homo sapiens
  misc_feature (46)..(46): n is a, c, g, or t
aaaaccaaaggggttcgcccccccctttgggcacttttgggaaaanaattgattttccaaagagaaaaaaagtttgccagaagtttgtcaagtcaaccaatgtagaaagctttgcttatggtaataaaaatggctcatacttatatagcacttactttgttgcaagtactgctgtaaataaatgctttatgcaaaccaa

SEQ ID NO: 86988 - DNA, 4754 bp, Homo sapiens
cggagccgtgtgcgccgggagcgcggaacagcttgtccacccgccggccggaccagggctcctgaacctagcccagctggacggagaaatggactctagcctcctctgatagcctcatgccaggccccgtgcacattgctttgcttgcctccctcaatcctcatagcttctctttgggaagcctttgggtctgaagtgtctgtgagacctcacagaagagcacccctgggctccacttacctgccccctgctccttcagggatggaggcaatggcggccagcacttccctgcctgaccctggagactttgaccggaacgtgccccggatctgtggggtgtgtggagaccgagccactggctttcacttcaatgctatgacctgtgaaggctgcaaaggcttcttcaggcgaagcatgaagcggaaggcactattcacctgccccttcaacggggactgccgcatcaccaaggacaaccgacgccactgccaggcctgccggctcaaacgctgtgtggacatcggcatgatgaaggagttcattctgacagatgaggaagtgcagaggaagcgggagatgatcctgaagcggaaggaggaggaggccttgaaggacagtctgcggcccaagctgtctgaggagcagcagcgcatcattgccatactgctggacgcccaccataagacctacgaccccacctactccgacttctgccagttccggcctccagttcgtgtgaatgatggtggagggagccatccttccaggcccaactccagacacactcccagcttctctggggactcctcctcctcctgctcagatcactgtatcacctcttcagacatgatggactcgtccagcttctccaatctggatctgagtgaagaagattcagatgacccttctgtgaccctagagctgtcccagctctccatgctgccccacctggctgacctggtcagttacagcatccaaaaggtcattggctttgctaagatgataccaggattcagagacctcacctctgaggaccagatcgtactgctgaagtcaagtgccattgaggtcatcatgttgcgctccaatgagtccttcaccatggacgacatgtcctggacctgtggcaaccaagactacaagtaccgcgtcagtgacgtgaccaaagccggacacagcctggagctgattgagcccctcatcaagttccaggtgggactgaagaagctgaacttgcatgaggaggagcatgtcctgctcatggccatctgcatcgtctccccagatcgtcctggggtgcaggacgccgcgctgattgaggccatccaggaccgcctgtccaacacactgcagacgtacatccgctgccgccacccgcccccgggcagccacctgctctatgccaagatgatccagaagctagccgacctgcgcagcctcaatgaggagcactccaagcagtaccgctgcctctccttccagcctgagtgcagcatgaagctaacgccccttgtgctcgaagtgtttggcaatgagatctcctgactaggacagcctgtggcggtgcctgggtggggctgctcctccagggccacgtgccaggcccggggctggcggctactcagcagccctcctcaccccgtctggggttcagcccctcctctgccacctcccctatccacccagcccattctctctcctgtccaacctaacccctttcctgcgggcttttccccggtcccttgagacctcagccatgaggagttgctgtttgtttgacaaagaaacccaagtgggggcagagggcagaggctggaggcagggccttgcccagagatgcctccaccgctgcctaagtggctgctgactgatgttgagggaacagacaggagaaatgcatccattcctcagggacagagacacctgcacctccccccactgcaggccccgcttgtccagcgcctagtggggtctccctctcctgcctactcacgataaataatcggcccacagctcccaccccacccccttcagtgcccaccaacatcccattgccctggttatattctcacgggcagtagctgtggtgaggtgggttttcttcccatcactggagcaccaggcacgaacccacctgctgagagacccaaggaggaaaaacagacaaaaacagcctcacagaagaatatgacagctgtccctgtcaccaagctcacagttcctcgccctgggtctaaggggttggttgaggtggaagccctccttccacggatccatgtagcaggactgaattgtccccagtttgcagaaaagcacctgccgacctcgtcctcccccgccagtgccttacctcctgcccaggagagccagccctccctgtcctcctcggatcaccgagagtagccgagagcctgctcccccaccccctccccaggggagagggtctggagaagcagtgagccgcatcttctccatctggcagggtgggatggaggagaagaattttcagaccccagcggctgagtcatgatctccctgccgcctcaatgtggttgcaaggccgctgttcacccacagggctaagagctagcgctgccgcaccccagagtgtgggaagggagagcggggcagtctcgggtggctagtcagagagagtgtttgggggttccgtgatgtagggtaaggtgccttcttattctcactccaccacccaaaagtcaaaaggtgcctgtgaggcaggggcggagtgatacaacttcaagtgcatgctctctgcagccagcccagcccagctggtgggaagcgtctgtccgtttactccaaggtggggtctttgtgagagtgagctgtaggtgtgcgggaccggtacagaaaggcgttcttcgaggtggatcacagaggcttcttcagatcagtgcttgagtttggggaatgcggccgcattccctgagtcaccaggaatgttaaagtcagtgggaacgtgactgccccaactcctggaagctgtgtccttgcacctgcatccgtagttccctgaaaacccagagaggaatcagacttcacactgcaagagccttggtgtccacctggccccatgtctctcagaattcttcaggtggaaaaacatctgaaagccacgttccttactgcagaatagcatatatatcgcttaatcttaaatttattagatatgagttgttttcagactcagactccatttgtattatagtctaatatacagggtagcaggtaccactgatttggagatatttatggggggagaacttacattgtgaaacttctgtacattaattattattgctgttgttattttacaagggtctagggagagacccttgtttgattttagctgcagaacgtattggtccagcttgctcttcagtgggagaaaacacttgtaagttgctaaacgagtcaatcccctcattaaggaaaactgacagaggagggcgtgactcacccaagcatatataactagctagaagtgggccaggacaggccgggcgcggtggctcacgcctgtaatcccagcagtttgggaggtcgaggtaggtggatcacctgaggtcgggagttcgagaccaacctgaccaacatggagaaaccctgtctctattaaaaatacaaaaaaaaaaaaaaaaaaaaatagccgggcatggtggcgcaagcctgtaatcccagctactcaggaggctgaggcagaagaattgaacccaggaggtggaggttgcagtgagctgagatcgtgccgttactctccaacctggacaacaagagcgaaactccgtcttagaagtggaccaggacaggaccagattttggagtcatggtccggtgtccttttcactacaccatgtttgagctcagacccccactctcattccccaggtggctgacccagtccctgggggaagccctggatttcagaaagagcaagtctggatctgggaccctttccttccttccctggcttgtaactccaccaacccatcagaaggagaaggaaggagactcacctctgcctcaatgtgaatcagaccctaccccaccacgatgtggccctggcctgctgggctctccacctcagccttggataatgctgttgcctcatctataacatgcatttgtctttgtaatgtcaccaccttcccagctctccctctggccctgccttcttcggggaactcctggaaatatcagttactcagccctgggccccaccacctaggccactcctccaaaggaagtctaggagctgggaggaaaagaaaagaggggaaaatgagtttttatggggctgaacggggagaaaaggtcatcatcgattctactttagaatgagagtgtgaaatagacatttgtaaatgtaaaacttttaaggtatatcattataactgaaggagaaggtgccccaaaatgcaagattttccacaagattcccagagacaggaaaatcctctggctggctaactggaagcatgtaggagaatccaagcgaggtcaacagagaaggcaggaatgtgtggcagatttagtgaaagctagagatatggcagcgaaaggatgtaaacagtgcctgctgaatgatttccaaagagaaaaaaagtttgccagaagtttgtcaagtcaaccaatgtagaaagctttgcttatggtaataaaaatggctcatacttatatagcacttactttgttgcaagtactgctgtaaataaatgctttatgcaaaccaa

SEQ ID NO: 86989 - DNA, 4470 bp, Homo sapiens
cggagccgtgtgcgccgggagcgcggaacagcttgtccacccgccggccggaccagggctcctgaacctagcccagctggacggagaaatggactctagcctcctctgatagcctcatgccaggccccgtgcacattgctttgcttgcctccctcaatcctcatagcttctctttgggaagcctttgggtctgaagtgtctgtgagacctcacagaagagcacccctgggctccacttacctgccccctgctccttcagggatggaggcaatggcggccagcacttccctgcctgaccctggagactttgaccggaacgtgccccggatctgtggggtgtgtggagaccgagccactggctttcacttcaatgctatgacctgtgaaggctgcaaaggcttcttcaggcgaagcatgaagcggaaggcactattcacctgccccttcaacggggactgccgcatcaccaaggacaaccgacgccactgccaggcctgccggctcaaacgctgtgtggacatcggcatgatgaaggagttcattctgacagatgaggaagtgcagaggaagcgggagatgatcctgaagcggaaggaggaggaggccttgaaggacagtctgcggcccaagctgtctgaggagcagcagcgcatcattgccatactgctggacgcccaccataagacctacgaccccacctactccgacttctgccagttccggcctccagttcgtgtgaatgatggtggagggagccatccttccaggcccaactccagacacactcccagcttctctggggactcctcctcctcctgctcagatcactgtatcacctcttcagacatgatggactcgtccagcttctccaatctggatctgagtgaagaagattcagatgacccttctgtgaccctagagctgtcccagctctccatgctgccccacctggctgacctggtcagttacagcatccaaaaggtcattggctttgctaagatgataccaggattcagagacctcacctctgaggaccagatcgtactgctgaagtcaagtgccattgaggtcatcatgttgcgctccaatgagtccttcaccatggacgacatgtcctggacctgtggcaaccaagactacaagtaccgcgtcagtgacgtgaccaaagccggacacagcctggagctgattgagcccctcatcaagttccaggtgggactgaagaagctgaacttgcatgaggaggagcatgtcctgctcatggccatctgcatcgtctccccagatcgtcctggggtgcaggacgccgcgctgattgaggccatccaggaccgcctgtccaacacactgcagacgtacatccgctgccgccacccgcccccgggcagccacctgctctatgccaagatgatccagaagctagccgacctgcgcagcctcaatgaggagcactccaagcagtaccgctgcctctccttccagcctgagtgcagcatgaagctaacgccccttgtgctcgaagtgtttggcaatgagatctcctgactaggacagcctgtggcggtgcctgggtggggctgctcctccagggccacgtgccaggcccggggctggcggctactcagcagccctcctcaccccgtctggggttcagcccctcctctgccacctcccctatccacccagcccattctctctcctgtccaacctaacccctttcctgcgggcttttccccggtcccttgagacctcagccatgaggagttgctgtttgtttgacaaagaaacccaagtgggggcagagggcagaggctggaggcagggccttgcccagagatgcctccaccgctgcctaagtggctgctgactgatgttgagggaacagacaggagaaatgcatccattcctcagggacagagacacctgcacctccccccactgcaggccccgcttgtccagcgcctagtggggtctccctctcctgcctactcacgataaataatcggcccacagctcccaccccacccccttcagtgcccaccaacatcccattgccctggttatattctcacgggcagtagctgtggtgaggtgggttttcttcccatcactggagcaccaggcacgaacccacctgctgagagacccaaggaggaaaaacagacaaaaacagcctcacagaagaatatgacagctgtccctgtcaccaagctcacagttcctcgccctgggtctaaggggttggttgaggtggaagccctccttccacggatccatgtagcaggactgaattgtccccagtttgcagaaaagcacctgccgacctcgtcctcccccgccagtgccttacctcctgcccaggagagccagccctccctgtcctcctcggatcaccgagagtagccgagagcctgctcccccaccccctccccaggggagagggtctggagaagcagtgagccgcatcttctccatctggcagggtgggatggaggagaagaattttcagaccccagcggctgagtcatgatctccctgccgcctcaatgtggttgcaaggccgctgttcacccacagggctaagagctagcgctgccgcaccccagagtgtgggaagggagagcggggcagtctcgggtggctagtcagagagagtgtttgggggttccgtgatgtagggtaaggtgccttcttattctcactccaccacccaaaagtcaaaaggtgcctgtgaggcaggggcggagtgatacaacttcaagtgcatgctctctgcagccagcccagcccagctggtgggaagcgtctgtccgtttactccaaggtggggtctttgtgagagtgagctgtaggtgtgcgggaccggtacagaaaggcgttcttcgaggtggatcacagaggcttcttcagatcagtgcttgagtttggggaatgcggccgcattccctgagtcaccaggaatgttaaagtcagtgggaacgtgactgccccaactcctggaagctgtgtccttgcacctgcatccgtagttccctgaaaacccagagaggaatcagacttcacactgcaagagccttggtgtccacctggccccatgtctctcagaattcttcaggtggaaaaacatctgaaagccacgttccttactgcagaatagcatatatatcgcttaatcttaaatttattagatatgagttgttttcagactcagactccatttgtattatagtctaatatacagggtagcaggtaccactgatttggagatatttatggggggagaacttacattgtgaaacttctgtacattaattattattgctgttgttattttacaagggtctagggagagacccttgtttgattttagctgcagaacgtattggtccagcttgctcttcagtgggagaaaacacttgtaagttgctaaacgagtcaatcccctcattaaggaaaactgacagaggagggcgtgactcacccaagcatatataactagctagaagtgggccaggacaggccgggcgcggtggctcacgcctgtaatcccagcagtttgggaggtcgaggtaggtggatcacctgaggtcgggagttcgagaccaacctgaccaacatggagaaaccctgtctctattaaaaatacaaaaaaaaaaaaaaaaaaaaatagccgggcatggtggcgcaagcctgtaatcccagctactcaggaggctgaggcagaagaattgaacccaggaggtggaggttgcagtgagctgagatcgtgccgttactctccaacctggacaacaagagcgaaactccgtcttagaagtggaccaggacaggaccagattttggagtcatggtccggtgtccttttcactacaccatgtttgagctcagacccccactctcattccccaggtggctgacccagtccctgggggaagccctggatttcagaaagagcaagtctggatctgggaccctttccttccttccctggcttgtaactccaccaacccatcagaaggagaaggaaggagactcacctctgcctcaatgtgaatcagaccctaccccaccacgatgtggccctggcctgctgggctctccacctcagccttggataatgctgttgcctcatctataacatgcatttgtctttgtaatgtcaccaccttcccagctctccctctggccctgccttcttcggggaactctggaagcatgtaggagaatccaagcgaggtcaacagagaaggcaggaatgtgtggcagatttagtgaaagctagagatatggcagcgaaaggatgtaaacagtgcctgctgaatgatttccaaagagaaaaaaagtttgccagaagtttgtcaagtcaaccaatgtagaaagctttgcttatggtaataaaaatggctcatacttatatagcacttactttgttgcaagtactgctgtaaataaatgctttatgcaaaccaa

SEQ ID NO: 86990 - DNA, 2385 bp, Homo sapiens
cggagccgtgtgcgccgggagcgcggaacagcttgtccacccgccggccggaccagaagcctttgggtctgaagtgtctgtgagacctcacagaagagcacccctgggctccacttacctgccccctgctccttcagggatggaggcaatggcggccagcacttccctgccgcctcaatgtggttgcaaggccgctgttcacccacagggctaagagctagcgctgccgcaccccagagtgtgggaagggagagcggggcagtctcgggtggctagtcagagagagtgtttgggggttccgtgatgtagggtaaggtgccttcttattctcactccaccacccaaaagtcaaaaggtgcctgtgaggcaggggcggagtgatacaacttcaagtgcatgctctctgcagccagcccagcccagctggtgggaagcgtctgtccgtttactccaaggtggggtctttgtgagagtgagctgtaggtgtgcgggaccggtacagaaaggcgttcttcgaggtggatcacagaggcttcttcagatcagtgcttgagtttggggaatgcggccgcattccctgagtcaccaggaatgttaaagtcagtgggaacgtgactgccccaactcctggaagctgtgtccttgcacctgcatccgtagttccctgaaaacccagagaggaatcagacttcacactgcaagagccttggtgtccacctggccccatgtctctcagaattcttcaggtggaaaaacatctgaaagccacgttccttactgcagaatagcatatatatcgcttaatcttaaatttattagatatgagttgttttcagactcagactccatttgtattatagtctaatatacagggtagcaggtaccactgatttggagatatttatggggggagaacttacattgtgaaacttctgtacattaattattattgctgttgttattttacaagggtctagggagagacccttgtttgattttagctgcagaacgtattggtccagcttgctcttcagtgggagaaaacacttgtaagttgctaaacgagtcaatcccctcattaaggaaaactgacagaggagggcgtgactcacccaagcatatataactagctagaagtgggccaggacaggccgggcgcggtggctcacgcctgtaatcccagcagtttgggaggtcgaggtaggtggatcacctgaggtcgggagttcgagaccaacctgaccaacatggagaaaccctgtctctattaaaaatacaaaaaaaaaaaaaaaaaaaaatagccgggcatggtggcgcaagcctgtaatcccagctactcaggaggctgaggcagaagaattgaacccaggaggtggaggttgcagtgagctgagatcgtgccgttactctccaacctggacaacaagagcgaaactccgtcttagaagtggaccaggacaggaccagattttggagtcatggtccggtgtccttttcactacaccatgtttgagctcagacccccactctcattccccaggtggctgacccagtccctgggggaagccctggatttcagaaagagcaagtctggatctgggaccctttccttccttccctggcttgtaactccaccaacccatcagaaggagaaggaaggagactcacctctgcctcaatgtgaatcagaccctaccccaccacgatgtggccctggcctgctgggctctccacctcagccttggataatgctgttgcctcatctataacatgcatttgtctttgtaatgtcaccaccttcccagctctccctctggccctgccttcttcggggaactcctggaaatatcagttactcagccctgggccccaccacctaggccactcctccaaaggaagtctaggagctgggaggaaaagaaaagaggggaaaatgagtttttatggggctgaacggggagaaaaggtcatcatcgattctactttagaatgagagtgtgaaatagacatttgtaaatgtaaaacttttaaggtatatcattataactgaaggagaaggtgccccaaaatgcaagattttccacaagattcccagagacaggaaaatcctctggctggctaactggaagcatgtaggagaatccaagcgaggtcaacagagaaggcaggaatgtgtggcagatttagtgaaagctagagatatggcagcgaaaggatgtaaacagtgcctgctgaatgatttccaaagagaaaaaaagtttgccagaagtttgtcaagtcaaccaatgtagaaagctttgcttatggtaataaaaatggctcatacttatatagcacttactttgttgcaagtactgctgtaaataaatgctttatgcaaaccaa

SEQ ID NO: 86991 - DNA, 2434 bp, Homo sapiens
cggagccgtgtgcgccgggagcgcggaacagcttgtccacccgccggccggaccagggctcctgaacctagcccagctggacggagaaatggactctagcctcctctgatagcctcatgccaggccccgtgcacattgctttgcttgcctccctcaatcctcatagcttctctttgggaagcctttgggtctgaagtgtctgtgagacctcacagaagagcacccctgggctccacttacctgccccctgctccttcagggatggaggcaatggcggccagcacttccctgcctgaccctggagactttgaccggaacgtgccccggatctgtggggtgtgtggagaccgtgatgtagggtaaggtgccttcttattctcactccaccacccaaaagtcaaaaggtgcctgtgaggcaggggcggagtgatacaacttcaagtgcatgctctctgcagccagcccagcccagctggtgggaagcgtctgtccgtttactccaaggtggggtctttgtgagagtgagctgtaggtgtgcgggaccggtacagaaaggcgttcttcgaggtggatcacagaggcttcttcagatcagtgcttgagtttggggaatgcggccgcattccctgagtcaccaggaatgttaaagtcagtgggaacgtgactgccccaactcctggaagctgtgtccttgcacctgcatccgtagttccctgaaaacccagagaggaatcagacttcacactgcaagagccttggtgtccacctggccccatgtctctcagaattcttcaggtggaaaaacatctgaaagccacgttccttactgcagaatagcatatatatcgcttaatcttaaatttattagatatgagttgttttcagactcagactccatttgtattatagtctaatatacagggtagcaggtaccactgatttggagatatttatggggggagaacttacattgtgaaacttctgtacattaattattattgctgttgttattttacaagggtctagggagagacccttgtttgattttagctgcagaacgtattggtccagcttgctcttcagtgggagaaaacacttgtaagttgctaaacgagtcaatcccctcattaaggaaaactgacagaggagggcgtgactcacccaagcatatataactagctagaagtgggccaggacaggccgggcgcggtggctcacgcctgtaatcccagcagtttgggaggtcgaggtaggtggatcacctgaggtcgggagttcgagaccaacctgaccaacatggagaaaccctgtctctattaaaaatacaaaaaaaaaaaaaaaaaaaaatagccgggcatggtggcgcaagcctgtaatcccagctactcaggaggctgaggcagaagaattgaacccaggaggtggaggttgcagtgagctgagatcgtgccgttactctccaacctggacaacaagagcgaaactccgtcttagaagtggaccaggacaggaccagattttggagtcatggtccggtgtccttttcactacaccatgtttgagctcagacccccactctcattccccaggtggctgacccagtccctgggggaagccctggatttcagaaagagcaagtctggatctgggaccctttccttccttccctggcttgtaactccaccaacccatcagaaggagaaggaaggagactcacctctgcctcaatgtgaatcagaccctaccccaccacgatgtggccctggcctgctgggctctccacctcagccttggataatgctgttgcctcatctataacatgcatttgtctttgtaatgtcaccaccttcccagctctccctctggccctgccttcttcggggaactcctggaaatatcagttactcagccctgggccccaccacctaggccactcctccaaaggaagtctaggagctgggaggaaaagaaaagaggggaaaatgagtttttatggggctgaacggggagaaaaggtcatcatcgattctactttagaatgagagtgtgaaatagacatttgtaaatgtaaaacttttaaggtatatcattataactgaaggagaaggtgccccaaaatgcaagattttccacaagattcccagagacaggaaaatcctctggctggctaactggaagcatgtaggagaatccaagcgaggtcaacagagaaggcaggaatgtgtggcagatttagtgaaagctagagatatggcagcgaaaggatgtaaacagtgcctgctgaatgatttccaaagagaaaaaaagtttgccagaagtttgtcaagtcaaccaatgtagaaagctttgcttatggtaataaaaatggctcatacttatatagcacttactttgttgcaagtactgctgtaaataaatgctttatgcaaaccaa

SEQ ID NO: 86992 - DNA, 1725 bp, Homo sapiens
tctgaagaagcctctgtgatccacctcgaagaacgcctttctgtaccggtcccgcacacctacagctcactctcacaaagaccccaccttggagtaaacggacagacgcttcccaccagctgggctggcctggctgcagagagcatgcacttgaagttgtatcactccgcccctgcctcacaggtccatttgtattatagtctaatatacagggtagcaggtaccactgatttggagatatttatggggggagaacttacattgtgaaacttctgtacattaattattattgctgttgttattttacaagggtctagggagagacccttgtttgattttagctgcagaacgtattggtccagcttgctcttcagtgggagaaaacacttgtaagttgctaaacgagtcaatcccctcattaaggaaaactgacagaggagggcgtgactcacccaagcatatataactagctagaagtgggccaggacaggccgggcgcggtggctcacgcctgtaatcccagcagtttgggaggtcgaggtaggtggatcacctgaggtcgggagttcgagaccaacctgaccaacatggagaaaccctgtctctattaaaaatacaaaaaaaaaaaaaaaaaaaaatagccgggcatggtggcgcaagcctgtaatcccagctactcaggaggctgaggcagaagaattgaacccaggaggtggaggttgcagtgagctgagatcgtgccgttactctccaacctggacaacaagagcgaaactccgtcttagaagtggaccaggacaggaccagattttggagtcatggtccggtgtccttttcactacaccatgtttgagctcagacccccactctcattccccaggtggctgacccagtccctgggggaagccctggatttcagaaagagcaagtctggatctgggaccctttccttccttccctggcttgtaactccaccaacccatcagaaggagaaggaaggagactcacctctgcctcaatgtgaatcagaccctaccccaccacgatgtggccctggcctgctgggctctccacctcagccttggataatgctgttgcctcatctataacatgcatttgtctttgtaatgtcaccaccttcccagctctccctctggccctgccttcttcggggaactcctggaaatatcagttactcagccctgggccccaccacctaggccactcctccaaaggaagtctaggagctgggaggaaaagaaaagaggggaaaatgagtttttatggggctgaacggggagaaaaggtcatcatcgattctactttagaatgagagtgtgaaatagacatttgtaaatgtaaaacttttaaggtatatcattataactgaaggagaaggtgccccaaaatgcaagattttccacaagattcccagagacaggaaaatcctctggctggctaactggaagcatgtaggagaatccaagcgaggtcaacagagaaggcaggaatgtgtggcagatttagtgaaagctagagatatggcagcgaaaggatgtaaacagtgcctgctgaatgatttccaaagagaaaaaaagtttgccagaagtttgtcaagtcaaccaatgtagaaagctttgcttatggtaataaaaatggctcatacttatatagcacttactttgttgcaagtactgctgtaaataaatgctttatgcaaaccaa

SEQ ID NO: 86993 - DNA, 4632 bp, Homo sapiens
cggagccgtgtgcgccgggagcgcggaacagcttgtccacccgccggccggaccagaagcctttgggtctgaagtgtctgtgagacctcacagaagagcacccctgggctccacttacctgccccctgctccttcagggatggaggcaatggcggccagcacttccctgcctgaccctggagactttgaccggaacgtgccccggatctgtggggtgtgtggagaccgagccactggctttcacttcaatgctatgacctgtgaaggctgcaaaggcttcttcaggcgaagcatgaagcggaaggcactattcacctgccccttcaacggggactgccgcatcaccaaggacaaccgacgccactgccaggcctgccggctcaaacgctgtgtggacatcggcatgatgaaggagttcattctgacagatgaggaagtgcagaggaagcgggagatgatcctgaagcggaaggaggaggaggccttgaaggacagtctgcggcccaagctgtctgaggagcagcagcgcatcattgccatactgctggacgcccaccataagacctacgaccccacctactccgacttctgccagttccggcctccagttcgtgtgaatgatggtggagggagccatccttccaggcccaactccagacacactcccagcttctctggggactcctcctcctcctgctcagatcactgtatcacctcttcagacatgatggactcgtccagcttctccaatctggatctgagtgaagaagattcagatgacccttctgtgaccctagagctgtcccagctctccatgctgccccacctggctgacctggtcagttacagcatccaaaaggtcattggctttgctaagatgataccaggattcagagacctcacctctgaggaccagatcgtactgctgaagtcaagtgccattgaggtcatcatgttgcgctccaatgagtccttcaccatggacgacatgtcctggacctgtggcaaccaagactacaagtaccgcgtcagtgacgtgaccaaagccggacacagcctggagctgattgagcccctcatcaagttccaggtgggactgaagaagctgaacttgcatgaggaggagcatgtcctgctcatggccatctgcatcgtctccccagatcgtcctggggtgcaggacgccgcgctgattgaggccatccaggaccgcctgtccaacacactgcagacgtacatccgctgccgccacccgcccccgggcagccacctgctctatgccaagatgatccagaagctagccgacctgcgcagcctcaatgaggagcactccaagcagtaccgctgcctctccttccagcctgagtgcagcatgaagctaacgccccttgtgctcgaagtgtttggcaatgagatctcctgactaggacagcctgtggcggtgcctgggtggggctgctcctccagggccacgtgccaggcccggggctggcggctactcagcagccctcctcaccccgtctggggttcagcccctcctctgccacctcccctatccacccagcccattctctctcctgtccaacctaacccctttcctgcgggcttttccccggtcccttgagacctcagccatgaggagttgctgtttgtttgacaaagaaacccaagtgggggcagagggcagaggctggaggcagggccttgcccagagatgcctccaccgctgcctaagtggctgctgactgatgttgagggaacagacaggagaaatgcatccattcctcagggacagagacacctgcacctccccccactgcaggccccgcttgtccagcgcctagtggggtctccctctcctgcctactcacgataaataatcggcccacagctcccaccccacccccttcagtgcccaccaacatcccattgccctggttatattctcacgggcagtagctgtggtgaggtgggttttcttcccatcactggagcaccaggcacgaacccacctgctgagagacccaaggaggaaaaacagacaaaaacagcctcacagaagaatatgacagctgtccctgtcaccaagctcacagttcctcgccctgggtctaaggggttggttgaggtggaagccctccttccacggatccatgtagcaggactgaattgtccccagtttgcagaaaagcacctgccgacctcgtcctcccccgccagtgccttacctcctgcccaggagagccagccctccctgtcctcctcggatcaccgagagtagccgagagcctgctcccccaccccctccccaggggagagggtctggagaagcagtgagccgcatcttctccatctggcagggtgggatggaggagaagaattttcagaccccagcggctgagtcatgatctccctgccgcctcaatgtggttgcaaggccgctgttcacccacagggctaagagctagcgctgccgcaccccagagtgtgggaagggagagcggggcagtctcgggtggctagtcagagagagtgtttgggggttccgtgatgtagggtaaggtgccttcttattctcactccaccacccaaaagtcaaaaggtgcctgtgaggcaggggcggagtgatacaacttcaagtgcatgctctctgcagccagcccagcccagctggtgggaagcgtctgtccgtttactccaaggtggggtctttgtgagagtgagctgtaggtgtgcgggaccggtacagaaaggcgttcttcgaggtggatcacagaggcttcttcagatcagtgcttgagtttggggaatgcggccgcattccctgagtcaccaggaatgttaaagtcagtgggaacgtgactgccccaactcctggaagctgtgtccttgcacctgcatccgtagttccctgaaaacccagagaggaatcagacttcacactgcaagagccttggtgtccacctggccccatgtctctcagaattcttcaggtggaaaaacatctgaaagccacgttccttactgcagaatagcatatatatcgcttaatcttaaatttattagatatgagttgttttcagactcagactccatttgtattatagtctaatatacagggtagcaggtaccactgatttggagatatttatggggggagaacttacattgtgaaacttctgtacattaattattattgctgttgttattttacaagggtctagggagagacccttgtttgattttagctgcagaacgtattggtccagcttgctcttcagtgggagaaaacacttgtaagttgctaaacgagtcaatcccctcattaaggaaaactgacagaggagggcgtgactcacccaagcatatataactagctagaagtgggccaggacaggccgggcgcggtggctcacgcctgtaatcccagcagtttgggaggtcgaggtaggtggatcacctgaggtcgggagttcgagaccaacctgaccaacatggagaaaccctgtctctattaaaaatacaaaaaaaaaaaaaaaaaaaaatagccgggcatggtggcgcaagcctgtaatcccagctactcaggaggctgaggcagaagaattgaacccaggaggtggaggttgcagtgagctgagatcgtgccgttactctccaacctggacaacaagagcgaaactccgtcttagaagtggaccaggacaggaccagattttggagtcatggtccggtgtccttttcactacaccatgtttgagctcagacccccactctcattccccaggtggctgacccagtccctgggggaagccctggatttcagaaagagcaagtctggatctgggaccctttccttccttccctggcttgtaactccaccaacccatcagaaggagaaggaaggagactcacctctgcctcaatgtgaatcagaccctaccccaccacgatgtggccctggcctgctgggctctccacctcagccttggataatgctgttgcctcatctataacatgcatttgtctttgtaatgtcaccaccttcccagctctccctctggccctgccttcttcggggaactcctggaaatatcagttactcagccctgggccccaccacctaggccactcctccaaaggaagtctaggagctgggaggaaaagaaaagaggggaaaatgagtttttatggggctgaacggggagaaaaggtcatcatcgattctactttagaatgagagtgtgaaatagacatttgtaaatgtaaaacttttaaggtatatcattataactgaaggagaaggtgccccaaaatgcaagattttccacaagattcccagagacaggaaaatcctctggctggctaactggaagcatgtaggagaatccaagcgaggtcaacagagaaggcaggaatgtgtggcagatttagtgaaagctagagatatggcagcgaaaggatgtaaacagtgcctgctgaatgatttccaaagagaaaaaaagtttgccagaagtttgtcaagtcaaccaatgtagaaagctttgcttatggtaataaaaatggctcatacttatatagcacttactttgttgcaagtactgctgtaaataaatgctttatgcaaaccaa

SEQ ID NO: 86994 - DNA, 4252 bp, Homo sapiens
tacgcgtgtctgcgacacttgcaatgatgaaggagttcattctgacagatgaggaagtgcagaggaagcgggagatgatcctgaagcggaaggaggaggaggccttgaaggacagtctgcggcccaagctgtctgaggagcagcagcgcatcattgccatactgctggacgcccaccataagacctacgaccccacctactccgacttctgccagttccggcctccagttcgtgtgaatgatggtggagggagccatccttccaggcccaactccagacacactcccagcttctctggggactcctcctcctcctgctcagatcactgtatcacctcttcagacatgatggactcgtccagcttctccaatctggatctgagtgaagaagattcagatgacccttctgtgaccctagagctgtcccagctctccatgctgccccacctggctgacctggtcagttacagcatccaaaaggtcattggctttgctaagatgataccaggattcagagacctcacctctgaggaccagatcgtactgctgaagtcaagtgccattgaggtcatcatgttgcgctccaatgagtccttcaccatggacgacatgtcctggacctgtggcaaccaagactacaagtaccgcgtcagtgacgtgaccaaagccggacacagcctggagctgattgagcccctcatcaagttccaggtgggactgaagaagctgaacttgcatgaggaggagcatgtcctgctcatggccatctgcatcgtctccccagatcgtcctggggtgcaggacgccgcgctgattgaggccatccaggaccgcctgtccaacacactgcagacgtacatccgctgccgccacccgcccccgggcagccacctgctctatgccaagatgatccagaagctagccgacctgcgcagcctcaatgaggagcactccaagcagtaccgctgcctctccttccagcctgagtgcagcatgaagctaacgccccttgtgctcgaagtgtttggcaatgagatctcctgactaggacagcctgtggcggtgcctgggtggggctgctcctccagggccacgtgccaggcccggggctggcggctactcagcagccctcctcaccccgtctggggttcagcccctcctctgccacctcccctatccacccagcccattctctctcctgtccaacctaacccctttcctgcgggcttttccccggtcccttgagacctcagccatgaggagttgctgtttgtttgacaaagaaacccaagtgggggcagagggcagaggctggaggcagggccttgcccagagatgcctccaccgctgcctaagtggctgctgactgatgttgagggaacagacaggagaaatgcatccattcctcagggacagagacacctgcacctccccccactgcaggccccgcttgtccagcgcctagtggggtctccctctcctgcctactcacgataaataatcggcccacagctcccaccccacccccttcagtgcccaccaacatcccattgccctggttatattctcacgggcagtagctgtggtgaggtgggttttcttcccatcactggagcaccaggcacgaacccacctgctgagagacccaaggaggaaaaacagacaaaaacagcctcacagaagaatatgacagctgtccctgtcaccaagctcacagttcctcgccctgggtctaaggggttggttgaggtggaagccctccttccacggatccatgtagcaggactgaattgtccccagtttgcagaaaagcacctgccgacctcgtcctcccccgccagtgccttacctcctgcccaggagagccagccctccctgtcctcctcggatcaccgagagtagccgagagcctgctcccccaccccctccccaggggagagggtctggagaagcagtgagccgcatcttctccatctggcagggtgggatggaggagaagaattttcagaccccagcggctgagtcatgatctccctgccgcctcaatgtggttgcaaggccgctgttcacccacagggctaagagctagcgctgccgcaccccagagtgtgggaagggagagcggggcagtctcgggtggctagtcagagagagtgtttgggggttccgtgatgtagggtaaggtgccttcttattctcactccaccacccaaaagtcaaaaggtgcctgtgaggcaggggcggagtgatacaacttcaagtgcatgctctctgcagccagcccagcccagctggtgggaagcgtctgtccgtttactccaaggtggggtctttgtgagagtgagctgtaggtgtgcgggaccggtacagaaaggcgttcttcgaggtggatcacagaggcttcttcagatcagtgcttgagtttggggaatgcggccgcattccctgagtcaccaggaatgttaaagtcagtgggaacgtgactgccccaactcctggaagctgtgtccttgcacctgcatccgtagttccctgaaaacccagagaggaatcagacttcacactgcaagagccttggtgtccacctggccccatgtctctcagaattcttcaggtggaaaaacatctgaaagccacgttccttactgcagaatagcatatatatcgcttaatcttaaatttattagatatgagttgttttcagactcagactccatttgtattatagtctaatatacagggtagcaggtaccactgatttggagatatttatggggggagaacttacattgtgaaacttctgtacattaattattattgctgttgttattttacaagggtctagggagagacccttgtttgattttagctgcagaacgtattggtccagcttgctcttcagtgggagaaaacacttgtaagttgctaaacgagtcaatcccctcattaaggaaaactgacagaggagggcgtgactcacccaagcatatataactagctagaagtgggccaggacaggccgggcgcggtggctcacgcctgtaatcccagcagtttgggaggtcgaggtaggtggatcacctgaggtcgggagttcgagaccaacctgaccaacatggagaaaccctgtctctattaaaaatacaaaaaaaaaaaaaaaaaaaaatagccgggcatggtggcgcaagcctgtaatcccagctactcaggaggctgaggcagaagaattgaacccaggaggtggaggttgcagtgagctgagatcgtgccgttactctccaacctggacaacaagagcgaaactccgtcttagaagtggaccaggacaggaccagattttggagtcatggtccggtgtccttttcactacaccatgtttgagctcagacccccactctcattccccaggtggctgacccagtccctgggggaagccctggatttcagaaagagcaagtctggatctgggaccctttccttccttccctggcttgtaactccaccaacccatcagaaggagaaggaaggagactcacctctgcctcaatgtgaatcagaccctaccccaccacgatgtggccctggcctgctgggctctccacctcagccttggataatgctgttgcctcatctataacatgcatttgtctttgtaatgtcaccaccttcccagctctccctctggccctgccttcttcggggaactcctggaaatatcagttactcagccctgggccccaccacctaggccactcctccaaaggaagtctaggagctgggaggaaaagaaaagaggggaaaatgagtttttatggggctgaacggggagaaaaggtcatcatcgattctactttagaatgagagtgtgaaatagacatttgtaaatgtaaaacttttaaggtatatcattataactgaaggagaaggtgccccaaaatgcaagattttccacaagattcccagagacaggaaaatcctctggctggctaactggaagcatgtaggagaatccaagcgaggtcaacagagaaggcaggaatgtgtggcagatttagtgaaagctagagatatggcagcgaaaggatgtaaacagtgcctgctgaatgatttccaaagagaaaaaaagtttgccagaagtttgtcaagtcaaccaatgtagaaagctttgcttatggtaataaaaatggctcatacttatatagcacttactttgttgcaagtactgctgtaaataaatgctttatgcaaaccaa

SEQ ID NO: 86995 - DNA, 4255 bp, Homo sapiens
cggagccgtgtgcgccgggagcgcggaacagcttgtccacccgccggccggaccagggctcctgaacctagcccagctggacggagaaatggactctagcctcctctgatagcctcatgccaggccccgtgcacattgctttgcttgcctccctcaatcctcatagcttctctttgggaagcctttgggtctgaagtgtctgtgagacctcacagaagagcacccctgggctccacttacctgccccctgctccttcagggatggaggcaatggcggccagcacttccctgcctgaccctggagactttgaccggaacgtgccccggatctgtggggtgtgtggagaccgagccactggctttcacttcaatgctatgacctgtgaaggctgcaaaggcttcttcaggcgaagcatgaagcggaaggcactattcacctgccccttcaacggggactgccgcatcaccaaggacaaccgacgccactgccaggcctgccggctcaaacgctgtgtggacatcggcatgatgaaggagttcattctgacagatgaggaagtgcagaggaagcgggagatgatcctgaagcggaaggaggaggaggccttgaaggacagtctgcggcccaagctgtctgaggagcagcagcgcatcattgccatactgctggacgcccaccataagacctacgaccccacctactccgacttctgccagttccggcctccagttcgtgtgaatgatggtggagggagccatccttccaggcccaactccagacacactcccagcttctctggggactcctcctcctcctgctcagatcactgtatcacctcttcagacatgatggactcgtccagcttctccaatctggatctgagtgaagaagattcagatgacccttctgtgaccctagagctgtcccagctctccatgctgccccacctggctgacctggtcagttacagcatccaaaaggtcattggctttgctaagatgataccaggattcagagacctcacctctgaggaccagatcgtactgctgaagtcaagtgccattgaggtcatcatgttgcgctccaatgagtccttcaccatggacgacatgtcctggacctgtggcaaccaagactacaagtaccgcgtcagtgacgtgaccaaagccggacacagcctggagctgattgagcccctcatcaagttccaggtgggactgaagaagctgaacttgcatgaggaggagcatgtcctgctcatggccatctgcatcgtctccccagatcgtcctggggtgcaggacgccgcgctgattgaggccatccaggaccgcctgtccaacacactgcagacgtacatccgctgccgccacccgcccccgggcagccacctgctctatgccaagatgatccagaagctagccgacctgcgcagcctcaatgaggagcactccaagcagtaccgctgcctctccttccagcctgagtgcagcatgaagctaacgccccttgtgctcgaagtgtttggcaatgagatctcctgactaggacagcctgtggcggtgcctgggtggggctgctcctccagggccacgtgccaggcccggggctggcggctactcagcagccctcctcaccccgtctggggttcagcccctcctctgccacctcccctatccacccagcccattctctctcctgtccaacctaacccctttcctgcgggcttttccccggtcccttgagacctcagccatgaggagttgctgtttgtttgacaaagaaacccaagtgggggcagagggcagaggctggaggcagggccttgcccagagatgcctccaccgctgcctaagtggctgctgactgatgttgagggaacagacaggagaaatgcatccattcctcagggacagagacacctgcacctccccccactgcaggccccgcttgtccagcgcctagtggggtctccctctcctgcctactcacgataaataatcggcccacagctcccaccccacccccttcagtgcccaccaacatcccattgccctggttatattctcacgggcagtagctgtggtgaggtgggttttcttcccatcactggagcaccaggcacgaacccacctgctgagagacccaaggaggaaaaacagacaaaaacagcctcacagaagaatatgacagctgtccctgtcaccaagctcacagttcctcgccctgggtctaaggggggcggagtgatacaacttcaagtgcatgctctctgcagccagcccagcccagctggtgggaagcgtctgtccgtttactccaaggtggggtctttgtgagagtgagctgtaggtgtgcgggaccggtacagaaaggcgttcttcgaggtggatcacagaggcttcttcagatcagtgcttgagtttggggaatgcggccgcattccctgagtcaccaggaatgttaaagtcagtgggaacgtgactgccccaactcctggaagctgtgtccttgcacctgcatccgtagttccctgaaaacccagagaggaatcagacttcacactgcaagagccttggtgtccacctggccccatgtctctcagaattcttcaggtggaaaaacatctgaaagccacgttccttactgcagaatagcatatatatcgcttaatcttaaatttattagatatgagttgttttcagactcagactccatttgtattatagtctaatatacagggtagcaggtaccactgatttggagatatttatggggggagaacttacattgtgaaacttctgtacattaattattattgctgttgttattttacaagggtctagggagagacccttgtttgattttagctgcagaacgtattggtccagcttgctcttcagtgggagaaaacacttgtaagttgctaaacgagtcaatcccctcattaaggaaaactgacagaggagggcgtgactcacccaagcatatataactagctagaagtgggccaggacaggccgggcgcggtggctcacgcctgtaatcccagcagtttgggaggtcgaggtaggtggatcacctgaggtcgggagttcgagaccaacctgaccaacatggagaaaccctgtctctattaaaaatacaaaaaaaaaaaaaaaaaaaaatagccgggcatggtggcgcaagcctgtaatcccagctactcaggaggctgaggcagaagaattgaacccaggaggtggaggttgcagtgagctgagatcgtgccgttactctccaacctggacaacaagagcgaaactccgtcttagaagtggaccaggacaggaccagattttggagtcatggtccggtgtccttttcactacaccatgtttgagctcagacccccactctcattccccaggtggctgacccagtccctgggggaagccctggatttcagaaagagcaagtctggatctgggaccctttccttccttccctggcttgtaactccaccaacccatcagaaggagaaggaaggagactcacctctgcctcaatgtgaatcagaccctaccccaccacgatgtggccctggcctgctgggctctccacctcagccttggataatgctgttgcctcatctataacatgcatttgtctttgtaatgtcaccaccttcccagctctccctctggccctgccttcttcggggaactcctggaaatatcagttactcagccctgggccccaccacctaggccactcctccaaaggaagtctaggagctgggaggaaaagaaaagaggggaaaatgagtttttatggggctgaacggggagaaaaggtcatcatcgattctactttagaatgagagtgtgaaatagacatttgtaaatgtaaaacttttaaggtatatcattataactgaaggagaaggtgccccaaaatgcaagattttccacaagattcccagagacaggaaaatcctctggctggctaactggaagcatgtaggagaatccaagcgaggtcaacagagaaggcaggaatgtgtggcagatttagtgaaagctagagatatggcagcgaaaggatgtaaacagtgcctgctgaatgatttccaaagagaaaaaaagtttgccagaagtttgtcaagtcaaccaatgtagaaagctttgcttatggtaataaaaatggctcatacttatatagcacttactttgttgcaagtactgctgtaaataaatgctttatgcaaaccaa

SEQ ID NO: 86996 - DNA, 577 bp, Homo sapiens
cggagccgtgtgcgccgggagcgcggaacagcttgtccacccgccggccggaccagggctcctgaacctagcccagctggacggagaaatggactctagcctcctctgatagcctcatgccaggccccgtgcacattgctttgcttgcctccctcaatcctcatagcttctctttgggaagcctttgggtctgaagtgtctgtgagacctcacagaagagcacccctgggctccacttacctgccccctgctccttcagggatggaggcaatggcggccagcacttccctgcctgaccctggagactttgaccggaacgtgccccggatctgtggggtgtgtggagaccgagccactggctttcacttcaatgctatgacctgtgaaggctgcaaaggcttcttcaggcgaagcatgaagcggaaggcactattcacctgccccttcaacggggactgccgcatcaccaaggcacattcaacgcgctccgggccattcaacagcgctccgggccacccaacggctccggcacagtcaacgctaccggccgtccacgccgccgccaagtgcatcgcgc

SEQ ID NO: 86997 - DNA, 440 bp, Homo sapiens
caataataatgataaggctctttctcattgttgtcagtgtaatttatctatttaattatagaacctagttccaggatgcttaatctgaagtatatacttggggcaaaatgaattatatcttaataataatctggaatttttctctctaacttgacatattttaattcttgctagattttcaaaatgtcatacctcgaaccaccaccagatggctatgagaatgttacaaatattgtgccaccatataatgctttctcagcccaaggcatgccagaggtaaaataaaatacatttgtaacccaagtctttaaatggttcttttgctatataaaacctgtatagaggactaaaaccagggaaattaggtgaatcattcatgcggattcattgtttgatattcagtactatgaaaacctcatccctcaaatttaaaaaattat

SEQ ID NO: 86998 - DNA, 300 bp, Homo sapiens
gacattagttccatgagccataaaaaagtgacattcctttggggatttactgcccctgaatcatgtgagagccccagaaacaaagcatttctcaaatatgcatcattttaggtagatgagaaagaagccacagtcacctccgccctctggactgcagagagcttagctcacatcggcatttgcatccaacagcacaacatggaaagcagtacacaacaagaacaggcagaagtgtcttcataaacacattttgcctaaatattctgtattaaccacagccatccacttacagggtgttag

SEQ ID NO: 86999 - DNA, 209 bp, Homo sapiens
caatatgaatgtctttaaagtcagtatcagcagcaaagaaggtactgcacatacgatgtgcaggggaaaacctttttaccaggcacagaccaccaccaaagcccctctgcctaaatctgtatttgaaaagctaattaaagattttttttttctttggggtcttgaaatactttgcctttgaaagctctttgttaaaatgaaaatgcctt

SEQ ID NO: 87000 - DNA, 184 bp, Homo sapiens
aaatctaaatattattcctcatagcacagtttctggtctccttaaattaaggatcctactcatcaggattgaataaaaagggggaaattcctaaaattggtatattgtataatattgtgggttaagtaaaatttaggggggcattatggaaatgtacctattttaaagggcagtggcaattact

SEQ ID NO: 87001 - DNA, 658 bp, Homo sapiens
  misc_feature (32)..(32): n is a, c, g, or t
gtcctgcttctgagaccagacagcctttcccnatttttgaatcttcctgccgttaagtctaggttagaatttttattaccttatgtctagacaattgcagtggtttcctaactggtctctagtataagaggtcttcaaaaagttcatggaaaatgtgtattatgaaaaaaacttgcatggatttcaaaatttttttgcaccaaaataaactctgtactaactgagcaggatctagtgtgaggcactgagaaggataagacatcagtttgaaaagagcccctatcagagcaacatgaactctgctaaaattcaagtaagaacaaacatccaatttatggtgaaacctggttggaagaatggtgaaatcattgatgctttacaaaaagtttatggagtcacacctgtaatcccagcactttgggaggccaaggcaggcggatcatgaggtcaggagatcgagaccatcctggctaacatggtgaaaccccacatctactaaaaatacaaaaaactagccgggcgtagtgcgggcgcctgtagtcccagccactcgggaggctgaggcaggagaatggcgtgaacccgggaggcggagcttgcagtgagccgagatcgcgccactgcactccagccttggcgactgagcagactccgtctc

SEQ ID NO: 87002 - DNA, 950 bp, Homo sapiens
ctataaggggaaaagaatcacattggtctcagacttgtcatctgttcgttggagtgctacaacatactgctatttttgaagttctgagggagaactgttttgaatttagacttctatcttgagtgaaactgtcaagagtaagggcacagcaaggacattctaccaattttagaacatgcaaggatttcagaaattaactcataaaacacaacctgcacggcatggtatcaaattatgtaaagaaaaacttggtaaacaagaaattgtcaaatttataatcatagctacgtatttgaacacagcgcttagaaattgtcagataaagagttcaaaatagaggaaacattttgaattatatagtgcacaaattttaatagctatagaatatttgttttcaaatgccatgaaaaaatgaccatgaagcaaaaaccacaatatttttttgtttgttgataggtaggaattcagggtccatcctgtcatcacaatgcaatgaaacaaaaaattagcaagtggatagcaataaatcaatttttaaaaatcagacaaaagaaaacactgtccttgtaatgcttgcatttaaaaggaaataaaaacttatgaaagagaatctttattttatttaagcagttctagattatacaaaatgttgaaacatctcaatttggtctctgaggctagcataatccttattccagaaaattgttcatcaaagatagctatagaccagtctcacttacgaacaaatgtaatttgttgaaactggtcatgttgaaaaaacatgaccaattaatatcccaaaataatgtgtcatggtagagtagggtttatctgaaaactgcaacatgacgattatgtaactcaatcctttaggaaatttattactttaacttaaaaaaaaataccataagcttgatagatgctcgaaaaacatttcctaagattgaaca

SEQ ID NO: 87003 - DNA, 229 bp, Homo sapiens
gaggacacagggagaggacggccatctacaagtgaaggagagaggatgcagaatgaactagtcctgttgatactctgatctctaacttctaacccccagaactgtgagaacataaatttctattgtttaagccacctagtctgttgcactttgttatggcagcccaagaaaattaacacagcaaaggttgtagagtgtctctcttggggctttctcaatacctagcaat

SEQ ID NO: 87004 - DNA, 287 bp, Homo sapiens
ggtcagctcaccccttaactataataaccctgtgggagtgagactaatgctatagaaacccagagtaaagcagaatgtatagttacatcttttaaaaaaaaaagcattggcaatctgtagtgggactggatactaagatagaatttaaaacctgtgagttatattttccacgcatttaattaccttgttttactgcctaggcactttacttggtacgatcatctttattttaatcatcattttcctctattggataattttcaagcacagaaaaaggtaagtatagc

SEQ ID NO: 87005 - DNA, 527 bp, Homo sapiens
ttttttttgtgtaatggtatgcttttaagaagtgacagccaatcttgaacgtggcaggggtaggggaagtcccagctccttgaatactggctgtacttgtaattgagaacgtgttctgcctgatgcttacagtttggcagcataattgcggattcttatctgaaacactgaaggttaaaataaatagaagaattgtttctttcacttaacatgcttgtgagattcattcatatgatgtgcacatcagtagtcatccaggctcccatgacttctctaaagaagaaagaaactagtctctttcgcattggacaggggggtcgcttgactggaaaaaacctgcaaggaaaccctctggcatcccaatctgattccaatctgcagaactgtaagaaaaaattgttggtagtgccgtgctcacctgtaatcccacatttgggaggccaaggtgggtggttcgcttgagccatggagttcaaaaccagcctgggcaacatggtaaaactcctctctacagtaccgagtcgatg

SEQ ID NO: 87006 - DNA, 518 bp, Homo sapiens
agcgatttaagagcctcggaaatttcctttaaggtcaggagagaagctggtaacagatggggcgaaggaggaaaagttctttttgcggcaccctcacgccttcccagccctttcgcggtttactcgctccccggaaagcagggcattcaagcagccctgaggagaggtccacatggtgagccactgagggccttgccaagagccagcaccaacggtccaggtttggagtgtaccaccttggaagtgaatcttccagtccagtcaagccttcagatgacttcagaaccgtccatgtaagccactcttggattcctgacccacagaaactgttggagtaagtgatgtttctgaagcaccaatgaaaatgaagtcctgaagtcctgtgctcaatatgaaatgttggaagttagaagaaaaaaacaaaacttggatccaatctcaaggcactttttgtttaatgggaagaagtggattattttaaaagctacaaataaagttacataaaagtagcaaagttg

SEQ ID NO: 87007 - DNA, 699 bp, Homo sapiens
agcgatttaagagcctcggaaatttcctttaaggtcaggagagaagctggtaacagatggggcgaaggaggaaaagttctttttgcggcaccctcacgccttcccagccctttcgcggtttactcgctccccggaaagcagggcattcaagcagccctgaggagaggtccacatggtgagccactgagggccttgccaagagccagcaccaacggtccaggtttggagtgtaccaccttggaagtgaatcttccagtccagtcaagccttcagatgacttcagaaccgtccatgtaagccactcttggattcctgacccacagaaactgttggagaacatcacctgtagtcttgccagtgagatcaaactgaagtccaattaacctctggatccagctgccaatttgcaggaaatagaggagagaagcatctgttgaactgcaccatgagtatacactcagcaaaggccaaactgtggaaaatgatacaggtcaaacagcctggattctttaacagtaagtgatgtttctgaagcaccaatgaaaatgaagtcctgaagtcctgtgctcaatatgaaatgttggaagttagaagaaaaaaacaaaacttggatccaatctcaaggcactttttgtttaatgggaagaagtggattattttaaaagctacaaataaagttacataaaagtagcaaagttg

SEQ ID NO: 87008 - DNA, 638 bp, Homo sapiens
agcgatttaagagcctcggaaatttcctttaaggtcaggagagaagctggtaacagatggggcgaaggaggaaaagttctttttgcggcaccctcacgccttcccagccctttcgcggtttactcgctccccggaaagcagggcattcaagcagccctgaggagaggtccacatggtgagccactgagggccttgccaagagccagcaccaacggtccaggtttggagtgtaccaccttggaagtgaatcttccagtccagtcaagccttcagatgacttcagaaccgtccatgtaagccactcttggattcctgacccacagaaactgttggagctgccaatttgcaggaaatagaggagagaagcatctgttgaactgcaccatgagtatacactcagcaaaggccaaactgtggaaaatgatacaggtcaaacagcctggattctttaacagtaagtgatgtttctgaagcaccaatgaaaatgaagtcctgaagtcctgtgctcaatatgaaatgttggaagttagaagaaaaaaacaaaacttggatccaatctcaaggcactttttgtttaatgggaagaagtggattattttaaaagctacaaataaagttacataaaagtagcaaagttg

SEQ ID NO: 87009 - DNA, 576 bp, Homo sapiens
ggctggtcttgaactcctgacctcaggtgatccacccacctcagcctcccaaagtgctgggattacaggcatgagccaccgtgcctggccttttgtatctgttttattttttaaataataagattaaaaataaatattctgcatgattaaacaaatacagatttaaatttttacagtccaattgagtgatttcctcatgttccaaaaccaggaagtaggtgtgggacatctatctccgtattgcatacacagtctggattctagttgtagactccatatgggctgtcatacacgctactacagaaatgagagaaatccttgggaaatggaaccatctcacacatgagagacatctctgacaacttattcataactgaatacttctcatttatctttaccagtaagtgatgtttctgaagcaccaatgaaaatgaagtcctgaagtcctgtgctcaatatgaaatgttggaagttagaagaaaaaaacaaaacttggatccaatctcaaggcactttttgtttaatgggaagaagtggattattttaaaagctacaaataaagttacataaaagtag

SEQ ID NO: 87010 - DNA, 117 bp, Homo sapiens
gatctgatattgaaccctatgccaaatagcgtggcatgaggccagagaacagtgcttgccttccccgtctccacccaaattgtcccttgctctggatattatgccagttccatattt

SEQ ID NO: 87011 - DNA, 362 bp, Homo sapiens
atattgatactcataagtaaaattggtccataattttttgttttatctttatcaggcatacgtcatcaaagttattctctcttcataggaagttttccttcatgttacatattctccaacagcagaagttcaaagcatgtgaattgtatcagctgtaaagtgtgtattagaaatacatgaatgttactggtatcctctgtaagtccaaggtgccacatatcactcagtgacaaaaggggtttctctgggcggttggaataagttgtcactttgaggagttccatacagctttctgcctgtgcagggaaatctttgctgttgtctaattctgacatggtttggatctgtgtccccacccaaat

SEQ ID NO: 87012 - DNA, 357 bp, Homo sapiens
gcacggcgaagtaagaaaagatcaacaaattaatgacctaaatgtatgataaacagtaggcatacttctgaaatccagaactggcctaacaaatacattcttgtcaaaatcagagttattatcttcagagtgtaatgatctcttacattcaattattaaaactatctataaaatattatagtctttctttacaatgaagtttttagagccataagtaaggagtaaaagtttccctactaataaactctgaataccttaccaactgtaagttaaaagccatcataagatgctaacctaagaaagaaaacacagtgaatgtgagaccagtcactatgttataaatgcaaaccccaaagt

SEQ ID NO: 87013 - DNA, 252 bp, Homo sapiens
ctgtggaagggactcactgggccagcccatcctcaagtgtgcatgagggactaagctctacctcccacttacagtcttttgaagctttgcaagtcttgtttctttttcctttttttgatggagtgttgttttgtcatccaggctggagtgtagtggcatgatcttgggtcactgcaaccttcctcttctgggttcaagtgattcttgtgcaccagcctcctgagtagctggggctacaggcatgcaccacca

SEQ ID NO: 87014 - DNA, 292 bp, Homo sapiens
gtccagcagagtaactagtcgtttgtggtcaagtgtaaaaatgaatgattgagttgtctatctggatgagcctttcgtttatttcatagttaacatgttaatgaacatgcaattaaaacatccatatcagctcgaatggctcctctttttcatcaggtatggtttagcagttgtttgaatctttagcaccttaatttttgtttcattcaagtgattttcctgaagtcattgaagaatctaccttgacaccaattttaactagagaaattcaattatttgctgaaagttagta

SEQ ID NO: 87015 - DNA, 453 bp, Homo sapiens
acattcatggtcctatgggcacactccacagaatacacaccacagaagatgccatgtaaacactgtccctggagttgtgcagtgccattaccctgggctgcttcctctcctaagagctgactgtgctgcaaatagtcagttccactataagatgacttatgtgttcctgaaaatcattgtgctatataaaattgtgtgattaaaaatcacagggtaggccaggtgtggtggctcatgcctgccatcccagcactttgggaggctgaggcaggtggatcagctcaggtcagcagttcaagaccaacctggacaacaagatgaatccccatctgtactaaaaatacgaaatcaaccaggcattgtgcacacctgtagtcccagctacttgggaggctgagacacaagaatctcttgaacccaggaggcggaggctgtagtgagccaagattgtgc

SEQ ID NO: 87016 - DNA, 397 bp, Homo sapiens
aagtaataattgtaaagaatagaatagcataatttcaaaccaatacatataacggctgacatctggaatctgaaattgcttgtcattggtggttttataatcatatatatcaaaagtcactgcttttcataaagcaaaattacacaagtattaagatttaagtaaaatacccagttttccaacaatcagtgtaaatgtatttaaaagtggtgaaaataggataaattttcttaaaattttcattttaatggtgcttaatattcacttgcctaaaattttctctcaggtttaaaaaatgttatgtattctttggaatcaatccaacttgcatttactgcatttactcaacattctcactcaaggaaccaaggcaagaaatattctcttctactggcag

SEQ ID NO: 87017 - DNA, 556 bp, Homo sapiens
ttggtacagtcttgctctgtttcccaggctagagtgcagtggcttgatctcggcttactgcaacctctgcctcctgagttcaagcaattctcctgcctcagcctcccaagtggctgggattacaggcgcccaccaccactcccagctaatttttgtatttttagtagagacgggttttcgcgatgttggccaggctggtttcgaactcctgacctcaggtgatccacccgcctcggcctcccaaagctctgggattacagatgtaagccaccacacatggcccaggaatgccttttccagtatacctatccaaaactattcagtaggacctgaatgaagttccatctcctttgtaaaatagttcttataaacacagatcttttcaagtcttaaaattccataactcctattttctgtgcctcacaatggaagatttaccatatattgtcttacgttgttctctgatgtttcattgtctttattttttcatttcaactatctacataaaaaaaagccttctctagggtctgtatctcatgcttttgtgtctcctctg

SEQ ID NO: 87018 - DNA, 438 bp, Homo sapiens
cctctagtccacgggcctctggctttaccccaaagccggcccatagagctgtggctcaccttcccaggcccccacatggctaacctccgaggaccttttctgtcctcctgtgccctgccctgtctgcccttggtttttgccctgcccgatgtccctcctgcccctatctgggcctcagcattcctggtcttctctgtgttttgagccactactcgcttcctctgcatcatttgctcttgttgggggatgagtccccagtactctggcccagccctcactttcccggggaggggttccctctgcctggaatggtcttctcccatcacccactgctgcactctgccctggcctctgagcagctacgtgcccccctccaagagggctgtggcccccgtgcccgcagtgcctcgggcttccatggctttttgtttgggaccc

SEQ ID NO: 87019 - DNA, 571 bp, Homo sapiens
  misc_feature (482)..(482): n is a, c, g, or t
ctcctctgcaaggggcctttgggattgttctggacatggctgaagattgacttagagattgaccctccacctcgacattactgacatttggggccaggtgattctttttgaggggactgtcccctgcattgtaggatgctgagcagcatcccgggcctcaccagatgccagtagtgccatcccccaaccatacccctggttgtgacagcccccaaaaatgtctctagacattgcgaaatgttccctgcagggcaaaattgcccccatttgagaaccactggcttggagaagggactacaaatgtacttcctcccccattcttttgacgctaagccaccctggtcctgacgcctcccctcacttagaaaaggcatacaggaggccgggcatggtggctcacacctgtaatcccagcactttggggaggctaaggtgggcggatcacaaggtcaggagtttttgagaccagcctggccaacatnggtgaaaccccatctctactaaaaatacaaaaattagctgggtgtggtggcgggtgcctgtaatcccagctacttgggaggctgaggca

SEQ ID NO: 87020 - DNA, 206 bp, Homo sapiens
ggtcaccccaattttgagccctttggggattttaaattgtaaatgagggtgcttaagattcaacttctttagttgtctttttagcttccaaattttatttttgccttgtttggttttaagagtttatacttttaaaataatctctttactgttgtttttctggtttttcaggagggagaatttgtgttgaattgggtttgttctga

SEQ ID NO: 87021 - DNA, 427 bp, Homo sapiens
tcagcagtgtcaactcattgacaattatactaagttctgatctttttacatttggattttgagaatgcttgtgtattatttttagggaattatataaattagatatcagaaattaattactattttgaatatgtggcacatgattttttcactataagataatatataaataagtaaaagaaactaatttgtattttggatctgtttgctacattaaatatttaatttcgttccatgtttagaaggggaaaaatgatctccattcagaaagattttgtttttaagctgcaagtgttaagaatatcattcttgctaatctagtagatttttcattattgagatcatagtacaaagtaatattaaaaatgaaaaatttttctagatcccgcaaatgttggtacactaactcctagttttacgtccctat

SEQ ID NO: 87022 - DNA, 311 bp, Homo sapiens
ggtatttcagaaaagccaaaggcattacagaagcctttcctgagttgacaggcaagagtggcaccaggaatcaagggctgacacatgtcatcagcctggaaaaagtggagcttggacattaatgatggctcttgtgaacactcagtgtgataaagccaagaggacttggcttggggtttagtttgcataggcagggagttagagcttagagaacacctgccaagagttttcactgtcccggctgttggtgatgcatccttcatccttgacttctgtcactcctttttagtgggtgatggtagaaatgctgg

SEQ ID NO: 87023 - DNA, 944 bp, Homo sapiens
ctacaggtgcctaccactacgtccagctaatttttttgtatttttaatagagacagggtttcaccatgttagccaggatggtctcgatctcctgaccttgtgatccacccgccttggcctcccaaagtgctgggattacaggcgtgagccactgcgcccggcctctggatactaatcttcaggttacatatattgtcgacattattgcctcatttgtggtatgccttttcacattctctgtgatgtcctttgttagttttgtttttttgagacggagtcttgctctgtcgcccaggctggagtgcagtggcaccatcttggctcactgcaacctctgcctcctgagttcaaatgattcttcgtgcctcagcctcccaagtggctgggaccacaggcatgtgccaccaggcctggctaattgtgatatcctttgaacagaagttcttaactttaatgtagtcaaatttatgaatatatacatatatatgtatatatattttttttaatgagacggagtttcattttttttaatgagacggagtttcactccagccttgttgcccaggctggagtgcagtggcgtaatcttggctcaccgcaacctccacctcccaggttcaagtgattctcctgcctcagcctcccgagtagctgggattacaggcatgcaccaccatgcctggctaattttgtatttttagtagagacggggtttctccatattggtcaggctggtctcgaactcccgacctcagatgatctgcccgcctcggtctctcagagtgctgggattacaggcgtgaactactatgcccagcctatatattctttatagttagcaattcttgggtttaagacatcttttattacctcaatgtcatcaagagagtttcctataatttcttctaaaatattgatttttttggttgaacatttatatcttt

SEQ ID NO: 87024 - DNA, 670 bp, Homo sapiens
aaccaaagcactttagtaaaactctctactactagaaatgtgtttaacattattggtgtgttttcaacaatacacatcaaactttgagagccactcttgtgagtgaaattgctgtggagtatggagtgagaagttattctttgatctattttaggctacttgcaaagaaatataatagaatggctagaagagccatctctggagtcaggacagagtatctgtggccaagaattagcaggatgaccctgtagaagttattcacataactgaatttttaatgagataatgcatgtaaactactaagttttagatggtatagtatctgatcagtatacggtagctacttattatttgaatatgttctctaattcctcattgatttgtatttattaaagattattctacagattcaacttgtgctgatgtctttccactggctacagaagattcccagtttacttcacgtatctgaaaaaaagaatttcttatttaaatttacccctacacaactggaggcaggggggcagtgtgtgggaaaggtgaatttttatagaagtataaactggttgggcggggcaacaagctggtcggggagggttgccttaccattgcccctgttgggaaccagatttggaaacccccctttaaatgggcaggaaccctcggggga

SEQ ID NO: 87025 - DNA, 407 bp, Homo sapiens
aatagaataaaattggggtctgagagctggtaccatgttactcgatttccgatgatgaatcctctcaccagctcaagggcaccaacttgatggatttaatgtaatgtctaaaatgactaagctttgatattgtaagtagcctgaccatatcatgagattctgagtaacttgatttgtctggcattgttctgaagtggatccactttatcaaagccacagatatatggcaaagttgaaaagataatgtgaaagttcctttagcacacagacgtcccaggccctggtttcaatcacaccagtaggacggaattttaggcagttgatcataaaagtttgtccaaacttaggaaatgtacaattaactagaaagaaggatccactatgattgactataaaatgtgccacct

SEQ ID NO: 87026 - DNA, 373 bp, Homo sapiens
tctttagccgagggtgttggggtttgccttcttcctcagaaaatagttcaggggaagagatgcatggttaatttggttcctaactggtcctctatttactggtttttgattttttttttttttttgagacggagtctcgctctgtcgtccaggctggagcgcaatggctcgatctcagctcactgcaacttccgctttctgggttcaagcgattctcctgcctcagcctctcaagtagctgggattacagtcgctcaccgccatgcccggctaatttttgtatttttgtggagaccgggtttcaccatgttggccaggctggtatttgaactcgaccttcgcagcctagtgctatttttaactagggggttct

SEQ ID NO: 87027 - DNA, 396 bp, Homo sapiens
tctcatgcccttgcacctgccgctcttcctctgactaactcctattgatccttcaggtttctggacatcacctcctccaggaagcccttccttgaccctgcccagcctgagccaggcgcccttgctatgtgctctagagctccctgagtgtcctgtccaagtgttcaccccatgataacataattttctatttgaggtctgcatcccctgctagatctttctgtgtgtcttgttattttagcccctgaagctaggatagtagccacaaaaatattcacaaacacctctgaatgaacaaacaaaagtagatttgcaaatctataaaattcaactcaaaactgctatcagtctaaaagaacaactttcaaacaacaattttgagctctgttttcaaat

SEQ ID NO: 87028 - DNA, 440 bp, Homo sapiens
tctgggagtactgaagttcaagctacaccatggaacacatatggaatataacttattcattacttaattaattcacttatttgataaatatttgttgtgtgacattatgtcccaagcactatcctaggcagtgaacaaaaagacaaagtctctttctcatggagcttacatgcagatagacaaaaaatagtaggcacgaccaataaactatacactgtgttcaaaggtggtaagtgctatggagaaaatataaagcagggaaagggaatgagtgacagggtggagaaaagtactgctatttcttatagagtgcttagggaagaccaaactcgctataataaataatctaatatatttgaatcatagttaattcagtccatagtcaaaccttccgttcaatctgttaatatgcaatacctgccgggcgcggtggctcacgc

SEQ ID NO: 87029 - DNA, 516 bp, Homo sapiens
agtgctgtccatgcagtatcatacagattgaagggctctgagccttccaaagattcctggcccttctgtttttgaatggcattaaaaatcacctagcaattgagttcctactaatcacttatcatgagtaccttatggtctcaacagtgaactgcaccattgctttgtatgggagaaagttaaattggaagcttaaagagattctaggggttatctcattcaaacattcattcatttgaaaatttaggggattgtggtaaattattgttatggctccttctagccttagcattggatgataactgtgaagaatcatagaaatatttattattaatttcatttatttaacaaagttaatcactccttcctttgtgctgtcttgctgtatcctttatcttctgttaccataattatcactctgacttacaattacctgtttgtgtgttttatttatttatttatttttaatttttgtcagtaacataggtatgtatatttatggggccatgaaataca

SEQ ID NO: 87030 - DNA, 369 bp, Homo sapiens
caagtctcttaagacttctatgcttagttattctgtgagtcccttgtttgtcttctctctagcaaatattagttgggatagttctaacctgttagagatgttcagatagtgttgcaggaagatatcaaagttttttcttctttgttaccagattttttaccccaagcccctttatatcttatgtagcagcttttcttagatagaggagggtcccatgttgtccgcagtgggctccaacttgtggttggcccctcgagtgatctgttttccataataataaaaatctcccagcccacttgcttctccacctcaagtttttaaaatatcttcaaatattacctcataggaagccattagtcagaattatct

SEQ ID NO: 87031 - DNA, 366 bp, Homo sapiens
ttcacaaggcagatggttagccaagattcactcaacttctacaggataaggtcagttcatggatgactggaaaaatgtttcattccagattttaaaaccaattaaaaattggttttgttccaatttcagaagcaatgccaatgtatctctggcctccatgcgaaaaagaaagctttttcccagatgtctgctgccttttgatagctgttttcagctacggatacatcaacacatcttagtcctttagtctttctcttcctgcctcagatccttgcaggtcttgatataatatgtagttctaaaaatgatgttatgttatctataatcttacttgcctttggatgtatcaatagtgaccttaaaaat

SEQ ID NO: 87032 - DNA, 297 bp, Homo sapiens
atttctcggctcattttttttttctgttaagatgttgaaataacacctacttcacaggcttaatttaagaatgaaatgtgataatatatacaaaacacttagcatagtgatccattatgatctctgttattactatcaataatttggaaaaaatagatacctacttttaagaaataccttcatttttgttttttattagccatgtaaataaaactatcaggtattaaatattacatactgacatatattgaacatatatgtctgttttaatacatatatatttctttaatatatatg

SEQ ID NO: 87033 - DNA, 592 bp, Homo sapiens
tagattgcagtgggcctcataattgataccttgtctaggagctaccaatgtttcctgtgtcctcattagggagctggtgccctttgtctcatatgatgtagcagcttgaggacagtacaaacttttgaggtggctcctggagtttcagtcacaatcccttagaatcacgcttcagcatacggctagcttggatcttagagtaactggctcctagaagttccttggatctggagctggcgtaggagaggcaggtgtgatggtgtgttttatctgcattggtaaaactgaacaagagctgccactagggtgtgtgtgtttatgtgtctttgaggggtaggtgaaaatatgcattgtaggacccctgcctatataaataattggaatcattgaacatccatccctgttttggagaaccagtgacaacaactactctccaggcaggtgtcatggaacttaagacaaccgcagaacaaacccaactctgtagaaacaagtcccagtgcttttcagggcatctggtctaccccatgttctggggaagggaaccttgattgggcgcaaccaacacagggtgcatgtgggccagggctgg

SEQ ID NO: 87034 - DNA, 280 bp, Homo sapiens
caagttacccagtaatttgaatgtaagtagttgaaccgagagtctgacgtgctggcagacaccccatgctcgtattgttttctggctccttccctcttttctttccctttgctaagtaggtattctgaatgttattaaggatctcttagtgtagtggagtaaacggttctgcaaggaagtaatgacaaggctatttggtaatttcttataggagtaagaaaaaagttcttttggaacacagaggagtgggaggccaattttactttactgcttggtgctg

SEQ ID NO: 87035 - DNA, 429 bp, Homo sapiens
cagttattgggctaaccatttgagatagtggtggaaaagtaacatgatcttcctgtcctgaaacagtttagaggggatgagaggcaaacaaatggataaatataattattgattatgattaagaactacagaggtaatgaagaggaatgctcctttatataaggtgatcaggaaaaaactctgtaaatgtgacatctgaactgagatccactgttgagactgaggcagaattgcagagggctggcaaaagattgtcacagaaagaagtacagctggctagagcttagtgagtaatggggataaagttgtgaagtaagcaagaactggattatgcagtaccttctaggccttgataaggaactggttcttaagggtaaattgggaccggagggtattacatgatctgatttacatttttaaaaaggtcac

SEQ ID NO: 87036 - DNA, 440 bp, Homo sapiens
cgtctttattcttcaacaagttctatgccttcatcatttacttctccattatcctagccttcttcattctcctcatccaaaaaacctgaacccaactccactgctggatgcctgaccacgtgcaccagcagtcccatatctgagctccaaacagtaaatctttacatttagaccagtctgagaaggactcttctgtgattgccaccataggcttccaatgggaaacactgaggtcaggggtgaacgaagagaaaatgtgcagcgcccaggatcagcaggtgatggttcaatgggagtttctccccatcagcacttttgctgattctgatcccctctgagggcatgccctttccttttccctttccttatccaaatcccaactattcttcaaatgtcaagctcaggtcccacctcctatggggcacattcacacctctgca

SEQ ID NO: 87037 - DNA, 275 bp, Homo sapiens
tttaattagtgatttataattttcagcacacagctcatgcacatattttgttagctctacaccaaaatattttaatgatatttttgtggtatagttaaatatggtacctttaaaatttgaatatctgattattcgttgcccatatatggaaatactggttttctaccttgttaaattaacttttaaattgtgtctgctttttaataaactttctttggagtttatatgtagataatgatgtcctttaggatttcaaaaaagagtacactttattt

SEQ ID NO: 87038 - DNA, 394 bp, Homo sapiens
ccccctcccctccttcaggatctcctgaggacacactgcttcctctgcgcagatcctctgagccgcagccagcaagccttgatccaaaggtggtacttttaccccaggaaagctggagaagggacacacactcactggtgcacctcagggctggaaagggcatgctggcaggtgtggagcaaaatatcttctcagccccagaaacgtagacaacaagatgatacttcaggctagaatgactgggactctgaaatgtgcacctatgagggtatggtgtaaggctttttaacaaagtgtatgtgtgtgtgtgtgtgtgtacacacacatatataactttgtataactttatagcaatatgtatttaatataatattctccaaggtaaaaatacaaa

SEQ ID NO: 87039 - DNA, 1459 bp, Homo sapiens
atgaccagtttgaacaagaattcacccaactttcaagatgccttttcaaaaggatcttgtagtcagttggtatgtacagacaattggcatggaagtggtaggatataaatcggatgacgcctggctgctgaggtgccagctggatcagctggtgcacttcttgtttcttgtaagaggtttctttaaaatgactagtttgatgtatctggtaacatataggcctgactatacattttacattatttcgctatttgtaaactgggattttagaaagcacgtttgccatttgttaaagtacatgccccttaaattttggagtagtttttaaaagtttaaaatggtaatagaggagccagaaactttttaagcattgtaaaatgttttgaattgatattgactttgtttggaagagagtagaggcagggggctttaaagaaacaaagaaatgcattgtaaaaatgtagttttagagcaaattaataatgatggtggggaaagtgttgctaatttgtttatttccctggaagaaatgggaagtgtgataagcagtttaatttttaaggagctggtctcaattttagtactttttaattatgcaaataaatcaatgtttccttaaattttgtcattgctttgtcacagttgtctagggttcatatccaaccttctgtggcaattcaattttatatagtcttttaagaggtaattgtaatgtatttctgacagtataaacaaaaagaatataaggcatagaagaattgtcctctaaaaatatcaatgatgtatcctggaatgtgaagatgtccctttatagttaaaaattgaattattttaatattgtaccattgttagaccttgaatgagtccatgttaccgtgtgtgtctgtatatctatctgtagagaaagaaaaatgacaactgaaatgttacttttaaaaatcagaataaattgggcactgtctgtgttgcaccactactgtatcttttcgaaagaattaacagtatttgcctattgtaaaggttaattctgatgacgttttcacattcaccagactttttttcctgtattatttgcatccccaaatatttaatacaagtagattctgcatggcttgggcattcagagattaatagaatgatgactcaattttaattctaaagccatgaaaagttactttgagactgaacaattctgaattatttatgatacccaatgtccatgtttctttccctactgtaaaagaattgatcagtttcttcattaaagcagcaaaaacttattaaatcttgtaaataccatgtctcttttagatttctgtgtatgctgtgaatgaaatcattttgagatgaaattgtacaaaggcattttaaaaggctctgcatgcatcgtacctccaaacagtacatattcggaaagtcaaagattcctgcaaaataaataaactaaaagcaaacacta

SEQ ID NO: 87040 - DNA, 957 bp, Homo sapiens
aaagaatataaggcatagaagaattgtcctctaaaaatatcaatgatgtatcctggaatgtgaagatgtccctttatagtactttttaattatgcaaataaatcaatgtttccttaaattttgtcattgctttgtcacagttgtctagggttcatatccaaccttctgtggcaattcaattttatatagtcttttaagaggtaattgtaatgtatttctgacagtataaacaaaaagaatataaggcatagaagaattgtcctctaaaaatatcaatgatgtatcctggaatgtgaagatgtccctttatagttaaaaattgaattattttaatattgtaccattgttagaccttgaatgagtccatgttaccgtgtgtgtctgtatatctatctgtagagaaagaaaaatgacaactgaaatgttacttttaaaaatcagaataaattgggcactgtctgtgttgcaccactactgtatcttttcgaaagaattaacagtatttgcctattgtaaaggttaattctgatgacgttttcacattcaccagactttttttcctgtattatttgcatccccaaatatttaatacaagtagattctgcatggcttgggcattcagagattaatagaatgatgactcaattttaattctaaagccatgaaaagttactttgagactgaacaattctgaattatttatgatacccaatgtccatgtttctttccctactgtaaaagaattgatcagtttcttcattaaagcagcaaaaacttattaaatcttgtaaataccatgtctcttttagatttctgtgtatgctgtgaatgaaatcattttgagatgaaattgtacaaaggcattttaaaaggctctgcatgcatcgtacctccaaacagtacatattcggaaagtcaaagattcctgcaaaataaataaactaaaagcaaacacta

SEQ ID NO: 87041 - DNA, 390 bp, Homo sapiens
agttttgagaggattccaatgggttttttatatctagttgcagacttttcttgtggccctactgtggttgtgcactgcttaatgatggggatatgtatgaaaatgtgtcattaggcaattttgttgtattgcaaacattatagagtgtacttccgcaaatctaaatggtacagcctcctatacacctaggctatatggtatacctattactcctaggcaacaaacctgtacaccatgtcagcatactgaatactgtacgcaatcataacatgatggtgtttgtgtatctaaacatttctaaacatagaaaaggtatagtaagaatacaatactataatcttagggaccgtagttgtatatgcagttattgactaaaatatcatcacatgg

SEQ ID NO: 87042 - DNA, 366 bp, Homo sapiens
aacaatggtacaggttgggcgttgtggctcatgcctgtaatcccagcactttgggaggctgagacaggcagattgcttgagcccaggagtttgaggcttatttgagcaacatagggatactttctctctacaagaaatacaaaaattagccaggtgtggtggtgcctttgtacctggaggctgaggtgggagaatcacttgaggttgaggctatagtgagttgtgatcataccactatactcctgcctgggctataagagtgagaccctgccaaaaaaagaaagagaaggagagagagaacccatatttccatatcttgtatctaaaaagaatggctaacatttacatatattaatctcaaaggat

SEQ ID NO: 87043 - DNA, 746 bp, Homo sapiens
agtaaacccttcattatatctttcacagtacccagcaccaggactttcacatcgtgggtcttcaataagtaattgctgaattagagagtcattattgcatatcctacaagcaactagtcatgaggaattaatcctttatgacaagaaaacaccaccaaactcctgtcccagccgggctggttaaaggcagcagcactgaaaacttacaaacacagccaaaaaagtagaaaaagaaataataagagaacaaatctctgtgagcagatatatgtaggcaacgtttattcatctggacactaattctgccagaagggtggggtgatctcaagtatcatagatgcaaaaaggaactaagcaaaagaaaaatggtttagtcaccaaaggagaagatcagaggcattattatatgacagaagttataacaatcaaaattatgaaaggcttttgttttatgttgtgtctaagaaagcacagtcagagtaacttaaaaaaaaggaaaacagaaaaaaagagaagacacattaaaagggatatcattatgcagggtataaatttttaaagaacagcactaaattatttgaagtgaaagaaagactgaggagaaaggctgaaaatatgaagagaataaggcacataagtgagtagaatcaaagacaagatgaattaatgtaaagtgtaaactcaatggatgagaagtaaaggctaagataaattataggaggtgaaaggagcagcaggagcacagg

SEQ ID NO: 87044 - DNA, 426 bp, Homo sapiens
tgaactgcaatctcattgtttatctcagagcagtcttccctcaccccacctggagggggaattaaattccaggatcctttgcactaattcggatggccctggaaacccattaccatgcactgctgtgatgctgtgaatggccattcactagaagctcattggccacaactggccctgtcttttccaatgtcagcattgatgtggatcaaaatggagtttgttaattctcagatgggtcatttagatttcagggcctttcttcaagaggtccaatgcccacctcctctctggagctgctccgttacacttgccacactctctccctactcctgggagcctgcagtgtcctgaatggtcaagggtgttacttttttaaaaaactggaagaaatcatagtttgaattggaggcaaataaagaataattc

SEQ ID NO: 87045 - DNA, 116 bp, Homo sapiens
gatctaaaaataattcttaatcatgaatttaattcacgacttccttgttttcagtcttattcagcttactgtaggagattttaataaactaaagcttttgttgatttatgagttag

SEQ ID NO: 87046 - DNA, 341 bp, Homo sapiens
gaggggctagggaagcttattcccctgtttatctttttggggaaagataaaaagtggacttgagggtttaaatctggggttcccttcaaggaattagatgctggttgccgaaaggtctttgatagtgttcattcaatgctccctccctttgtagtgaggctgtttcagccaaggcaggggccgtcctgccagtacttgggcctggaggccctcaaggctacagacaatgagctgactttccttaggaaagtcaggagacctgaggaacacggcttaatggctctagaagacctatcccttatttcacctctaaataagggtgtcagcaatctgggtcattt

SEQ ID NO: 87047 - DNA, 264 bp, Homo sapiens
tttcatttgggtgagaactgctcctgtgaattgcattttacacgcctgtctctgacttatcagtggatgaagtgatgagctctgttcctaccttgtacatgggtttttgcagcataaaagtgcttaattctggactaagccttgttagaagaccaggagcttaattgagcttttagaagagaagaaaaggaaaagtgttttaacaagtccatgtttatgctaggtgggattgcatgtctacaatttacctgtcaaaaaagggaa

SEQ ID NO: 87048 - DNA, 172 bp, Homo sapiens
aggccctcctttcatctgcaggaacccacctccaggtccagagagcctcgttctggctccacaggcgcgagggggaaacacggtagtggcatttgctctcagcctctttgttttttggttgtgtgtgtgtgttttgtttttgttttgagatggagaccttgctctgtcgccc

SEQ ID NO: 87049 - DNA, 89 bp, Homo sapiens
gatctcttcccttaggaaatatcaacatctttatgtacatgtcagagtcatggtgtgatgacgtactttgaagcatggagtcagttttc

SEQ ID NO: 87050 - DNA, 630 bp, Homo sapiens
tacctaatgcctgtaccatcattgcatcttggaagtaaataacgtgttattggtcttacaggctcataggcggaagggacttgccttgagtctcagatgagactttggactttggacttttgagttgatgctagaatgacttaagactttgggggactattaaggaggggtgattatattttgcagcatgagaaggacatgagatctggggggccagggtggaattatatggtttggatatctgtcccctccaaatctcatgtcgaaatgtgatttccactgttggaggtggggcctagtaagaggtgtttgggtcatggggcagacccttcatgaatgccttggtgtcctcctatggcaatgagtgagttatcattcataagagagctggttgtttacaggagtctggcatctctcatttgcttccttttcttgccatgtaacacacctgctccccctttaccttccatcatgaatgaaagcttcctgaggcctcaccagaagccaagtggatgctggtgccatgcttggacagcctgcagaaccgtgagccaaataaacctcttctgtctgtaaattacccagccttggatattcctttgtagcaacacaaaatggactaatacagat

SEQ ID NO: 87051 - DNA, 406 bp, Homo sapiens
agtcctcattattatctaagatgtaatatgtggtcctgaacatggtttggtctgtgtctctaacaagaatccagatcatgacctggaccttctgggcatgagtctagagctgtgttgtccagtaaggtagtcacttgccatacagtcatttatacttcattttaatgcaatgaaaacttcagttttcaatagccacatttcaattggtccatagtcacatatgattagtggctcaggtagagatttccatcatcaccggaagttctgcggactgtgctggatccctgggaccagtatttgtgaaccagcagcaggaacatcacctgggagcttggaagaaatgtggaatctcagctgtgtccagacctactgagagagaatctgctttttacacaatcctgggtaa

SEQ ID NO: 87052 - DNA, 495 bp, Homo sapiens
tattttttgagacaaggtctcactcttttggtccaggctggagtgcagtggcatgatcaaggctcagtgcagcctcaacctcccggactcaggctcccccgactccacccctgcaccaagtagccgggattacaggcacaaattcatgccccggctaaggtatttttattaaagatggggtttcgccatgttgcctcggctggtctaggctggtctggacctaggctggtctcaacatggactctgaactcaagcaatccgctcgccgtggtctcccaaaatgctaggattacaggcatgagccaccgtgaccggcttgccagtggttctcaaagtgtggtctctgtaccaatagcattgttaccatcagtgaacatgttcgaaatgtaaattctagggccctaccccagacctaatgaatcatacactgggaatggtggtcagcaatctgtattttgttttatttctgtatttttgcattactgaattactgta

SEQ ID NO: 87053 - DNA, 339 bp, Homo sapiens
tagtagctactctatgcacaccgtatcttatgtaaagtgctgatttactgagtgtgagatgaatgcataactattttcctacctgctccttttctcttgtcacaggtggattaccacacctttcctctttcccctccagcctacttttcctttttaaacaatgaggctctcaaactcatctttggggaaagccactggcctctttctgtggcatgtcctcaactgtggcaaaataaacatctaaattggtacttgactctgatactttttggtttacatgtagttggagaagaaaaacagtgaaatttcttcctctgacggcagttgaaaggtgattta

SEQ ID NO: 87054 - DNA, 462 bp, Homo sapiens
  misc_feature (419)..(419): n is a, c, g, or t
  misc_feature (426)..(426): n is a, c, g, or t
ttgtgtggcgttctagaggatccctggcgggtgggtgcatgtatctgcatgtccttcctgcacacacagtgctcccctccgatgctgccagcctgtggtgacttcctcttctgaccccttcttcccccccggcctgttttatcagtgaaaggacttaactaagcagatctccaggtcacctttggaactcagctcaggtagcacagcaggtggtcttcctggaccttgtgcagagaactgggcccttctgggactccccttagttagtgctgttcactggattgggcatcacctcttgcctgtccccgcagctggactgagagcaggacagtccttacgtgcacaaacccggaaggatgcacaaacccggaaggatgcacaaacccggaaggatgcacaaacccggaaggatgcacaancccgganggatgcacaaacccggaaggatgcacaaacccggaa

SEQ ID NO: 87055 - DNA, 412 bp, Homo sapiens
ccgcagctggactgagagcaggacagtccttacgtgcatctccctcatctcagaggatggctcagtctaggctcgggctgtgtctgcccacaagcaaggcatcttcgtggcctgtgtagagcctccgttaattcgtggactcgttccacctgactcgtaacgagctcttgctgtgcactgaagactagttggagacttcgcacgtgttaactcgtggaacctacagcagccctgtgagtggctctgttatttccactcttctggataaggacacaagccatgttgcttgctgagccccacaaagcctgtgtgtggcagaggctggatttgaacccagggcccctgctcccaaggcctggctcttagctgctgccctcctttgagctgctcagttgcagcaagaaaacaaaag

SEQ ID NO: 87056 - DNA, 316 bp, Homo sapiens
gtgggacgccctctgccttgtcctgagagcaatgtcttctccatggggcagcatgggccctggatgggcctgagcatagcagaccacgtggtcacatgtgcatgtgtggacatgtgtgcatgtgtggatatgtatgctcctgagtgtatctgcatgtccttcctgcacacacagtgctcccctccgatgctgccagcctgtggtgacttcctcttctgaccccttcttcccccccggcctgttttatcagtgaaaggacttaactaagcagatctccaggtcacctttggaactcagctcaggtagcacagcaggt

SEQ ID NO: 87057 - DNA, 377 bp, Homo sapiens
gacatcgagtccctcctctccttctcccatgccttcctgcctgccatggcaaatctgagtggcttctataagcttctgctggtacaaatcaatgtggcaccatgagcttcatggtggcagaagagacaatagtccttagctctcctcccagtacaccccctacttggtcagtctgtaggccaacaagaaggttcctttacccccatgcaagacacttatgagaacacattacaagatggctgaccgtggaggatgagtggatcctgaaaggttgtcccaaactgttgatttggaaaagaaataagcacatagataaccttattgtgtgctgcatggaaaggaactgaatacatttgcctttaagcatgaaaaaaaaa

SEQ ID NO: 87058 - DNA, 384 bp, Homo sapiens
gtccctcctctccttctcccatgccttcctgcctgccatggcaaatctgagtggcttctataagcttctgctggtacaaatcaatgtggcaccatgagcttcatggtggcagaagagacaatagtccttagctctcctcccagtacaccccctacttggtcagtctgtaggtcaacaagaaggtcagtctgtaggccaacaagaaggttcctttacccccatgcaagacacttatgagaacacattacaagatggctgaccgtggaggatgagtggatcctgaaaggttgtcccaaactgttgatttggaaaagaaataagcacatagataaccttattgtgtgctgcatggaaaggaactgaatacatttgcctttaagcatg

SEQ ID NO: 87059 - DNA, 462 bp, Homo sapiens
gattaggtaagacaggatgttggtacatttgaggtcattaaaccaagaagggaagggtgggggttgcggggggggcaaagaaatcttgctaaatatattgtggagctgaactaaatgctgaatagctaagggacattctttgtgttctgtgccaagactttaaaaccctgtttagaaacagactagaatgatggagacagctccatctagatgcagtgcattggtaaatgcctgtctttccaagaaatactattttacttgtccttttatggaggaggcgtggaaggctgtgatgtactgggttgtataacatttttgtaagcggatacagctagtatagaacctagagaaacaataaaagccgccttttcacatggtgtctcacagttcccgtttcattactaggaaaataatgaatatgtcacagagaagctaattcgtatgaaaggtttttgtcagctg

SEQ ID NO: 87060 - DNA, 110 bp, Homo sapiens
cagagatgggctaccaaataaaatattaataaaatgggaagtattattttttctagagatcctcattatacatgcaaattaagtatattgcttaagtaaacaaagcaaat

SEQ ID NO: 87061 - DNA, 282 bp, Homo sapiens
tctctctccagtgtcacctctgactacattctgcctccaactttgcactccagaaacaagaaaacaattctaatgtcttgcatgtggcatatgaattattgcttgtgctctcccctaatcctctaatgtatgttcaaaagcaatctctgcttaaagtttctctcccatcgcactaagtctgggccatttttacaaaatttatcactatcaaaactatcagattgcttttttttttctagcatgtgtttaagctacccagtgttagtaatagtgggcatcttt

SEQ ID NO: 87062 - DNA, 143 bp, Homo sapiens
gatctagacaagtctgatgttgcacatacaaataagaatatgttactaattgtgtttaatttcatatgtatttagccaaagaagtgccctttctagtacaaataataatttatgttgtggataataaaaatattttttcacct

SEQ ID NO: 87063 - DNA, 331 bp, Homo sapiens
ccattctgggctatagccctcactcgggtaaggtggctaatgcattacagggttttaaagcgatgagcggtcatttaagaggaagagtggtaaatgcttcctttccacactggccaatcttccccatggcagcagaaagcaaaactctgaaacctggccagcaactcttgctctctccttggtccttccccagataaactttcctttttgactaaacttaatagtttccttgcaagaaagaatggctgtttgagaacttacattcatacctctaagctccttaactctctactaatacaattttctaaaactagccaagaatggtttagaa

SEQ ID NO: 87064 - DNA, 429 bp, Homo sapiens
aaaccaagaaagaggaagaagcaaagaggaagatgtaggagatgacaaacaacggaactgatacagacaagaggttactagaatccccagaatgatggagcagagaggccccaaagtaacatttgtacatcaggtcctagagggcaaccagttcagtccaggctggtcagaagtgtctggcggaaacttctgcaagacaataaaaggaacagaacctcatgcacttaaatggtttgagaagaaatgaagacactggtggaaagcttagggttctattaaggaaaaatacacagaaaactaagcaaaccgaagaacaaggcagtcatttattacaataaaaacaaaaagtcacacaggaaaggaaactgaaacatagtatatgacactattcacaaagccataataaaacactcaatatcgatcggacta

SEQ ID NO: 87065 - DNA, 259 bp, Homo sapiens
tagcatcaaccaaacagggaggtgggagcactcaccaggcagagaagtccctgcccccactgctgcagcccaacagtgtggccccatatgggtctccctggactaatggctgcggccttggaggtggtgtgctctggccaggcctggatcacttgtccatcctgagtgggagtgggggcagcccccagagacagactcaggagagggggagtgcaaggatgtcccccagatgccctgtgctgcccaggggacagctcac

SEQ ID NO: 87066 - DNA, 228 bp, Homo sapiens
cattaaaaaaaataacttctgagattaccatgacatttggaaaagagtatctctaaatttgaacttttaaagttatttttctttacaggtaagtatttttaattctagcagcctatttcccttctttcataaatgtattgttcatcatgctattaggcagccaattctctgtaattttcgtttggctttatacatcttttgattggttagttcttgatatatacattt

SEQ ID NO: 87067 - DNA, 414 bp, Homo sapiens
atgttgtagagactgagtctcgctctgtcacccaggctggagtacagggatgtaatcataactcactgcagcctcgaactcttgggttcaagtggttccccccacctcagccttctgagtagctgggactacagacacacaccactatgccaagctaatatttttatttttggtagagatggggtctcactacgttgcccaggctggtctccagtctggcctcaagcaatcctctcaccttagcctcctgagtagccaagatttcaggggtgagctatcatgcttggcccctcaatgtctttaggtgtagaaactaaggacaagagagttcaactatcttggctgaaggtcagcctactaatgaccagtgaaggcaggaccagagccaggtcttcaggaccccagctggtaccc

SEQ ID NO: 87068 - DNA, 385 bp, Homo sapiens
agaaaagaaaattccaaagagccctcatagtgattccaggtgctgagttctgacgtgtccttcactgaaggtcattgactgcctgggcacggtggctcatgcctgtcatcctgcaacttcaggaaggcaatgtgggaggatcgcctcagctcagaagtttgagctcactctgggcaacatactgagacctcgtgtctacaaacaatttttgaaaattagccaggtgtggtggtgtgcgcctctcagctacttgggaggctgaggtgggaggatcgcttgggccggagaggctgaggctgcagtgaaccatgattacactattgccctccagcttgggcctgacaccctgtttcaaaaataaattaataaatacaaattaaaaagt

SEQ ID NO: 87069 - DNA, 425 bp, Homo sapiens
gtgatggcttctcacggggctctgtttcctctggatcctgggagacattgcgaatgtcaaagtcattcattctgaacctcctagaagactatgggccgactctagcaatagtcatgcatgtttactgagcacttactatctgacaagcacatgatgtggaatggctcaatggcttgggcaggcatgcagcctctgctctgtgaatgaggaaaccaaggctcagaggcattgagcctcaccttccccaacgagcacctcatcgccagtgatgagcaggctgaccctggccgagcttttcctgtgtgcctgcttggagagatagtggcgctgccattaaccccatttacagctgaggaaactgaggctcggagaagctgagtggctttttcaaggttgcattgctcttcaggaggctgagacgaatg

SEQ ID NO: 87070 - DNA, 900 bp, Homo sapiens
gggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccacccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacacctcccttagctactcaggaggctgaggcagaaaaaccacgcaaacccaagaggcagagggcggctgagatggaaccacctcccgaacccaagaggcggagggtcggtgacgtggaaccgtcacgcaaacccaagaggcggagggccgctgacgtggaaccatcatcacccgaacccaagaggcggagggtcggtgatgtggaaccgtcacgcaaacccaagaggcggagggccgctgacgtggaaccatcatcacccgaacccaagaggcggagggtcggtgacgtggaaccgtcacgcaaacccaagaggcggagggccgctgacgtggaaccatcattacccgaacccaagaggcggaggttgagctgagaagaggccagtgcactcaagcctgagcaataagaataaaaccgagtagaacaaaataaaaaattcaaaaaacaaaacaaaacccacactccaaaaactaacaaagaataaataaataatat

SEQ ID NO: 87071 - DNA, 815 bp, Homo sapiens
gggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccacactcagctccaccctcagcagatgataatatcaagacacctgccgagcgtctgcggggagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccg

SEQ ID NO: 87072 - DNA, 386 bp, Homo sapiens
ttcttcacagtttatttgctcattcaacacacaggtactatgccctgacaacacgccaggccctgtgctagacaatgaagcacagagatgaaaactgtctgtccttcaagaagtccatagcctcctcaaggagacaaagatattaaaagacaaataaaacagagataattaatgcaactagcactgtttgctttctggttttctcctattaggtggtaccaaattggcatatgaatacagactattctcttagtattggtttaaatggtggtatgaagtacatctactgcattaagaagtgccactctaggccgggcgcagtggctcacccctgtaatcccaactcctttgggaggtcaaggcaggtggatcatctgaggtcagga

SEQ ID NO: 87073 - DNA, 2190 bp, Homo sapiens
aacattttaaatctgaattgaaccacccattttcctttcttagccaaatcaccaaaatgtccagttagaacaagaatttagcattctgcaaaagaagttaacagctgagataacgaggaaatattctgaaatggatcccaaatatttcatcttaattttgttttgtggacacctgaacaatacatttttttcaaagacagagacaattacaacagagaagcagtcacagcctaccttattcacatcatcaatgtcacaggtattggctaattctcaaaacacaacagggaatcctttgggtcaaccaacacaattcagcgacactttttctggacaatcaatatcacctgccaaagtcactgctggacaaccaacaccagctgtctatacctcttctgaaaaaccagaagcacatacttctgctggacaaccacttgcctacaacaccaaacaaccaacaccaatagccaacacctcctcccagcaagccgtgttcacctctgccagacaactaccatctgcccgtacttctaccacacaaccaccaaagtcatttgtctatacttttactcaacaatcatcatctgtccagatcccttctagaaaacaaataactgttcataatccatccacacaaccaacatcaactgtcaaaaattcacctaggagtacaccaggatttatcttagatactaccagtaacaaacaaaccccacaaaaaaacaattataattcaatagctgccatactaattggtgtacttctgacttctatgttggtagctataatcatcattgtactttggaaatgcttaaggaaaccagttttaaatgatcaaaattgggcaggtagatctccatttgctgatggagaaacccctgacatttgtatggataacatcagagaaaatgaaatatccacaaaacgtacatcaatcatttcacttacaccctggaaaccaagcaaaagcacacttttagcagatgacttagaaattaagttgtttgaatcaagtgaaaacattgaagactccaacaaccccaaaacagagaaaataaaagatcaagtaaatggtacatcagaagatagtgctgatggttcaacagttggaactgctgtttcttcttcagatgatgcagatctgcctccaccacctccccttctggatttggaaggacaggaaagtaaccaatctgacaaacccacaatgacaattgtatctcctcttccaaatgattctactagtctccctccatctctggactgtctcaatcaagactgtggagatcataaatctgagataatacaatcatttccaccgcttgactcacttaacttgcccctgccaccagtagattttatgaaaaaccaagaagattccaaccttgagatccagtgtcaggagttctctattcctcccaactctgatcaagatcttaatgaatccctgccacctccacctgcagaactgttataaatattacaacttgctttttagctgatcttccatcctcaaatgactcttttttctttatatgttaacatatataaaatggcaactgatagtcaattttgatttttattcaggaactatctgaaatctgctcagagcctatgtgcatagatgaaacttttttttaaaaaaagttatttaacagtaatctatttactaattatagtacctatctttaaagtatagtacattttacatatgtaaatggtatgtttcaataatttaagaactctgaaacaatctacatatacttattacccagtacagttttttttcccctgaaaagctgtgtataaaattatggtgaataaacttttatgtttccatttcaaagaccagggtggagaggaataagagactaagtatatgcttcaagttttaaattaatacctcaagtattaaataaatattccaagtttgtgggaatgggagattaaaatgcatgtttgagaatagagaaattttcttcttggtttcattgcaaagagtaaaacaaacatgttaaaacatcaactgaagggttgggttaggaacatttaccctgaaaaaaatatgaggatgcatcataaaatgtaaatattttcctaccatgttgggggggcacaaattttaaaactggcatctttacaagtttcttctttataaacacccaaacaaaatcaagttttataaagcaa

SEQ ID NO: 87074 - DNA, 1968 bp, Homo sapiens
aacattttaaatctgaattgaaccacccattttcctttcttagccaaatcaccaaaatgtccagttagaacaagaatttagcattctgcaaaagaagttaacagctgagataacgaggaaatattctgaaatggatcccaaatatttcatcttaattttgttttgtggacacctgaacaatacatttttttcaaagacagagacaattacaacagagaagcagtcacagcctaccttattcacatcatcaatgtcacaggtattggctaattctcaaaacacaacagggaatcctttgggtcaaccaacacaattcagcgacactttttctggacaatcaatatcacctgccaaagtcactgctggacaaccaacaccagctgtctatacctcttctgaaaaaccagaagcacatacttctgctggacaaccacttgcctacaacaccaaacaaccaacaccaatagccaacacctcctcccagcaagccgtgttcacctctgccagacaactaccatctgcccgtacttctaccacacaaccaccaaagtcatttgtctatacttttactcaacaatcatcatctgtccagatcccttctagaaaacaaataactgttcataatccatccacacaaccaacatcaactgtcaaaaattcacctaggagtacaccaggatttatcttagatactaccagtaacaaacaaaccccacaaaaaaacaattataattcaatagctgccatactaattggtgtacttctgacttctatgttggtagctataatcatcattgtactttggaaatgcttaaggaaaccagttttaaatgatcaaaattgggcaggtagatctccatttgctgatggagaaacccctgacatttgtatggataacatcagagaaaatgaaatatccacaaaacgtacatcaatcatttcacttacaccctggaaaccaagcaaaagcacacttttagcagatgacttagaaattaagttgtttgaatcaagtgaaaacattgaagactccaacaaccccaaaacagagaaaataaaagatcaagtaaatggtacatcagaagatagtgctgatggttcaacagttggaactgctgtttcttcttcagatgatgcagatctgcctccaccacctccccttctggatttggaaggacaggaaagtaaccaatctgacaaacccacaatgacaattgtatctcctcttccaaatgattctactagtctccctccatctctggactgtctcaatcaagactgtggagatcataaatctgagataatacaatcatttccaccgcttgactcacttaacttgcccctgccaccagtagattttatgaaaaaccaagaagattccaaccttgagatccagtgtcaggagttctctattcctcccaactctgatcaagatcttaatgaatccctgccacctccacctgcagaactgttataaatattacaacttgctttttagctgatcttccatcctcaaatgactcttttttctttatatgttaacatatataaaatggcaactgatagtcaattttgatttttattcaggaactatctgaaatctgctcagagcctatgtgcatagatgaaacttttttttaaaaaaagttatttaacagtaatctatttactaattatagtacctatctttaaagtatagtacattttacatatgtaaatggtatgtttcaataatttaagaactctgaaacaatctacatatacttattacccagtacagttttttttcccctgaaaagctgtgtataaaattatggtgaataaacttttatgtttccatttcaaagaccagggtggagaggaataagagactaagtatatgcttcaagttttaaattaatacctcaagtattaaataaatattccaagtttgtgggaatgggagattaaaatgcatgtttgagaata

SEQ ID NO: 87075 - DNA, 1888 bp, Homo sapiens
atgatatgctgtttagatatgctgaaaagataacgaggaaatattctgaaatggatcccaaatatttcatcttaattttgttttgtggacacctgaacaatacatttttttcaaagacagagacaattacaacagagaagcagtcacagcctaccttattcacatcatcaatgtcacaggtattggctaattctcaaaacacaacagggaatcctttgggtcaaccaacacaattcagcgacactttttctggacaatcaatatcacctgccaaagtcactgctggacaaccaacaccagctgtctatacctcttctgaaaaaccagaagcacatacttctgctggacaaccacttgcctacaacaccaaacaaccaacaccaatagccaacacctcctcccagcaagccgtgttcacctctgccagacaactaccatctgcccgtacttctaccacacaaccaccaaagtcatttgtctatacttttactcaacaatcatcatctgtccagatcccttctagaaaacaaataactgttcataatccatccacacaaccaacatcaactgtcaaaaattcacctaggagtacaccaggatttatcttagatactaccagtaacaaacaaaccccacaaaaaaacaattataattcaatagctgccatactaattggtgtacttctgacttctatgttggtagctataatcatcattgtactttggaaatgcttaaggaaaccagttttaaatgatcaaaattgggcaggtagatctccatttgctgatggagaaacccctgacatttgtatggataacatcagagaaaatgaaatatccacaaaacgtacatcaatcatttcacttacaccctggaaaccaagcaaaagcacacttttagcagatgacttagaaattaagttgtttgaatcaagtgaaaacattgaagactccaacaaccccaaaacagagaaaataaaagatcaagtaaatggtacatcagaagatagtgctgatggttcaacagttggaactgctgtttcttcttcagatgatgcagatctgcctccaccacctccccttctggatttggaaggacaggaaagtaaccaatctgacaaacccacaatgacaattgtatctcctcttccaaatgattctactagtctccctccatctctggactgtctcaatcaagactgtggagatcataaatctgagataatacaatcatttccaccgcttgactcacttaacttgcccctgccaccagtagattttatgaaaaaccaagaagattccaaccttgagatccagtgtcaggagttctctattcctcccaactctgatcaagatcttaatgaatccctgccacctccacctgcagaactgttataaatattacaacttgctttttagctgatcttccatcctcaaatgactcttttttctttatatgttaacatatataaaatggcaactgatagtcaattttgatttttattcaggaactatctgaaatctgctcagagcctatgtgcatagatgaaacttttttttaaaaaaagttatttaacagtaatctatttactaattatagtacctatctttaaagtatagtacattttacatatgtaaatggtatgtttcaataatttaagaactctgaaacaatctacatatacttattacccagtacagttttttttcccctgaaaagctgtgtataaaattatggtgaataaacttttatgtttccatttcaaagaccagggtggagaggaataagagactaagtatatgcttcaagttttaaattaatacctcaagtattaaataaatattccaagtttgtgggaatgggagattaaaatgcatgtttgagaata

SEQ ID NO: 87076 - DNA, 1747 bp, Homo sapiens
gctgctcctcctgcggcgagggcttcgccaacacctacggcctcaagaaacaccgcctggcgcacaaggccgagaacctcggggggcctggagcaggggcgggcaccttggccgggaaggatgcctgaccgaggggttcccatcccactcccatcaaaagcccccttctggactcccacctcccaggactgatcagactcttcccccctcctcgctgttgccccatccttcagaacttcacacggactggcgaccttcagggcgcacgcccgacaggctcaagactgaatcactcccatcctcgacctctctgccctcccctcatcccatcagacactgaaccctatcctccgtccaaccctcgtttgtgacccgcatcagcccccgccccagcagcactctgcccccagtaagttttggcggagatgggtctgaaccgcccctccccctcctttggaatctggctggacagtggagtatgagcagagttgggagggcacaagggagtgctgggtgctttttggggtgggggggtggggggcggggtggcagacgcggcttgtacagagcggagaataataaatcttaccatgagggccgctggagtccatccttgcatcccacccagggagagtggggatcacatggtggcaaagcacaaagttaaaacttgtttcctctgcagttttgatgccgggcgcctctgtctctcactcactctcattcaacagggacttactgaggatttgctgtattcccagcgttagtctgagctgggcaaatggagatggacaagacaggtaagtgtctgctctcaggaactgacttaacatgccccgactcttccccttccggatgctttcagcctttgttcactccaccaccacttccggagacctcctgcctgccaggccctgagctgggcactggggaaacagatgaattggacgtgccccttggcctcaagtaacacaaaagagaactcccatccggctgccgtggctgcctcacaaccatgtgcagactgatggtcatgatacagctccctcttagcacttgtcctccagggtaatgattgggagattcaaaagcccgttcacagctctcatgttggcttgggattacaggcatgagccactgcgcctggtctatttcttattgagaagctctttattaaaagagatcattcatagcacccagaactcatcctccagtttcccttttttgagagctggaagtatgtcatctctgtatcccctctgtacatccctatagagaaggcatgtatatggctcagtgagtgtttggtgaatgaatgagtgagaaattgaattcatgcagatagaagaactttgtaccagagcttaaggctattgagtattttttcccttttttttcctccccacccccactaaagctattaaatatttgcagaggagagcactgtttagtggaattaccataagctttcaaatcaggcaaacctgggtccagatccgtttatctgcttgctgtgcaactctgggcaagcaatgtctcctctaagtgtctagctgacatctacaaagtgggcaccataatgtcatttggcagggttgtagttagaatgccactgattgagaatgccaaaggtctgtgtgatgcctggaaccaactggtgctcaataaatgtgggttctgcctgggcttggtattctctactaagaatacaaaaattaacatgcacagtggagcacgcctgtagtcc

SEQ ID NO: 87077 - DNA, 498 bp, Homo sapiens
tgagacagggtctcactctgtcagccaggctggagtgcagtggcgtgatcttggctcaatgcaacctccgcctcccaggttccagcaattttcctgcctcagccacctgagtagctgggattacaggtgcgtgccaccacgcctggcttatttttgtattttttagtaaagatggggtttcgccatgttggccaggctggtctcaaactcctggtctcaagcgatccacccgcctcagcctcccaaagtgctgggattacaggtgtgagccactgcacccggccaatcctatattttaatattttacagtactctgctagcacacaaaggtgatcacagctttccaggttgctgtcccctccctccaccatcagtcactcgggaatgaccagctctgactcacagcaccggcctctgcgataaacatagacaagcacaagccattcctgtgagccctggcactgggctaggccaccaaggcaacacccaaccaggaca

SEQ ID NO: 87078 - DNA, 159 bp, Homo sapiens
  misc_feature (152)..(152): n is a, c, g, or t
  misc_feature (158)..(159): n is a, c, g, or t
tttttttttttcaacatcttcagaatatgaaaaaatcttcgaaatgcttgaaggagtgcaaggacctactgcagtcaggaagcgattttttgaatccatcatcaaggaagcagcaaggtgggtagaaataggaactgtccaatttctttaancacttnn

SEQ ID NO: 87079 - DNA, 979 bp, Homo sapiens
gggcaggtttctagaaagtgccaccagtggggaggcgccacaacttcactgccattttgtgaggtgccgctgtctctcctccagcaaggtcaggacgaaacaatgaccgataaaacagagaaggtggctgtagatcctgaaactgtgtttaaacgtcccagggaatgtgacagtccttcgtatcagaaaaggcagaggatggcccttgttggcaaggaaacaaggagcaggagacagccttattgcaggctctgccatgtccaaagcaaagaagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacgagaaattaatgctgatataaaacgtaaattagtgaaggaactccgatgcgttggacaaaaatatgaaaaaatcttcgaaatgcttgaaggagtgcaaggacctactgcagtcaggaagcgattttttgaatccatcatcaaggaagcagcaagatgtatgagacgagactttgttaagcaccttaagaagaaactgaaacgtatgatttgagaatacttgtccctggaggattatcacaccccaaatgcataatctcgttaatgattgaggagagaaaaggatcagattgctgttttctacaatggagcaggatattgctgaagtctcctggcatatgttaccgaatcaaatagccttccagaggctaagaaatttctgttagtaaaagatgttctttttcccaaagcattttatttgaaaggataacttgtgttttggttattttgtattcccacctgtgctggtagatattattaacccattaggtaaatactattacagtcgtggtttctgcag

SEQ ID NO: 87080 - DNA, 924 bp, Homo sapiens
gggcaggtttctagaaagtgccaccagtggggaggcgccacaacttcactgccattttgtgaggtgccgctgtctctcctccagcaaggtcaggacgaaacaatgaccgataaaacagagaaggtggctgtagatcctgaaactgtgtttaaacgtcccagggaatgtgacagtccttcgtatcagattgcaggctctgccatgtccaaagcaaagaagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacgagaaattaatgctgatataaaacgtaaattagtgaaggaactccgatgcgttggacaaaaatatgaaaaaatcttcgaaatgcttgaaggagtgcaaggacctactgcagtcaggaagcgattttttgaatccatcatcaaggaagcagcaagatgtatgagacgagactttgttaagcaccttaagaagaaactgaaacgtatgatttgagaatacttgtccctggaggattatcacaccccaaatgcataatctcgttaatgattgaggagagaaaaggatcagattgctgttttctacaatggagcaggatattgctgaagtctcctggcatatgttaccgaatcaaatagccttccagaggctaagaaatttctgttagtaaaagatgttctttttcccaaagcattttatttgaaaggataacttgtgttttggttattttgtattcccacctgtgctggtagatattattaacccattaggtaaatactattacagtcgtggtttctgcag

SEQ ID NO: 87081 - DNA, 249 bp, Homo sapiens
agcttgtgcttgagtgcagggaagacaatggaagcagaagtgaagggatcctccagctgacttgtggaagagccagtggggaattttttttttttttgtgagacagagtgttgctctgtcgccaggctggagtgcagagcaggactctgtgtctaaaaaaaggaaaaagaaaaggaaaaaaaaattacgagagacgaaagagaaagagaaaagctgtggctcacatacttttgggggtaacagaccata

SEQ ID NO: 87082 - DNA, 312 bp, Homo sapiens
  misc_feature (173)..(173): n is a, c, g, or t
cccgggctccagaagcagaccagcaaaccagcagaccagcaggtggacagccaaacgatgcggcagagaaagaaggaagaggaggaacatctgaacaccgagaggagttcagctgggggtggttggagaggagtccagccactgggcagcccaactccaggggaagatcatcntcccattccatccccagcttctgggttcccatccatctgactgaaagccagctccaccactctataaaacctcacattcatccttcaagactgtgtgtgacccaatttttctgggacactgggcaagagcttgggctac

SEQ ID NO: 87083 - DNA, 202 bp, Homo sapiens
ggaaactgggatgaacatgggtattctttgggattttgctgtggaggcaaagagatgagtgagatgtagggagaggagaaccgaggagctgaggagtgatggtgtgtagtttgtgttctgcagatgtgagtctgagataggacaacacatttttctgctgagggaaaaaaggaaaggttggagagaacagttgataggcatg

SEQ ID NO: 87084 - DNA, 187 bp, Homo sapiens
tctgcattggcctcccaaagggctgggattgcaggcctgaaccaccgtgaccagccccagtagttttccacctatatatttgtgtccagaaatggtcactgatcatccttgatgcaaaagagtctagaaaaatgaatatttttaactgggcccatgggtgccccaaacccaattgaaattccattag

SEQ ID NO: 87085 - DNA, 512 bp, Homo sapiens
aaaaagtcactgctcttcctatttgtacctctgtttcctactggctttgatgttttctttgaaaaagttattcagtctgtgctctgtgctcagaccttggtcaggaagaatattggaacagtggaggaatcagtccccacagggaaacagggtcttatgggtttgataagttacagatgattgaccacacttgggaacactttgaaactttacagactagagctttccaggtagctaaggtagaattccatagtgagtagcctcagtctgcaagtgtgacaaggtgatctgctttatgaggcttttaggaaaatgataggtgaggacagtgggcagtagcagggagaagataattcagggcatgaatgataggtgattacagattctctggctggacatggtggctcacgcgtgcaatcccagcactttgggaggccgaggtgggtggtggatcacttgaggtcaggagtttgagaccagcctggccaacatggtgaaaccccatctcttct

SEQ ID NO: 87086 - DNA, 669 bp, Homo sapiens
gggactacaggtgcctgccaccatgcctagctaattttttgtatttttagtagagacagggtttcaccgtggtctcgatctcctgacctcgtgatctgccagcctcggcctccagaagtgctgggattacaagcgtgagccactgtgcccggcctgattttgaatttttgtagttgctatcaatagctgtaccaatcagtatatacagcttctgacagtgcaccttatacctgtaaacatctttgagagtgaaaatgcttatctgtgccaaataacacatttaaatgccagagtatttacattttaataagctttttcatgtttgtcattacattgcaattcagttgtttttgactataagccactagaagattgagatagtattttatgaaaaaaatgaaaaacatggaagtttgtgtttcttttgcatctagtagacactatacatgttcactgatgacatgaattgggtatgcactgcaagtcgaatattaaacaagtgcatgagtaggcatatagtatttatgagtaggtcagaagtgattcaagggatcagaagacatataattgaggtgaagttcagaaaagtagctttgttagtaccatgtttagacagagtaaggtgctacagtaaactagggatattttaggaaagcttaatgagtgagg

SEQ ID NO: 87087 - DNA, 414 bp, Homo sapiens
cttttttaggcactgagaaaaatatcagtaaacaaaacaaataaaaattcttattctcatgtagtttaccttataagggaggaggagggttgaaagagatagtttcataagctcttttattgctaatattctgtaatctaaattcctgattgtgggaatcagagagttttaaaaagtgtggggggaggtatattcagactcttctagtctagggaatgcagtcctctttatagatcgtctagttcagaaaacattataaaagcagtaacaccaaagcattcatagttacttttggttcagttaggttaaagacgtttaaaaggcaagttctctatattctggaagattattctcaaatggcaagacagattacagtctggcctgtctcagagatgtttgattaagagccaatgg

SEQ ID NO: 87088 - DNA, 727 bp, Homo sapiens
agccccctgagtagctgggattacaggcgtgtgccaccacgcccagctaattttgtatttttagtagagacgggatgtcactatgtttgtcgggctggtgttgaactcctgagctcatgatctgcctgtcttggcttccctaagtgctgagattacaggcctgagccaccgctagcctatttattttttattttaaattttaattttctatatagagacgaggtcactatcctgcccaggctggtcttaatctcctgggttcagtcaatcttcccaccttggcctcccgaagtgtcagaattatagatgtgagccactgtgcccagcccagaactgatgttttctaaatgctgggtgctgagaaggatgtgtggctggcagtcttgactgtgttatctgtctttaccaggccagtaacttctttggtctggtcatcaagataatctagcatcaccagcaagcatgcatggagaaggatgggcccaatgtggccaagatggtaacgggaccagtagagagccctgtagaagacatctagatattctgccctaagagcccggagggccgggctgtctcatgaccctctgacgtgctgacctggactctggcagaatgtgcacacacacagtcacacagcttcgtggcttgcgcaagtcccaggagggcggtgccagccacaggcttttcccattcgagggttggaagcgtatcatcaaaccacatcaga

SEQ ID NO: 87089 - DNA, 442 bp, Homo sapiens
ggcacctgtagtcccagctacttgggaggctgaggcaggagaacggcgtgaacccaggaggcggagcttgcagtgagccaagatctcgccaccgcactccagcctgggggacagagtgaggctccgtttcaaaaaaaagaagaagaaaaaaaaagctataaggacaaaattgtaacaattggtgaaatttttctatgaactctggattagacaattattacatctctgctacatttcattttaataaatgaactatagttatagtcccctgtgctcagaaaatacactaatataattatagataaaggaaaatgatgtctgaaaattactatcaggtagttcagaagtatatatgtagagagaattagcaaacaaaaaagcaaaatgttaaaaactggtaaatatgtaaggacataggacagttttttctattatttttgca

SEQ ID NO: 87090 - DNA, 437 bp, Homo sapiens
agatcagtaagaaaaagttaacaaccaaaaaagcagacaaggccaaggaccagctcttcacagaggaggtgatattggcagtgaaaagatgcccaagttcactagaaattggagggatgggatttaaaacaagactcaattcaggccagacgtggtagctcacacctgtaatcccagcactctgggaggtggaagcaggaggatgacttgaggccaggagtttgaaaccagcctggtcaccgcagcaagaccccctccctacaaaagaaaagttaaaaaattagctagacatagtggtgcatgcctgtagtttcagctagttgggaggctgaggtgggaggattgcttgagcgtgggaggttgacactgcagtgggccatgatggcgccactgccctccagcctgggcaacagtgagacccggtctcagaaaaataa

SEQ ID NO: 87091 - DNA, 127 bp, Homo sapiens
atttatctgcatccccaaaatgttacatatgctcaagagattaaaagaaaagacatcggaataattagagaaaccatggccttgaggaggacgtgcatggagaggttccacaaaggaaagcaaacag

SEQ ID NO: 87092 - DNA, 426 bp, Homo sapiens
ctggtgtggtggcagcagatgacagggaagcagagctcctaaatctctattttgcttttgtctttacacaaagaagggccacctgactaggaggacaggacgcatgatggaaaaggacctgaagcccgagttggtgagagagaacctcactgttaaaactagttcacaatttcaggtctggatgaattacatctcatgatgttggaggaatttttagatgtgtgtgtgtggagtgagtagagatcatcttggaggtgccctgaagtatgaggaagagagaagaagaaaggaaagaggtagtcacctttattttcaaactggaagccaatgtagatgctggaaaccatggatcagggagctgaagaccatccatcagaaaaattttagcagcgtgtggtatctagttggaaaagaagtagctgatct

SEQ ID NO: 87093 - DNA, 316 bp, Homo sapiens
accactttctttatgcattttttcttctcagctttcatctggaatcatcagcctaaagtacatcttttagattcttcctgatagcagactctctcagtattcgttagtctgcacatgtctttggtttattcttgtttttgaaagatatttctactggatatgcaaattccagtttggcaattattttcttttggcacagtgatgatatcattacactaccttatgctttaatcatcaccactgagaatccagtcatcagactatcatccttttgaagtgaatctgtcttattttctctaatagctttaaacttttt

SEQ ID NO: 87094 - DNA, 388 bp, Homo sapiens
aaggttttgtcatgtgggctagctggtcttgatctcctagcctcaagtgatccgcgtgtctcaacctcccaaagtgtggggattcgggtgtaaaccacaggtgcccggcctttttctttttccccctaaatacttacgatccatagttggttgaatccatgaatgcagaactcatgggtacaatggaccaactatatatacgatcttttttccccctaaatacttacgatccatagttggttgaatccatgaatgcagaactcatgggtacaatggaccaactatatatacgatcttttttccccctaaatacttacgatccatagttggttgaatccatgaatgcagaactcatgggtacaatggaccaactatatatacgatccca

SEQ ID NO: 87095 - DNA, 475 bp, Homo sapiens
cacttgtttgactctgttccatgggtaagaatgtaacactgcaggagccagcagtttttcctgctgagcctcttgctaatgctactgctgatctaaggcttgactgataccttatcattttggcatgttttaactgaccaccacgacacctggcagctcagttctttctgcatcagcttagttcttaacaccaccttcttctcctacttcataagtgtcttggctgttcctggttctttgcatttacatataaattttaggatcagctgtcaaatttgacccactcccttctaaaaaattattgggattttgattgagagtgtattgaatctatagattattggggagaatcaacattcttacatgaattttctaattcatgaacatggtatagcattccatttctttagggtcttaatttttcccaataatattttatggttttctgtgtcggtcttgatcatctttattagat

SEQ ID NO: 87096 - DNA, 192 bp, Homo sapiens
aacacttttacctcccactctcaacgacaggacaaaacaaagaccagctgtattcatcaatgggcccttgttctgcacataaaggctaattacattttgcttcaagcctacacatggaaaactttactgccgttgtctgccacagtcagcccgtgctgtcccagctgacgcatggcgatgactgctcacgat

SEQ ID NO: 87097 - DNA, 366 bp, Homo sapiens
aacaattccaggggccctcaaactaggtaccacagaaccctagaggttccatggagggaggggaggcagcactttggagtggaatttgtttgaagaaaaaaattcgactttaaagaaaaaaagatggatagccacagagaggccagtctgttcattttgtatttgagagtggaggtttagggaggttaagcaacctaccctatgcctcactgagcagtagcggtgagtcgagcagggatctaaaaccaaggcatttattcatttaaccgacatttctcgaacacagcgggaagagggaaatgggctgcatcctggaatctcagagaagacagacgaccagcccaccctcctgaagccgcctgatgc

SEQ ID NO: 87098 - DNA, 447 bp, Homo sapiens
gacacagtgcttatctccatgacagagttgaggggctataagcttacagatgtttagtgatgtgatcgagttgctgagctaacactcagtggagtttgaacccaggcagtatgatttcagagaccacgctgaagtatctgtactgctcatggactgttgccctgaaatgcagtttatttgtctgaagtgtaatgtctggagttttttgcatcttcatcattataaacctcttacaaatattaattgagttccttaggccattccttaaggttttatagcagataagagaagataatgtggttccaactgaagaccaccaaatagtgctcactggtagctgaaattcaggaaatgatttacatatccagcaggagtgattttctttatatatagaaaaatatatttaaattgagttaaatcattatctgtagtaattatagctgaatg

SEQ ID NO: 87099 - DNA, 503 bp, Homo sapiens
gtgcagcttcccccggtagtggtgaggggccaaggaggcagcttttacacccatttaccttcctgcttgcatccaaccttgtgcccatcacaatcaactgtgaactaaactgttgtgcatgctttctttctttctttccttctttttctttccttccttcctttttctttctccttccttccttccttcctcttttagtgtgtgtgagacaaggtttcactctatcacccaggctggagtgtagtggtatgatctttggtcactgcagccttaacctcctggactcaagggatcctcctgcctcagccacttaagtagctgggactatgagtatgtgccaccatgcccatctaatttttgtattttttagtagagataaggtttcaccatgttgcccaagcttcgttttttacctgccgttttttttggtttggtttttagttggtcttaagatacccattgttagcaagagctcagtaaataggagtcgattgaatttccag

SEQ ID NO: 87100 - DNA, 298 bp, Homo sapiens
ataataataataaaaattcttttatattttaattatcttttaaataaaaagatttattatcttattatctttttattattattcaacaaagaatatctttgtggaatttctcatcaaattatgaattattttcccaattcctttgtattggctgtgttctcttgtattttactgagtttccttaagatcattaccttgaattgtttttcaggtatttcatggattctcatttctctggggtctgttactagagaattattgtgttcctttgtggaggtgtcatatttccttgcttttt

SEQ ID NO: 87101 - DNA, 328 bp, Homo sapiens
ttcatgttatgtgctttttactacaattaaaaaaaatttaaccatttaacaaaaaagaaagttataaaagttttttgttatttaaaaaaatatatagccgattcttaaatacttttgattataatagaaatataaatggcctggagaaagttaaggaacagatgccaaacctcagtatatccactagtgacaacttctttttttgctgtgtcgcccagattggagtgcagtggtgcgatctcagctcactgcaacctccacctcttgggttcaagcgattgtcttgcctcggtctcctaagtagctgggattgcaggtctgcaccacc

SEQ ID NO: 87102 - DNA, 819 bp, Homo sapiens
aatccttggagcaactctaggagggaggtgttatcctctaattgcagatgaggttgatgaagcttaaagagtaatgatgccttgagtccatcctctggctccaaagcccttgtatttaactgttctcccttttgcatccctgtgctaaagtgactttgctataatatccacaaggaagaatttctgtgtaaaaattagacttccttgcaggcagtctatcagtgatatccaataaagactcaataatggctaacaatacaaaccacacacacaagaaaaacttctccttttgtgccaggtacttagattaggtgtagtggttttcttaaactgattatcaaggtaaacaccacctcatacatttcagcagagagcagtggtttctctctccagcagtgggagccattgaatcaggacaatgccacacagttgggctttcatgttagatagatcactcttgtggttttgggggatggcattataagagaggagactggagacaggggggctattgtcatgcagatttgttggatgtccacccagcattcactttttccatcttttgccaggggtacactacacaacatcaccagtcatttcatagaatggcaattagattaggcttaggtctgcactgccttccttcactccgctctgtcacttgccatcattgtaaatgctgacaacttagtgcctttcatgcttcaagtatcaataagataggaatagtaatagtatcacattgaattattgtggagttttgaacagatgatacttgtgttatcagtgctcaataaatattagctgtcctcttcctta

SEQ ID NO: 87103 - DNA, 491 bp, Homo sapiens
aactagaaaagaaccaaggagttaggtactttttatacagattccaaatatgccattttagtattccacaattatgccaccatttggaaagaaaggattgttgacagcaaaagatacccctactaaatatgggtcacagatattttaccctaccctaggctatccacctaccacagaaagctgcagttcattgctggggctaccagaaatgccaagatgagattacctagagaaacaggagggtcggccaagcagcaacggccaccaccctttccggggaactccttatggcccttatcccaactttgcctaacaacctgcccaccctgcaatggggtatcaaatgtgaatatactctaggactgaaagattgtataaattgggagaggttctttatttcccccaggttctccagcagaaagcaataagggcactccataattcttgtttctgtaggagaggccatctccatcagctataaccaaaaaaaa

SEQ ID NO: 87104 - DNA, 346 bp, Homo sapiens
tctgttcaatatccattattttcttagtaacagaaccacaattttattacaacaggcaatattcctagttaaagattatagttttatggctctattgtaggtaagtttggcaaaatatatattagaaatgttacctgcaaattccaattgccatttggagaacaactctttgcttgaagatggaagtcagttaaatatattgtgcctaaaagataaaagtgtccaaggtctcaacaagtagctgtcatactatccctggagaactgataacttgagataaatttggtacaattattctgaatatagtaacttaaaacaaatatttatttactgctcacaggttggc

SEQ ID NO: 87105 - DNA, 364 bp, Homo sapiens
ttacacaggtctcaggaagcatgtgtgtgacatgcacaggctgctctgctatgcacaggccttgggaaacacacatgtgacatgcacaggctgtcctgcacatgcctgcctctgtcctgctccttgggcttcctggtacctgccagctgccttggttcctcagcctccttgtctatcatcaccgaggcctttgggcttctggggaaagttctcaacatgcagaactaactctgaaaccacatgtgtgctggccttgcccatttgccaccatctccagtgtccccagacacagcaaactgtcccaacaatgccttcctgtcctttcagcctgactcatcaactgtcattcaacacctagtgattg

SEQ ID NO: 87106 - DNA, 759 bp, Homo sapiens
tgagacagaggttctctcaatgttgcccaggctggtctcaaactcttgggctcaagcgatcctccctcctctgcctctggagtagctgggattacaagcacgtgcctactatgcctgtcttcaaaatcacattgttaatttttatagccacaattattaatttgataaaacaaataattttatagaagcattaaagtattatcagaacaaaatcagagttccaaaatttggggagtattttaagattgtgaaatgttaccttttggatgcaaaccaatgatacaaatctttaagaaagaattacagtgggactcctttgaaactctgattttgaaaatagaacaaatacacatttcatagccaaactttgtgtgggacttctattgttactaattgtaaggctgtaactttggttgacttcatccaaatccaagaaacagagtcacagtagtgagactattctcattgcttctttggagcattagctgaagctttaccatatcacataccttacaaaatccctatacatattgccagttttaaaagaatgtaattatgcatgttacaaactatatatatctttttggctagagaagtgactattttagaataacagtatgaatgtaaaaggcaataattttttttaaatacacaaaacattgccattgcccttttttgtcacttccttttttcttctaaaaattttcatttggtgtatctaactttgtatcacttaaattattcagacttactaagata

SEQ ID NO: 87107 - DNA, 462 bp, Homo sapiens
ggggtgactaagactccgtctgaaaaaaataaggaaatgaagactcctcttttcacttagaggagatccagcgaggacttagccctaaaccaaaggacacagaaaccacaaatccccactcccatagtgtcagggctggaccaggggacgtcatgggcctggggatgccagggtggggtggcagggattccgcctggagtgggacagtagaatccattcaggggcaggtgcggtggctcacgtctgtaatcccagcactttgagaggctgaggcgggtggatcacaaggtcaggagttcaagaccagcctggctaagatggtgaaaccccatctctactaaaaataataatacaaaaaattagccaggcgtgggtatccgcctgtagtcccagctactcgggaggctgaggcagaagaattgcttgaacccaggaggtggaggttgcagtgagccaagatcg

SEQ ID NO: 87108 - DNA, 355 bp, Homo sapiens
agctattctcatgcctcagactcccgagtagctgggattacaggcacctgccaccacacccagctaatttttgtatttttagtagacaaggggttttgccatgttggccaggctggtcttgaacttccgaccctaggttatctgcttgcctcggcctcccaaagtgctgggattacaggcatgagccactgcacccaacctgccacgactaacctttaagaaattattacctatgagttttggcagagtatcaaagaagactacctacaaggatctctcaaaagactattaaactctcttcccttttccaacaacatatctgtctaaggtcaggttttcttcatatacttcaatc

SEQ ID NO: 87109 - DNA, 282 bp, Homo sapiens
gatcatcaaagaaagacagggtgacctgaggattatatgttcagccaagctcccctccaagcataaaggctacagataaccatttgtacatattcaggaactggagtaatgtgattccaatgagcctgtcttgaaggaactcctaggggattaacttcagctaacctgggaagttatctggagaaaccacaacagaaggactggttgtagttcgaggctgtagtcagctatgattgcaccactgcactctagcctggataatagagcaagactttgtctcca

SEQ ID NO: 87110 - DNA, 602 bp, Homo sapiens
ggttaagttttaggcttccccagaatagaaacaagaaagtgaagtgtggaaaggagggtgtggtaaattcagatggcagatctaagaagagatggctccttcccactaacagattaatcatagagactcatcactgatgattgtaaaacatagttcagtgccatggacccatttctacatctttagttgatatcctctttacatatattctcccatttacaatcaatattctatgaagaattctcaatactcaactcacttccctctgcacttccctacacctcagtcttcatttctcatctactgggacttggttcccccacccttccactgaaatgaactctcccaagtctacagccacctctttgtcacatttatagatcaagagtgttgaaataaatgttcaaatggagataaacaggtactttcccagggggaaaaggtttccctcccccaagacagaattcatttccttgtgtctatagacaaagatagcatgcaatgctatcagttacctaaaaggtagagttgtaaaacagctttcagagtcagataaccagaaggctaagctgcagacgacatgctttcaaatgaagcacaca

SEQ ID NO: 87111 - DNA, 237 bp, Homo sapiens
attgtatatcagtttctatatatttttcaggcaaatatgggagaaaatgggtttaaaaacacaatccgagatgcaaatgcagtcacagaacatgccccattggctcaggccagaagaaactggagtcaggaaaagaggccggcagactcagagtcccaggaagccaatggcgccttggaggctcttgggaggatggagcgagagagctggtgctttgaggcaacgggaagcaggatc

SEQ ID NO: 87112 - DNA, 303 bp, Homo sapiens
aaacaaaaggtaaatatcacaaggaaagactgatgatttaaatgttttattaacatcaaatcctaagagcacagcaaaataaaattcagttgtctcacatgaagtaaggataagaatcccaatataaaaaccaccatatggtattaaaaaaaagggaaacagtacctgcacaatcaaaaacttatctaaaatttaaaactaaatcatgatagagaatagcagctctggagacatattggtgaactgctctaaatacaaaaatcaattcaagtgtttagataaaaatttttctggaaagtgatc

SEQ ID NO: 87113 - DNA, 858 bp, Homo sapiens
ctgcattttatttatttcagccttctctctctttttttcttagtctagataaaggcttgtggattttgttttttaaaccagctcttcatttcattgatctttattttagtctttttttgtttatttcttctctgagctttattatttcctttttagattgccaattttgccaattttgagtttggtttgttcctgcttatctctcgcctaagtcttaaagattaagagcttgtgaacagaatattggcagaaatatggacaatgaaggcctttctgatgaggtctcagatggaaatgaggaatatcttattagaaactgaaggcttgagaaaaatgtccttaagtgtcgtaaacttgcatcaaacccacttactcatcaaaccccacttatgacttcccttagaggacaagcgacatttcagctcagttatacactgcttttctcaattcctgccatttttttctcttcctttgccccctggcctacgtctccagctcactgaaaacagcctcccctgatgagcacaccattgttatgtaatagcctaacccttacccctcgcctatcagggggtgccaagcctgcagactcactctgccttcctcaaaactgccctgaggagaaggctgaagactgaggaatcctctttctgcctcccatttgactgcattttctttggtcaaaggcttccttattcatgggacctgcctgggtccaggaccccttgacaggtgctctctggctgcctgtcctctgggcactcttgtcccaggtctattgttttcatgacccaccaggatggcgcttcacttcctcagaaattgtgatccccaggaaagtgccccacaagaggggtg

SEQ ID NO: 87114 - DNA, 635 bp, Homo sapiens
tgtgttgagtgtgagtgtgtctctgtgtgtgtaggggtcgaggtggggggggtccgtgtttgcgatctgaacctttggtacctacaaggagggtgtctcaccgaacggtagctaaaacctcaccagaaccgcgcggaagtgagaagtcgcggccaaaggcgcccgcagaagcctcctctctgggccggaccccagcccgagcggccgaaaggagccccccgcccggatcacaggtgtgttgctggcaatatgtggccccaggggagaggcaaaagtggaggttcccgagtcatctgagatttgttgcctcggaacaggatccacagctcaataatagtcactgtactgtcattgtttatttgaaatctaaaggtgtaatgcaagaatatgcaagaccacagggactggagacacaaagagcatctgaagagagcttgaatgactcccaacagttccagtctcaaagttaccatgtgcagcacagtcagggcagcatgtgagaagaacaacaagaaagctggggtctgccagagaagacggaagccctcacattaaactgagtcagctggcatcttgatcttggactttcaaatctccagaactgtgagaaataaatgttagttgtttaaaccacc

SEQ ID NO: 87115 - DNA, 1721 bp, Homo sapiens
tgtgttgagtgtgagtgtgtctctgtgtgtgtaggggtcgaggtggggggggtccgtgtttgcgatctgaacctttggtacctacaaggagggtgtctcaccgaacggtagctaaaacctcaccagaaccgcgcggaagtgagaagtcgcggccaaaggcgcccgcagaagcctcctctctgggccggaccccagcccgagcggccgaaaggagccccccgcccggatcacagctgctgcagctgccgctgaaattcgctgtggccgctgcctcttcccgctttaatcccagacctccagtcattgggcagctcctcagaggcaagaagtcaacaccatggcaacccgacaagcctatcaaatcaccggctggcgtgacagcagcaacactgcaggcaggagtgggctgggcggaagagcagagtggccactgcgctcagaagtttacaaggaaaggggaaatgtctgaaatggagattgcacaatcctgtcttgaagcagaagactcagctagagcacatctggaaacacctggcactcctcaatagaattcaaatgctattttaaaagagtccatttctaagaagatgtggttcgaacatacagagctacataatatgagtaaaataggacctaacagtagtgttctccagcattgctctgcctttccttttctggatgtaacaacattactaagaaaggaagaaaaagcaaaaatctgctctcggggagattccagaatgttggaaagccccaaatggaagtctctgctttggttacaggacataaggtttaataaataaaaagatgctcatctgggatgctgcaccaattatcatgtactaaataaggttacctacttcactctccaggtagaaatgtctatcataagcatgtgccacagaaggtctctcaagtatcattattggctgtgttgaattttgtttttagttctcttttataaggtctgtagtcttactttcagtgaggaagtgttttctcaggttctcaagaaagtaacaaaatgccagcattgtcaaggtcaccattgccactgaattatcttactgtctgattaattccatcttcctctgcatcatattagcctgatgactacattctaattatttaaagcgttatgtaaatcaaagccagtaaatgtaatttctagtcttactagatatcatgtacattaggtcgaataactctagaaatgtcgtcataatcatgtcatgcctaatgatgacctactcagcccctgccaacatcattcaattactcatttcagtattgatttttctcatgcctctcttcatggcatttaaacagccctcacatctccccttttactgaggtgtaatgttgtataatgacagagatgctttgcttcccagattcataatgttacactctgtttcaaatccttttggagacaaattggggaatcaatatataaataatgacacacttatttttaattaaaatcactgctttcacagaaatggtatattaaaattatttttgctaaaaaaattttaaatacctatgtacgataaaaagactgccaatccttgggatcaagaatataatttgccccaaataacttttctgtaaaagtagaattcttaatggaaaatagattaatacatataatttcaagatctaaccttaaaaatggaaataatgtgtccatttttaaaaataaatcatatttacataca

SEQ ID NO: 87116 - DNA, 1888 bp, Homo sapiens
tgtgttgagtgtgagtgtgtctctgtgtgtgtaggggtcgaggtggggggggtccgtgtttgcgatctgaacctttggtacctacaaggagggtgtctcaccgaacggtagctaaaacctcaccagaaccgcgcggaagtgagaagtcgcggccaaaggcgcccgcagaagcctcctctctgggccggaccccagcccgagcggccgaaaggagccccccgcccggatcacagctgctgcagctgccgctgaaattcgctgtggccgctgcctcttcccgctttaatcccagacctccagtcattgggcagctcctcagaggcaagaagtcaacaccatggcaacccgacaagcctatcaaatcaccggctggcgtgacagcagcaacactgcaggcaggagtgggctgggcggaagagcagagtggccactgcgctcagaagtttacaaggaaaggggaaatgtctgaaatggagattgcacaatcctgtcttgaagcagaagactcagctagagcacatctggaaacacctggcactcctcaatagaattcaaatgctattttaaaagatgtaaaatctgagctgcaacactgaacaaaagctgtacttgccagccagcaaagatgctaccactctgcacaacagataaaacccatacatatagggaagtcaaaagagtctttaagctacagtgtttgagaggctgtttgtctctgatggaaaattaagaaaatgagtccatttctaagaagatgtggttcgaacatacagagctacataatatgagtaaaataggacctaacagtagtgttctccagcattgctctgcctttccttttctggatgtaacaacattactaagaaaggaagaaaaagcaaaaatctgctctcggggagattccagaatgttggaaagccccaaatggaagtctctgctttggttacaggacataaggtttaataaataaaaagatgctcatctgggatgctgcaccaattatcatgtactaaataaggttacctacttcactctccaggtagaaatgtctatcataagcatgtgccacagaaggtctctcaagtatcattattggctgtgttgaattttgtttttagttctcttttataaggtctgtagtcttactttcagtgaggaagtgttttctcaggttctcaagaaagtaacaaaatgccagcattgtcaaggtcaccattgccactgaattatcttactgtctgattaattccatcttcctctgcatcatattagcctgatgactacattctaattatttaaagcgttatgtaaatcaaagccagtaaatgtaatttctagtcttactagatatcatgtacattaggtcgaataactctagaaatgtcgtcataatcatgtcatgcctaatgatgacctactcagcccctgccaacatcattcaattactcatttcagtattgatttttctcatgcctctcttcatggcatttaaacagccctcacatctccccttttactgaggtgtaatgttgtataatgacagagatgctttgcttcccagattcataatgttacactctgtttcaaatccttttggagacaaattggggaatcaatatataaataatgacacacttatttttaattaaaatcactgctttcacagaaatggtatattaaaattatttttgctaaaaaaattttaaatacctatgtacgataaaaagactgccaatccttgggatcaagaatataatttgccccaaataacttttctgtaaaagtagaattcttaatggaaaatagattaatacatataatttcaagatctaaccttaaaaatggaaataatgtgtccatttttaaaaataaatcatatttacataca

SEQ ID NO: 87117 - DNA, 1160 bp, Homo sapiens
tgtgttgagtgtgagtgtgtctctgtgtgtgtaggggtcgaggtggggggggtccgtgtttgcgatctgaacctttggtacctacaaggagggtgtctcaccgaacggtagctaaaacctcaccagaaccgcgcggaagtgagaagtcgcggccaaaggcgcccgcagaagcctcctctctgggccggaccccagcccgagcggccgaaaggagccccccgcccggatcacaggtgtgttgctggcaatatgtggccccaggggagaggcaaaagtggaggttcccgagtcatctgagatttgttgcctcggaacaggatccacagctcaataatagtcactgtactgtcattgtttatttgaaatctaaaggtgtaatgcaagaatatgcaagaccacagggactggagacacaaagagcatctgaagagagcttgaatgactcccaacagttccagtctcaaagttaccatgtgcagcacagtcagggcaggtctgtctaactgggcttccttgaattaacttccacatagaatacattgtttattaaagaataagtatttctagcttaaatcttgcgtgtatataatattattaaatctcaatgggaaccccaggaattgttttgaaattagatctaccaaagatgtttctcaaggaggagtattttatttttgaattgtttagaattgctggaacacagtgataatagtagggcaaatcatagccaatttgttattgttattaaattctctgtagacaatgcacactcttgtctgtactggggaagactgcaccgtctgctccactctttgtacactatgtgtcagctttgacttaaccatttttactacatttctgtattagattccaagttccaaagagaaggtatattgtatactgtcttcttccctaaccttatatccttttgctccacattttattacagccatgatgacccattttacgtcaaattgatcagatcatgaaatatccaaatatttggtgaaaaattatcctaggtgtttctgtgagagtatttttggatgaaattaaccttttaatcagtagagaaaattgccctccataatgtgtgcgggcctcatccaatcagttgaagaccccaaaagaataaaaatattgactgtcacttccctgag

SEQ ID NO: 87118 - DNA, 403 bp, Homo sapiens
aagagactaagcacattccctgtagtgctttaagaatgcaatcagaacaacaggcgagggttgtagagaggtatatttcgctaccatacaggacagttttccccccctcaatcactattgctattcatcaaggcgctagttgtcttaagggagaatatgagttttgcattactagaaatattcaatataacctttataatttttcttttctttttattttcaaatagagtccatttctaagaagatgtggttcgaacatacagagctacataatatgagtaaaataggacctaacagtagtgttctccagcattgctctgcctttccttttctggatgtaacaacattactaagaaaggaagaaaaagcaaaaatctgctctcggggagattccagaatgttg

SEQ ID NO: 87119 - DNA, 781 bp, Homo sapiens
tccctcccaattcctaactgctccctatggtgtgtggtttcgcttgctacaatcagcgaataaacgtaattttgtttcacttgtaggtgtgttgctggcaatatgtggccccaggggagaggcaaaagtggaggttcccgagtcatctgagatttgttgcctcggaacaggatccacagctcaataatagtaaatatatctgagattccttgtgtctctagctgtctgaggcattaccctaccaatggctgagagttaagttcctctggatttagactttgtttgcaggtcactgttaacagagaatatgaaacactatgctgtctcacacaagccatttccatcatgcttctgctgggtggtcgttaggtcaaagctgacctccttgataaatgcttcaaatcatgatatgttttaggatatgttaaggaaagatactatatattaaaatcaatgcaaacaggtgtaaagatgacattaggtatgaacattacagagcctagcacattcagcttgagacagaggccattgtagagtaatatagactgtaggtatatgtgcagacagagcccaaactgaggtattataattttattatctactgggatacatatgtaaatgaaatgctaatgtactagtatacaaaaatgcatggaagagtttatcttggcttttaaaaaggtggttattattaattgacaatcttgaccatgagatgatttaattatgaaatatataaaacattggatttgcaatatatatcctcaatggtcaaggaaac

SEQ ID NO: 87120 - DNA, 1453 bp, Homo sapiens
ccttaggcaacttaagcctgccttgtggagtgcccctgtgggggactccagccagcctgagtgacatgatccaaagagccctcctgggtaggaaattgccccggtggaatccctcaccagagaagcaggtagcaggccctcgcagaggattaacacagtggctgaacaccaggaaggaactggcacttggagtccagacatctaaaatttggaaatgaaagcatttgtccagatctctggcaaagatggcactgtggtgttttctctggggccagttgtgcaaaaccttatagaagagaaggctgatctcattgcttcagacttggcccagattccacagaaggaagacccactacattatctgagacaatggggaaagctgacgtatggcttattcgaaactcctggaattttcagtttcctcatccactcttaccaaatgttgattttgttggaggactccactgcaaacctgccaaacccctgcctaaggaaatggaagactttgtacagagctctggagaaaatggtgttgtggtgttttctctggggtcaatggtcagtaacatgacagaagaaagggccaacgtaattgcatcagccctggcccagatcccacaaaaggttctttggagatttgatgggaataaaccagatgccttaggtctcaatactcggctgtacaagtggataccccagaatgaccttctaggtcatccaaagaccagagcttttataactcatggtggagccaatggcatctacgaggcaatctaccatgggatccctatggtgggcattccattgttttttgatcaacctgataatattgctcacatgaaggccaagggagcagctgttagagtggacttcaacacaatgtcgagtacagacctgctgaatgcactgaagacagtaattaatgatccttcatataaagagaatattatgaaattatcaagaattcaacatgatcaaccagtgaagcccctggatcgagcagtcttctggattgaatttgtcatgcgccacaaaggagccaaacatcttcgagttgcagcccacaacctcacctggttccagtaccactctttggatgtgattgggttcctgctggcttgtgtggcaaccgtgctatttatcatcacaaagtgttgtctgttttgtttctggaagtttgctagaaaaggaaagaagggaaaaagggattagttatatctgagatttgaagctggaaaacctgatagatagagaatacttcagttgattccagcaataaatattgtgatgcaagatttctttcttcctgtgacaaaaaaaaatcctttcgaagtctaccttgtcaagtaaaaatttgtttttcagagatttaccacccagttaatggttagaaatattctgtggcaatgaagaaaacactaggggaaataaaaaataatataaagccatatga

SEQ ID NO: 87121 - DNA, 1788 bp, Homo sapiens
ctgcacaaggatggctctgaaatggactacagttctgctgatacaactcagtttttactttagctctgggagttgtggaaaggtgctggtatgggccgcagaatacagcctttggatgaatatgaagacaatcctgaaagaacttgttcagagaggtcatgaggtgactgtactggcatcttcagcttccattctttttgatcccaacgactcatccactcttaaacttgaagtttatcctacatctttaactaaaactgaatttgagaatatcatcatgcaattggttaagagattgtcagaaattcaaaaagatacattttggttacctttttcacaagaacaagaaatcctgtgggcaattaatgacataattagaaacttctgtaaagatgtagtttcaaataagaaacttatgaaaaaactacaagagtcaagatttgacatcgtttttgcagatgcttatttaccctgtggtgagctgctggctgagctatttaacataccctttgtgtacagtcacagcttcagtcctggctactcatttgaaaggcacagtggaggatttattttccctccttcctacgtacctgttgttatgtcaaaattaagtgatcaaatgactttcatggagagggtaaaaaatatgctctatgtgctttattttgacttttggttccaaatatttaatatgaagaagtgggatcagttttacagtgaagttttaggaagacccactacattatctgagacaatggggaaagctgacgtatggcttattcgaaactcctggaattttcagtttcctcatccactcttaccaaatgttgattttgttggaggactccactgcaaacctgccaaacccctgcctaaggaaatggaagactttgtacagagctctggagaaaatggtgttgtggtgttttctctggggtcaatggtcagtaacatgacagaagaaagggccaacgtaattgcatcagccctggcccagatcccacaaaagtcggctgtacaagtggataccccagaatgaccttctaggtcatccaaagaccagagcttttataactcatggtggagccaatggcatctacgaggcaatctaccatgggatccctatggtgggcattccattgttttttgatcaacctgataatattgctcacatgaaggccaagggagcagctgttagagtggacttcaacacaatgtcgagtacagacctgctgaatgcactgaagacagtaattaatgatccttcatataaagagaatattatgaaattatcaagaattcaacatgatcaaccagtgaagcccctggatcgagcagtcttctggattgaatttgtcatgcgccacaaaggagccaaacatcttcgagttgcagcccacaacctcacctggttccagtaccactctttggatgtgattgggttcctgctggcttgtgtggcaaccgtgctatttatcatcacaaagtgttgtctgttttgtttctggaagtttgctagaaaaggaaagaagggaaaaagggattagttatatctgagatttgaagctggaaaacctgatagatagagaatacttcagttgattccagcaataaatattgtgatgcaagatttctttcttcctgtgacaaaaaaaaatcctttcgaagtctaccttgtcaagtaaaaatttgtttttcagagatttaccacccagttaatggttagaaatattctgtggcaatgaagaaaacactaggggaaataaaaaataatataaagccatatga

SEQ ID NO: 87122 - DNA, 1217 bp, Homo sapiens
ctgcacaaggatggctctgaaatggactacagttctgctgatacaactcagtttttactttagctctgggagttgtggaaaggtgctggtatgggccgcagaatacagcctttggatgaatatgaagacaatcctgaaagaacttgttcagagaggtcatgaggaagacccactacattatctgagacaatggggaaagctgacgtatggcttattcgaaactcctggaattttcagtttcctcatccactcttaccaaatgttgattttgttggaggactccactgcaaacctgccaaacccctgcctaaggaaatggaagactttgtacagagctctggagaaaatggtgttgtggtgttttctctggggtcaatggtcagtaacatgacagaagaaagggccaacgtaattgcatcagccctggcccagatcccacaaaaggttctttggagatttgatgggaataaaccagatgccttaggtctcaatactcggctgtacaagtggataccccagaatgaccttctaggcaatctaccatgggatccctatggtgggcattccattgttttttgatcaacctgataatattgctcacatgaaggccaagggagcagctgttagagtggacttcaacacaatgtcgagtacagacctgctgaatgcactgaagacagtaattaatgatccttcatataaagagaatattatgaaattatcaagaattcaacatgatcaaccagtgaagcccctggatcgagcagtcttctggattgaatttgtcatgcgccacaaaggagccaaacatcttcgagttgcagcccacaacctcacctggttccagtaccactctttggatgtgattgggttcctgctggcttgtgtggcaaccgtgctatttatcatcacaaagtgttgtctgttttgtttctggaagtttgctagaaaaggaaagaagggaaaaagggattagttatatctgagatttgaagctggaaaacctgatagatagagaatacttcagttgattccagcaataaatattgtgatgcaagatttctttcttcctgtgacaaaaaaaaatcctttcgaagtctaccttgtcaagtaaaaatttgtttttcagagatttaccacccagttaatggttagaaatattctgtggcaatgaagaaaacactaggggaaataaaaaataatataaagccatatga

SEQ ID NO: 87123 - DNA, 564 bp, Homo sapiens
aacttactttcagtgtcggtatctttatttttatccttcagatatataaagagaatattatgaaattatcaagaattcaacatgatcaaccagtgaagcccctggatcgagcagtcttctggattgaatttgtcatgcgccacaaaggagccaaacatcttcgagttgcagcccacaacctcacctggttccagtaccactctttggatgtgattgggttcctgctggcttgtgtggcaaccgtgctatttatcatcacaaagtgttgtctgttttgtttctggaagtttgctagaaaaggaaagaagggaaaaagggattagttatatctgagatttgaagctggaaaacctgatagatagagaatacttcagttgattccagcaataaatattgtgatgcaagatttctttcttcctgtgacaaaaaaaaatcctttcgaagtctaccttgtcaagtaaaaatttgtttttcagagatttaccacccagttaatggttagaaatattctgtggcaatgaagaaaacactaggggaaataaaaaataatataaagccatatga

SEQ ID NO: 87124 - DNA, 2799 bp, Homo sapiens
ctgcacaaggatggctctgaaatggactacagttctgctgatacaactcagtttttactttagctctgggagttgtggaaaggtgctggtatgggccgcagaatacagcctttggatgaatatgaagacaatcctgaaagaacttgttcagagaggtcatgaggtgactgtactggcatcttcagcttccattctttttgatcccaacgactcatccactcttaaacttgaagtttatcctacatctttaactaaaactgaatttgagaatatcatcatgcaattggttaagagattgtcagaaattcaaaaagatacattttggttacctttttcacaagaacaagaaatcctgtgggcaattaatgacataattagaaacttctgtaaagatgtagtttcaaataagaaacttatgaaaaaactacaagagtcaagatttgacatcgtttttgcagatgcttatttaccctgtggtgagctgctggctgagctatttaacataccctttgtgtacagtcacagcttcagtcctggctactcatttgaaaggcacagtggaggatttattttccctccttcctacgtacctgttgttatgtcaaaattaagtgatcaaatgactttcatggagagggtaaaaaatatgctctatgtgctttattttgacttttggttccaaatatttaatatgaagaagtgggatcagttttacagtgaagttttaggaagacccactacattatctgagacaatggggaaagctgacgtatggcttattcgaaactcctggaattttcagtttcctcatccactcttaccaaatgttgattttgttggaggactccactgcaaacctgccaaacccctgcctaaggaaatggaagactttgtacagagctctggagaaaatggtgttgtggtgttttctctggggtcaatggtcagtaacatgacagaagaaagggccaacgtaattgcatcagccctggcccagatcccacaaaaggttctttggagatttgatgggaataaaccagatgccttaggtctcaatactcggctgtacaagtggataccccagaatgaccttctaggtcatccaaagaccagagcttttataactcatggtggagccaatggcatctacgaggcaatctaccatgggatccctatggtgggcattccattgttttttgatcaacctgataatattgctcacatgaaggccaagggagcagctgttagagtggacttcaacacaatgtcgagtacagacctgctgaatgcactgaagacagtaattaatgatccttcatataaagagaatattatgaaattatcaagaattcaacatgatcaaccagtgaagcccctggatcgagcagtcttctggattgaatttgtcatgcgccacaaaggagccaaacatcttcgagttgcagcccacaacctcacctggttccagtaccactctttggatgtgattgggttcctgctggcttgtgtggcaaccgtgctatttatcatcacaaagtgttgtctgttttgtttctggaagtttgctagaaaaggaaagaagggaaaaagggattagttatatctgagatttgaagctggggaattccgtttattgaagattcaggttaacctgaatcaagttaacccagtctcaaatgctcacttatcctatctccttggcacaaatctctcctctcctggattgccaaagaaaattcaaattattcttcaattagtcaggatgatttgactatcagcagttcatagtacccatcttcataactaagccacctagggatccggcagaaaaaaaagggatgcaggggagtcatcatacagggggtggatcatttaccaggatccacacttcctacaaagcggttgtaatattaaataacaaaactgttttttattccaatcttcacataaaacaggaataattgtatactttcttactaatgtgttccatggagtttttcctccaagaagtggcttaggggaaaatgagccccagtaatgctctgtggcatccaatccttctaccccgaccctttgactttctgccccagcccctcttagttctcctagaattaggactaaggttaagtgccctcttgggatatgacttccttcccttcctcttgatacaaaaagagcctattaccaaccctcatacacacaagagttcccttcctagttgcagactcttctgctccagctggactcccctagctctggactcccactagatcacacaggggtccctgcatgtcagtaaactttggatgaccttgggagaccaaaaaatggaatatcattttttgatctaaacaaaatagtttcctgatttaacactggccaggaaggtgggctgcaccctcagtctctctctcccatcatggttttcacatgatatcaaaggactctcataacagtctgattcttatgagttgggcatcctgtgtttccctttagggcctgcttccttcaaatagaggagatgggtgctatgaaacctattcactctggacttgggatggctcttctccatcttcccaagtctgagctggagcctccatgcccaactctgctctgctcttctatttcctgacagcagctaaggcatgttcctgttctgcccccaaattgaccttactaacagtgagaacttggaggagtcttcgggtcttgggaaatccaagttttcccggaaacgttttgttgtaaacagtgtccacactctttgctccaataaagctcggttccttaagggaattc

SEQ ID NO: 87125 - DNA, 1340 bp, Homo sapiens
ccttaggcaacttaagcctgccttgtggagtgcccctgtgggggactccagccagcctgagtgacatgatccaaagagccctcctgggtaggaaattgccccggtggaatccctcaccagagaagcaggtagcaggccctcgcagaggattaacacagtggctgaacaccaggaaggaactggcacttggagtccagacatctaaaatttggaaatgaaagcatttgtccagatctctggcaaagatggcactgtggtgttttctctggggccagttgtgcaaaaccttatagaagagaaggctgatctcattgcttcagacttggcccagattccacagaaggaagacccactacattatctgagacaatggggaaagctgacgtatggcttattcgaaactcctggaattttcagtttcctcatccactcttaccaaatgttgattttgttggaggactccactgcaaacctgccaaacccctgcctaaggaaatggaagactttgtacagagctctggagaaaatggtgttgtggtgttttctctggggtcaatggtcagtaacatgacagaagaaagggccaacgtaattgcatcagccctggcccagatcccacaaaaggttctttggagatttgatgggaataaaccagatgccttaggtctcaatactcggctgtacaagtggataccccagaatgaccttctaggtcatccaaagaccagagcttttataactcatggtggagccaatggcatctacgaggcaatctaccatgggatccctatggtgggcattccattgttttttgatcaacctgataatattgctcacatgaaggccaagggagcagctgttagagtggacttcaacacaatgtcgagtacagacctgctgaatgcactgaagacagtaattaatgatccttcatataaagagaatattatgaaattatcaagaattcaacatgatcaaccagtgaagcccctggatcgagcagtcttctggattgaatttgtcatgcgccacaaaggagccaaacatcttcgagttgcagcccacaacctcacctggttccagtaccactctttggatgtgattgggttcctgctggcttgtgtggcaaccgtgctatttatcatcacaaagtgttgtctgttttgtttctggaagtttgctagaaaaggaaagaagggaaaaagggattagttatatctgagatttgaagctggaaaacctgatagatagagaatacttcagttgattccagcaataaatcgtgatgcggccgtgcaccacactaaatattactaatactctaacgggagcggggcggc

SEQ ID NO: 87126 - DNA, 1233 bp, Homo sapiens
ccttaggcaacttaagcctgccttgtggagtgcccctgtgggggactccagccagcctgagtgacatgatccaaagagccctcctgggtaggaaattgccccggtggaatccctcaccagagaagcaggtagcaggccctcgcagaggattaacacagtggctgaacaccaggaaggaactggcacttggagtccagacatctaaaatttggaaatgaaagcatttgtccagatctctggcaaagatggcactgtggtgttttctctggggccagttgtgcaaaaccttatagaagagaaggctgatctcattgcttcagacttggcccagattccacagaaggaagacccactacattatctgagacaatggggaaagctgacgtatggcttattcgaaactcctggaattttcagtttcctcatccactcttaccaaatgttgattttgttggaggactccactgcaaacctgccaaacccctgcctaaggaaatggaagactttgtacagagctctggagaaaatggtgttgtggtgttttctctggggtcaatggtcagtaacatgacagaagaaagggccaacgtaattgcatcagccctggcccagatcccacaaaaggttctttggagatttgatgggaataaaccagatgccttaggtctcaatactcggctgtacaagtggataccccagaatgaccttctagatataaagagaatattatgaaattatcaagaattcaacatgatcaaccagtgaagcccctggatcgagcagtcttctggattgaatttgtcatgcgccacaaaggagccaaacatcttcgagttgcagcccacaacctcacctggttccagtaccactctttggatgtgattgggttcctgctggcttgtgtggcaaccgtgctatttatcatcacaaagtgttgtctgttttgtttctggaagtttgctagaaaaggaaagaagggaaaaagggattagttatatctgagatttgaagctggaaaacctgatagatagagaatacttcagttgattccagcaataaatattgtgatgcaagatttctttcttcctgtgacaaaaaaaaatcctttcgaagtctaccttgtcaagtaaaaatttgtttttcagagatttaccacccagttaatggttagaaatattctgtggcaatgaagaaaacactaggggaaataaaaaataatataaagccatatga

SEQ ID NO: 87127 - DNA, 581 bp, Homo sapiens
cccccatcttccttatacggatatgcttgtacggagcagggtcgtttttttatcaagcacatataaagagaatattatgaaattatcaagaattcaacatgatcaaccagtgaagcccctggatcgagcagtcttctggattgaatttgtcatgcgccacaaaggagccaaacatcttcgagttgcagcccacaacctcacctggttccagtaccactctttggatgtgattgggttcctgctggcttgtgtggcaaccgtgctatttatcatcacaaagtgttgtctgttttgtttctggaagtttgctagaaaaggaaagaagggaaaaagggattagttatatctgagatttgaagctggaaaacctgatagatagagaatacttcagttgattccagcaataaatattgtgatgcaagatttctttcttcctgtgacaaaaaaaaatcctttcgaagtctaccttgtcaagtaaaaatttgtttttcagagatttaccacccagttaatggttagaaatattctgtggcaatgaagaaaacactaggggaaataaaaaataatataaagccatatga

SEQ ID NO: 87128 - DNA, 360 bp, Homo sapiens
atgtcttacatggctggtgcaggaggaagagagagaagtgggaggtgctacacacttttatttatatttatttattattttgagacaaagtctggttctaccaccaggctggagtgcagcggtgcaattttggttcactgcaatctctgcctcctgggctcaagccatcctcccacctcagcctcccgagtagtagggactacagggatgcaccacaatgcccagctaatttttgaattttttgtggagacagggttttgccatgtttcccgggctggtctcaaactcctgtgtgcaagcaatccacacaccttggcttcccaaagtactgagattacaggtgtgagcctctgcgcctgg

SEQ ID NO: 87129 - DNA, 492 bp, Homo sapiens
gagggtatatcattctgacacacatcaagaggctgaactaaattgatttttttaaagataaggtgttctcattttaaacacgctaacagattaaatataacagtattagaaagctcaagttttaagttgatggacacaaaaagaaattcagtcccttgtgctacttttctagtgcgccttattaaatccaaatctgaacaatgtaactgagaatgaacaaatgctccttttgatggttgcaaacaaagcacctgttgaatgtcaaagcaaaccatatgcatgcgcacttaatctttgaaatttaagataaggtctgatgttcccaacccagctttttctactgcaatttatcaaacctcagtactgctaggtttacaagctttttcttccgaattttgttctatgaagaggaaaatagtgctcttgagatattataatagctactgatttaataggtctgaatttaatatgatggtacagaaaatgtcttgc

SEQ ID NO: 87130 - DNA, 441 bp, Homo sapiens
tacaggagcgcaccactacacccagctaatttttgtattttagtagagatggggtttcaccatgttggtcaggctggtctcaaattcttgacctcgtgatccgcctgcctcggcctcccaaagtgctgggattcaggcgtgagccatggcgcccagcctacttggtcatttttaaagagagtcaggacaatgcagctgaaagcaaaggacttttctttagttcagttcatcatttcattattttgcttgcagtattgcaaagaaaatttctcataatctaatgagaactttggagagaatcttttaagtaaatgaaagtttattgttggaaactaagtatgttagcaaaatcttagttatgtttcattgttgatattttccaaactgagtcaggttatcattaaacctaactctttgaaaggacctcttggtgtacctctc

SEQ ID NO: 87131 - DNA, 394 bp, Homo sapiens
tataatcctttagactaaaatcctttcctttgtgaccaactaaatttgattatttggaaaaataatcaagacaaaattgtagaacctactctttctttgcacgaatgaaggcctaacaagcaaatcaaagttcacctaaatgcagatggttatttctggagcttatcttgtcttaaaaaaataaaaaataaaaagtccatcctggccaacatggtgaaacctcgtctctactaaaatacaaaaaattagccaggcgtggtggtgggcacctgtagtcccagctacatgggaggctgaggcaggggaatcgctttaacctgggagacggagattacagtcagccaagactgtgccactgcactccagcctggcgacaaagcaagactgcatctta

SEQ ID NO: 87132 - DNA, 668 bp, Homo sapiens
tgggcccttaattctaatcttggtatcaagcaccttgcggaggtccattataaagagcctcatgaaatgaaagaaagattggtgttattcaagaaatggaagatgatacatgtagagacattgattcctggattttttttctttaaaagttggagcaccttcagaaataaaacatttggcctttgaattacattgtttaaactttcaaagttttacagaagttaaaatgatctagaggatactagagaggtcttaattgatagtattcttgttaatgtagggaataagaaagggtaaactactgttgataaatgttgatacctgctttattggatataaggcataggttatctgtgtttggctattgtgagtaatttttttaaaaagaaggagcagagtccttgctctgggaacataatccattgcagagagagcacaagaactagtacatattttaacctttgattattgtgttaattaacaaggaaaatattaattctgggatattagtgttgagtcagtgtgtctgtgatgtgaacttaatctaagcaaaacacttaggtacatttgctttaaaaaaaaaaatcccgtgatggatgaaaggccaaatactttgggttatctgtatttataaacctatgaagattataatgtttccaatatactgc

SEQ ID NO: 87133 - DNA, 417 bp, Homo sapiens
gctcatcatgtcaacatggctctctccgtctttccatttttcctcaggtgcagcatgttgtcctatttcctcatacctactgcccatgtcacggggcagcagctttaggagtcatgtccatgttaaggagggaataagagtaagaggctaggccacgtgcagtggctcacgcctgtaatcccagcactttgggaggccgaggcgggtggatcacctgaggtcaggagttcgaggccagcctggccaacatggcgaaaccccatctctactaaaaatacaaaaattagctgggtgtggtggtgtgcgcctgtaatcctagacacttgggaggctgaggcaggagaattgctagaacccaggcggtggaggttgcggtgagctgagatcatgccactgcactccagcctggatgacaga

SEQ ID NO: 87134 - DNA, 375 bp, Homo sapiens
ggcacgagaactggatgcaaaattataaaattctggaatcaattaaaaaaagaggggggaagcagaacagaatgtaaaagtggcattcatttccctggttacaaagttagttattttccagattcatcaataacttgagtatcaaaaatggcttatccaattacattttagaaacgtttaaaaaaaaaaatcacaattttttttattaatagagacagggttttgccatgttgcccaggctgatcctgaacacctgagctcaagcaacccacccacctcagcctcccaaagtgctggcattacaggcgtgacaccattatccagcctaaattttttgagtttgaaatactattctgtcattcaaatcattaaagt

SEQ ID NO: 87135 - DNA, 348 bp, Homo sapiens
ggccagttcccaggcagctaattggagcatttatctgaagcaaagcggggccagctcttcttccggtcgttcccagggagggtgatgcttaaacggtttaaagcggtggtgcacaggaaaatcacccagggagctttaacaacgcgacattcaggggtccacaggcagaccaattgaagcagagtctctggggttggagcctgaccactgctagggccagtatttttcataagcttaacgtgcaatcaaggttgagaatctttgctctatgggctcccagagacagacaagaggaagtggggacacactcaccaaacccaaagattccatttcagctgtaaagctgac

SEQ ID NO: 87136 - DNA, 452 bp, Homo sapiens
aggcatttagacaggcttaagcaaaaagcagagtgatttaatttttatactaaggaaaagtatgttagtaaaagctaatgagtcctaggatcaaaagtttttatgtcaaggcatggggccattggagaagagtgaagtaacattctaaattcctacaagcctaaaacaaggagtctttttgtttttatgcttgagattgattactattacttctgtaatactgttttcacagttctaaatgattcagtcctcagttacattagtaaaaggcagaggtcggatatgaaaggaaaatttataataaaagaatcagaattagttgtataaggggtaccaaaatttctaatcatcttttatctattccagttttagaatgtattttatagtgaaggattaacccattgtccaccctagcatctggtacatactacattgtttatttcacatttttt

SEQ ID NO: 87137 - DNA, 423 bp, Homo sapiens
atagaaaaagaggaaacgaaccaaactctttttatgaggctggtataactgtgatatgaaaaccagaaaagtactacaaggaaaattacagtgcaaatctgttcatgaatgctagtacaaaaatctcacaataccagcaaactaaaccagcaatatacacacacacacgtgcacgtatgcgtgtaaaaaacatatcatgatatcatgactgcttggtttagcgtaatattacaaaaactaattcgtttaatacatcccattaatgtatttttaaaactgtgattacaaacttattaaacacctctgatcactcccatagataatgaaaaagggttcactgaaatttaacatgaatttattgttagaaaatacttagcaaactattatacagtggaagtttactaatccaagaaaggatggctt

SEQ ID NO: 87138 - DNA, 245 bp, Homo sapiens
ccatgctcctgaaataagtggagaaaacactttctgcatctcagcagcccttcgggattctcttgcatgcatattacacagggtttgaaggtagccctccaaaatattagctgaaagcttcctcggaaagcaaatctttcccacatccttccctgcagttcctctttaagaggtgtcagcatggctgaaagaatgaagtggctgcacattgtttggctgtgctattatgtgcttaacatttccat

SEQ ID NO: 87139 - DNA, 307 bp, Homo sapiens
gggtgtcccaacttacacttccccctaaaaagtgggacagtgcccttttgtagaactctcaacatttctttcttttatactttttggtttgtttttgaggctttttttcttttacttttatttttcaattttttggggacagggtctccctctgtcacccactgcagccttgacctcgcgggctcaagcgatcctcccatctcagtctcctgagtagctgggcccacaggcacgtgccaccacattgggctaatttttgtggtttttttttttttttttttgtagagatggggtctccctatgttac

SEQ ID NO: 87140 - DNA, 646 bp, Homo sapiens
ctaaggctgtttagtgaatagagtattccagtttacctagagtacaagttatgtgtgtaagtaaggccttgtcctaaaaaaaaaaaaaaaaaatcagtctagtgaggaaaaaatgtaaataaacaaatgaatgagtacattttgcattctgagttatgcagaaagtgctttgcaacatagaggaaaaagccctaactgttgtggtggttgagagttgattggaaagcctcatggcaggctgagtcttgatggagcagtactttgcccagtggaaataagaagaaagcatatagaagttctccttatcctttggacttgcaatacacacaaaactttctggggctttctaaggaaattttatttcaagattctgctaggcaataactctccttccttaaattgaagggtaaggactctaagttctgctttttcttttctcactgaatttgcttaggtttttttttcgtttttgtttgtttttttttttttcacctttctcactggtattgatcactttctcttccttagtaaagctccatttgcttctctcctaacctggacattataggaagcactgatgctgtattaaaatttagagaaagctcccagtctgtctttcccaacatcccttcagtttcaataagca

SEQ ID NO: 87141 - DNA, 632 bp, Homo sapiens
aacacttgatttttatttatttatttatttttttgggacaagagtctcgctctgtcacccaggctgaagtcgcccaggctggagtgcagtggcctgatctcggctcactgctagctccgcctcccgcgttcggccattctcctgcctcagcctcccaaagtgctgggattactggcataagccaccgcgcccggccaggaaacacttgattttaacttgctacttggactactctgaaagtcctgtgtaatgattctgaacatatatttcagaatatgacacattaattcatgcataataatatatagtttgaattatgaacttacctttcatgaagtcagagatgcctctgacattcctgcatttatccattcagatggaagcttgatataaaagattataaaacttttaacaggcttaacttcttctaatttgaaatgcatgcactacctctttgtagcttctaaatgaactggcccaaaaccagtcagattttacagttggatggtaggtttctttactgaactatgaaaacagcagtgccaatggggaaaatgtgattgctgcattaagaaaaaataaataaataaaagaaagaaactccaacaccagcagccttaaagtatattttt

SEQ ID NO: 87142 - DNA, 291 bp, Homo sapiens
ggagtaatactttgaaaatatgtttaatgttgtgaaccactctgtggccgagaagcaactccggctaaaatatatttaatgcttagagtcatttggcggtttcgaaaaaaagaaacttcttgttaatttttaacatttattgctgatcagtggctgctaaagtaactatcagtacagcatgatttatatttagggacacgctgtgctgctactaaaacaattcatactcttctctcaaggctacacaaaaagtgtcaatagcattacctttgcaattgcaccactaataaa

SEQ ID NO: 87143 - DNA, 2151 bp, Homo sapiens
caagggtcaggtctccagcagaccctgaaagctgagctgccctgacccccaaagtgaggagaagctgcaagggaaaagggagggacagatcagggagaccggggaagaaggaggagcagccaaggaggctgctgtccccccacagagcagctcggactcagctcccggagcaacccagctgcggaggcaacggcagtgctgctcctccagcgaaggacagcaggcaggcagacagacagaggtcctgggactggaaggcctcagcccccagccactgggctgggcctggcccaatggcctttaatgacctcctgcagcaggtggggggtgtcggccgcttccagcagatccaggtcaccctggtggtcctccccctgctcctgatggcttctcacaacaccctgcagaacttcactgctgccatccctacccaccactgccgcccgcctgccgatgccaacctcagcaagaacggggggctggaggtctggctgccccgggacaggcaggggcagcctgagtcctgcctccgcttcacctccccgcagtggggactgccctttctcaatggcacagaagccaatggcacaggggccacagagccctgcaccgatggctggatctatgacaacagcaccttcccatctaccatcgtgactgagtgggaccttgtgtgctctcacagggccctacgccagctggcccagtccttgtacatggtgggggtgctgctcggagccatggtgttcggctaccttgcagacaggctaggccgccggaaggtactcatcttgaactacctgcagacagctgtgtcagggacctgcgcagccttcgcacccaacttccccatctactgcgccttccggctcctctcgggcatggctctggctggcatctccctcaactgcatgacactgaatgtggagtggatgcccattcacacacgggcctgcgtgggcaccttgattggctatgtctacagcctgggccagttcctcctggctggtgtggcctacgctgtgccccactggcgccacctgcagctactggtctctgcgcctttttttgccttcttcatctactcctggttcttcattgagtcggcccgctggcactcctcctccgggaggctggacctcaccctgagggccctgcagagagtcgcccggatcaatgggaagcgggaagaaggagccaaattgagtatggaggtactccgggccagtctgcagaaggagctgaccatgggcaaaggccaggcatcggccatggagctgctgcgctgccccaccctccgccacctcttcctctgcctctccatgctgtggtttgccactagctttgcatactatgggctggtcatggacctgcagggctttggagtcagcatctacctaatccaggtgatctttggtgctgtggacctgcctgccaagcttgtgggcttccttgtcatcaactccctgggtcgccggcctgcccagatggctgcactgctgctggcaggcatctgcatcctgctcaatggggtgataccccaggaccagtccattgtccgaacctctcttgctgtgctggggaagggttgtctggctgcctccttcaactgcatcttcctgtatactggggaactgtatcccacaatgatccggcagacaggcatgggaatgggcagcaccatggcccgagtgggcagcatcgtgagcccactggtgagcatgactgccgagctctacccctccatgcctctcttcatctacggtgctgttcctgtggccgccagcgctgtcactgtcctcctgccagagaccctgggccagccactgccagacacggtgcaggacctggagagcaggaaagggaaacagacgcgacagcaacaagagcaccagaagtatatggtcccactgcaggcctcagcacaagagaagaatggactctgaggactgagaaggggccttacagaaccctaaagggagggaaggtcctacaggtctccggccacccacacaaggaggaggaagaggaaatggtgacccaagtgtgggggttgtggttcaggaaagcatcttcccaggggtccacctccctttataaaccccaccagaaccacatcattaaaaggtttgactgcgcaccaaaaaaaaa

SEQ ID NO: 87144 - DNA, 2190 bp, Homo sapiens
caagggtcaggtctccagcagaccctgaaagctgagctgccctgacccccaaagtgaggagaagctgcaagggaaaagggagggacagatcagggagaccggggaagaaggaggagcagccaaggaggctgctgtccccccacagagcagctcggactcagctcccggagcaacccagctgcggaggcaacggcagtgctgctcctccagcgaaggacagcaggcaggcagacagacagaggtcctgggactggaaggcctcagcccccagccactgggctgggcctggcccaatggcctttaatgacctcctgcagcaggtggggggtgtcggccgcttccagcagatccaggtcaccctggtggtcctccccctgctcctgatggcttctcacaacaccctgcagaacttcactgctgccatccctacccaccactgccgcccgcctgccgatgccaacctcagcaagaacggggggctggaggtctggctgccccgggacaggcaggggcagcctgagtcctgcctccgcttcacctccccgcagtggggactgccctttctcaatggcacagaagccaatggcacaggggccacagagccctgcaccgatggctggatctatgacaacagcaccttcccatctaccatcgtgactgagtgggaccttgtgtgctctcacagggccctacgccagctggcccagtccttgtacatggtgggggtgctgctcggagccatggtgttcggctaccttgcagacaggctaggccgccggaaggtactcatcttgaactacctgcagacagctgtgtcagggacctgcgcagccttcgcacccaacttccccatctactgcgccttccggctcctctcgggcatggctctggctggcatctccctcaactgcatgacactgaatgtggagtggatgcccattcacacacgggcctgcgtgggcaccttgattggctatgtctacagcctgggccagttcctcctggctggtgtggcctacgctgtgccccactggcgccacctgcagctactggtctctgcgcctttttttgccttcttcatctactcctggttcttcattgagtcggcccgctggcactcctcctccgggaggctggacctcaccctgagggccctgcagagagtcgcccggatcaatgggaagcgggaagaaggagccaaattgagtatggaggtactccgggccagtctgcagaaggagctgaccatgggcaaaggccaggcatcggccatggagctgctgcgctgccccaccctccgccacctcttcctctgcctctccatgctgtggtttgccactagctttgcatactatgggctggtcatggacctgcagggctttggagtcagcatctacctaatccaggtgatctttggtgctgtggacctgcctgccaagcttgtgggcttccttgtcatcaactccctgggtcgccggcctgcccagatggctgcactgctgctggcaggcatctgcatcctgctcaatggggtgataccccaggaccagtccattgtccgaacctctcttgctgtgctggggaagggttgtctggctgcctccttcaactgcatcttcctgtatactggggaactgtatcccacaatgatccggcagacaggcatgggaatgggcagcaccatggcccgagtgggcagcatcgtgagcccactggtgagcatgactgccgagctctacccctccatgcctctcttcatctacggtgctgttcctgtggccgccagcgctgtcactgtcctcctgccagagaccctgggccagccactgccagacacggtgcaggacctggagagcaggtgggcccccactcagaaagaagcagggatatatcccaggaaagggaaacagacgcgacagcaacaagagcaccagaagtatatggtcccactgcaggcctcagcacaagagaagaatggactctgaggactgagaaggggccttacagaaccctaaagggagggaaggtcctacaggtctccggccacccacacaaggaggaggaagaggaaatggtgacccaagtgtgggggttgtggttcaggaaagcatcttcccaggggtccacctccctttataaaccccaccagaaccacatcattaaaaggtttgactgcgcaccaaaaaaaaa

SEQ ID NO: 87145 - DNA, 2058 bp, Homo sapiens
caagggtcaggtctccagcagaccctgaaagctgagctgccctgacccccaaagtgaggagaagctgcaagggaaaagggagggacagatcagggagaccggggaagaaggaggagcagccaaggaggctgctgtccccccacagagcagctcggactcagctcccggagcaacccagctgcggaggcaacggcagtgctgctcctccagcgaaggacagcaggcaggcagacagacagaggtcctgggactggaaggcctcagcccccagccactgggctgggcctggcccaatggcctttaatgacctcctgcagcaggtggggggtgtcggccgcttccagcagatccaggtcaccctggtggtcctccccctgctcctgatggcttctcacaacaccctgcagaacttcactgctgccatccctacccaccactgccgcccgcctgccgatgccaacctcagcaagaacggggggctggaggtctggctgccccgggacaggcaggggcagcctgagtcctgcctccgcttcacctccccgcagtggggactgccctttctcaatggcacagaagccaatggcacaggggccacagagccctgcaccgatggctggatctatgacaacagcaccttcccatctaccatcgtgactgagtgggaccttgtgtgctctcacagggccctacgccagctggcccagtccttgtacatggtgggggtgctgctcggagccatggtgttcggctaccttgcagacaggctaggccgccggaaggtactcatcttgaactacctgcagacagctgtgtcagggacctgcgcagccttcgcacccaacttccccatctactgcgccttccggctcctctcgggcatggctctggctggcatctccctcaactgcatgacactgaatgtggagtggatgcccattcacacacgggcctgcgtgggcaccttgattggctatgtctacagcctgggccagttcctcctggctggtgtggcctacgctgtgccccactggcgccacctgcagctactggtctctgcgcctttttttgccttcttcatctactcctggttcttcattgagtcggcccgctggcactcctcctccgggaggctggacctcaccctgagggccctgcagagagtcgcccggatcaatgggaagcgggaagaaggagccaaattgagtatggaggtactccgggccagtctgcagaaggagctgaccatgggcaaaggccaggcatcggccatggagctgctgcgctgccccaccctccgccacctcttcctctgcctctccatgctgtggtttgccactagctttgcatactatgggctggtcatggacctgcagggctttggagtcagcatctacctaatccaggtgatctttggtgctgtggacctgcctgccaagcttgtgggcttccttgtcatcaactccctgggtcgccggcctgcccagatggctgcactgctgctggcaggcatctgcatcctgctcaatggggtgataccccaggaccagtccattgtccgaacctctcttgctgtgctggggaagggttgtctggctgcctccttcaactgcatcttcctgtatactggggaactgtatcccacaatgatccgcgctgtcactgtcctcctgccagagaccctgggccagccactgccagacacggtgcaggacctggagagcaggtgggcccccactcagaaagaagcagggatatatcccaggaaagggaaacagacgcgacagcaacaagagcaccagaagtatatggtcccactgcaggcctcagcacaagagaagaatggactctgaggactgagaaggggccttacagaaccctaaagggagggaaggtcctacaggtctccggccacccacacaaggaggaggaagaggaaatggtgacccaagtgtgggggttgtggttcaggaaagcatcttcccaggggtccacctccctttataaaccccaccagaaccacatcattaaaaggtttgactgcgcaccaaaaaaaaa

SEQ ID NO: 87146 - DNA, 2019 bp, Homo sapiens
caagggtcaggtctccagcagaccctgaaagctgagctgccctgacccccaaagtgaggagaagctgcaagggaaaagggagggacagatcagggagaccggggaagaaggaggagcagccaaggaggctgctgtccccccacagagcagctcggactcagctcccggagcaacccagctgcggaggcaacggcagtgctgctcctccagcgaaggacagcaggcaggcagacagacagaggtcctgggactggaaggcctcagcccccagccactgggctgggcctggcccaatggcctttaatgacctcctgcagcaggtggggggtgtcggccgcttccagcagatccaggtcaccctggtggtcctccccctgctcctgatggcttctcacaacaccctgcagaacttcactgctgccatccctacccaccactgccgcccgcctgccgatgccaacctcagcaagaacggggggctggaggtctggctgccccgggacaggcaggggcagcctgagtcctgcctccgcttcacctccccgcagtggggactgccctttctcaatggcacagaagccaatggcacaggggccacagagccctgcaccgatggctggatctatgacaacagcaccttcccatctaccatcgtgactgagtgggaccttgtgtgctctcacagggccctacgccagctggcccagtccttgtacatggtgggggtgctgctcggagccatggtgttcggctaccttgcagacaggctaggccgccggaaggtactcatcttgaactacctgcagacagctgtgtcagggacctgcgcagccttcgcacccaacttccccatctactgcgccttccggctcctctcgggcatggctctggctggcatctccctcaactgcatgacactgaatgtggagtggatgcccattcacacacgggcctgcgtgggcaccttgattggctatgtctacagcctgggccagttcctcctggctggtgtggcctacgctgtgccccactggcgccacctgcagctactggtctctgcgcctttttttgccttcttcatctactcctggttcttcattgagtcggcccgctggcactcctcctccgggaggctggacctcaccctgagggccctgcagagagtcgcccggatcaatgggaagcgggaagaaggagccaaattgagtatggaggtactccgggccagtctgcagaaggagctgaccatgggcaaaggccaggcatcggccatggagctgctgcgctgccccaccctccgccacctcttcctctgcctctccatgctgtggtttgccactagctttgcatactatgggctggtcatggacctgcagggctttggagtcagcatctacctaatccaggtgatctttggtgctgtggacctgcctgccaagcttgtgggcttccttgtcatcaactccctgggtcgccggcctgcccagatggctgcactgctgctggcaggcatctgcatcctgctcaatggggtgataccccaggaccagtccattgtccgaacctctcttgctgtgctggggaagggttgtctggctgcctccttcaactgcatcttcctgtatactggggaactgtatcccacaatgatccgcgctgtcactgtcctcctgccagagaccctgggccagccactgccagacacggtgcaggacctggagagcaggaaagggaaacagacgcgacagcaacaagagcaccagaagtatatggtcccactgcaggcctcagcacaagagaagaatggactctgaggactgagaaggggccttacagaaccctaaagggagggaaggtcctacaggtctccggccacccacacaaggaggaggaagaggaaatggtgacccaagtgtgggggttgtggttcaggaaagcatcttcccaggggtccacctccctttataaaccccaccagaaccacatcattaaaaggtttgactgcgcaccaaaaaaaaa

SEQ ID NO: 87147 - DNA, 1509 bp, Homo sapiens
cagctgggctcagggtgtctaggtgggagcttggcattgccagccggcgctggtttgaggatctacagcaccagcctcatacttcagaggtcctcaaaaggccccagcccaggcatcatccagggctaggccgccggaaggtactcatcttgaactacctgcagacagctgtgtcagggacctgcgcagccttcgcacccaacttccccatctactgcgccttccggctcctctcgggcatggctctggctggcatctccctcaactgcatgacactgaatgtggagtggatgcccattcacacacgggcctgcgtgggcaccttgattggctatgtctacagcctgggccagttcctcctggctggtgtggcctacgctgtgccccactggcgccacctgcagctactggtctctgcgcctttttttgccttcttcatctactcctggttcttcattgagtcggcccgctggcactcctcctccgggaggctggacctcaccctgagggccctgcagagagtcgcccggatcaatgggaagcgggaagaaggagccaaattgagtatggaggtactccgggccagtctgcagaaggagctgaccatgggcaaaggccaggcatcggccatggagctgctgcgctgccccaccctccgccacctcttcctctgcctctccatgctgtggtttgccactagctttgcatactatgggctggtcatggacctgcagggctttggagtcagcatctacctaatccaggtgatctttggtgctgtggacctgcctgccaagcttgtgggcttccttgtcatcaactccctgggtcgccggcctgcccagatggctgcactgctgctggcaggcatctgcatcctgctcaatggggtgataccccaggaccagtccattgtccgaacctctcttgctgtgctggggaagggttgtctggctgcctccttcaactgcatcttcctgtatactggggaactgtatcccacaatgatccggcagacaggcatgggaatgggcagcaccatggcccgagtgggcagcatcgtgagcccactggtgagcatgactgccgagctctacccctccatgcctctcttcatctacggtgctgttcctgtggccgccagcgctgtcactgtcctcctgccagagaccctgggccagccactgccagacacggtgcaggacctggagagcaggaaagggaaacagacgcgacagcaacaagagcaccagaagtatatggtcccactgcaggcctcagcacaagagaagaatggactctgaggactgagaaggggccttacagaaccctaaagggagggaaggtcctacaggtctccggccacccacacaaggaggaggaagaggaaatggtgacccaagtgtgggggttgtggttcaggaaagcatcttcccaggggtccacctccctttataaaccccaccagaaccacatcattaaaaggtttgactgcgcaccaaaaaaaaa

SEQ ID NO: 87148 - DNA, 362 bp, Homo sapiens
tttaaaaatctctttccatacaactttgctttctattgagtttgaaggaaatatggtgatggcatctaagcccaaatttcggtgttttattttggctttcctgttctgtttaagcctctgtaaccccttgaacctttctctactcttcagaaggaacaagttatattttttttccatctcaacatcgtccaaatgaaccgtactattttaacaatctgtgtaaacagatataaaaggaggaagactactttctttaattttcctcccagcgagctgcaaagctgtttcagtcatcctagtgattagcagaatgtgagtaataaacaacattaaaatgaagaaacgtctttctgagtaggacc

SEQ ID NO: 87149 - DNA, 427 bp, Homo sapiens
gaaagggaccaagacagacggacagacagacaacctgactgagacgggctcagggccgatgagagggtgacagggatagagcaagagggaggaatagatggaggagaaggagagaaggggcctgggggtcccgagggaggcaagattgtgaggggggagactcaggagggggttgaggccagaggaggtggacggggaccagaggcggagggggaggaccgagaggggcagagagagagttaagggggctggggtcggtgggtggagagaaaggaggctgcggtcgggggagagtcgaggtagaggtgggagagggggtggaaggagaccggaggaggcgagcggggaggggagcagagaactgctgcagtggccaaaggacagccccccccaggggtgggaagggcgacaggccagtggggggggc

SEQ ID NO: 87150 - DNA, 389 bp, Homo sapiens
catttgaaagacataaattattaatattaacaatttgctcacctcctttccctattaaaatattcaatctacaagcatttgagacttgaatatcttcaaggaaaaaataccatctgaataagtaattaaattatttgaactgtttcttcacatcagagcatgtgccctaacctcagtactgcagtgtggcagcatagacccaaatacaagaccaagggcacatttccagccctctagacacaatgagaaaagcactcagtctataaacgtttatgaacatgattttcagtcagatttctgaagttgactgctctgctcttatactgtgaaaatgacagcaataagagctacttccatggaagggtggagtgaattgggaacactaaaac

SEQ ID NO: 87151 - DNA, 429 bp, Homo sapiens
atttgtttatgaactctcctgattgttaaatgttggcatttaattgaaacagaaatcgtggggactacacaaagtttttggctgcaggtgacagttttggcagcaaagctcccatggtgccaggctctgtgctagggtggctggggacaaaggcaagtcagtcggtcctccctgggaggctgcgatccaggagagcagccttccatggaaaaggggcactataataggatttagtgaaatgggatttgacccacattatccttgagctccttaggcgtggacctgcagaacactttttgtagctgaaattgaaaaagtaaaacaatttgcagcaggcagagcgaatgtcttgggaaacgtttctagggctttcatgtttcctgagggcttcccctatctcatttgagttattccattaaatgagcaata

SEQ ID NO: 87152 - DNA, 350 bp, Homo sapiens
tcttgcctgccaatgagcataaccaagaatctttagagtctacaaagtagggtgtacctacttcattgggatgttaggagaacaactacacgaagtaagtaagtaaacaaactaccaggtgctttaagtgccttaagaaataattaccagacatgatgtggtccaagctgaaatccaataggtcaatgagccagaggaccagcaggaaattgttttattcaattatgaaaaattttctggcatattcctaagaagagcaaaatgggctatactactaggatgaggacaagaagcaaaatgtcaagtggacttctaaaaaataacagctttcataccaaaggtatcgaaag

SEQ ID NO: 87153 - DNA, 245 bp, Homo sapiens
ttaagagatttacagtgatctttccatataggtttttctcgaaacatatatatttttaatttctcaccatctcaggggtaaataaatatattaaaataagctatgggatgtacagcagagtataacaatgataaatgatgttgtgtgtaatttttctactattaacataaagtaatataaactgaaggacactggtctattgagagacttagaagctaatgttccatatcagatgcggccaatgt

SEQ ID NO: 87154 - DNA, 477 bp, Homo sapiens
cggaagtcaaagactggattgggtggaaactgcaagtaaagcctccagcaaagaccattaaactcatctagttttattctcatccaggcccagtcagacatgggctatctctgaccctccccagccccacagccctcctgccctgtgctgtggggccatgggtctgcagcactgctgcctagatggagctcagcactgggagtactcatctctccccttcctccctcacctttcagctcttactaggaattgtcccatttggcctttctttatctggcagtcttcccccatggactcagaccccagaactcctgatgagttctttccttttaaaaataaacctgcctccaaatgcaccacaatcattttgagttatttgccattttaaacaaacctgtagtgaacttacagtgttttcttatgggcagaagccatacctaatggagttttctagggaaattcatcttttttaagaca

SEQ ID NO: 87155 - DNA, 556 bp, Homo sapiens
gaaaaattgttagaaacataatagcaatgggatgctttaacatgctaccttgaacctttaccaaatcaagagagtaaaaattaagcacaaaagagggatctaatactataaacaaggtagatttaatacatatgtatcaaacatagtaacctagaagcaatgaatatacattttctggtgctcatttaacattaacgaccttcaagaaggctttaaacagcaacagatagagttgagttgctttggcctattgctaaaggcatctaacccacctgctttgtgggaggtcatctgctttgaatctcaactgtatccaagtcagatttaaactctatggggcattggaattgtcctctgaatcatctccaactctgcaggatacataatagcaccactttgttgttctggaatttaaagacagggtcttattcaactttggctatttttgtgcagtccatggatccttgaaacaggacattctactttaccaatatctgactcatagaagacctatctatatacctaccaggtggctactacccagtaactcctaccg

SEQ ID NO: 87156 - DNA, 566 bp, Homo sapiens
cgatgtctttcagtggatttcttagacttacttgggctgattcagcctgactcagctttctctgccctacattaattctattttagcttttgttgtaaattgctctcagactttaggggaggttaacgttctcctcaacactttaaaaaagccttgtgaatgtaatctgatttgggcctcttattacaaacagaaaaatgttctactacttgagatcagtttcccagctcatcaaggtgacctaaatgattctcttttcctttgctcctggagaactgaaaacttggggatttttgaggatgttattgtttcagcattttgaagggaacagtacctattatgacttgagtctgtaatacctgatagtattaaggcttcagtatgtctactagtggagaataaaagaaatatttcaatagtacactgtagagctaaaataaatagtaaaatggtggttttgtagtaacacaatagttgcttatctggatggcctggaagggataaatttacttaaaataatcattccactgctcatgagacattgatgtaatcagtgtctagggtaa

SEQ ID NO: 87157 - DNA, 348 bp, Homo sapiens
cactagtggggtggggaaaaacggggcaggggggacatgaaggcaaatcacaaagcagaaatcctgctgtgaaggtaaaagaacaaattctttttgatttatattctgaacttggctgtgtgaaatgttttatatttgtgcagtggaataacagtagcagaaatcttatcagtcaaatcatatatatcttttttgacagcccagacatgcctcccaccactctagccccagcattatcatcatagacagatttttgcatattcctttgtttctaaacacagaaatatacttttaatcttacagatatatccttttcttttttttttgggggggacaggttctgactct

SEQ ID NO: 87158 - DNA, 248 bp, Homo sapiens
tgaggtttgaggaaggagaggtgaggcacctgtggcagaaaaaaaaactgcaccacgaagaagcagagcctgggtccccaacggacgaaagtgtcttcccatcagcacttgcgctgggcccaggggaccctggcattcctggttcgagaccagggtgtgcttcaggccgctagggatacccaaaagcaagcagaaggcccatgaggggaaggtgatgcacgtggggcagagaaaaaaacaacaaccgt

SEQ ID NO: 87159 - DNA, 683 bp, Homo sapiens
ggaaatagttgaccctgttttgttcccacctatgcattgatcagacatttgctgtttgattattctgtgtcaagcaccgtggagatattgaagaataatacataatctttgcttccaggagctgatgtcttataggaaaacaagaaataaattaaaaacatgattagggcttgccacttgtaaataaggggctgggaggggactaaacccaaatgaaggctttctgaagtaaaagacatcccagtgtttttccatggtgagcaggatttccagctaacgaggaaatgacttaaagaggttatttgaaaaacaagtactgggtcctagaactctagacatggaaaggacatttaaaaatatccagtcctgtaaagttaaaattgtgcaggtgctatggaaaaaaaaaagtataatggttcctctaaaaattaaaaatagaattatgacacaagccagcaattctgcttctgggaatataccccaaagaattgaaagctgagactcaaacggatacttgcacacccatgttcatagcagcattattcacaatagccaaaatgtggatgcagcccaagtgcctatcaatggatgaagaaaatgtgatgtatacattccatggaacattattcagttttaaaaatgaaggaaattctgacacatactgcaacatggaggaaccctga

SEQ ID NO: 87160 - DNA, 598 bp, Homo sapiens
attaccagtaggggaaatttggttaagagcatgtgatgtttctattatttcttacaactgctcatgaatctacagttacctcaaattaagtgtaatttaaaaaatactggaaaagaacaacccccttaccccatgcagatattttcatctattttggttgtatttatttggtattgacttccacaatgtatatagtatgttttgattgctaatctatgatttattaattgaagacgattttagatagatctgtatctttatggtagagtttatttattgtagctgcattttaatttaaaacttaattactggttaaaacaaagaaaaaagaaaaaaaaaaaaaaaataaaaaagaagaaaaaagaaacagaaaagaaacaaagagagagagagacagaacagcgacaaaacaaaaagaatacacacaaaaaagaggagcacaacaaatcaaataaaaagagaaacacaacagaataatgatgatgagacaaaagagggagaccccaacaaatagaggaggagcgagaagattaaatagcaacaagaaaccagcgacgcgcagacgataaacaaaaggaagcaatcaagagtggaaaac

SEQ ID NO: 87161 - DNA, 526 bp, Homo sapiens
cataaaactgcctttttttttttaatgattgattgggagagtattcagtggtagtggcattggcattaagcctgtgattaaaagcccctaagtcaagagtgccatatcagacacaattgagttttctgtgtttattttaaatttctatcttcattttttgaggaaaatacaaaaggagaaaaagtaaatttgggagctgggcatggtggctataattctagctacttggaagcttgaggcaggaggatcatttgagcccaagagtttgagatcagtctaggcaacatagtgacacccccctgcctcacaaaaaataaagtaaaatttggtatatgttgaagaaaatacaagggtaaattttaatcattgtgcccaagagactgacatgtatgttgcagagagacataaataattttattatagtgtttaattgcacataaataattttattatagtgtaaaatatgcattaatagaagtggaatagaagtggttacttctgatggggtcactgtagtctttttcta

SEQ ID NO: 87162 - DNA, 425 bp, Homo sapiens
aagtcagaagtaaaaagaattggggaatacagtgaacacaatgtgtatgccagcagtttagagaatttgatgaaataggcaaattcctagaaagttacaaacttaccaatactgatgtaaggcgaaacagaaaatctgaataaatctatgatgcagattgaattgtgtccccctaaaacatgaatccacccctggtacctgtgaatgtgaccttatttggaaatacagtagtcttcccccttataagggggatgcctgaaactacagatcgtaccaaactctatatatactatgtttttttcctgtacacacatacctatgataaagcttaatttgtaaattagtcacaataagagattaaaactaataataaaattgaacaattataacaatatactataacaaaagttatgtgaatattctct

SEQ ID NO: 87163 - DNA, 302 bp, Homo sapiens
ttttttcctatatgtacatatctatgataaggtttaacttataaattaggcataaaaagagtttaacagtataataaaatagaaaaattataacaatactcagaaccaagcacaactgaaaacttgtgaaatgtttatttaggcatgagccactgcacctggccaaatgttgatttttttaataccattttataataaaaggaacaaggactccctggagaaacagctgatactaaggcaggagtagaaaatatacaagataatcctggaaaatcttgtagggccagaaagtaaacaagtgc

SEQ ID NO: 87164 - DNA, 683 bp, Homo sapiens
caataattcactgggttagcttttaggccaacccttcatataataaaataatcggcttctttgtaaataccagtcattcctctgtgcttggcctttaagatattcttcatatagggtttaggagaaggaagcccactggttactgaactgaagcagccatcagctacagagacagtagtgctcacagtcatttgtaggaaactataagtgttgatgaaaaactgcaagatttcactggaaaacacagtagttctgtgttgagtaaaatggaggtgcagtaaggaaagtgaggcttcaaggtggtaatggcgtgcaagtcagtgtttttgagcagagaagtgatacgcacaaggctgttagtatgaggaactcttctctcaatgacctggaagagatgactagaggcagggaggccagttaggaaacagacagaatagcggaaaagttggccctaaactaggtgatagtactgaatatggaaagtacatttctcttagttgaaaggagttgattagagacaagtgtagtttctagactgggttctgcatatatagtttcattcaacaagtatttattgtatgttactatattagatataaaagctttatctgagcagcacatactcttgtgaatgtcatagctaatatgacgcaaaatgctcatcaattgagacatttcactaa

SEQ ID NO: 87165 - DNA, 410 bp, Homo sapiens
taagaaaataaacaatataaatgtcattgcattatttatttattttcaaaaatgataaaaaagcaggagtgaaaagagtagactttggagggtaaataaaatagttgtttactatgtacacacatacatatatttgcatagaaatacaggaggaatatggacttctagtatgaaccactggttgacagaccccagattaagaatttttatgtttatgtaccttttttaagagacagagttcataggttttgtcagattttgatagtaatcagtaatctcaacagcattaaaatgatttctaaagttctttctatatttaaaattgtgtaattcactttacatcctaatatattcctgttgaaacatatttgcttttctccagagaaacagaaatatatcttattttctaa

SEQ ID NO: 87166 - DNA, 488 bp, Homo sapiens
tgctctagaggatcctctggagactgggtttcgccatattggccaggctggtctcgaacacctgacctcaggtgatccgcccactgtggcctcccaaagtgctgggattataggcgtgactgaccgcgctcagccggtcttgaactttagagctcaagtaatctgtctgccttggcctctgaaagtcttgggattacaggcgtgagcctccgtgcccagccaatttttaaatttcaatgtgactactaggaaatagaaaaccacatgtggctctcattatgtttctgtgagacagcactggtctgactcgaccataagtttgtacagtggtagggactatatccattttatttactgtggtatcttcagcgcataacagacgttcaaaagatttggtgaatgaataaactaactctgttaacttttgaatgttattgcatagtttacagagaatgttacctattcagcttttgcttttcagaattgtt

SEQ ID NO: 87167 - DNA, 337 bp, Homo sapiens
tcatagaggatcttatcccgtacgccaacctgcttgacctacgctcttctgggatgactagcaagttttgaacttgaaaacagggtggtgtcatttatgaaactacagagcaaaggagaagcaggttggggttggtgctgcggatagaggagatgttgagttcagtgttggacttggaacatttcagacagctgcaatgagatgtctggagaaaatacgcagctggcagctgtgtctatgggtctggatctctcactagtgattcaggccaaagataacacagttgggagataacagtagacaggtagtcattaaagacttgggccgggcgtggtga

SEQ ID NO: 87168 - DNA, 487 bp, Homo sapiens
ctctttctctctcttttgttctttcttatctctctattggcttttaaatgctcctctttgtattaaaatttttgtggttgctcaagagattacaatatgcatttttattctacttaatattgagtcacttaatgtaaaatataagaaatttggctttgtgcaatttcaaattctttttcatttttgccgttgttttcaaatacttcgcacccatgtacttacaaaccccacaatataatgttttagttttttgctttaattagttagttgtactcagtctaacattgggtgtccacgtttcctctgcctattatggtcaattccgggtggcagccacgcatcttaaactttaattctcaatggagtccctaaacccgagattagcaaacttttgctgtgaggggatgtatggtaaatattttaggctttgagatggtttctattcacctctgccattgtggtgtacaagcagctatagcacctaaat

SEQ ID NO: 87169 - DNA, 113 bp, Homo sapiens
ggtctaaatgatgtacttgttagtgtattcattcatattgattgtaaaggattatttttcactcagtactgatgtccttggaaatcttacctggaaacatgtttgcaaaaaac

SEQ ID NO: 87170 - DNA, 175 bp, Homo sapiens
cgcgctcgaggcctccgcggactcccgcccctcgcggccctctccttcgctggcccggccgtcgggcctcgggaaacaaaggagccgccgccgctcccgcacgcgcccgcctcatcgcgtaccctccccagcccgccgggcccggctcgccctcgcccctccccgagtccgcgcg

SEQ ID NO: 87171 - DNA, 425 bp, Homo sapiens
ctgacatataagtattcaacatacatttcttatcataacaattagcattattattaactgtctaattagtggtggacttcgctgtggctcagagttcctgtgacttcctggtaggtcccatgggaccctaagtcatatcaaagttgattcttttacaagtttagagctcaagctggtattgtacataaacagtatttcatggagctttagacttctggcccaatacctggagaggtgaaagtcctaaggatggggtcctatcccactgctcaaagaatgccttctagaagcaaaatcaggaaagcactacctctagttgacctagctgataatgagataagccatactagaaaatacacttaaatacaatatgcttttctttttttttgcaatagagtcttgctccatcacccaggctggagtgc

SEQ ID NO: 87172 - DNA, 354 bp, Homo sapiens
cagaagacaaaaggcatgacttacatggtggcaggcaagagagaatgagagccaagtgaaaggggtttcccctgataaaaccgtcagatctcgtgggacttattcactaccatgagaacagtatgggggaaaccgcccccagtattcagttatctcccagcaggtccatcccacagcatgtaagaattatgggagctacaattcaagatgacttttcggtgtggacacagccaaaccacatcactgtgttggacaaaaggaagataagcatgttgctaactatttaagttattgcttagagaaaagttatattagaatggctatttaaaatttagtattatgaattcatacata

SEQ ID NO: 87173 - DNA, 290 bp, Homo sapiens
gctaaatcaggcctagtgtctttcctttcacctataagcacagatatggtaataactggaatttggaaaatctactttggaatttggaaatacagtcccttcttcaaaaccagaaaacagcggtatccccgtgttttgacacacaacatttaaaaatcattcttggatctcacttacatccttacttatatatccttatagatacaatagttaagttgtggatctggtgtttttttaaaaaaataacacaagtaactggtcagttctagctgaggcatactttaaaactg

SEQ ID NO: 87174 - DNA, 411 bp, Homo sapiens
aaaaaataaaaaaaaagaatatttgatgagcactggcttataggattctccctgtggccttcattccattgcacagcctctaccgttttcccgtctggctctctgttttgcctttcagtaataatacaagaaggtgcaccattcttttggttgaaaggggaattaagaatgaactcaagttctttcgcattatttaccgtgtaatgtgaaaagaaatctacttttgtagggatgtcttttaaagatgtttttactttgaatttttagttttctcctttctgggtgtatacttcagtcactttcaagttttatgatcttaccagtagataatgtatggatatttgttagaatttatccccatttcttcacatctttataataaatattgagtgaatgaatcctttacatgaa

SEQ ID NO: 87175 - DNA, 485 bp, Homo sapiens
aaggcatggattgtaggcctggttataccacagttacttgtgggactttaggaaacatgcttcatctggtcctgcttctgtttctgctatcttacaatgaagataattttccccctactttttaaacttatttgcagtgaagactagataaaaaaggatatgactaacacattaaattctgaagtaccacataaatatgacttatttttgcaaaatttaagagcacagaatgttggttatcaaagagtgtttaaaatgacctttctctgttttttgtaagtgttgtttgagagcacagtgatgaccacttaattcctttcctggagcaagacatgtttcttgtgggtttgatttgtacattatcactgaaaaacttcatcagtgacaacaacaaaaaagcccaaaaggaacctaatgaaaatagtagtgaagttttacacattacatagttacccccctgccacacacacacacaaagaacgaaa

SEQ ID NO: 87176 - DNA, 286 bp, Homo sapiens
gaaataaagatatacattcttatattttagacaacaaattacaaataaaataagtgaaaagaaagtcatattgaaataaagccgggtatataacagaatatcaaagacagaaggaagaccctgattcaaccaaatgttcaggccagaattgcaatactaatattgagttctcaactgcaacagcaaaagccaagagatactgaaattatatgttcaacgtgcttatagaatgaaaactaaaaacctagcaacctctccagtgtcattacacttcaaaaagttaata

SEQ ID NO: 87177 - DNA, 296 bp, Homo sapiens
taaaatgagagatttggacatgacccaccatgattgaatacattgaatacacagatttgcattttcagaggtaatgatggataccacatttaatctgcccagcatggtccaagaagcaacctggaaaatttgaaggatctaaaatagcatgagctacccttctgcagaaagctctcggagtagtgttatttcaaatgggtaaaatgcctcatgaatggaaagatgttcatctctctctctctcctttatgctcaggactcaaatcaagttctgtttctgcccatactgatgccgcc

SEQ ID NO: 87178 - DNA, 401 bp, Homo sapiens
actggcaatggcctcttcagaattctgtttaaaattagaattgtcagctttccactcctgtcatgacagagaaactgacaccacatgaacgctccaaaaatacgtgaaaatatatttacagacattggacaacaacacacaattggaagactcaaaatattttttgaggcagggtcttgctctgttgcccaggttggagtacagtaacatgatcatagctcactgcagcctcaatctttgagctcaagcgatcctcccatctcagcctaagtacctaggactacaggcatgtgccaccatacctggctaatttttttaatttttagtaaggaagaggtcttggtatgttgcccaggctggtctccaactcctgagctcaagtgatgttcacacctcagctt

SEQ ID NO: 87179 - DNA, 388 bp, Homo sapiens
ggaggcggagcttgcggtgagccaagattgtgccaccgcactccaggctgggcaacagagcgagactctgtctcaaaaagaaaaaaaaaagggtctattgaatgtattttttgtctctgaattgttcacttttttctaaacacatacatcatttttttttgtaatgaaatgaagttgttagaaggccacttcacaaacaagtcctcagtgaatgaaatgagtaaatgaatgaaatctgataatcctaccatttgcaattcactcttttgagacaggaggtgttttcctgttccagattctctaccaatatgcaaatacccctgagtggagctgataaagccgaaattgtcactgatcactaatctggggcttgtcagcctcaggccga

SEQ ID NO: 87180 - DNA, 275 bp, Homo sapiens
tcaataactggctcccctactagtccatcaagaaacaggatccacccagtaaaaacatttgttgctttagtctaagtgggtctgattgtcaatggatgcttataagtttatgataaaacaataaaaataaataggataaaaaagacatgcaacctatgatgacaactgtgtattttatagttaaagatgggaaataaatttccagtcaatgaattcacaggatattgagctgagagggaaagatggggagtgagaagctcttatcaagttagtta

SEQ ID NO: 87181 - DNA, 459 bp, Homo sapiens
  misc_feature (399)..(399): n is a, c, g, or t
  misc_feature (417)..(417): n is a, c, g, or t
acctcagattgtgaagggctctgtaggctatgttaaggacactagaaatctattgaaaggttttaagcagagaattgacttgctcatatttttgcttcaaaaagctcaatagctacaaaacggtcaatagatggtagctttgtggggctggggtgaatgcaatgatattgcaaaacaagatatagggagacaagaacttttaataacctaaaccagtggttctcaaactttccatgcatcagaatcacctggatgacttgcgaaaacacaaataatcagacttaatccctacattttctgatttagcaggtatagaatgaggtttaagaatttctaacaagttcccagatggcgtaaggtgtctctcaggttttttacttgagcaactgggtggatccngtggatcttatgtccctncgagtaaggggtcaggtacagcattctccggtcagattgttt

SEQ ID NO: 87182 - DNA, 458 bp, Homo sapiens
agtacaaattgctgatgtgtggaattgtaaaaaaaaaaaaactcaataatttagtatcaatgtagatgcaaccacccatttcagtcacaatgcctacccaagtgtttcacctagttaaatccttcagttgagttttctaatagaggcatgtaatgcgcaaacacgtgggaacctaccatgacttttgagtatgaagcccagtggtacacaaatggtgcatatgtagaaaatctgctgagctgagccaaagatacaaggatatttcagaaattacctatcatttaaaaaggagattagtttgtaggtttgatgacagcaattcctgaaagttttccaaataacagttcttaaaacaacattgttgaaaaatgaagaaattctttccagacataacagtaaaactttctctgaagttatcttcttgtgcacgtgtaataattcagagggatagtggaaac

SEQ ID NO: 87183 - DNA, 1003 bp, Homo sapiens
aagacccagggaagaggtctgagaggctggccacctgatgccaccctaaaggctcaacacctcttttcctccaccccagcggggtgcactctggccctcacctgtctagcatatccatttggactgtcactggctgggctccagcatcaataccatgtttttgtttgttttgttttgttttggatatgttttgttttgttttggaaactgggcctcagtttcctcatcttaaaataaggagattgggttagagatatagatggcttctaaggtctcctgaacccaaggctttctgattctttcattgctttttaatgcctgctctagggaggaaggagcacatctcccccttggtcgtgacttgtcacagttccagacttatagctgttgggttctaataccccccagctctcaggggaccaataaaaaccacatccagtcagcctgggcctgccccagcacatggagacaactggtctcaaagcagcccttcccagtccccctccccacacggcctcctacccacttccgactctttttgtttgtttgtttgttttttggagacggagttttgctcttgtagcccaggctggagtgcaatggtgcaatcccagctcactgcaacctccactccccgggttcaagtgattctcctgcctcagctgggattacaggtgcccgccaccacacccagctaaattttgtatttttagtagagacgggctttcaccatgttggccaggctggtctcgaactccagacctcaggtgatccacccgcctcagcctcccaaagtgttgggattacaggcgtgagccaccgcacccggcccactcctgacttttaaaaagagacaggaagcaaaaacaaaaccaagcacccaaggtaggtcagatgaagagccagggttagataacaagagcaacatcctttgagactaaaggtttggttgactcccttggagggccctgtgtggaagcggaggagggcgggatggccatac

SEQ ID NO: 87184 - DNA, 630 bp, Homo sapiens
tgacctcaagtaactcactcacctcagcctcccaaagtgccaagtgaaatattttagtgggaaaatgtccacagaataaggggtgtgggcttggtcagtggagagtggttgaagaggtgagagggaaccaaggctcttcctgctatttctttgctagggctggcccctttaggggcttcccttcccttagagatgactgccagggtcttccatccctactttctgccccttctctgaggggcctgagccccctcagcctcccaggttcatccaaacaaacaacttatggccttcataaaactgtctgattaaatgtgtattattatattttccttttttattatacaggatataaatgcttaactcttttcatgtatttttaaaccaactgacaaataattttgagcttgtcattagcatccttgggctaatataataaaactttgttacttaaacaaaaaaaaaaaaagggcggccgcccttttctttcttcatataggcggggggacagtctgccggctcattcacgtttcctcaacaccccggcacctttctcagctggccacccccttgccccaagacttttgtccacccattttcggacgacccccctttaacaccgcttccctg

SEQ ID NO: 87185 - DNA, 407 bp, Homo sapiens
gaggctctgcagctggcgccggggcgctgggccgattcctcagcctctgaggcctcacctttggcgtggggaaataaacgcgtgcgctctgcaggagtattgtgagggtggtcatgtactcgggacagtgcccagcatgcagtgttagctggaagagtgttagctgttgcgattattatagtcctttctccactcttataattcccaggagtctctttctctctgggaatgtaagttctaggaggatgaggaccgctagtcgttccagtgagccccctgcatgtcccaggcactggccatgccctccagggcttccgtttggccagggagcagtggcccgagccgccccatgcccagcatattcacacagtgctgtggggaggccaccgctacccaggaagaggggt

SEQ ID NO: 87186 - DNA, 225 bp, Homo sapiens
gagatcgtgccattgcactccagcctgggcgacaagagtgaaacttcatctcaaaaaaaaaaacaaaataagagctgaactctgctaacacctgaaggagcaggaaatggatcctctagagaggatcccagcccagtgagactcagacctgatttctgagccctagagcctaagatgataaatgtgtgctgtgtaagatgctaagtttacaatcatgtgttacgg

SEQ ID NO: 87187 - DNA, 2180 bp, Homo sapiens
agcggatctttccgtcccgggcagccagcgccagtcggagccagcgcgagccgccgccgccatcactgccgctgccaagtcctccacccgctgcccccgccatgtctgctaccgctgccacggccccccctgctgccccggctggggagggtggtccccctgcaccccctccaaacctcaccagtaacaggagactgcagcagacccaggcccaggtggatgaggtggtggacatcatgagggtgaacgtggacaaggtcctggagcgagaccagaagctgtcggagctggacgaccgtgcagatgcactccaggcgggggcctcccagtttgaaacaagcgcagccaagctcaagcgcaaatactggtggaaaaacctcaagatgatgatcatcttgggagtgatttgcgccatcatcctcatcatcatcatagtttacttcagcacttaaatccccgaggagtctgccctgcctagagaagggcctctcccccaaccctcagccgttcctccacctctcagccatatctttcagccccccctcccctggatccgtgtgtgtgtgtgtccgtgtgtgtgtccccctgtaaatagccagctgttatttatacatatataatattatatatatttggtctgtttgtagttttattactagatgatttttccggttgtccttaacaccccttcctgaggttcccttcacccctctctcttgccttccttccctttccctttcttcctgactagccccaagtcccttcatttgcatctgctatgcaatagtccctctcctttccttcttcttccctcagatttagctgatccttcctcccaccctggccttcctttcctctttcctcctcactctccccgtcatgctccctctgccccgccctcaaaaaaaaaaaaaaaaaaaaaaaaaaaaaaaaacaacagcacctgtccaggcttccttaggtacatcttctttgtatccattgggaggctctgagactggccccacttggtcctaagaatcccaaggtctttgggagcgtccagcatgttaattagcgtatcattacatactgctatccctttccatttctttttgttccatcactcttctctcaacctgtgtttctttttttactgaggagttagtccccattagttcttgtatcacattttcatttgcacgacattactcgcaggtggtggggagcctgggcttttggggaaccaggctgctctggtccccagcattgcctcctcctagcccctctagtccagtttgcctcccttaccctcattttccaaacctcttgtaccctcctctccctcccccagctggtatgtaagtgtcttgaagttcagtatgttatgatggaccaataattctgccacttcgggtttctccctacattcctgctccccagttttcatgtggggtactcaactgacattcccatggggtttccctcccatctgcctgatccacctcctcctcccaccaggagagttgggggttggccacaattgatctcttgtgagaggggtggctaccagtgtgtgtgtgggggtcatcactgccttggggaggagtggggcagggcagagaatccccccaattcctgcctgaaatctctggcctcacccctgctgggggttggactgaaaaccctcctccccaatttggggggtgttgccccatcactgcccagctcctctgactgccccccctgaatttagggtgggggtactagtcactgccaatgtgtgtatgggacttgctggaaaacggggatgcttgcccctctccaggactattgagcccagagagagctgtcctctcattgggtgaactgattgaggaagggtctattgtctttttaaatggcacaattttaagggtttgagggtacagtcccttaacctgccacgggagggggcccccaaactttcttccccccacacttctggttttctgtgtggagggggagcagggatatctaagctgtggtgtgaaagggtaggagagatgctggaggtgggggtgctgtgttctagaccccccatattatcccagtgtcccctgcccccctcttcccccaccccatgcccccaattctgtggcgcatccagattgtgaaaatgtacaataaatgtgtaatgagtaaccaagtgttgtctaaga

SEQ ID NO: 87188 - DNA, 715 bp, Homo sapiens
  misc_feature (43)..(44): n is a, c, g, or t
  misc_feature (143)..(143): n is a, c, g, or t
  misc_feature (149)..(149): n is a, c, g, or t
  misc_feature (160)..(160): n is a, c, g, or t
  misc_feature (175)..(175): n is a, c, g, or t
gtgactctaaggattactgctgctccctcttcaggactattgnnccagagagagctgtctctcattgggtgaactgattgaggaagggtctattgtctttttaaatggcacaatttaagggtttgagggtacagtcccttaanctgccncgggagggggnccccaaactttcttncccccacacttctggttttctgtgtggagggggagcagggatatctaagccttgaagttcagtatgttatgatggaccaataattctgccacttcgggtttctccctacattcctgctccccagttttcatgtggggtactcaactgacattcccatggggtttccctcccatctgcctgatccacctcctcctcccaccaggagagttgggggttggccacaattgatctcttgtgagaggggtggctaccagtgtgtgtgtgggggtcatcactgccttggggaggagtggggcagggcagagaatccccccaattcctgcctgaaatctctggcctcacccctgctgggggttggactgaaaaccctcctccccaatttggggggtgttgccccatcactgcccagctcctctgactgccccccctgaatttagggtgggggtactagtcactgccacatgcccccaattctgtggcgcatccagattgtgaaaatgtacaataaatgtgtaatgagtaaccaagtgttgtctaaga

SEQ ID NO: 87189 - DNA, 274 bp, Homo sapiens
  misc_feature (241)..(241): n is a, c, g, or t
  misc_feature (254)..(254): n is a, c, g, or t
  misc_feature (260)..(260): n is a, c, g, or t
agagagagagagagagagagagagagagagagagagagagagagagagagagagagagagagagagagagagagagagagagagagagagctcaggtctgctaccgctgccacggccccccctgctgccccggctggggagggtggtccccctgcaccccctccaaacctcaccagtaacaggagactgcagcagacccaggcccaggtggatgaggtgctgaaatcagccagcccatggnccccaataaaggnagctgnctctgctccctctg

SEQ ID NO: 87190 - DNA, 2612 bp, Homo sapiens
agcggatctttccgtcccgggcagccagcgccagtcggagccagcgcgagccgccgccgccatcactgccgctgccaagtcctccacccgctgcccccgccatgtgagtcggccgcccgccaccctcaccgcgcttccctgcgccggccgccgcccttggcaaccggccgtcgggagtgcccggggtctcttctgcgttccccgcgccccggggccaggcccaagccggtgactgcgcgcgggcggccgaggagccccgcgtcccgggctggccggctcgggcgatggccgcgggaaggagcggacccagtgtcctcctgcccctccccgcccctgtcaccgcggcgcctgtcttttcgggtcgacccggatcgcatctgtgaggtcgccctcagttgacaggcggggaaactgaggccgggggggctcgctcaaggtcacgcagctcatcggcggcagggctggaccgagaccagggcttacatcgggtggccttcctcccgaaaaggaggactggagggacgaggatggacaggtctgctaccgctgccacggccccccctgctgccccggctggggagggtggtccccctgcaccccctccaaacctcaccagtaacaggagactgcagcagacccaggcccaggtggatgaggtggtggacatcatgagggtgaacgtggacaaggtcctggagcgagaccagaagctgtcggagctggacgaccgtgcagatgcactccaggcgggggcctcccagtttgaaacaagcgcagccaagctcaagcgcaaatactggtggaaaaacctcaagatgatgatcatcttgggagtgatttgcgccatcatcctcatcatcatcatagtttacttcagcacttaaatccccgaggagtctgccctgcctagagaagggcctctcccccaaccctcagccgttcctccacctctcagccatatctttcagccccccctcccctggatccgtgtgtgtgtgtgtccgtgtgtgtgtccccctgtaaatagccagctgttatttatacatatataatattatatatatttggtctgtttgtagttttattactagatgatttttccggttgtccttaacaccccttcctgaggttcccttcacccctctctcttgccttccttccctttccctttcttcctgactagccccaagtcccttcatttgcatctgctatgcaatagtccctctcctttccttcttcttccctcagatttagctgatccttcctcccaccctggccttcctttcctctttcctcctcactctccccgtcatgctccctctgccccgccctcaaaaaaaaaaaaaaaaaaaaaaaaaaaaaaaaacaacagcacctgtccaggcttccttaggtacatcttctttgtatccattgggaggctctgagactggccccacttggtcctaagaatcccaaggtctttgggagcgtccagcatgttaattagcgtatcattacatactgctatccctttccatttctttttgttccatcactcttctctcaacctgtgtttctttttttactgaggagttagtccccattagttcttgtatcacattttcatttgcacgacattactcgcaggtggtggggagcctgggcttttggggaaccaggctgctctggtccccagcattgcctcctcctagcccctctagtccagtttgcctcccttaccctcattttccaaacctcttgtaccctcctctccctcccccagctggtatgtaagtgtcttgaagttcagtatgttatgatggaccaataattctgccacttcgggtttctccctacattcctgctccccagttttcatgtggggtactcaactgacattcccatggggtttccctcccatctgcctgatccacctcctcctcccaccaggagagttgggggttggccacaattgatctcttgtgagaggggtggctaccagtgtgtgtgtgggggtcatcactgccttggggaggagtggggcagggcagagaatccccccaattcctgcctgaaatctctggcctcacccctgctgggggttggactgaaaaccctcctccccaatttggggggtgttgccccatcactgcccagctcctctgactgccccccctgaatttagggtgggggtactagtcactgccaatgtgtgtatgggacttgctggaaaacggggatgcttgcccctctccaggactattgagcccagagagagctgtcctctcattgggtgaactgattgaggaagggtctattgtctttttaaatggcacaattttaagggtttgagggtacagtcccttaacctgccacgggagggggcccccaaactttcttccccccacacttctggttttctgtgtggagggggagcagggatatctaagctgtggtgtgaaagggtaggagagatgctggaggtgggggtgctgtgttctagaccccccatattatcccagtgtcccctgcccccctcttcccccaccccatgcccccaattctgtggcgcatccagattgtgaaaatgtacaataaatgtgtaatgagtaaccaagtgttgtctaaga

SEQ ID NO: 87191 - DNA, 2755 bp, Homo sapiens
gggaccccaggcttcctctgagacatccaccagcggtgatgggttgggaccaatctcccccactcctctccaccctagcagtctgctaccgctgccacggccccccctgctgccccggctggggagggtggtccccctgcaccccctccaaacctcaccagtaacaggagactgcagcagacccaggcccaggtggatgaggtggtggacatcatgagggtgaacgtggacaaggtcctggagcgagaccagaagctgtcggagctggacgaccgtgcagatgcactccaggcgggggcctcccagtttgaaacaagcgcagccaagctcaagcgcaaatactggtggaaaaacctcaagatgatgatcatcttgggagtgatttgcgccatcatcctcatcatcatcatagtgagtagggtgagaatggccggggccctttccctggagaggtttccccagtggattctaggttttgaaggtcattaatctagtttttactcttcagccaaaaacacatatagctgctaatggcaattctgattcatctagagccaaaaactttgatgttatttagcctgcattttgcctagttcttggcagtcttgttaacatttggaaataggaaagctggtgtatccattgaggaccctttaggcctaagagcccagtctgagaaccctggaattgaggagtgggagaaaggaaaggaccaggggcttgagacatgaccaggaagccaaccaccccattatttgagagcttgcggtctcagaggctcagaggattagggtctgtggcttcaaggccataccatggagcggaagggacctcagaacctacctgtctagccccttgctttgtagatggaaaaactgagtccaagagagggtgtcagccagctggggagtggggaggattggagcagggccaggcctgacacactgctttcttgttctctctctttctctcccctctccctcttcctcatcttcttcccctctctccactttacttcagcacttaaatccccgaggagtctgccctgcctagagaagggcctctcccccaaccctcagccgttcctccacctctcagccatatctttcagccccccctcccctggatccgtgtgtgtgtgtgtccgtgtgtgtgtccccctgtaaatagccagctgttatttatacatatataatattatatatatttggtctgtttgtagttttattactagatgatttttccggttgtccttaacaccccttcctgaggttcccttcacccctctctcttgccttccttccctttccctttcttcctgactagccccaagtcccttcatttgcatctgctatgcaatagtccctctcctttccttcttcttccctcagatttagctgatccttcctcccaccctggccttcctttcctctttcctcctcactctccccgtcatgctccctctgccccgccctcaaaaaaaaaaaaaaaaaaaaaaaaaaaaaaaaacaacagcacctgtccaggcttccttaggtacatcttctttgtatccattgggaggctctgagactggccccacttggtcctaagaatcccaaggtctttgggagcgtccagcatgttaattagcgtatcattacatactgctatccctttccatttctttttgttccatcactcttctctcaacctgtgtttctttttttactgaggagttagtccccattagttcttgtatcacattttcatttgcacgacattactcgcaggtggtggggagcctgggcttttggggaaccaggctgctctggtccccagcattgcctcctcctagcccctctagtccagtttgcctcccttaccctcattttccaaacctcttgtaccctcctctccctcccccagctggtatgtaagtgtcttgaagttcagtatgttatgatggaccaataattctgccacttcgggtttctccctacattcctgctccccagttttcatgtggggtactcaactgacattcccatggggtttccctcccatctgcctgatccacctcctcctcccaccaggagagttgggggttggccacaattgatctcttgtgagaggggtggctaccagtgtgtgtgtgggggtcatcactgccttggggaggagtggggcagggcagagaatccccccaattcctgcctgaaatctctggcctcacccctgctgggggttggactgaaaaccctcctccccaatttggggggtgttgccccatcactgcccagctcctctgactgccccccctgaatttagggtgggggtactagtcactgccaatgtgtgtatgggacttgctggaaaacggggatgcttgcccctctccaggactattgagcccagagagagctgtcctctcattgggtgaactgattgaggaagggtctattgtctttttaaatggcacaattttaagggtttgagggtacagtcccttaacctgccacgggagggggcccccaaactttcttccccccacacttctggttttctgtgtggagggggagcagggatatctaagctgtggtgtgaaagggtaggagagatgctggaggtgggggtgctgtgttctagaccccccatattatcccagtgtcccctgcccccctcttcccccaccccatgcccccaattctgtggcgcatccagattgtgaaaatgtacaataaatgtgtaatgagtaaccaagtgttgtctaaga

SEQ ID NO: 87192 - DNA, 2154 bp, Homo sapiens
agcggatctttccgtcccgggcagccagcgccagtcggagccagcgcgagccgccgccgccatcactgccgctgccaagtcctccacccgctgcccccgccatgtctgctaccgctgccacggccccccctgctgccccggctggggagggtggtccccctgcaccccctccaaacctcaccagtaacaggagactgcagcagacccaggcccaggtggatgaggtggtggacatcatgagggtgaacgtggacaaggtcctggagcgagaccagaagctgtcggagctggacgaccgtgcagatgcactccaggcgggggcctcccagtttgaaacaagcgcagccaagctcaagcgcaaatactggtggaaaaacctcaagatgatgatcatcttgggagtgatttgcgccatcatcctcatcatcatcatagtttacttcagcacttaaatccccgaggagtctgccctgcctagagaagggcctctcccccaaccctcagccgttcctccacctctcagccatatctttcagccccccctcccctggatccgtgtgtgtgtgtgtccgtgtgtgtgtccccctgtaaatagccagctgttatttatacatatataatattatatatatttggtctgtttgtagttttattactagatgatttttccggttgtccttaacaccccttcctgaggttcccttcacccctctctcttgccttccttccctttccctttcttcctgactagccccaagtcccttcatttgcatctgctatgcaatagtccctctcctttccttcttcttccctcagatttagctgatccttcctcccaccctggccttcctttcctctttcctcctcactctccccgtcatgctccctctgccccgccctcaaaaaaaaaaaaaaaaaaaaaaaaaaaaaaaaacaacagcacctgtccaggcttccttaggtacatcttctttgtatccattgggaggctctgagactggccccacttggtcctaagaatcccaaggtctttgggagcgtccagcatgttaattagcgtatcattacatactgctatccctttccatttctttttgttccatcactcttctctcaacctgtgtttctttttttactgaggagttagtccccattagttcttgtatcacattttcatttgcacgacattactcgcaggtggtggggagcctggtccccagcattgcctcctcctagcccctctagtccagtttgcctcccttaccctcattttccaaacctcttgtaccctcctctccctcccccagctggtatgtaagtgtcttgaagttcagtatgttatgatggaccaataattctgccacttcgggtttctccctacattcctgctccccagttttcatgtggggtactcaactgacattcccatggggtttccctcccatctgcctgatccacctcctcctcccaccaggagagttgggggttggccacaattgatctcttgtgagaggggtggctaccagtgtgtgtgtgggggtcatcactgccttggggaggagtggggcagggcagagaatccccccaattcctgcctgaaatctctggcctcacccctgctgggggttggactgaaaaccctcctccccaatttggggggtgttgccccatcactgcccagctcctctgactgccccccctgaatttagggtgggggtactagtcactgccaatgtgtgtatgggacttgctggaaaacggggatgcttgcccctctccaggactattgagcccagagagagctgtcctctcattgggtgaactgattgaggaagggtctattgtctttttaaatggcacaattttaagggtttgagggtacagtcccttaacctgccacgggagggggcccccaaactttcttccccccacacttctggttttctgtgtggagggggagcagggatatctaagctgtggtgtgaaagggtaggagagatgctggaggtgggggtgctgtgttctagaccccccatattatcccagtgtcccctgcccccctcttcccccaccccatgcccccaattctgtggcgcatccagattgtgaaaatgtacaataaatgtgtaatgagtaaccaagtgttgtctaaga

SEQ ID NO: 87193 - DNA, 2778 bp, Homo sapiens
agcggatctttccgtcccgggcagccagcgccagtcggagccagcgcgagccgccgccgccatcactgccgctgccaagtcctccacccgctgcccccgccatgtctgctaccgctgccacggccccccctgctgccccggctggggagggtggtccccctgcaccccctccaaacctcaccagtaacaggagactgcagcagacccaggcccaggtggatgaggtggtggacatcatgagggtgaacgtggacaaggtcctggagcgagaccagaagctgtcggagctggacgaccgtgcagatgcactccaggcgggggcctcccagtttgaaacaagcgcagccaagctcaagcgcaaatactggtggaaaaacctcaagatgatgatcatcttgggagtgatttgcgccatcatcctcatcatcatcatagtgagtagggtgagaatggccggggccctttccctggagaggtttccccagtggattctaggttttgaaggtcattaatctagtttttactcttcagccaaaaacacatatagctgctaatggcaattctgattcatctagagccaaaaactttgatgttatttagcctgcattttgcctagttcttggcagtcttgttaacatttggaaataggaaagctggtgtatccattgaggaccctttaggcctaagagcccagtctgagaaccctggaattgaggagtgggagaaaggaaaggaccaggggcttgagacatgaccaggaagccaaccaccccattatttgagagcttgcggtctcagaggctcagaggattagggtctgtggcttcaaggccataccatggagcggaagggacctcagaacctacctgtctagccccttgctttgtagatggaaaaactgagtccaagagagggtgtcagccagctggggagtggggaggattggagcagggccaggcctgacacactgctttcttgttctctctctttctctcccctctccctcttcctcatcttcttcccctctctccactttacttcagcacttaaatccccgaggagtctgccctgcctagagaagggcctctcccccaaccctcagccgttcctccacctctcagccatatctttcagccccccctcccctggatccgtgtgtgtgtgtgtccgtgtgtgtgtccccctgtaaatagccagctgttatttatacatatataatattatatatatttggtctgtttgtagttttattactagatgatttttccggttgtccttaacaccccttcctgaggttcccttcacccctctctcttgccttccttccctttccctttcttcctgactagccccaagtcccttcatttgcatctgctatgcaatagtccctctcctttccttcttcttccctcagatttagctgatccttcctcccaccctggccttcctttcctctttcctcctcactctccccgtcatgctccctctgccccgccctcaaaaaaaaaaaaaaaaaaaaaaaaaaaaaaaaacaacagcacctgtccaggcttccttaggtacatcttctttgtatccattgggaggctctgagactggccccacttggtcctaagaatcccaaggtctttgggagcgtccagcatgttaattagcgtatcattacatactgctatccctttccatttctttttgttccatcactcttctctcaacctgtgtttctttttttactgaggagttagtccccattagttcttgtatcacattttcatttgcacgacattactcgcaggtggtggggagcctgggcttttggggaaccaggctgctctggtccccagcattgcctcctcctagcccctctagtccagtttgcctcccttaccctcattttccaaacctcttgtaccctcctctccctcccccagctggtatgtaagtgtcttgaagttcagtatgttatgatggaccaataattctgccacttcgggtttctccctacattcctgctccccagttttcatgtggggtactcaactgacattcccatggggtttccctcccatctgcctgatccacctcctcctcccaccaggagagttgggggttggccacaattgatctcttgtgagaggggtggctaccagtgtgtgtgtgggggtcatcactgccttggggaggagtggggcagggcagagaatccccccaattcctgcctgaaatctctggcctcacccctgctgggggttggactgaaaaccctcctccccaatttggggggtgttgccccatcactgcccagctcctctgactgccccccctgaatttagggtgggggtactagtcactgccaatgtgtgtatgggacttgctggaaaacggggatgcttgcccctctccaggactattgagcccagagagagctgtcctctcattgggtgaactgattgaggaagggtctattgtctttttaaatggcacaattttaagggtttgagggtacagtcccttaacctgccacgggagggggcccccaaactttcttccccccacacttctggttttctgtgtggagggggagcagggatatctaagctgtggtgtgaaagggtaggagagatgctggaggtgggggtgctgtgttctagaccccccatattatcccagtgtcccctgcccccctcttcccccaccccatgcccccaattctgtggcgcatccagattgtgaaaatgtacaataaatgtgtaatgagtaaccaagtgttgtctaaga

SEQ ID NO: 87194 - DNA, 2261 bp, Homo sapiens
atggagacccaggactgaggagtaaagggctaaggaacagggagatggctggagaaggagacaggcagataggctgataggtcttagatggtctagggatgttggaagccaggggcattaggatgtagaggcaggggtggcctgaggacaggagagtctgggtctccatgagcccagtctgagaaccctggaattgaggagtgggagaaaggaaaggaccaggggcttgagacatgaccaggaagccaaccaccccattatttgagagcttgcggtctcagaggctcagaggattagggtctgtggcttcaaggccataccatggagcggaagggacctcagaacctacctgtctagccccttgctttgtagatggaaaaactgagtccaagagagggtgtcagccagctggggagtggggaggattggagcagggccaggcctgacacactgctttcttgttctctctctttctctcccctctccctcttcctcatcttcttcccctctctccactttacttcagcacttaaatccccgaggagtctgccctgcctagagaagggcctctcccccaaccctcagccgttcctccacctctcagccatatctttcagccccccctcccctggatccgtgtgtgtgtgtgtccgtgtgtgtgtccccctgtaaatagccagctgttatttatacatatataatattatatatatttggtctgtttgtagttttattactagatgatttttccggttgtccttaacaccccttcctgaggttcccttcacccctctctcttgccttccttccctttccctttcttcctgactagccccaagtcccttcatttgcatctgctatgcaatagtccctctcctttccttcttcttccctcagatttagctgatccttcctcccaccctggccttcctttcctctttcctcctcactctccccgtcatgctccctctgccccgccctcaaaaaaaaaaaaaaaaaaaaaaaaaaaaaaaaacaacagcacctgtccaggcttccttaggtacatcttctttgtatccattgggaggctctgagactggccccacttggtcctaagaatcccaaggtctttgggagcgtccagcatgttaattagcgtatcattacatactgctatccctttccatttctttttgttccatcactcttctctcaacctgtgtttctttttttactgaggagttagtccccattagttcttgtatcacattttcatttgcacgacattactcgcaggtggtggggagcctgggcttttggggaaccaggctgctctggtccccagcattgcctcctcctagcccctctagtccagtttgcctcccttaccctcattttccaaacctcttgtaccctcctctccctcccccagctggtatgtaagtgtcttgaagttcagtatgttatgatggaccaataattctgccacttcgggtttctccctacattcctgctccccagttttcatgtggggtactcaactgacattcccatggggtttccctcccatctgcctgatccacctcctcctcccaccaggagagttgggggttggccacaattgatctcttgtgagaggggtggctaccagtgtgtgtgtgggggtcatcactgccttggggaggagtggggcagggcagagaatccccccaattcctgcctgaaatctctggcctcacccctgctgggggttggactgaaaaccctcctccccaatttggggggtgttgccccatcactgcccagctcctctgactgccccccctgaatttagggtgggggtactagtcactgccaatgtgtgtatgggacttgctggaaaacggggatgcttgcccctctccaggactattgagcccagagagagctgtcctctcattgggtgaactgattgaggaagggtctattgtctttttaaatggcacaattttaagggtttgagggtacagtcccttaacctgccacgggagggggcccccaaactttcttccccccacacttctggttttctgtgtggagggggagcagggatatctaagctgtggtgtgaaagggtaggagagatgctggaggtgggggtgctgtgttctagaccccccatattatcccagtgtcccctgcccccctcttcccccaccccatgcccccaattctgtggcgcatccagattgtgaaaatgtacaataaatgtgtaatgagtaaccaagtgttgtctaaga

SEQ ID NO: 87195 - DNA, 2120 bp, Homo sapiens
tgatgctaggtcgatctaaggatcccatgggcccagtctgagaaccctggaattgaggagtgggagaaaggaaaggaccaggggcttgagacatgaccaggaagccaaccaccccattatttgagagcttgcggtctcagaggctcagaggattagggtctgtggcttcaaggccataccatggagcggaagggacctcagaacctacctgtctagccccttgctttgtagatggaaaaactgagtccaagagagggtgtcagccagctggggagtggggaggattggagcagggccaggcctgacacactgctttcttgttctctctctttctctcccctctccctcttcctcatcttcttcccctctctccactttacttcagcacttaaatccccgaggagtctgccctgcctagagaagggcctctcccccaaccctcagccgttcctccacctctcagccatatctttcagccccccctcccctggatccgtgtgtgtgtgtgtccgtgtgtgtgtccccctgtaaatagccagctgttatttatacatatataatattatatatatttggtctgtttgtagttttattactagatgatttttccggttgtccttaacaccccttcctgaggttcccttcacccctctctcttgccttccttccctttccctttcttcctgactagccccaagtcccttcatttgcatctgctatgcaatagtccctctcctttccttcttcttccctcagatttagctgatccttcctcccaccctggccttcctttcctctttcctcctcactctccccgtcatgctccctctgccccgccctcaaaaaaaaaaaaaaaaaaaaaaaaaaaaaaaaacaacagcacctgtccaggcttccttaggtacatcttctttgtatccattgggaggctctgagactggccccacttggtcctaagaatcccaaggtctttgggagcgtccagcatgttaattagcgtatcattacatactgctatccctttccatttctttttgttccatcactcttctctcaacctgtgtttctttttttactgaggagttagtccccattagttcttgtatcacattttcatttgcacgacattactcgcaggtggtggggagcctgggcttttggggaaccaggctgctctggtccccagcattgcctcctcctagcccctctagtccagtttgcctcccttaccctcattttccaaacctcttgtaccctcctctccctcccccagctggtatgtaagtgtcttgaagttcagtatgttatgatggaccaataattctgccacttcgggtttctccctacattcctgctccccagttttcatgtggggtactcaactgacattcccatggggtttccctcccatctgcctgatccacctcctcctcccaccaggagagttgggggttggccacaattgatctcttgtgagaggggtggctaccagtgtgtgtgtgggggtcatcactgccttggggaggagtggggcagggcagagaatccccccaattcctgcctgaaatctctggcctcacccctgctgggggttggactgaaaaccctcctccccaatttggggggtgttgccccatcactgcccagctcctctgactgccccccctgaatttagggtgggggtactagtcactgccaatgtgtgtatgggacttgctggaaaacggggatgcttgcccctctccaggactattgagcccagagagagctgtcctctcattgggtgaactgattgaggaagggtctattgtctttttaaatggcacaattttaagggtttgagggtacagtcccttaacctgccacgggagggggcccccaaactttcttccccccacacttctggttttctgtgtggagggggagcagggatatctaagctgtggtgtgaaagggtaggagagatgctggaggtgggggtgctgtgttctagaccccccatattatcccagtgtcccctgcccccctcttcccccaccccatgcccccaattctgtggcgcatccagattgtgaaaatgtacaataaatgtgtaatgagtaaccaagtgttgtctaaga

SEQ ID NO: 87196 - DNA, 2549 bp, Homo sapiens
agcggatctttccgtcccgggcagccagcgccagtcggagccagcgcgagccgccgccgccatcactgccgctgccaagtcctccacccgctgcccccgccatgtgagtcggccgcccgccaccctcaccgcgcttccctgcgccggccgccgcccttggcaaccggccgtcgggagtgcccggggtctcttctgcgttccccgcgccccggggccaggcccaagccggtgactgcgcgcgggcggccgaggagccccgcgtcccgggctggccggctcgggcgatggccgcgggaaggagcggacccagtgtcctcctgcccctccccgcccctgtcaccgcggcgcctgtcttttcgggtcgacccggatcgcatctgtgaggtcgccctcagttgacaggcggggaaactgaggccgggggggctcgctcaaggtcacgcagctcatcggcggcagggctggaccgagaccagggcttacatcgggtggccttcctcccgaaaaggaggactggagggacgaggatggacaggtctgctaccgctgccacggccccccctgctgccccggctggggagggtggtccccctgcaccccctccaaacctcaccagtaacaggagactgcagcagacccaggcccaggtggatgaggtggtggacatcatgagggtgaacgtggacaaggtcctggagcgagaccagaagctgtcggagctggacgaccgtgcagatgcactccaggcgggggcctcccagtttgaaacaagcgcagccaagctcaagcgcaaatactggtggaaaaacctcaagatgatgatcatcttgggagtgatttgcgccatcatcctcatcatcatcatagcctcagccgttcctccacctctcagccatatctttcagccccccctcccctggatccgtgtgtgtgtgtgtccgtgtgtgtgtccccctgtaaatagccagctgttatttatacatatataatattatatatatttggtctgtttgtagttttattactagatgatttttccggttgtccttaacaccccttcctgaggttcccttcacccctctctcttgccttccttccctttccctttcttcctgactagccccaagtcccttcatttgcatctgctatgcaatagtccctctcctttccttcttcttccctcagatttagctgatccttcctcccaccctggccttcctttcctctttcctcctcactctccccgtcatgctccctctgccccgccctcaaaaaaaaaaaaaaaaaaaaaaaaaaaaaaaaacaacagcacctgtccaggcttccttaggtacatcttctttgtatccattgggaggctctgagactggccccacttggtcctaagaatcccaaggtctttgggagcgtccagcatgttaattagcgtatcattacatactgctatccctttccatttctttttgttccatcactcttctctcaacctgtgtttctttttttactgaggagttagtccccattagttcttgtatcacattttcatttgcacgacattactcgcaggtggtggggagcctgggcttttggggaaccaggctgctctggtccccagcattgcctcctcctagcccctctagtccagtttgcctcccttaccctcattttccaaacctcttgtaccctcctctccctcccccagctggtatgtaagtgtcttgaagttcagtatgttatgatggaccaataattctgccacttcgggtttctccctacattcctgctccccagttttcatgtggggtactcaactgacattcccatggggtttccctcccatctgcctgatccacctcctcctcccaccaggagagttgggggttggccacaattgatctcttgtgagaggggtggctaccagtgtgtgtgtgggggtcatcactgccttggggaggagtggggcagggcagagaatccccccaattcctgcctgaaatctctggcctcacccctgctgggggttggactgaaaaccctcctccccaatttggggggtgttgccccatcactgcccagctcctctgactgccccccctgaatttagggtgggggtactagtcactgccaatgtgtgtatgggacttgctggaaaacggggatgcttgcccctctccaggactattgagcccagagagagctgtcctctcattgggtgaactgattgaggaagggtctattgtctttttaaatggcacaattttaagggtttgagggtacagtcccttaacctgccacgggagggggcccccaaactttcttccccccacacttctggttttctgtgtggagggggagcagggatatctaagctgtggtgtgaaagggtaggagagatgctggaggtgggggtgctgtgttctagaccccccatattatcccagtgtcccctgcccccctcttcccccaccccatgcccccaattctgtggcgcatccagattgtgaaaatgtacaataaatgtgtaatgagtaaccaagtgttgtctaaga

SEQ ID NO: 87197 - DNA, 1812 bp, Homo sapiens
tggcacgaggccttggctgggtgtggtggctcacacctgaaaacccagcgcattgggaggctgaggcaggcagatcacctgaggtcaggagttcgagaacaccctgaccaatatgatgaaaccctgtctcatctaaaaatacaaaacttagtcagccatatctttcagccccccctcccctggatccgtgtgtgtgtgtgtccgtgtgtgtgtccccctgtaaatagccagctgttatttatacatatataatattatatatatttggtctgtttgtagttttattactagatgatttttccggttgtccttaacaccccttcctgaggttcccttcacccctctctcttgccttccttccctttccctttcttcctgactagccccaagtcccttcatttgcatctgctatgcaatagtccctctcctttccttcttcttccctcagatttagctgatccttcctcccaccctggccttcctttcctctttcctcctcactctccccgtcatgctccctctgccccgccctcaaaaaaaaaaaaaaaaaaaaaaaaaaaaaaaaacaacagcacctgtccaggcttccttaggtacatcttctttgtatccattgggaggctctgagactggccccacttggtcctaagaatcccaaggtctttgggagcgtccagcatgttaattagcgtatcattacatactgctatccctttccatttctttttgttccatcactcttctctcaacctgtgtttctttttttactgaggagttagtccccattagttcttgtatcacattttcatttgcacgacattactcgcaggtggtggggagcctgggcttttggggaaccaggctgctctggtccccagcattgcctcctcctagcccctctagtccagtttgcctcccttaccctcattttccaaacctcttgtaccctcctctccctcccccagctggtatgtaagtgtcttgaagttcagtatgttatgatggaccaataattctgccacttcgggtttctccctacattcctgctccccagttttcatgtggggtactcaactgacattcccatggggtttccctcccatctgcctgatccacctcctcctcccaccaggagagttgggggttggccacaattgatctcttgtgagaggggtggctaccagtgtgtgtgtgggggtcatcactgccttggggaggagtggggcagggcagagaatccccccaattcctgcctgaaatctctggcctcacccctgctgggggttggactgaaaaccctcctccccaatttggggggtgttgccccatcactgcccagctcctctgactgccccccctgaatttagggtgggggtactagtcactgccaatgtgtgtatgggacttgctggaaaacggggatgcttgcccctctccaggactattgagcccagagagagctgtcctctcattgggtgaactgattgaggaagggtctattgtctttttaaatggcacaattttaagggtttgagggtacagtcccttaacctgccacgggagggggcccccaaactttcttccccccacacttctggttttctgtgtggagggggagcagggatatctaagctgtggtgtgaaagggtaggagagatgctggaggtgggggtgctgtgttctagaccccccatattatcccagtgtcccctgcccccctcttcccccaccccatgcccccaattctgtggcgcatccagattgtgaaaatgtacaataaatgtgtaatgagtaaccaagtgttgtctaaga

SEQ ID NO: 87198 - DNA, 2144 bp, Homo sapiens
agcggatctttccgtcccgggcagccagcgccagtcggagccagcgcgagccgccgccgccatcactgccgctgccaagtcctccacccgctgcccccgccatgtctgctaccgctgccacggccccccctgctgccccggctggggagggtggtccccctgcaccccctccaaacctcaccagtaacaggagactgcagcagacccaggcccaggtggatgaggtggtggacatcatgagggtgaacgtggacaaggtcctggagcgagaccagaagctgtcggagctggacgaccgtgcagatgcactccaggcgggggcctcccagtttgaaacaagcgcagccaagctcaagcgcaaatactggtggaaaaacctcaagatgatgatcatcttgggagtgatttgcgccatcatcctcatcatcatcatagtttacttcagcacttaaatccccgaggagtctgccctgcctagagaagggcctctcccccaaccctcagccgttcctccacctctcagccatatctttcagccccccctcccctggatccgtgtgtgtgtgtgtccgtgtgtgtgtccccctgtaaatagccagctgttatttatacatatataatattatatatatttggtctgtttgtagttttattactagatgatttttccggttgtccttaacaccccttcctgaggttcccttcacccctctctcttgccttccttccctttccctttcttcctgactagccccaagtcccttcatttgcatctgctatgcaatagtccctctcctttccttcttcttccctcagatttagctgatccttcctcccaccctggccttcctttcctctttcctcctcactctccccgtcatgctccctctgccccgccctcaaaaaaaaaaaaaaaaaaaaaaaaaaaaaaaaacaacagcacctgtccaggcttccttaggtacatcttctttgtatccattgggaggctctgagactggccccacttggtcctaagaatcccaaggtctttgggagcgtccagcatgttaattagcgtatcattacatactgctatccctttccatttctttttgttccatcactcttctctcaacctgtgtttctttttttactgaggagttagtccccattagttcttgtatcacattttcatttgcacgacattactcgcaggtggtggggagcctgggcttttggggaaccaggctgctctggtccccagcattgcctcctcctagcccctctagtccagtttgcctcccttaccctcattttccaaacctcttgtaccctcctctccctcccccagctggtatgtaagtgtcttgaagttcagtatgttatgatggaccaataattctgccacttcgggtttctccctacattcctgctccccagttttcatgtggggtactcaactgacattcccatggggtttccctcccatctgcctgatccacctcctcctcccaccaggagagttgggggttggccacaattgatctcttgtgagaggggtggctaccagtgtgtgtgtgggggtcatcactgccttggggaggagtggggcagggcagagaatccccccaattcctgcctgaaatctctggcctcacccctgctgggggttggactgaaaaccctcctccccaatttggggggtgttgccccatcactgcccagctcctctgactgccccccctgaatttagggtgggggtactagtcactgccaatgtgtgtatgggacttgctggaaaacggggatgcttgcccctctccaggactattgagcccagagagagctgtcctctcattgggtgaactgattgaggaagggtctattgtctttttaaatggcacaattttaagggtttgagggtacagtcccttaacctgccacgggagggggcccccaaactttcttccccccacacttctggttttctgtgtggagggggagcagggatatctaagctgtggtgtgaaagggtaggagagatgctggaggtgggggtgctgtgttctagaccccccatatcatgcccccaattctgtggcgcatccagattgtgaaaatgtacaataaatgtgtaatgagtaaccaagtgttgtctaaga

SEQ ID NO: 87199 - DNA, 1792 bp, Homo sapiens
agcggatctttccgtcccgggcagccagcgccagtcggagccagcgcgagccgccgccgccatcactgccgctgccaagtcctccacccgctgcccccgccatgtctgctaccgctgccacggccccccctgctgccccggctggggagggtggtccccctgcaccccctccaaacctcaccagtaacaggagactgcagcagacccaggcccaggtggatgaggtggtggacatcatgagggtgaacgtggacaaggtcctggagcgagaccagaagctgtcggagctggacgaccgtgcagatgcactccaggcgggggcctcccagtttgaaacaagcgcagccaagctcaagcgcaaatactggtggaaaaacctcaagatgatgatcatcttgggagtgatttgcgccatcatcctcatcatcatcatagtttacttcagcacttaaatccccgaggagtctgccctgcctagagaagggcctctcccccaaccctcagccgttcctccacctctcagccatatctttcagccccccctcccctggatccgtgtgtgtgtgtgtccgtgtgtgtgtccccctgtaaatagccagctgttatttatacatatataatattatatatatttggtctgtttgtagttttattactagatgatttttccggttgtccttaacaccccttcctgaggttcccttcacccctctctcttgccttccttccctttccctttcttcctgactagccccaagtcccttcatttgcatctgctatgcaatagtccctctcctttccttcttcttccctcagatttagctgatccttcctcccaccctggccttcctttcctctttcctcctcactctccccgtcatgctccctctgccccgccctcaaaaaaaaaaaaaaaaaaaaaaaaaaaaaaaaacaacagcacctgtccaggcttccttaggtacatcttctttgtatccattgggaggctctgagactggccccacttggtcctaagaatcccaaggtctttgggagcgtccagcatgttaattagcgtatcattacatactgctatccctttccatttctttttgttccatcactcttctctcaacctgtgtttctttttttactgaggagttagtccccattagttcttgtatcacattttcatttgcacgacattactcgcaggtggtggggagcctgggcttttggggaaccaggctgctctggtccccagcattgcctcctcctagcccctctagtccagtttgcctcccttaccctcattttccaaacctcttgtaccctcctctccctcccccagctggtatgtaagtgtcttgaagttcagtatgttatgatggaccaataattctgccacttcgggtttctccctacattcctgctccccagttttcatgtggggtactcaactgacattcccatggggtttccctcccatctgcctgatccacctcctcctcccaccaggagagttgggggttggccacaattgatctcttgtgagaggggtggctaccagtgtgtgtgtgggggtcatcactgccttggggaggagtggggcagggcagagaatccccccaattcctgcctgaaatctctggcctcacccctgctgggggttggactgaaaaccctcctccccaatttggggggtgttgccccatcactgcccagctcctctgactgccccccctgaatttagggtgggggtactagtcactgccagagactctctccacactgggagagtgatgcgttt

SEQ ID NO: 87200 - DNA, 1624 bp, Homo sapiens
catggctgggaaggcctcaggagacttacaatcatggtggaagaaaaggggaagcagacatgtcttacgttgcccgagaaggaggaagatagagagaagggggaagtgccacacacttttaaacaaccagatcttgtgaggttcccttcacccctctctcttgccttccttccctttccctttcttcctgactagccccaagtcccttcatttgcatctgctatgcaatagtccctctcctttccttcttcttccctcagatttagctgatccttcctcccaccctggccttcctttcctctttcctcctcactctccccgtcatgctccctctgccccgccctcaaaaaaaaaaaaaaaaaaaaaaaaaaaaaaaaacaacagcacctgtccaggcttccttaggtacatcttctttgtatccattgggaggctctgagactggccccacttggtcctaagaatcccaaggtctttgggagcgtccagcatgttaattagcgtatcattacatactgctatccctttccatttctttttgttccatcactcttctctcaacctgtgtttctttttttactgaggagttagtccccattagttcttgtatcacattttcatttgcacgacattactcgcaggtggtggggagcctgggcttttggggaaccaggctgctctggtccccagcattgcctcctcctagcccctctagtccagtttgcctcccttaccctcattttccaaacctcttgtaccctcctctccctcccccagctggtatgtaagtgtcttgaagttcagtatgttatgatggaccaataattctgccacttcgggtttctccctacattcctgctccccagttttcatgtggggtactcaactgacattcccatggggtttccctcccatctgcctgatccacctcctcctcccaccaggagagttgggggttggccacaattgatctcttgtgagaggggtggctaccagtgtgtgtgtgggggtcatcactgccttggggaggagtggggcagggcagagaatccccccaattcctgcctgaaatctctggcctcacccctgctgggggttggactgaaaaccctcctccccaatttggggggtgttgccccatcactgcccagctcctctgactgccccccctgaatttagggtgggggtactagtcactgccaatgtgtgtatgggacttgctggaaaacggggatgcttgcccctctccaggactattgagcccagagagagctgtcctctcattgggtgaactgattgaggaagggtctattgtctttttaaatggcacaattttaagggtttgagggtacagtcccttaacctgccacgggagggggcccccaaactttcttccccccacacttctggttttctgtgtggagggggagcagggatatctaagctgtggtgtgaaagggtaggagagatgctggaggtgggggtgctgtgttctagaccccccatattatcccagtgtcccctgcccccctcttcccccaccccatgcccccaattctgtggcgcatccagattgtgaaaatgtacaataaatgtgtaatgagtaaccaagtgttgtctaaga

SEQ ID NO: 87201 - DNA, 1600 bp, Homo sapiens
agcggatctttccgtcccgggcagccagcgccagtcggagccagcgcgagccgccgccgccatcactgccgctgccaagtcctccacccgctgcccccgccatgtctgctaccgctgccacggccccccctgctgccccggctggggagggtggtccccctgcaccccctccaaacctcaccagtaacaggagactgcagcagacccaggcccaggtggatgaggtggtggacatcatgagggtgaacgtggacaaggtcctggagcgagaccagaagctgtcggagctggacgaccgtgcagatgcactccaggcgggggcctcccagtttgaaacaagcgcagccaagctcaagcgcaaatactggtggaaaaacctcaagatgatgatcatcttgggagtgatttgcgccatcatcctcatcatcatcatagtttacttcagcacttaaatccccgaggagtctgccctgcctagagaagggcctctcccccaaccctcagccgttcctccacctctcagccatatctttcagccccccctcccctggatccgtgtgtgtgtgtgtccgtgtgtgtgtccccctgtaaatagccagctgttatttatacatatataatattatatatatttggtctgtttgtagttttattactagatgatttttccggttgtccttaacaccccttcctgaggttcccttcacccctctctcttgccttccttccctttccctttcttcctgactagccccaagtcccttcatttgcatctgctatgcaatagtccctctcctttccttcttcttccctcagatttagctgatccttcctcccaccctggccttcctttcctctttcctcctcactctccccgtcatgctccctctgccccgccctcaaaaaaaaaaaaaaaaaaaaaaaaaaaaaaaaacaacagcacctgtccaggcttccttaggtacatcttctttgtatccattgggaggctctgagactggccccacttggtcctaagaatcccaaggtctttgggagcgtccagcatgttaattagcgtatcattacatactgctatccctttccatttctttttgttccatcactcttctctcaacctgtgtttctttttttactgaggagttagtccccattagttcttgtatcacattttcatttgcacgacattactcgcaggtggtggggagcctgggcttttggggaaccaggctgctctggtccccagcattgcctcctcctagcccctctagtccagtttgcctcccttaccctcattttccaaacctcttgtaccctcctctccctcccccagctggtatgtaagtgtcttgaagttcagtatgttatgatggaccaataattctgccacttcgggtttctccctacattcctgctccccagttttcatgtggggtactcaactgacattcccaaactttcttccccccacacttctggttttctgtgtggagggggagcagggatatctaagctgtggtgtgaaagggtaggagagatgctggaggtgggggtgctgtgttctagaccccccatatgtctgcagagaggggatcctctg

SEQ ID NO: 87202 - DNA, 1440 bp, Homo sapiens
aaaaaatcaaaagaatttttaggctggtctcgaactcttgacctcaagtgatctgcccgcctcagcctctcagagtgctgggattacaggcatgagtcacccatgcctgggcataggcttttaaaaaataatttcagtcttcagaaatccatgaagatggaaatagaaattgataacaaaagcagaaattgctttaggacattttgaagctaactctgcttgggcatcttctttgtatccattgggaggctctgagactggccccacttggtcctaagaatcccaaggtctttgggagcgtccagcatgttaattagcgtatcattacatactgctatccctttccatttctttttgttccatcactcttctctcaacctgtgtttctttttttactgaggagttagtccccattagttcttgtatcacattttcatttgcacgacattactcgcaggtggtggggagcctgggcttttggggaaccaggctgctctggtccccagcattgcctcctcctagcccctctagtccagtttgcctcccttaccctcattttccaaacctcttgtaccctcctctccctcccccagctggtatgtaagtgtcttgaagttcagtatgttatgatggaccaataattctgccacttcgggtttctccctacattcctgctccccagttttcatgtggggtactcaactgacattcccatggggtttccctcccatctgcctgatccacctcctcctcccaccaggagagttgggggttggccacaattgatctcttgtgagaggggtggctaccagtgtgtgtgtgggggtcatcactgccttggggaggagtggggcagggcagagaatccccccaattcctgcctgaaatctctggcctcacccctgctgggggttggactgaaaaccctcctccccaatttggggggtgttgccccatcactgcccagctcctctgactgccccccctgaatttagggtgggggtactagtcactgccaatgtgtgtatgggacttgctggaaaacggggatgcttgcccctctccaggactattgagcccagagagagctgtcctctcattgggtgaactgattgaggaagggtctattgtctttttaaatggcacaattttaagggtttgagggtacagtcccttaacctgccacgggagggggcccccaaactttcttccccccacacttctggttttctgtgtggagggggagcagggatatctaagctgtggtgtgaaagggtaggagagatgctggaggtgggggtgctgtgttctagaccccccatattatcccagtgtcccctgcccccctcttcccccaccccatgcccccaattctgtggcgcatccagattgtgaaaatgtacaataaatgtgtaatgagtaaccaagtgttgtctaaga

SEQ ID NO: 87203 - DNA, 910 bp, Homo sapiens
  misc_feature (25)..(25): n is a, c, g, or t
  misc_feature (42)..(42): n is a, c, g, or t
  misc_feature (50)..(50): n is a, c, g, or t
  misc_feature (52)..(52): n is a, c, g, or t
  misc_feature (54)..(54): n is a, c, g, or t
aggcaattcatgtagcgacaccatnattgaaaaacgcttggnatgtttanananagcagcgtacggtcgattcggatacttgaagttcagtatgttatgatggaccaataattctgccacttcgggtttctccctacattcctgctccccagttttcatgtggggtactcaactgacattcccatggggtttccctcccatctgcctgatccacctcctcctcccaccaggagagttgggggttggccacaattgatctcttgtgagaggggtggctaccagtgtgtgtgtgggggtcatcactgccttggggaggagtggggcagggcagagaatccccccaattcctgcctgaaatctctggcctcacccctgctgggggttggactgaaaaccctcctccccaatttggggggtgttgccccatcactgcccagctcctctgactgccccccctgaatttagggtgggggtactagtcactgccaatgtgtgtatgggacttgctggaaaacggggatgcttgcccctctccaggactattgagcccagagagagctgtcctctcattgggtgaactgattgaggaagggtctattgtctttttaaatggcacaattttaagggtttgagggtacagtcccttaacctgccacgggagggggcccccaaactttcttccccccacacttctggttttctgtgtggagggggagcagggatatctaagctgtggtgtgaaagggtaggagagatgctggaggtgggggtgctgtgttctagaccccccatattatcccagtgtcccctgcccccctcttcccccaccccatgcccccaattctgtggcgcatccagattgtgaaaatgtacaataaatgtgtaatgagtaaccaagtgttgtctaaga

SEQ ID NO: 87204 - DNA, 1057 bp, Homo sapiens
  misc_feature (43)..(44): n is a, c, g, or t
  misc_feature (143)..(143): n is a, c, g, or t
  misc_feature (149)..(149): n is a, c, g, or t
  misc_feature (160)..(160): n is a, c, g, or t
  misc_feature (175)..(175): n is a, c, g, or t
gtgactctaaggattactgctgctccctcttcaggactattgnnccagagagagctgtctctcattgggtgaactgattgaggaagggtctattgtctttttaaatggcacaatttaagggtttgagggtacagtcccttaanctgccncgggagggggnccccaaactttcttncccccacacttctggttttctgtgtggagggggagcagggatatctaagccttgaagttcagtatgttatgatggaccaataattctgccacttcgggtttctccctacattcctgctccccagttttcatgtggggtactcaactgacattcccatggggtttccctcccatctgcctgatccacctcctcctcccaccaggagagttgggggttggccacaattgatctcttgtgagaggggtggctaccagtgtgtgtgtgggggtcatcactgccttggggaggagtggggcagggcagagaatccccccaattcctgcctgaaatctctggcctcacccctgctgggggttggactgaaaaccctcctccccaatttggggggtgttgccccatcactgcccagctcctctgactgccccccctgaatttagggtgggggtactagtcactgccaatgtgtgtatgggacttgctggaaaacggggatgcttgcccctctccaggactattgagcccagagagagctgtcctctcattgggtgaactgattgaggaagggtctattgtctttttaaatggcacaattttaagggtttgagggtacagtcccttaacctgccacgggagggggcccccaaactttcttccccccacacttctggttttctgtgtggagggggagcagggatatctaagctgtggtgtgaaagggtaggagagatgctggaggtgggggtgctgtgttctagaccccccatattatcccagtgtcccctgcccccctcttcccccaccccatgcccccaattctgtggcgcatccagattgtgaaaatgtacaataaatgtgtaatgagtaaccaagtgttgtctaaga

SEQ ID NO: 87205 - DNA, 717 bp, Homo sapiens
ggcgactctaggagtatcccgacagcatcctaaccaggagagttgggggttggccacaattgatctcttgtgagaggggtggctaccagtgtgtgtgtgggggtcatcactgccttggggaggagtggggcagggcagagaatccccccaattcctgcctgaaatctctggcctcacccctgctgggggttggactgaaaaccctcctccccaatttggggggtgttgccccatcactgcccagctcctctgactgccccccctgaatttagggtgggggtactagtcactgccaatgtgtgtatgggacttgctggaaaacggggatgcttgcccctctccaggactattgagcccagagagagctgtcctctcattgggtgaactgattgaggaagggtctattgtctttttaaatggcacaattttaagggtttgagggtacagtcccttaacctgccacgggagggggcccccaaactttcttccccccacacttctggttttctgtgtggagggggagcagggatatctaagctgtggtgtgaaagggtaggagagatgctggaggtgggggtgctgtgttctagaccccccatattatcccagtgtcccctgcccccctcttcccccaccccatgcccccaattctgtggcgcatccagattgtgaaaatgtacaataaatgtgtaatgagtaaccaagtgttgtctaaga

SEQ ID NO: 87206 - DNA, 720 bp, Homo sapiens
gcggccgctccaacatcagaatggtaaccacccctctcacaagagatcaattgtggccaacccccaactctcctggtgggaggaggaggtggatcaggcagatgggagggaaaccccttggggaggagtggggcagggcagagaatccccccaattcctgcctgaaatctctggcctcacccctgctgggggttggactgaaaaccctcctccccaatttggggggtgttgccccatcactgcccagctcctctgactgccccccctgaatttagggtgggggtactagtcactgccaatgtgtgtatgggacttgctggaaaacggggatgcttgcccctctccaggactattgagcccagagagagctgtcctctcattgggtgaactgattgaggaagggtctattgtctttttaaatggcacaattttaagggtttgagggtacagtcccttaacctgccacgggagggggcccccaaactttcttccccccacacttctggttttctgtgtggagggggagcagggatatctaagctgtggtgtgaaagggtaggagagatgctggaggtgggggtgctgtgttctagaccccccatattatcccagtgtcccctgcccccctcttcccccaccccatgcccccaattctgtggcgcatccagattgtgaaaatgtacaataaatgtgtaatgagtaaccaagtgttgtctaaga

SEQ ID NO: 87207 - DNA, 1002 bp, Homo sapiens
  misc_feature (43)..(44): n is a, c, g, or t
  misc_feature (143)..(143): n is a, c, g, or t
  misc_feature (149)..(149): n is a, c, g, or t
  misc_feature (160)..(160): n is a, c, g, or t
  misc_feature (175)..(175): n is a, c, g, or t
gtgactctaaggattactgctgctccctcttcaggactattgnnccagagagagctgtctctcattgggtgaactgattgaggaagggtctattgtctttttaaatggcacaatttaagggtttgagggtacagtcccttaanctgccncgggagggggnccccaaactttcttncccccacacttctggttttctgtgtggagggggagcagggatatctaagccttgaagttcagtatgttatgatggaccaataattctgccacttcgggtttctccctacattcctgctccccagttttcatgtggggtactcaactgacattcccatggggtttccctcccatctgcctgatccacctcctcctcccaccaggagagttgggggttggccacaattgatctcttgtgagaggggtggctaccagtgtgtgtgtgggggtcatcactgccttggggaggagtggggcagggcagagaatccccccaattcctgcctgaaatctctggcctcacccctgctgggggttggactgactgccccccctgaatttagggtgggggtactagtcactgccaatgtgtgtatgggacttgctggaaaacggggatgcttgcccctctccaggactattgagcccagagagagctgtcctctcattgggtgaactgattgaggaagggtctattgtctttttaaatggcacaattttaagggtttgagggtacagtcccttaacctgccacgggagggggcccccaaactttcttccccccacacttctggttttctgtgtggagggggagcagggatatctaagctgtggtgtgaaagggtaggagagatgctggaggtgggggtgctgtgttctagaccccccatattatcccagtgtcccctgcccccctcttcccccaccccatgcccccaattctgtggcgcatccagattgtgaaaatgtacaataaatgtgtaatgagtaaccaagtgttgtctaaga

SEQ ID NO: 87208 - DNA, 937 bp, Homo sapiens
agcggatctttccgtcccgggcagccagcgccagtcggagccagcgcgagccgccgccgccatcactgccgctgccaagtcctccacccgctgcccccgccatgtctgctaccgctgccacggccccccctgctgccccggctggggagggtggtccccctgcaccccctccaaacctcaccagtaacaggagactgcagcagacccaggcccaggtggatgaggtggtggacatcatgagggtgaacgtggacaaggtcctggagcgagaccagaagctgtcggagctggacgaccgtgcagatgcactccaggcgggggcctcccagtttgaaacaagcgcagccaagctcaagcgcaaatactggtggaaaaacctcaagatgatgatcatcttgggagtgatttgcgccatcatcctcatcatcatcatagtttacttcagcacttaaatccccgaggagtctgccctgcctagagaagggcctctcccccaaccctcagccgttcctccacctctcagccatatctttcagccccccctcccctggatccgtgtgtgtgtgtgtccgtgtgtgtgtccccctgtaaatagccagctgttatttatacatatataatattatatatatttggtctgtttgtagttttattactagatgatttttccggttgtccttaacaccccttcctgaggttcccttcacccctctctcttgccttccttccctttccctttcttcctgactagccccaagtcccttcatttgcatctgctatgcaatagtccctctcctttccttcttcttccctcagatttagctgatccttcctcccaccctggccttcctttcctctttcctcctcactctccccgtcattgtttccttctgcttcgcccgttttttttttttttttttttttttttagtcgacgc

SEQ ID NO: 87209 - DNA, 495 bp, Homo sapiens
ccaacgagcgcaggtgatacaggtactctccgccattcctccccactgcctcagcattaaccttggaagcatggaattcacagcatcccttagtgtccccaacccaatttgcccctctccaggactattgagcccagagagagctgtcctctcattgggtgaactgattgaggaagggtctattgtctttttaaatggcacaattttaagggtttgagggtacagtcccttaacctgccacgggagggggcccccaaactttcttccccccacacttctggttttctgtgtggagggggagcagggatatctaagctgtggtgtgaaagggtaggagagatgctggaggtgggggtgctgtgttctagaccccccatattatcccagtgtcccctgcccccctcttcccccaccccatgcccccaattctgtggcgcatccagattgtgaaaatgtacaataaatgtgtaatgagtaaccaagtgttgtctaaga

SEQ ID NO: 87210 - DNA, 1429 bp, Homo sapiens
agcggatctttccgtcccgggcagccagcgccagtcggagccagcgcgagccgccgccgccatcactgccgctgccaagtcctccacccgctgcccccgccatgtgagtcggccgcccgccaccctcaccgcgcttccctgcgccggccgccgcccttggcaaccggccgtcgggagtgcccggggtctcttctgcgttccccgcgccccggggccaggcccaagccggtgactgcgcgcgggcggccgaggagccccgcgtcccgggctggccggctcgggcgatggccgcgggaaggagcggacccagtgtcctcctgcccctccccgcccctgtcaccgcggcgcctgtcttttcgggtcgacccggatcgcatctgtgaggtcgccctcagttgacaggcggggaaactgaggccgggggggctcgctcaaggtcacgcagctcatcggcggcagggctggaccgagaccagggcttacatcgggtggccttcctcccgaaaaggaggactggagggacgaggatggacaggtctgctaccgctgccacggccccccctgctgccccggctggggagggtggtccccctgcaccccctccaaacctcaccagtaacaggagactgcagcagacccaggcccaggtggatgaggtggtggacatcatgagggtgaacgtggacaaggtcctggagcgagaccagaagctgtcggagctggacgaccgtgcagatgcactccaggcgggggcctcccagtttgaaacaagcgcagccaagctcaagcgcaaatactggtggaaaaacctcaagatgatgatcatcttgggagtgatttgcgccatcatcctcatcatcatcatagtgagtagggtgagaatggccggggccctttccctggagaggtttccccagtggattctaggttttgaaggtcattaatctagtttttactcttcagccaaaaacacatatagctgctaatggcaattctgattcatctagagccaaaaactttgatgttatttagcctgcattttgcctagttcttggcagtcttgttaacatttggaaataggaaagctggtgtatccattgaggaccctttaggcctaagagcccagtctgagaaccctggaattgaggagtgggagaaaggaaaggaccaggggcttgagacatgaccaggaagccaaccaccccattatttgagagcttgcggtctcagaggctcagaggattagggtctgtggcttcaaggccataccatggagcggaagggacctcagaacctacctgtctagccccttgctttgtagatggaaaaactgagtccaagagagggtgtcagccagctggggagtggggaggaaagaggaaaggaaggccagggtgggaggaaggatcagctaaatctgaggtcgacg

SEQ ID NO: 87211 - DNA, 511 bp, Homo sapiens
gataagatccccaccttccaagggctgaaaaccctcctccccaatttggggggtgttgccccatcactgcccagctcctctgactgccccccctgaatttagggtgggggtactagtcactgccaatgtgtgtatgggacttgctggaaaacggggatgcttgcccctctccaggactattgagcccagagagagctgtcctctcattgggtgaactgattgaggaagggtctattgtctttttaaatggcacaattttaagggtttgagggtacagtcccttaacctgccacgggagggggcccccaaactttcttccccccacacttctggttttctgtgtggagggggagcagggatatctaagctgtggtgtgaaagggtaggagagatgctggaggtgggggtgctgtgttctagaccccccatatcatgcccccaattctgtggcgcatccagattgtgaaaatgtacaataaatgtgtaatgagtaaccaagtgttgtctaaga

SEQ ID NO: 87212 - DNA, 1953 bp, Homo sapiens
ggattcgtacgagaacggttactgagcagacccatttcaggtggatgaggtggtggacatcatgagggtgaacgtggacaaggtcctggagcgagaccagaagctgtcggagctggacgaccgtgcagatgcactccaggcgggggcctcccagtttgaaacaagcgcagccaagctcaagcgcaaatactggtggaaaaacctcaagtttacttcagcacttaaatccccgaggagtctgccctgcctagagaagggcctctcccccaaccctcagccgttcctccacctctcagccatatctttcagccccccctcccctggatccgtgtgtgtgtgtgtccgtgtgtgtgtccccctgtaaatagccagctgttatttatacatatataatattatatatatttggtctgtttgtagttttattactagatgatttttccggttgtccttaacaccccttcctgaggttcccttcacccctctctcttgccttccttccctttccctttcttcctgactagccccaagtcccttcatttgcatctgctatgcaatagtccctctcctttccttcttcttccctcagatttagctgatccttcctcccaccctggccttcctttcctctttcctcctcactctccccgtcatgctccctctgccccgccctcaaaaaaaaaaaaaaaaaaaaaaaaaaaaaaaaacaacagcacctgtccaggcttccttaggtacatcttctttgtatccattgggaggctctgagactggccccacttggtcctaagaatcccaaggtctttgggagcgtccagcatgttaattagcgtatcattacatactgctatccctttccatttctttttgttccatcactcttctctcaacctgtgtttctttttttactgaggagttagtccccattagttcttgtatcacattttcatttgcacgacattactcgcaggtggtggggagcctgggcttttggggaaccaggctgctctggtccccagcattgcctcctcctagcccctctagtccagtttgcctcccttaccctcattttccaaacctcttgtaccctcctctccctcccccagctggtatgtaagtgtcttgaagttcagtatgttatgatggaccaataattctgccacttcgggtttctccctacattcctgctccccagttttcatgtggggtactcaactgacattcccatggggtttccctcccatctgcctgatccacctcctcctcccaccaggagagttgggggttggccacaattgatctcttgtgagaggggtggctaccagtgtgtgtgtgggggtcatcactgccttggggaggagtggggcagggcagagaatccccccaattcctgcctgaaatctctggcctcacccctgctgggggttggactgaaaaccctcctccccaatttggggggtgttgccccatcactgcccagctcctctgactgccccccctgaatttagggtgggggtactagtcactgccaatgtgtgtatgggacttgctggaaaacggggatgcttgcccctctccaggactattgagcccagagagagctgtcctctcattgggtgaactgattgaggaagggtctattgtctttttaaatggcacaattttaagggtttgagggtacagtcccttaacctgccacgggagggggcccccaaactttcttccccccacacttctggttttctgtgtggagggggagcagggatatctaagctgtggtgtgaaagggtaggagagatgctggaggtgggggtgctgtgttctagaccccccatattatcccagtgtcccctgcccccctcttcccccaccccatgcccccaattctgtggcgcatccagattgtgaaaatgtacaataaatgtgtaatgagtaaccaagtgttgtctaaga

SEQ ID NO: 87213 - DNA, 2181 bp, Homo sapiens
  misc_feature (1849)..(1849): n is a, c, g, or t
agcggatctttccgtcccgggcagccagcgccagtcggagccagcgcgagccgccgccgccatcactgccgctgccaagtcctccacccgctgcccccgccatgtctgctaccgctgccacggccccccctgctgccccggctggggagggtggtccccctgcaccccctccaaacctcaccagtaacaggagactgcagcagacccaggcccaggtggatgaggtggtggacatcatgagggtgaacgtggacaaggtcctggagcgagaccagaagctgtcggagctggacgaccgtgcagatgcactccaggcgggggcctcccagtttgaaacaagcgcagccaagctcaagcgcaaatactggtggaaaaacctcaagatgatgatcatcttgggagtgatttgcgccatcatcctcatcatcatcatagtttacttcagcacttaaatccccgaggagtctgccctgcctagagaagggcctctcccccaaccctcagccgttcctccacctctcagccatatctttcagccccccctcccctggatccgtgtgtgtgtgtgtccgtgtgtgtgtccccctgtaaatagccagctgttatttatacatatataatattatatatatttggtctgtttgtagttttattactagatgatttttccggttgtccttaacaccccttcctgaggttcccttcacccctctctcttgccttccttccctttccctttcttcctgactagccccaagtcccttcatttgcatctgctatgcaatagtccctctcctttccttcttcttccctcagatttagctgatccttcctcccaccctggccttcctttcctctttcctcctcactctccccgtcatgctccctctgccccgccctcaaaaaaaaaaaaaaaaaaaaaaaaaaaaaaaaacaacagcacctgtccaggcttccttaggtacatcttctttgtatccattgggaggctctgagactggccccacttggtcctaagaatcccaaggtctttgggagcgtccagcatgttaattagcgtatcattacatactgctatccctttccatttctttttgttccatcactcttctctcaacctgtgtttctttttttactgaggagttagtccccattagttcttgtatcacattttcatttgcacgacattactcgcaggtggtggggagcctgggcttttggggaaccaggctgctctggtccccagcattgcctcctcctagcccctctagtccagtttgcctcccttaccctcattttccaaacctcttgtaccctcctctccctcccccagctggtatgtaagtgtcttgaagttcagtatgttatgatggaccaataattctgccacttcgggtttctccctacattcctgctccccagttttcatgtggggtactcaactgacattcccatggggtttccctcccatctgcctgatccacctcctcctcccaccaggagagttgggggttggccacaattgatctcttgtgagaggggtggctaccagtgtgtgtgtgggggtcatcactgccttggggaggagtggggcagggcagagaatccccccaattcctgcctgaaatctctggcctcacccctgctgggggttggactgaaaaccctcctccccaatttggggggtgttgccccatcactgcccagctcctctgactgccccccctgaatttagggtgggggtactagtcactgccaatgtgtgtatgggacttgctggaaaacggggatgcttgcccctctccaggactattgagcccagagagagctgtcctcccagagggggggnaagagaggggggggggggggaggggtgggtttgaggggggagaagagggggggggggggaagagtcccgacctgccacgggagggggcccccaaactttcttccccccacacttctggttttctgtgtggagggggagcagggatatctaagctgtggtgtgaaagggtaggagagatgctggaggtgggggtgctgtgttctagaccccccatattatcccagtgtcccctgcccccctcttcccccaccccatgcccccaattctgtggcgcatccagattgtgaaaatgtacaataaatgtgtaatgagtaaccaagtgttgtctaaga

SEQ ID NO: 87214 - DNA, 1218 bp, Homo sapiens
agcggatctttccgtcccgggcagccagcgccagtcggagccagcgcgagccgccgccgccatcactgccgctgccaagtcctccacccgctgcccccgccatgtctgctaccgctgccacggccccccctgctgccccggctggggagggtggtccccctgcaccccctccaaacctcaccagtaacaggagactgcagcagacccaggcccaggtggatgaggtggtggacatcatgagggtgaacgtggacaaggtcctggagcgagaccagaagctgtcggagctggacgaccgtgcagatgcactccaggcgggggcctcccagtttgaaacaagcgcagccaagctcaagcgcaaatactggtggaaaaacctcaagatgatgatcatcttgggagtgatttgcgccatcatcctcatcatcatcatagtttacttcagcacttaaatccccgaggagtctgccctgcctagagaagggcctctcccccaaccctcagccgttcctccacctctcagccatatctttcagccccccctcccctggatccgtgtgtgtgtgtgtccgtgtgtgtgtccccctgtaaatagccagctgttatttatacatatataatattatatatatttggtctgtttgtagttttattactagatgatttttccggttgtccttaacaccccttcctgaggttcccttcacccctctctcttgccttccttccctttccctttcttcctgactagccccaagtcccttcatttgcatctgctatgcaatagtccctctcctttccttcttcttccctcagatttagctgatccttcctcccaccctggccttcctttcctctttcctcctcactctccccgtcatgctccctctgccccgccctcaaaaaaaaaaaaaaaaaaaaaaaaaaaaaaaaacaacagcacctgtccaggcttccttaggtacatcttctttgtatccattgggaggctctgagactggccccacttggtcctaagaatcccaaggtctttgggagcgtccagcatgttaattagcgtatcattacatactgctatccctttccatttctttttgttccatcactcttctctcaacctgtgtttctttttttactgaggagttagtccccattagttcttgtatcacattttcatttgcacgacatatagctatggtggatccactagagtcggcc

SEQ ID NO: 87215 - DNA, 1462 bp, Homo sapiens
agcggatctttccgtcccgggcagccagcgccagtcggagccagcgcgagccgccgccgccatcactgccgctgccaagtcctccacccgctgcccccgccatgtgagtcggccgcccgccaccctcaccgcgcttccctgcgccggccgccgcccttggcaaccggccgtcgggagtgcccggggtctcttctgcgttccccgcgccccggggccaggcccaagccggtgactgcgcgcgggcggccgaggagccccgcgtcccgggctggccggctcgggcgatggccgcgggaaggagcggacccagtgtcctcctgcccctccccgcccctgtcaccgcggcgcctgtcttttcgggtcgacccggatcgcatctgtgaggtcgccctcagttgacaggcggggaaactgaggccgggggggctcgctcaaggtcacgcagctcatcggcggcagggctggaccgagaccagggcttacatcgggtggccttcctcccgaaaaggaggactggagggacgaggatggacaggtctgctaccgctgccacggccccccctgctgccccggctggggagggtggtccccctgcaccccctccaaacctcaccagtaacaggagactgcagcagacccaggcccaggtggatgaggtggtggacatcatgagggtgaacgtggacaaggtcctggagcgagaccagaagctgtcggagctggacgaccgtgcagatgcactccaggcgggggcctcccagtttgaaacaagcgcagccaagctcaagcgcaaatactggtggaaaaacctcaagtttacttcagcacttaaatccccgaggagtctgccctgcctagagaagggcctctcccccaaccctcagccgttcctccacctctcagccatatctttcagccccccctcccctggatccgtgtgtgtgtgtgtccgtgtgtgtgtccccctgtaaatagccagctgttatttatacatatataatattatatatatttggtctgtttgtagttttattactagatgatttttccggttgtccttaacaccccttcctgaggttcccttcacccctctctcttgccttccttccctttccctttcttcctgactagccccaagtcccttcatttgcatctgctatgcaatagtccctctcctttccttcttcttccctcagatttagctgatccttcctcccaccctggccttcctttcctctttcctcctcactctccccgtcatgctccctctgccccgccctcaaaaaaaaaaaaaaaaaaaaaaaaaatgacactactctccccttttaatcaaatataaccctggggggggcccggtacccaatattgcctatttggggcccgattacacattcatggcccgcctttacaccgtcggatcgggaacaccttggttcccaccttaatcgtttgcgccaatcct

SEQ ID NO: 87216 - DNA, 401 bp, Homo sapiens
caaggtcacgcagctcatcggcggcagggctggaccgagaccagggcttacatcgggtggccttcctcccgaaaaggaggactggagggacgaggatggacaggtggatgggcggagccctggctgcggggccgggaggctgcaggccctgggtcttaatccgtccctgctcctcaggtctgctaccgctgccacggccccccctgctgccccggctggggagggtggtccccctgcaccccctccaaacctcaccagtaacaggagactgcagcagacccaggcccaggtggatgaggtgagtgtggggggagtcaaaagcagtaggagggaccctgggggttggcgtataggtgtaggggcccatgttggtttgggagtgatgacagttcacgcctgtg

SEQ ID NO: 87217 - DNA, 348 bp, Homo sapiens
ctaaggcttaagcaagacttttgggggctaaccatggactctaaaactacttatattctttatttagagaaaaatgttccaaatgcctccaaactgattttttagcacagtcttaaaatacaaatgtctttgtaaactggcaggtggagggttgggagagggactgcatatttcctagttcctaatacacaacaatttgcacagtaagtcagtgcttgttaaatgaattgatgaccttgcatgacttggagattagcataaatataatttctgtgtacagattgaatattcctaatcaaaaaatcccaattccacaatgcttcaaaatctgaaactttctgagcaccg

SEQ ID NO: 87218 - DNA, 407 bp, Homo sapiens
gctaaggcaaaaggatcacttgagcctgggggttcaagactagcctggtcaacatagtgagatcctgtctctataaaaataaatttaaaagaaaataaaaataaatctcatggcctcttcttagatcttttaattttacatcccaaatcctcagttccgctctgctctttgtttttcttcagagggagaagagagggatctcttgggtctcctctgattatttaattggcctttggtcaaggatcataacaggttagtggaaaggagacggaaagtggaaggctgtggccctcctttaagaagcatggtgctggtcaggcgcagtggctcatgcctgaaatcccagcactttggaaggccgatgcaggcagatcacttgagctcagaagttcaagaccagcctgggc

SEQ ID NO: 87219 - DNA, 373 bp, Homo sapiens
gcgttagattctcagcctctctgggcggctatctccaaagaggcaggtgtggctcttcccccggggtatcccgacccttctgtaatgatcatcttggctaaagactagtcagtgaatactcagaaagaagataacatcaagaaaatttaattattgaatgctggcaaagttccccttctttccttaagcaaaggatcttttttccctatctcctttagcagggttgtcagagctcatgagggagaggacgggcaggctatgaatggcaagcatgcagtaaatcccagtctggactcagtgacaaaggagtaataaaaagattataggtaatttttcctcctgaattatagagagggtgtggattcagcctggc

SEQ ID NO: 87220 - DNA, 261 bp, Homo sapiens
ggtttttttctgtatgtgtggttgaaatcttcgaaagtactgtttgtcacatacctgaggacctgtgtatttcttctgggtagaaaaatgtgtggttttgttgttgttgttcttgtttttgagatagggacttgctcctttgcccaggctggagtgcagtggcatgatcatagctcggtgcagccttggcctccatgacttaagtgatcatctcacctcagcctcccaagtagctgggactacaggtgcaagccaccatac

SEQ ID NO: 87221 - DNA, 455 bp, Homo sapiens
ttttttttggagacagaatcttgctctgtcacccaggctggagtgcaggggcacagtctcggctcactgcaacctccgcctcctgggttcaagcaattctcccacctcggcctcccgagtagctgggattacaggcgtgcaccaccacacctggctaatttttgtattttcagtatagatggggtttcaccatgttggccaggctggtctcaaactcctggcctcaattgatctgcctgccctgacctcccaaaaaggtgggattacaggtatgagccaccacacccagtccctaaaaacatttttttaaaaaaactttccagccatccttctctcagcatccagtctatccatcacatgcatccattcctggagacaccatcagagcattcagctcgacgtggacactcagcacccaatttgcctgggtcacagaggaggtacctgctgtggta

SEQ ID NO: 87222 - DNA, 766 bp, Homo sapiens
ggttaagggaaggcggacgcctgatgggttaatgagcaaactgaagtgttttccatgatcttttttgagtcgcaattgaagtaccacctcccgagggtgattgcttccccatgcggggtagaacctttgctgtcctgttcaccactctacctccagcacagaatttggcttatgcctactcaatgtgaagatgatgaggatgaaaacctttgtgatgatccacttccacttaatgaatggtggcaaagcaaagctatattcaagaccacatgcaaagctactccctgagcaaagagtcacagataaaacgggggcaccagtagaatggccaggacaaacgcagtgcagcacagcagactcagaccctggcagccatgcctgcgcaggcagtgatgagagtgacatgtactgttgtggacatgcacaaaagtagagtgtgcaccggcacagacatgaagctgcggctccctgccagtcccgagacccacctggacatgctccgccacctctaccagggctagcaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtcgcgaggcacccagctctttgaggacaactatgccctgagcgtgctacacaatggagacccgctgaaccataccacacctgtcacaggggcctccacag

SEQ ID NO: 87223 - DNA, 322 bp, Homo sapiens
tttaaaataaagcctttcagggatttcaatagacacatttctttagctgaaatctattctctcagaaacttacccaaacttcttaataatgttcaaattctaagaaagatatcatggctacacagcaccaggaagagcacattatttctcttcacaattcccttgcatagcatcatggcttcctaagggcttttaagtttattgcttcaactgattctcataaaatctctgagatgctatctggaaagtattattatccccagtttgcagataagacaactgaggtctagacttgctaaaaatcacacaacaagtaagtggc

SEQ ID NO: 87224 - DNA, 454 bp, Homo sapiens
tgttctcctatctcttacctggcctggcccgtatgctggtggtttagacctggctgggactttcaggttgtttccattaaaagtcatcttattaaatgaacatgccaatctccgaggggcactagcagaggggtggaggaatggatgccattctgggaccaggagcagctgcactgttgccattcctgaagcctggtcaccaccagagcctccttaccttgctctcctcaagcctgtttgggaatcaccagtgtgcagaagaggaagctagggaattggggcaatagtggaggtggtagtaagaaggtctgctctggaatccagtggcaggtccagaagaatccacatgcaggaagattagggtactagagttcacatggggacggatgacacaaatctgagacagaattctccctagaagttccaatcactgaataaatattgtacctactta

SEQ ID NO: 87225 - DNA, 499 bp, Homo sapiens
ttctgaggctgtttctcacacattgtagggcctgcccagagaagctgggcataccgcttcagaggtatgctgaggccgaaggaacacaggccctaggcctgatccctgagcctccaggaccacagccatctcttccttctcaggtcctctcctgagcaccttccctgcctcagatccccccatggcctcctgctgtcccactgtcggatcaggttctcacccctgcagacctgacctcagcacaggatccctaaccattcagccgagaagcaactaaccagagagaggtttgcttgttatctgttccaggaaagtaactggggcaaagacaatgtgatgattctctagttcagggcacagaatgtttgctggtgactcagagagggcatggagggcacggagggccggcaaacactgtaagtcattttgtctgtgtaagtttaggggaacccatgctcagcctcactctgaagcatgtggtatcacccatatgatctga

SEQ ID NO: 87226 - DNA, 90 bp, Homo sapiens
gatcattgtggcgtccacaatgtatatataaaacaagttgtacacattaccatgtataaatttgtgtttgtcgattatatgtcaagaaag

SEQ ID NO: 87227 - DNA, 460 bp, Homo sapiens
aactataaaaacagaaatcataactttgaattttcaaaattaaaaactcttgtcctttgaaagcacttaagaaggtgagaaggaaagactcagaaggggaagaaatagttgcaataaatttctgacaaaagatttgtttcctgaaaatgtaaagaaatttataacccaattgtaaaaggacaactcaataaaaatgacaatatacttcaatagagataattcataaaataagatatgaaatggtcaatggggacaagaaaggatttcaacataagccaccagggaaatacaaatcaaaaccataatgagacacttttacacactcattaaaattaatgaaattaaaatgatcaacagtaccaagtgttggaagatgttgagcaactggaactcatgcgtggcaggtagggatgtaaaatggcacaaagactttgtaaaatactttggcaaattcttaaaa

SEQ ID NO: 87228 - DNA, 416 bp, Homo sapiens
atcctcccccttgtcactgcttctggatccctgtgagtaagggtgtcctcagctcagccctggagcaccttaggctctttgagtgttggaagaggatcaggtctgggtacataacttcccagctggagggtcagatccttgctatgctaagcagtgatgacaggctggtgacaacagaccaaactaagactgtctttgtatgttggcaatggcccccccagggggaccttgcaaatatgcagattttaacatccctcatttcagatctgtcagggtgggacaagttcttctggcctgtgagctcctgccatacacagtcctggagcctgctggctctgagttgctcatttgcatttggccacagggttctggtcaggggaactcccctctcccccacccttcctccatgacttggc

SEQ ID NO: 87229 - DNA, 373 bp, Homo sapiens
caacacaaacacatacacaaggatgcaaatatgtaaatgagcctataatttttcaagtggctctgcacgcaggtaaacatgctctgccctcaaccctcctcttcctggccccctaaggcgatctgactagaaggcatattcacaccccacaaaatcagaaacaagggggactacagtgcactttttcctttttgctctcaattactgtgagaccagagttgcaaaacaacttgtggcttttcacccatttccctatctaatctggactgttacaggaagatatgaccttacctttccttagctacacaccactaatctaagataaaataagtattcacctataataggccctatagttctctctcaaccccaa

SEQ ID NO: 87230 - DNA, 447 bp, Homo sapiens
ttcacacaatctgttgctttaagtttatataaaagatcaagttcctttcaataaaagaacaacaacaataaaaagattatgaccttacaaaaagcccttgaaatgtctaaaatagattaaataaaatatagaccagcacctcaacagggaataagaaacagctagcatttcacagacttacacaaagccaatgaacacatgaacatgtactcattagcatgaataatcaaataagtagaaatttaaaatgaggttttctttttcacctctcagattggtaggtaaagagactggtattatggtttggtgaggctgtagggaaataaacagagtaggaatggaattaagcacaaccattttgttttttaaattcattttattatttttatatattttgagacaagatctcactctgtctcccaggctggagtgcagtggcgtgatctc

SEQ ID NO: 87231 - DNA, 690 bp, Homo sapiens
gtaggcagtctgatggtaggatgcgtcataagtcctagagacacacgcatgtagaagctcaagaaattgaagggccaatggcgcccactaggtttatttatttgctcatctttatcacctaatggtagtttgttttctttggtagagtatatggcagtcccacatcgatgataattggtgctcccttcatccaactggatcactttgagattcagttttacatcattttagcattttgtttgtatatcagttgtgatgagccactgataaaattttgttctaaaatgaaacatattactttgttagtacattttttagtgtcacactgacttttaaaatttgaatgatatatagactttgtttttttaatgcaatatgaatatttgctcatgttttctaaattccttataaaataaaattaattcgaattcaatctgcactttcttaaaattatctttcctcaatgctttttctttcttctgtttctctaattttgtttatgttggtgagagaagtattatactctctatttttatttaaaaaattctagcaacttattacccaaaatatttataattctgttccaaaaatgtcttcctgaagaaggctcttaagtcttttatgttcattgtatttagcataagagaaacataggtgaaataataggttcatttaccagttggggttttg

SEQ ID NO: 87232 - DNA, 1111 bp, Homo sapiens
tgtttatcgatgccccctcctgtatacaggcggttaaagtatacaggaggatgtgcatcggttatatgcatatagcaagccatttcatataagaggcttgaacatccatggatttggtatagaggaggggtttaaggggtgtcctgcaatcagtccccctctcataccaaaggatgactgtatatttcttaaatgaagagactttcattctttaaatattattgacttacagtttaaaaataaataaataaaagcatactatagttgtaaaaacaaataattttaatagtatattcagtggctgaagtgatagggagtattaatcattatttcttcagtataaagttattcttcctgaaaaagtaagatatacctgggaaatattcttggatccttcacacatccacttaatttcttgaaggaagaaaacagacaaaagacatgtaacaacagaaacaaataaaccacttactgtaaaatttcagaaattgtgggctcattccctccctctagtttatttatttgctcatctttatcacctaatggtagtttgttttctttggtagagtatatggcagtcccacatcgatgataattggtgctcccttcatccaactggatcactttgagattcagttttacatcattttagcattttgtttgtatatcagttgtgatgagccactgataaaattttgttctaaaatgaaacatattactttgttagtacattttttagtgtcacactgacttttaaaatttgaatgatatatagactttgtttttttaatgcaatatgaatatttgctcatgttttctaaattccttataaaataaaattaattcgaattcaatctgcactttcttaaaattatctttcctcaatgctttttctttcttctgtttctctaattttgtttatgttggtgagagaagtattatactctctatttttatttaaaaaattctagcaacttattacccaaaatatttataattctgttccaaaaatgtcttcctgaagaaggctcttaagtcttttatgttcattgtatttagcataagagaaacataggtgaaataataggttcatttaccagttggggttttg

SEQ ID NO: 87233 - DNA, 668 bp, Homo sapiens
  misc_feature (668)..(668): n is a, c, g, or t
acctgcggaagccctttggacctctaaaggaagatgaatctggagtaaaagtgtttcaagaatcaggaaggctgcctcctgacttgggcactgtgttagtcccttgttgcactgctctgaagaaatacctgaaactgggtaatttactaaaaaaaaaaaaaaaaaaaaaaaaaaaaaaaaaaaaaaaaaaaaaaaaggggggggctaaaattcccccggggggccccacgactagcggcgccgcaccccggggtttttgtggacacaagaggggccccccacagtaggaggagccgtacttttataataacgaccgaggcaacggagcccgacgctttataacaaaagccggggttatgggggaaaaacgggcaacacggggactccttgggggaaggagaacccctataatcttgcggggggagcgatgagaaatattatgtggggagaacagctatcacctatagcagagagagtttataaagcgcctgtcgagggaagaattttattaaaactattttacagaggttgtattatggggtggtagaaacgccagagctggggtatattggctgtagtaggctgtaagaaaatgtttggtctctaagagggattgttttttttaagaaaatatttttaccagggggctggtgtaaataaggggaggn

SEQ ID NO: 87234 - DNA, 2351 bp, Homo sapiens
accatatgggaattgttaaaagtgcccattcccaatatttatattgggaaaaattatttggatactttataattttaaccggcatttttaataatgacacttgcatttattgtattgtaataaatttcacttttaactttaaaagtttaactttaaaatttttttgtgatgttgccttgcctgaaaagataacaaaaatgagagaatttcttgatgttttaaaatgggcagttttgagcaataatctgtcctaacagaacagtagcaataagttttaggataccatcttgaatgtctagttggtgtgcaatagcttttctttctaagatggcaataatgattcatttctactacattttgcaaaagtgtttttgttgcttatacacattttcaataaccaaggtagccttcatatgtagccttaaagcattacctcttgattgtatctttagattgatataaagtacttgcatatagagtatttgaagtgatagattattagatttgctctatgtctgaaaagagagctattctgcagtgcctaaatatcatttaaacagtaaatattaataggaaatattgctatatctgaatatataatacaaaagtttgatcatggtgacacaaatgttggacatttttttccttataaaaggctctttttttatatattgtacaatatatttggagattcagagcatagtgactatagtcgaaaactgagattgcacttccaaaattggccacaagtaaataatcttatgaagggattctttatcatgtttcaaacaagtgggttacaagcagactttgagacacttttccacagaaacaatactatgaattggtgattgagttcccaggccaagcctccctcaacaggttcaactctaatatacctaacctgtgatactgaaggtgcctgcctgagttttgggtctctgagacagggtagtgtgagtagtttggaggaaggacagtgcaactttccaccccttttcctaagaacaaggtctttctccttttaatttttccactcattttcacctcctaatgcccttgagatccaggtacactcctgggagttttgttcacctctcccaactgagaaccttcccactgggctccatcctccctcctgaggttcttcatattccagagtcacccacccttctcctcccattagtcagttctctaagtacagctgatgtcatgtggtgctgagaagaaagcagatcacacttcatcacagaaagaatgccttgtgattatcttctccacatctgaaattccttttgacacctgcattgggccgactgccattcccatgactgctgcacctgcgtttttagagaatgcctcataacccactgattctcattcacagagaatgggagaacggaatgaagaaagattccagcagcttatagaaggatagcaatattttgggacagggaaaatcctgtcatacctcatctcttcctcaggaggagttctgagctggtcctgcttttcatagttgtttcttttcttccacttaagaactcatagatttttcttactgtcctaaggaagtccttacctctgaggtatctcctcaatgaatactgttttcaaggctgaaatagttcattatgttaataaccttctttatgttctcagggaaatgcttaggtggtgtcacaaaatgtgccttttcttttcttttttttttttttttttgaggcagagtctcgctctgttgcccaggctggagtgcagtggtgcgatcttggctcactgcaagctccgcctcccgggttcacgccattctcctgcctcagcctcccaaggagctgggactacaggctcccgccaccacgcctggctaatttttttgtatttttagtaaagacgggtttcatcgtgttagccaggatggtctcgatctcctgacctcatgatccgcccgcctctgcctcccaaagtgctgggattacaggcctgagccactgtgcccagccaaaatgtgcctttgcaaagtttgcgaaatcagattttgtatcccaatagaaccaaaatatttatgaggatgctagcattttccaagcatagtaattagttcacaactgagaaatattatgtctgtagtagataaatattagttgtgcattttaatttaattctcctttttccattttgtctcatgaagtaccttattgcaaaaatcccactgagtaatagctcataaattataatctttcaaatagccatgctaccagcgtacaacagtgatacatgtaaccccaaatgtgatgtgagaggacgattactttgtaaataaaacttgttattgacattttaaaaaaaac

SEQ ID NO: 87235 - DNA, 479 bp, Homo sapiens
accaacaggttttgttcatcgatgtcaggattcaacaaggagggagagttcttagatgtctcccaggtgattggcttgaacaactagatagaagatgatgggattacaggcctgagccactgtgcccagccaaaatgtgcctttgcaaagtttgcgaaatcagattttgtatcccaatagaaccaaaatatttatgaggatgctagcattttccaagcatagtaattagttcacaactgagaaatattatgtctgtagtagataaatattagttgtgcattttaatttaattctcctttttccattttgtctcatgaagtaccttattgcaaaaatcccactgagtaatagctcataaattataatctttcaaatagccatgctaccagcgtacaacagtgatacatgtaaccccaaatgtgatgtgagaggacgattactttgtaaataaaacttgttattgacattttaaaaaaaac

SEQ ID NO: 87236 - DNA, 1220 bp, Homo sapiens
gaaagttgcactgtccttcctccaaactactcacccacccttctcctcccattagtcagttctctaagtacagctgatgtcatgtggtgctgagaagaaagcagatcacacttcatcacagaaagaatgccttgtgattatcttctccacatctgaaattccttttgacacctgcattgggccgactgccattcccatgactgctgcacctgcgtttttagagaatgcctcataacccactgattctcattcacagagaatgggagaacggaatgaagaaagattccagcagcttatagaaggatagcaatattttgggacagggaaaatcctgtcatacctcatctcttcctcaggaggagttctgagctggtcctgcttttcatagttgtttcttttcttccacttaagaactcatagatttttcttactgtcctaaggaagtccttacctctgaggtatctcctcaatgaatactgttttcaaggctgaaatagttcattatgttaataaccttctttatgttctcagggaaatgcttaggtggtgtcacaaaatgtgccttttcttttcttttttttttttttttttgaggcagagtctcgctctgttgcccaggctggagtgcagtggtgcgatcttggctcactgcaagctccgcctcccgggttcacgccattctcctgcctcagcctcccaaggagctgggactacaggctcccgccaccacgcctggctaatttttttgtatttttagtaaagacgggtttcatcgtgttagccaggatggtctcgatctcctgacctcatgatccgcccgcctctgcctcccaaagtgctgggattacaggcctgagccactgtgcccagccaaaatgtgcctttgcaaagtttgcgaaatcagattttgtatcccaatagaaccaaaatatttatgaggatgctagcattttccaagcatagtaattagttcacaactgagaaatattatgtctgtagtagataaatattagttgtgcattttaatttaattctcctttttccattttgtctcatgaagtaccttattgcaaaaatcccactgagtaatagctcataaattataatctttcaaatagccatgctaccagcgtacaacagtgatacatgtaaccccaaatgtgatgtgagaggacgattactttgtaaataaaacttgttattgacattttaaaaaaaac

SEQ ID NO: 87237 - DNA, 1870 bp, Homo sapiens
accatatgggaattgttaaaagtgcccattcccaatatttatattgggaaaaattatttggatactttataattttaaccggcatttttaataatgacacttgcatttattgtattgtaataaatttcacttttaactttaaaagtttaactttaaaatttttttgtgatgttgccttgcctgaaaagataacaaaaatgagagaatttcttgatgttttaaaatgggcagttttgagcaataatctgtcctaacagaacagtagcaataagttttaggataccatcttgaatgtctagttggtgtgcaatagcttttctttctaagatggcaataatgattcatttctactacattttgcaaaagtgtttttgttgcttatacacattttcaataaccaaggtagccttcatatgtagccttaaagcattacctcttgattgtatctttagattgatataaagtacttgcatatagagtatttgaagtgatagattattagatttgctctatgtctgaaaagagagctattctgcagtgcctaaatatcatttaaacagtaaatattaataggaaatattgctatatctgaatatataatacaaaagtttgatcatggtgacacaaatgttggacatttttttccttataaaaggctctttttttatatattgtacaatatatttggagattcagagcatagtgactatagtcgaaaactgagattgcacttccaaaattggccacaagtaaataatcttatgaagggattctttatcatgtttcaaacaagtgggttacaagcagactttgagacacttttccacagaaacaatactatgaattggtgattgagttcccaggccaagcctccctcaacaggttcaactctaatatacctaacctgtgatactgaaggtgcctgcctgagttttgggtctctgagacagggtagtgtgagtagtttggaggaaggacagtgcaactttccaccccttttcctaagaacaaggtctttctccttttaatttttccactcattttcacctcctaatgcccttgagatccaggtacactcctgggagttttgttcacctctcccaactgagaaccttcccactgggctccatcctccctcctgaggttcttcatattccagagtcacccacccttctcctcccattagtcagttctctaagtacagctgatgtcatgtggtgctgagaagaaagcagatcacacttcatcacagaaagaatgccttgtgattatcttctccacatctgaaattccttttgacacctgcattgggccgactgccattcccatgactgctgcacctgcgtttttagagaatgcctcataacccactgattctcattcacagagaatgggagaacggaatgaagaaagattccagcagcttatagaaggatagcaatattttgggacagggaaaatcctgtcatacctcatctcttcctcaggaggagttctgagctggtcctgcttttcatagttgtttcttttcttccacttaagaactcatagatttttcttactgtcctaaggaagtccttacctctgaggtatctcctcaatgaatactgttttcaaggctgaaatagttcattatgttaataaccttctttatgttctcagggaaatgcttaggtggtgtcacaaaatgtgcggaattcagcacattaagtgcaatttttttttttaaagaccgaaagcgtaggcttgcttatattacattttcaagtcaccatgatgcatttctccagcataagttggggctttaacaacgggtctccatcaaaggttttccatcggctcgccaatgtgggatgtgtcctattgactc

SEQ ID NO: 87238 - DNA, 811 bp, Homo sapiens
cagggctatatgaggataaatagcatgaaggggaaggcaaatacagaagcagggacacaaattcagagtcaatcccaacaatctaggcaagaaatgatggtagcttgaaagcagtgaagtggagagaaagcatctttctattatatttttggggtagagttgacaggattagtggaagttgacctctatgaaaacgcagaagattgtatgcagagaaagttgggtgggagagggctgtatcaggagcacagagtggaattgggagggttgaggtacctactagatatcaaattgacggaggtgaacgaaaatagatgatcaagagtttggatctcataaggagaggtccaacccggagatataaatttcagagtcatcagtgtatcaatggtatttaaagccatgaggctggatgagatcactgagggtctgacctcctagggcactacaacatttaaaggataaatttttaataaaattgacttcctgtctctcttcaagtctctctgcagtcctaaaacttgctttgagacatgcttaatacaaacctatgtttatatttccatagcaatagactctgatgtcaactaaaactctgtgttatctttttacatgctgccaattaaaagtgatggcttgagagataagactcgtgttcacccaagcatctaagcttaatcctgccaaatcaggaaatgagtgcctaattttcaaaaggtttaattggatagtggaataagtgaatttagaagcttttagatccaaagcggatgaagcattggacctagattacttaaaaaaaaaaagttat

SEQ ID NO: 87239 - DNA, 2573 bp, Homo sapiens
attaataaacctctaagccgaggagaaaactctggctggggcagtgcgctgagcgccggaggagcgtaggcagggcagcgctggcgccagtggcgacaggagccgcgcgaccggcaaaaatacacgggaggccgtcgccgaaaagagtccgcggtcctctctcgtaaacacactctcctccaccggcgcctccccctccgctctgcgcgccgcccggctgggcgcccgaggccgctccgactgctatgtgaccgcgaggctgcgggaggaaggggacagggaagaagaggctctcccgcgggagcccttgaggaccaagtttgcggccacttctgcaggcgtcccttcttagctctcgcctgcccctttctgcagcctaggcggcccaggttctcttctcttcctcgcgcgcccagccgcctcggttcccggcgaccatggtgacgatggaggagctgcgggagatggactgcagtgtgctcaaaaggctgatgaaccgggacgagaatggcggcggcgcgggcggcagcggcagccacggcaccctggggctgccgagcggcggcaagtgcctgctgctggactgcagaccgttcctggcgcacagcgcgggctacatcctaggttcggtcaacgtgcgctgtaacaccatcgtgcggcggcgggctaagggctccgtgagcctggagcagatcctgcccgccgaggaggaggtacgcgcccgcttgcgctccggcctctactcggcggtcatcgtctacgacgagcgcagcccgcgcgccgagagcctccgcgaggacagcaccgtgtcgctggtggtgcaggcgctgcgccgcaacgccgagcgcaccgacatctgcctgctcaaaggcggctatgagaggttttcctccgagtacccagaattctgttctaaaaccaaggccctggcagccatcccacccccggttccccccagcgccacagagcccttggacctgggctgcagctcctgtgggaccccactacacgaccaggggggtcctgtggagatccttcccttcctctacctcggcagtgcctaccatgctgcccggagagacatgctggacgccctgggcatcacggctctgttgaatgtctcctcggactgcccaaaccactttgaaggacactatcagtacaagtgcatcccagtggaagataaccacaaggccgacatcagctcctggttcatggaagccatagagtacatcgatgccgtgaaggactgccgtgggcgcgtgctggtgcactgccaggcgggcatctcgcggtcggccaccatctgcctggcctacctgatgatgaagaaacgggtgaggctggaggaggccttcgagttcgttaagcagcgccgcagcatcatctcgcccaacttcagcttcatggggcagctgctgcagttcgagtcccaggtgctggccacgtcctgtgctgcggaggctgctagcccctcgggacccctgcgggagcggggcaagacccccgccacccccacctcgcagttcgtcttcagctttccggtctccgtgggcgtgcactcggcccccagcagcctgccctacctgcacagccccatcaccacctctcccagctgttagagccgccctgggggccccagaaccagagctggctcccagcaagggtaggacgggccgcatgcgggcagaaagttgggactgagcagctgggagcaggcgaccgagctccttccccatcatttctccttggccaacgacgaggccagccagaatggcaataaggactccgaatacataataaaagcaaacagaacactccaacttagagcaataacggctgccgcagcagccagggaagaccttggtttggtttatgtgtcagtttcacttttccgatagaaatttcttacctcatttttttaagcagtaaggcttgaagtgatgaaacccacagatcctagcaaatgtgcccaaccagctttactaaagggggaggaagggagggcaaagggatgagaagacaagtttcccagaagtgcctggttctgtgtacttgtccctttgttgtcgttgttgtagttaaaggaatttcattttttaaaagaaatcttcgaaggtgtggttttcatttctcagtcaccaacagatgaataattatgcttaataataaagtatttattaagactttcttcagagtatgaaagtacaaaaagtctagttacagtggatttagaatatatttatgttgatgtcaaacagctgagcaccgtagcatgcagatgtcaaggcagttaggaagtaaatggtgtcttgtagatatgtgcaaggtagcatgatgagcaacttgagtttgttgccactgagaagcaggcgggttgggtgggaggaggaagaaagggaagaattaggtttgaattgctttttaaaaaaaaaagaaaagaaaaagacagcatctcactatgttgccaaggctcatcttgagaagcaggcgggttgggtgggaggaggaagaaagggaagaattaggtttgaattgcttttttaaaaaaaaagaaaagaaaaaaaaagaca

SEQ ID NO: 87240 - DNA, 1068 bp, Homo sapiens
  misc_feature (1045)..(1045): n is a, c, g, or t
attaataaacctctaagccgaggagaaaactctggctggggcagtgcgctgagcgccggaggagcgtaggcagggcagcgctggcgccagtggcgacaggagccgcgcgaccggcaaaaatacacgggaggccgtcgccgaaaagagtccgcggtcctctctcgtaaacacactctcctccaccggcgcctccccctccgctctgcgcgccgcccggctgggcgcccgaggccgctccgactgctatgtgaccgcgaggctgcgggaggaaggggacagggaagaagaggctctcccgcgggagcccttgaggaccaagtttgcggccacttctgcaggcgtcccttcttagctctcgcctgcccctttctgcagcctaggcggcccaggttctcttctcttcctcgcgcgcccagccgcctcggttcccggcgaccatggtgacgatggaggagctgcgggagatggactgcagtgtgctcaaaaggctgatgaaccgggacgagaatggcggcggcgcgggcggcagcggcagccacggcaccctggggctgccgagcggcggcaagtgcctgctgctggactgcagaccgttcctggcgcacagcgcgggctacatcctaggttcggtcaacgtgcgctgtaacaccatcgtgcggcggcgggctaagggctccgtgagcctggagcagatcctgcccgccgaggaggaggtacgcgcccgcttgcgctccggcctctactcggcggtcatcgtctacgacgagcgcagcccgcgcgccgagagcctccgcgaggacagcaccgtgtcgctggtggtgcaggcgctgcgccgcaacgccgagcgcaccgacatctgcctgctcaaaggcggctatgagaggttttcctccgagtacccagaattctgttctaaaaccaaggccctggcagccatcccacccccggttccccccagcgccacagagcccttggacctgggctgcagctcctgtgggaccccactacacgaccagggggtctgtggaatcttccttctctactngcatgctacatgtgccggaaaaa

SEQ ID NO: 87241 - DNA, 2505 bp, Homo sapiens
attaataaacctctaagccgaggagaaaactctggctggggcagtgcgctgagcgccggaggagcgtaggcagggcagcgctggcgccagtggcgacaggagccgcgcgaccggcaaaaatacacgggaggccgtcgccgaaaagagtccgcggtcctctctcgtaaacacactctcctccaccggcgcctccccctccgctctgcgcgccgcccggctgggcgcccgaggccgctccgactgctatgtgaccgcgaggctgcgggaggaaggggacagggaagaagaggctctcccgcgggagcccttgaggaccaagtttgcggccacttctgcaggcgtcccttcttagctctcgcctgcccctttctgcagcctaggcggcccaggttctcttctcttcctcgcgcgcccagccgcctcggttcccggcgaccatggtgacgatggaggagctgcgggagatggactgcagtgtgctcaaaaggctgatgaaccgggacgagaatggcggcggcgcgggcggcagcggcagccacggcaccctggggctgccgagcggcggcaagtgcctgctgctggactgcagaccgttcctggcgcacagcgcgggctacatcctaggttcggtcaacgtgcgctgtaacaccatcgtgcggcggcgggctaagggctccgtgagcctggagcagatcctgcccgccgaggaggaggtacgcgcccgcttgcgctccggcctctactcggcggtcatcgtctacgacgagcgcagcccgcgcgccgacttctttctcctttacaggcggctatgagaggttttcctccgagtacccagaattctgttctaaaaccaaggccctggcagccatcccacccccggttccccccagcgccacagagcccttggacctgggctgcagctcctgtgggaccccactacacgaccaggggggtcctgtggagatccttcccttcctctacctcggcagtgcctaccatgctgcccggagagacatgctggacgccctgggcatcacggctctgttgaatgtctcctcggactgcccaaaccactttgaaggacactatcagtacaagtgcatcccagtggaagataaccacaaggccgacatcagctcctggttcatggaagccatagagtacatcgatgccgtgaaggactgccgtgggcgcgtgctggtgcactgccaggcgggcatctcgcggtcggccaccatctgcctggcctacctgatgatgaagaaacgggtgaggctggaggaggccttcgagttcgttaagcagcgccgcagcatcatctcgcccaacttcagcttcatggggcagctgctgcagttcgagtcccaggtgctggccacgtcctgtgctgcggaggctgctagcccctcgggacccctgcgggagcggggcaagacccccgccacccccacctcgcagttcgtcttcagctttccggtctccgtgggcgtgcactcggcccccagcagcctgccctacctgcacagccccatcaccacctctcccagctgttagagccgccctgggggccccagaaccagagctggctcccagcaagggtaggacgggccgcatgcgggcagaaagttgggactgagcagctgggagcaggcgaccgagctccttccccatcatttctccttggccaacgacgaggccagccagaatggcaataaggactccgaatacataataaaagcaaacagaacactccaacttagagcaataacggctgccgcagcagccagggaagaccttggtttggtttatgtgtcagtttcacttttccgatagaaatttcttacctcatttttttaagcagtaaggcttgaagtgatgaaacccacagatcctagcaaatgtgcccaaccagctttactaaagggggaggaagggagggcaaagggatgagaagacaagtttcccagaagtgcctggttctgtgtacttgtccctttgttgtcgttgttgtagttaaaggaatttcattttttaaaagaaatcttcgaaggtgtggttttcatttctcagtcaccaacagatgaataattatgcttaataataaagtatttattaagactttcttcagagtatgaaagtacaaaaagtctagttacagtggatttagaatatatttatgttgatgtcaaacagctgagcaccgtagcatgcagatgtcaaggcagttaggaagtaaatggtgtcttgtagatatgtgcaaggtagcatgatgagcaacttgagtttgttgccactgagaagcaggcgggttgggtgggaggaggaagaaagggaagaattaggtttgaattgctttttaaaaaaaaaagaaaagaaaaagacagcatctcactatgttgccaaggctcatcttgagaagcaggcgggttgggtgggaggaggaagaaagggaagaattaggtttgaattgcttttttaaaaaaaaagaaaagaaaaaaaaagaca

SEQ ID NO: 87242 - DNA, 2366 bp, Homo sapiens
attaataaacctctaagccgaggagaaaactctggctggggcagtgcgctgagcgccggaggagcgtaggcagggcagcgctggcgccagtggcgacaggagccgcgcgaccggcaaaaatacacgggaggccgtcgccgaaaagagtccgcggtcctctctcgtaaacacactctcctccaccggcgcctccccctccgctctgccagccgcctcggttcccggcgaccatggtgacgatggaggagctgcgggagatggactgcagtgtgctcaaaaggctgatgaaccgggacgagaatggcggcggcgcgggcggcagcggcagccacggcaccctggggctgccgagcggcggcaagtgcctgctgctggactgcagaccgttcctggcgcacagcgcgggctacatcctaggttcggtcaacgtgcgctgtaacaccatcgtgcggcggcgggctaagggctccgtgagcctggagcagatcctgcccgccgaggaggaggtacgcgcccgcttgcgctccggcctctactcggcggtcatcgtctacgacgagcgcagcccgcgcgccgagagcctccgcgaggacagcaccgtgtcgctggtggtgcaggcgctgcgccgcaacgccgagcgcaccgacatctgcctgctcaaaggcggctatgagaggttttcctccgagtacccagaattctgttctaaaaccaaggccctggcagccatcccacccccggttccccccagcgccacagagcccttggacctgggctgcagctcctgtgggaccccactacacgaccaggggggtcctgtggagatccttcccttcctctacctcggcagtgcctaccatgctgcccggagagacatgctggacgccctgggcatcacggctctgttgaatgtctcctcggactgcccaaaccactttgaaggacactatcagtacaagtgcatcccagtggaagataaccacaaggccgacatcagctcctggttcatggaagccatagagtacatcgatgccgtgaaggactgccgtgggcgcgtgctggtgcactgccaggcgggcatctcgcggtcggccaccatctgcctggcctacctgatgatgaagaaacgggtgaggctggaggaggccttcgagttcgttaagcagcgccgcagcatcatctcgcccaacttcagcttcatggggcagctgctgcagttcgagtcccaggtgctggccacgtcctgtgctgcggaggctgctagcccctcgggacccctgcgggagcggggcaagacccccgccacccccacctcgcagttcgtcttcagctttccggtctccgtgggcgtgcactcggcccccagcagcctgccctacctgcacagccccatcaccacctctcccagctgttagagccgccctgggggccccagaaccagagctggctcccagcaagggtaggacgggccgcatgcgggcagaaagttgggactgagcagctgggagcaggcgaccgagctccttccccatcatttctccttggccaacgacgaggccagccagaatggcaataaggactccgaatacataataaaagcaaacagaacactccaacttagagcaataacggctgccgcagcagccagggaagaccttggtttggtttatgtgtcagtttcacttttccgatagaaatttcttacctcatttttttaagcagtaaggcttgaagtgatgaaacccacagatcctagcaaatgtgcccaaccagctttactaaagggggaggaagggagggcaaagggatgagaagacaagtttcccagaagtgcctggttctgtgtacttgtccctttgttgtcgttgttgtagttaaaggaatttcattttttaaaagaaatcttcgaaggtgtggttttcatttctcagtcaccaacagatgaataattatgcttaataataaagtatttattaagactttcttcagagtatgaaagtacaaaaagtctagttacagtggatttagaatatatttatgttgatgtcaaacagctgagcaccgtagcatgcagatgtcaaggcagttaggaagtaaatggtgtcttgtagatatgtgcaaggtagcatgatgagcaacttgagtttgttgccactgagaagcaggcgggttgggtgggaggaggaagaaagggaagaattaggtttgaattgctttttaaaaaaaaaagaaaagaaaaagacagcatctcactatgttgccaaggctcatcttgagaagcaggcgggttgggtgggaggaggaagaaagggaagaattaggtttgaattgcttttttaaaaaaaaagaaaagaaaaaaaaagaca

SEQ ID NO: 87243 - DNA, 3423 bp, Homo sapiens
gcagttcagacccccccacacccatcaaagagccgctcctcccccccgcaggcgccttcgccgcctccctcccttcctttcctttccgctcctcttccgacctgtccacccgggaggaagggagctggaaagggggcggaaacctctcccctccaaaaagcacaacaaaactgttcagtgcggaggagccgggttcgcccctgccggacagcggggggctttgttccccgcagttgtttcctgcccatttgacctgtcagctgctggggaaacgctgctgttgacctttggttgaactgctaaggcgattttgctgatttttctttctttttccgcgagggctgtcttttgctcctccaaatgagcccagtccccctcccttctccccaaagcgctccaagagaaagtgccaggaaggggcttgtcccggaaggcctggcggctgagcggggccaggtcctggttaggccaccagggtgggcgtccgcgccattgtttgagcttgtcggcgctggtgggagagatgagggcaattcctctgggacgcaagtcccctcgaatggccggggctggccgggatgttccccgcacggcgctgccctcgagtccccccgatggagagcgcgggcgcgccttccttcgctggcgtccaaacccgggaccagctagaacacagcagggctgggactgggttccagccccacgtggagtctggatttgttttgttgtgttttgctttccttcctggaagaaatcccgaggggaccgccctagagcggcagctccaggacctcggcccttgggcttccgggggtgcagccacttaggccccgctcccggggagagagggattattttttaagatttatccccagggcgcgcggcatttccctgtccctcgtgaatcccgttgagagtcctccctccccaacctcctccatttccccagccagaccgattcgagagccctggagattctgggcgaggctagtgactgggtagtacaggcctctagccccaccattgctctctctgtcttcagttccccaggagggcaatggcatcaaacagcacagctctgggggatgtcaatattgcataccttttctacctaaagggaaaatgactcgcttttctgcttgcaaatatggtagtttctgcttacaaatgtaatacaatgcccatgacagccaaggactggaagcataagttgctaggtcttacaggtgattttttacaatgaagcaaactcactatgttagacaccatttacattggatgtctccaactaacaaaagtaactaaagacagatgtaggtgtaaattgagagtgaaatttgaccctttagaccgtcacaacttccttgggcttatcctgggtgcttataggagaggtgggctccacccacaaaaatggactgctcagaaaaatgagggagagagaaagggtggccactttcccgagccaagaaattccttgaaaaaaaatcagaacatctgaaaccagagagccgatttccttaccgggaggcagttcctggctaacgaagaggaagcacgatgggaagaaaagttcactccaacggaagccagtttgctgaacatagcagatcgcccaggaggactgggagagactgcaaaccagttcgagcccccagcatggcgttaggtgtcagccagctggcaggaaggtccaggtgtctgtgttcagagtctcaaggcggctatgagaggttttcctccgagtacccagaattctgttctaaaaccaaggccctggcagccatcccacccccggttccccccagcgccacagagcccttggacctgggctgcagctcctgtgggaccccactacacgaccaggggggtcctgtggagatccttcccttcctctacctcggcagtgcctaccatgctgcccggagagacatgctggacgccctgggcatcacggctctgttgaatgtctcctcggactgcccaaaccactttgaaggacactatcagtacaagtgcatcccagtggaagataaccacaaggccgacatcagctcctggttcatggaagccatagagtacatcgatgccgtgaaggactgccgtgggcgcgtgctggtgcactgccaggcgggcatctcgcggtcggccaccatctgcctggcctacctgatgatgaagaaacgggtgaggctggaggaggccttcgagttcgttaagcagcgccgcagcatcatctcgcccaacttcagcttcatggggcagctgctgcagttcgagtcccaggtgctggccacgtcctgtgctgcggaggctgctagcccctcgggacccctgcgggagcggggcaagacccccgccacccccacctcgcagttcgtcttcagctttccggtctccgtgggcgtgcactcggcccccagcagcctgccctacctgcacagccccatcaccacctctcccagctgttagagccgccctgggggccccagaaccagagctggctcccagcaagggtaggacgggccgcatgcgggcagaaagttgggactgagcagctgggagcaggcgaccgagctccttccccatcatttctccttggccaacgacgaggccagccagaatggcaataaggactccgaatacataataaaagcaaacagaacactccaacttagagcaataacggctgccgcagcagccagggaagaccttggtttggtttatgtgtcagtttcacttttccgatagaaatttcttacctcatttttttaagcagtaaggcttgaagtgatgaaacccacagatcctagcaaatgtgcccaaccagctttactaaagggggaggaagggagggcaaagggatgagaagacaagtttcccagaagtgcctggttctgtgtacttgtccctttgttgtcgttgttgtagttaaaggaatttcattttttaaaagaaatcttcgaaggtgtggttttcatttctcagtcaccaacagatgaataattatgcttaataataaagtatttattaagactttcttcagagtatgaaagtacaaaaagtctagttacagtggatttagaatatatttatgttgatgtcaaacagctgagcaccgtagcatgcagatgtcaaggcagttaggaagtaaatggtgtcttgtagatatgtgcaaggtagcatgatgagcaacttgagtttgttgccactgagaagcaggcgggttgggtgggaggaggaagaaagggaagaattaggtttgaattgctttttaaaaaaaaaagaaaagaaaaagacagcatctcactatgttgccaaggctcatcttgagaagcaggcgggttgggtgggaggaggaagaaagggaagaattaggtttgaattgcttttttaaaaaaaaagaaaagaaaaaaaaagaca

SEQ ID NO: 87244 - DNA, 537 bp, Homo sapiens
attaataaacctctaagccgaggagaaaactctggctggggcagtgcgctgagcgccggaggagcgtaggcagggcagcgctggcgccagtggcgacaggagccgcgcgaccggcaaaaatacacgggaggccgtcgccgaaaagagtccgcggtcctctctcgtaaacacactctcctccaccggcgcctccccctccgctctgcgcgccgcccggctgggcgcccgaggccgctccgactgctatgtgaccgcgaggctgcgggaggaaggggacagggaagaagaggctctcccgcgggagcccttgaggaccaagtttgcggccacttctgcaggcgtcccttcttagctctcgcctgcccctttctgcagcctaggcggcccaggttctcttctcttcctcgcgcgcccagccgcctcggttcccggcgaccatggtgacgatggaggagctgcgggagatggactgcagtgtgctcaaaaggctgataatcgccggtcacgagatggtaccgagctcgattcactgcctcc

SEQ ID NO: 87245 - DNA, 2886 bp, Homo sapiens
tcacaatacacttcttgaaatccctttctctctcattcgtaaatccttggattagagtttgagactcccctggtcattagagaaagacaaaaagagctttttcttaccctattctttgcctttattaaccccaaataacaaaataatctgttatgcaaaaagattgcaggtataaaaacattaccttcctttccacctacctaaaacttccctcagcctttgtcagttctaatttaaaagctgtcctgggagctgttggagaaatggggaagatcatctagatattccagtttctccttccacttcaccctatagtaccggatagcatccaatagcccagggcctgaccatacagcccatgatattaccctttctgtagaaaacagtcactaaggccactgatgaatgtggggggagaggaacacaattaacagctctggaaactctggtgacatttttctgttttttctctctctagccccaccattgctctctctgtcttcagttccccaggagggcaatggcatcaaacagcacagctctgggggatgtcaatattgcataccttttctacctaaagggaaaatgactcgcttttctgcttgcaaatatggtagtttctgcttacaaatgtaatacaatgcccatgacagccaaggactggaagcataagttgctaggtcttacaggtgattttttacaatgaagcaaactcactatgttagacaccatttacattggatgtctccaactaacaaaagtaactaaagacagatgtaggtgtaaattgagagtgaaatttgaccctttagaccgtcacaacttccttgggcttatcctgggtgcttataggagaggtgggctccacccacaaaaatggactgctcagaaaaatgagggagagagaaagggtggccactttcccgagccaagaaattccttgaaaaaaaatcagaacatctgaaaccagagagccgatttccttaccgggaggcagttcctggctaacgaagaggaagcacgatgggaagaaaagttcactccaacggaagccagtttgctgaacatagcagatcgcccaggaggactgggagagactgcaaaccagttcgagcccccagcatggcgttaggtgtcagccagctggcaggaaggtccaggtgtctgtgttcagagtctcaaggcggctatgagaggttttcctccgagtacccagaattctgttctaaaaccaaggccctggcagccatcccacccccggttccccccagcgccacagagcccttggacctgggctgcagctcctgtgggaccccactacacgaccaggggggtcctgtggagatccttcccttcctctacctcggcagtgcctaccatgctgcccggagagacatgctggacgccctgggcatcacggctctgttgaatgtctcctcggactgcccaaaccactttgaaggacactatcagtacaagtgcatcccagtggaagataaccacaaggccgacatcagctcctggttcatggaagccatagagtacatcgatgccgtgaaggactgccgtgggcgcgtgctggtgcactgccaggcgggcatctcgcggtcggccaccatctgcctggcctacctgatgatgaagaaacgggtgaggctggaggaggccttcgagttcgttaagcagcgccgcagcatcatctcgcccaacttcagcttcatggggcagctgctgcagttcgagtcccaggtgctggccacgtcctgtgctgcggaggctgctagcccctcgggacccctgcgggagcggggcaagacccccgccacccccacctcgcagttcgtcttcagctttccggtctccgtgggcgtgcactcggcccccagcagcctgccctacctgcacagccccatcaccacctctcccagctgttagagccgccctgggggccccagaaccagagctggctcccagcaagggtaggacgggccgcatgcgggcagaaagttgggactgagcagctgggagcaggcgaccgagctccttccccatcatttctccttggccaacgacgaggccagccagaatggcaataaggactccgaatacataataaaagcaaacagaacactccaacttagagcaataacggctgccgcagcagccagggaagaccttggtttggtttatgtgtcagtttcacttttccgatagaaatttcttacctcatttttttaagcagtaaggcttgaagtgatgaaacccacagatcctagcaaatgtgcccaaccagctttactaaagggggaggaagggagggcaaagggatgagaagacaagtttcccagaagtgcctggttctgtgtacttgtccctttgttgtcgttgttgtagttaaaggaatttcattttttaaaagaaatcttcgaaggtgtggttttcatttctcagtcaccaacagatgaataattatgcttaataataaagtatttattaagactttcttcagagtatgaaagtacaaaaagtctagttacagtggatttagaatatatttatgttgatgtcaaacagctgagcaccgtagcatgcagatgtcaaggcagttaggaagtaaatggtgtcttgtagatatgtgcaaggtagcatgatgagcaacttgagtttgttgccactgagaagcaggcgggttgggtgggaggaggaagaaagggaagaattaggtttgaattgctttttaaaaaaaaaagaaaagaaaaagacagcatctcactatgttgccaaggctcatcttgagaagcaggcgggttgggtgggaggaggaagaaagggaagaattaggtttgaattgcttttttaaaaaaaaagaaaagaaaaaaaaagaca

SEQ ID NO: 87246 - DNA, 1450 bp, Homo sapiens
gaactaggtcacgcgctccgcgggtcgggcacccccgcccgccaggcacggccgcggctccttcctcttcctgcccgcggtagtgggggtggggcaggcctcgggacacctgcctccgccgccggccgccggccgccgtcctcgcgcggcttcccgggcggctctgccccgaccgtagactcccggcccgctcgccgcggcaggagccgtggttccgcggacctgggcgcgctctctccctggccactgggagaccccccgcggcctcgcggggaaaacctcgggactgccccgcgcccccggccgtctctgcgtcgctccttctcgcccgcgaccgtggactcgtcctcgcgagcctgggttggcggaagctgcgggggccggggtcgcactacttggcgcggaagggccggcggtgggcggagggatccccgtccgcggggtgagccgctgggcggagccgggaggagccgcgaggatccgcagtggggagccgggaggaacctggcgccggcacccacccgccgcgcccacgcgtgccgcggtcgcttgtttcccgcgggagcccggccgcgctcggggggaggcgcgcgcgcagctggggctgcctgggtctaggagctccggagccaccgttttgtgcccgtggagccgcggggaaggcgcacgcgctcgggtcttcccggcgggtcgtcctgcactttctccctctccggtacggaccgcggcgttctgtttccaggcaaaggaaaataagtcaaagactcagaaggcagcctgaatccagggcctgggatgcagggtttgctggaacgccagccggtgcgatcgcgcccctgggattccgcttagcccgcgcgtccatttccctgcatggtggactcagtaaagccggatctgtccaacgcctgcagcgtggatgtggaggcggactaatcaactagtgctctgttattatttctacccatcccttttctccatgctaatttgcttagaactttaacattgaatggacagcaaatgtcatgttctgtttaattatcactccttgaccattatgttaatttctttccctaacaaggtgacgcattgttttaagtaacaatgaccaactcatctactcttcttccaaattgtgtaaattgaagggtaaaatgtgggaaaacgctaaatttgaatgctaaatttgaacatttcacacaacaataatttgaaatgcttctttgcaatattatggcgtttcggaacagataaaaatacttcattttcagacatttggtcaacaaatacttcttggacgtttatatgcaaagcaatgcatgtaacattttcattactttgcaagtgtgcttatcagtaaaagaattttgttttaaattctagccttcgtttaaatgtattttagttaccacattgggaagaaaataaaatattactatgtacggaatgt

SEQ ID NO: 87247 - DNA, 435 bp, Homo sapiens
cactggcatttcatgaagcagtagggagcagagttaaccccaccaagagcactgcagtgcggccttccttcccagcccccgttccagcacctctttccatttcccgacttttctttcaccgccagtaaatttaatgtcttcagctgagcactgatttcatgagcgtaaaggacattagcagtacttcgcacatggtatgcacaaatattaggcaagtccaaggacaggatgagctgcaagcagtctatgataagagtcaaaggcaggagttggggttgtagactcctccagccaaccacagcaaccaggaatttggatgcttcggccgccagagtgcttgcaagagttcatctctgaaatcgcttccattccagcgctaacattttatgaaacctgtgcttttcaaacagattgttttattgcttcctgcatcac

SEQ ID NO: 87248 - DNA, 471 bp, Homo sapiens
ccccttctttctctctgtttctccatagcgtcctatccatatcacattgctctgccttttactttacttcttagatatttattggtctctctgtcctgcctgactctgagaggcatctttccatagttacttactgagcgctgtatgctagtgggctaaatggagatacagagattagtgagttatctgtgccttctgtgagacaaacatgtagatacttggtaaactgctgtttgcctgtaagccttgaaatatcacgtgcccaatgcacacaccactgccagaggacacggggcctcggcatctctgggcctctcctgagacagtgctaggggagaacttcctgggagcagctactttagaagcaggagggaaattagaggggagaggggccaggtgagacagtcagaatattctaggaggaagagaagagagtctcattctttatgggtagtgatcattatcaaagaa

SEQ ID NO: 87249 - DNA, 120 bp, Homo sapiens
accttctgacctctaaggacacctacttcttcaaccttcagacttcaagccattgacctttggccttacttaccctgacctccagcttcatatcttcactgatcttcaaaagcaacactg

SEQ ID NO: 87250 - DNA, 420 bp, Homo sapiens
atgcttccggacatgcttcctgatctccttcccctgccccaccctctccttgatcatcttcctctgcagtggtgtttctcaacctcagcactactgacattcggagctggataattctttggggtgaggtctgtcctgtgcattttaggatgttgagtagcaaccctggcctctacccactagaagctggtaggtagcatgtcctcctcccctacttgtgacaaccaaaaatgtctccagagttgtcaaatgcccccaaaggtgcaaaatgggtgcgaaccatggctctagagataacttttaaaaacaacagtgacaacaacaaaatttctgttcttagaatttctgtctctgcttattttacaggatgaggttaccctcccatatttgcccttggttaggcatcttttccccacccct

SEQ ID NO: 87251 - DNA, 392 bp, Homo sapiens
catgttttaactgcttgcttttttagattctgaattcttacagagtgcagtcattttatcccatggttttagctaccatccataaactgtctttacagatttgcatctctaaatctagccctcccctctcctgaactgtagtcttacatagccacctctcttcttgacctctttgatagatgtcatagagtccagtcaaatataacatgtacaaaattgagcttataattcctattctgtcttgctcaatttccttctactgtatttcagagaatagctttctacgaattagtttgtgcaagccagaattccagggtcacattggtcaatatcttctttcccctcaatttcactattctttcaagaattgctgcttttgcttagaaaatctt

SEQ ID NO: 87252 - DNA, 295 bp, Homo sapiens
tccttcagctctcccacaggtgggcatcctgggggaaaggattaaagccagatgaggaggctggggagactgttagtgacaagaggaaatggatcccagcatttggaaagggccaagaaaggaacattgggtatggaggagcggggaagatcttaaatcccaacagaaggtaagaggagaggtcgaccagagcagaaggtcgacgcagagcagaaggtcgacgcagagcagaaggtcgacgcagagcagaaggtcgacgcagagcagaaggtcgacgcagagcacaaggtcgacg

SEQ ID NO: 87253 - DNA, 442 bp, Homo sapiens
agtggcccaaaggagtaagaaagcatccaagctattttttgttgttgttggaatttttacatgctagagacagattttatcttagtatagtttattcatattccaggcctgtgacccttaatcaattttttttttcttttgagatggagtctggctctgttgcactccagcctgagtgacagagcgagactgtctcaaaaaaaaaaaaagggtcaattatatggaattcagaagttgttgttgttgaaatggcctctctccactgccttggtcagagtgcagtgatgccatcacagctcactgcagcctcaacttcttgggctcaaactttcttgaaagtgctaaaatgatgcgccaaagtagtatatttatcccacgttacaggtgcacaattactcctttggtaagaaaaatgcagtaaattacactgatgaaaatgtag

SEQ ID NO: 87254 - DNA, 176 bp, Homo sapiens
taaagaaaaaatagaaattaaatctgtcacattatcacatatgcaaagggtgtaaatacattaaacatattcaatataattaccacaacttgaaaatactttattcactacaaactttatatacatttacttcttatataaacagatttttcatatatatatatatatgtatgaaa

SEQ ID NO: 87255 - DNA, 789 bp, Homo sapiens
  misc_feature (262)..(262): n is a, c, g, or t
cctatgcccaagtttcacagatggaaaattgaacattgccaaaggaattctgctcagcagattaagtatgttcatgttttagaataaaaattgccaaaactttgttgagaaaccacttatgaggaaaccttaaatactaattaggaagctaaaaattgaatattggtatattggtatagaatgaatatatatatatatatatatctttttccaaattatgacattccgtgtaatatgagtgaattactcagctctgctgatngaggacttatgttgattatctaacctactgtatggacagtgcagatacagaacacttctatcatcacagcaagtactactggacaaagctgatatagtaagcatggttttcttttcttaggaaaactaaattttatttttattaaaaaatctttccttagttctaaacagattttttttgtgaaagacaagaagatttattaaagttttattaaactatctcttaactcatcacaaaaatgagccctgtaaattcacacatgcttcttggatgagtaatggtgaggccagtaagcccaagaacttaaatgaacattcttatacttcagtttgcattctcagagctggggaactgtctgtaggcacagaaatggaaaagggattttctggtctgtttctgactttaagttacacatttttaaaaagtactctggaagacactggggtttgttcatccccggcttgctactaaagtagtaatgattgttgttttcacattttcctttttttttttgagatggagtcttg

SEQ ID NO: 87256 - DNA, 419 bp, Homo sapiens
tcaatttaaaaatgggcagaggacatgaatagacatctctccaaagatgatctacaaatggtcaataagcaaatgaagagattcccaacatcatttattactgaggaaatgcaaattaaaactataataggacatcacctcacacccattaagatgactactatcaaaaaaaccccaaaataacaagtattggcaaggatgtggagaatctggaaccctggagaactattgatgggaatataaaatgacacagttcctatgaaaaacacgataagagttcctcaaaaaattaggaaataggaatgactgtatgatcccacattgcaactgtggggtatatacccaaaataatgggaaatcagggtcttgaaaatatatttgtattactccaagtttcttagcagcgttatttcacaaca

SEQ ID NO: 87257 - DNA, 220 bp, Homo sapiens
aggcaccaaatttagattggaggtctcagaggagcagtgttttccctccttcgtaacagttgaacaacttccagatgtagctagctgcaccccctgtaaagatgcaggctctttacaatgaagacacatcttctgatgttccttctctcctgtatggccagatgcacaggaatagtgcccaaaagacctcagcctgctttccctttaaggggaaggagaa

SEQ ID NO: 87258 - DNA, 220 bp, Homo sapiens
agtatgactgaattttggaagatagtgtgcagtgccagcttttatcctagaaagactacctccaaaggaacttcacagagtggcatttttggtgaattaccattgatcagagtccatttttcaacctcaaagatgtagaaaaaagatccgtagatcaagcagacccttagaaacagagtaggaataataaaattggcccaaaactgaggtgtaaactaaa

SEQ ID NO: 87259 - DNA, 277 bp, Homo sapiens
ctcattcccagtgcagctcccaaacctcaacccgatttattcctctttatctctaacattattccagcctcctgtgccctactagtcacctcaaagggtgactgagcgtgctgctcagggcctgcctgaacgggatcccatacagacttagccccaagtgataatctccacctttaaaccaccctaacctctgtttgtttgtttgtttgttttttccatacttgtcacattctcagctccatgttcaacctttttcctttctcccttagctcttgtc

SEQ ID NO: 87260 - DNA, 558 bp, Homo sapiens
  misc_feature (534)..(534): n is a, c, g, or t
ctttcagaccagcttgtgtcaatagggtcctacagagcagctgatatcagcagttttactagtatgcaggacctgaaagaatatctcaaagggaaaacaatgtttcataatgttcaggaagttatctatagagcagctaaggggaaataatcttgtaacagggtctgggtgattctgaggtaataggccccaaacaaccatggggaagcaggtcagagggcaagctggcctagtgtttaacattgaatgggctgaaagtttggtttatttttgtttcttgtttctccccctcccttcttacctgaataattttatgaagtttatagggatggtttcaggacctccattctatctgttcctgaaatattacaaaaagattattattgtagcactcatctaattgtgttttatctcgttgtttgcatgtctgtttcttccccagtgagttgtaaattgcttaagggcaaacagacgcatcctatttatctgtctgtcactaacattaagcacagcatttggtatacagtcatcacntctaataaagtttgaaaaaaaaaa

SEQ ID NO: 87261 - DNA, 402 bp, Homo sapiens
tgactataaaagtaattcatgctcattatagaaaatgtgtgagatacagaaatgttgcaagatgcaagataaatcactttgggtgaagttttaacgcaagactaagtgtcttataaaacgcagagttcagaattttacaacttcccctgagaagggggaagaaatgctgcagacataaagtaataaacacttccttcagagaaggcactgacttacctcttaagaaacagttacatcacatgtgcatttaacctactggaatttactgcatggcttggcaggcaatgagcatgtgccccagggtgggataagatatgggatgtgcatcagcttctcacccagtaggtttctgtgagcctctcatggtacctccaacctgaagctcctgaaggacttttcaag

SEQ ID NO: 87262 - DNA, 960 bp, Homo sapiens
cctaactgggctcagtcggaaggaacttgaccaaagtctgggctcagttgggcatcactcaggctaatggtcgtgtgctggatgccatcagagggaagtaccaatggtaaagtggaaacaatgtgcagctttcaactgggtggaggctgctattctgtggacagtgagatgtttccttggcactgtcaatagacaatctgcgtagagaaattccaagctgaaagccaataatgttataataaaatagagattcttcagaagatgaaaggaattaccagcatggaaattgtgtcataggcttaagggctaaagaagaagccttttcttttctgttcaccctcaccaagagcacaacttaaatagggcattttataacctgaacacaatttatattggacttaattattatgtgtaatatgtttataatcctttagatcttataaatatgtggtataaggaatgccatataatgtgccaaaaatctgagtgcatttaatttaatgcttgcttatagtgctaaagttaaatgatcttaattctttgcaattatatatgaaaaatgactgatttttcttaaaatatgtaacttatataaatatatctgtttgtacagattttaaccataaaaacatttttggaaaaccataaaaaagttcctttgtttgtatttttctcaaagttaaaagtctatagagaaagactgaatttccctaaggagattaagaattgctttaagactagaattaaaacacactttattacatctttttatgtactttttgttactttgttttgtatatctccagtaaaattttttttgtttaaattatagaaacattacacaaagctctgtttttctcccttataagtacttactcatataaggaattttccacttaggtaatatgataggagcttgaatttttttagtcacccaaaatatgatttacttatatacag

SEQ ID NO: 87263 - DNA, 2912 bp, Homo sapiens
gagacatacaggacagagcatggctcgcctacagactgcactcctggttgtcctcgtcctccttgctgtggcgcttcaagcaactgaggcaggcccctacggcgccaacatggaagacagcgtctgctgccgtgattacgtccgttaccgtctgcccctgcgcgtggtgaaacacttctactggacctcagactcctgcccgaggcctggcgtggtgttgctaaccttcagggataaggagatctgtgccgatcccagagtgccctgggtgaagatgattctcaataagctgagccaatgaagagcctactctgatgaccgtggccttggctcctccaggaaggctcaggagccctacctccctgccattatagctgctccccgccagaagcctgtgccaactctctgcattccctgatctccatccctgtggctgtcacccttggtcacctccgtgctgtcactgccatctcccccctgacccctctaacccatcctctgcctccctccctgcagtcagagggtcctgttcccatcagcgattcccctgcttaaacccttccatgactccccactgccctaagctgaggtcagtctcccaagcctggcatgtggccctctggatctgggttccatctctgtctccagcctgcccacttcccttcatgaatgttgggttctagctccctgttctccaaacccatactacacatcccacttctgggtctttgcctgggatgttgctgacactcagaaagtcccaccacctgcacatgtgtagccccaccagccctccaaggcattgctcgcccaagcagctggtaattccatttcatgtattagatgtcccctggccctctgtcccctcttaataaccctagtcacagtctccgcagattcttgggatttgggggttttctcccccacctctccactagttggaccaaggtttctagctaagttactctagtctccaagcctctagcatagagcactgcagacaggccctggctcagaatcagagcccagaaagtggctgcagacaaaatcaataaaactaatgtccctcccctctccctgccaaaaggcagttacatatcaatacagagactcaaggtcactagaaatgggccagctgggtcaatgtgaagccccaaatttgcccagattcacctttcttcccccactcccttttttttttttttttttttgagatggagtttcgctcttgtcacccacgctggagtgcaatggtgtggtcttggcttattgaagcctctgcctcctgggttcaagtgattctcttgcctcagcctcctgagtagctgggattacaggttcctgctaccacgcccagctaatttttgtatttttagtagagacgaggcttcaccatgttggccaggctggtctcgaactcctgtcctcaggtaatccgcccacctcagcctcccaaagtgctgggattacaggcgtgagccacagtgcctggcctcttccctctccccactgccccccccaactttttttttttttttatggcagggtctcactctgtcgcccaggctggagtgcagtggcgtgatctcggctcactacaacctcgacctcctgggttcaagtgattctcccaccccagcctcccaagtagctgggattacaggtgtgtgccactacggctggctaatttttgtatttttagtagagacaggtttcaccatattggccaggctggtcttgaactcctgacctcaagtgatccaccttccttgtgctcccaaagtgctgagattacaggcgtgagctatcacacccagcctccccctttttttcctaataggagactcctgtacctttcttcgttttacctatgtgtcgtgtctgcttacatttccttctcccctcaggctttttttgggtggtcctccaacctccaatacccaggcctggcctcttcagagtaccccccattccactttccctgcctccttccttaaatagctgacaatcaaattcatgctatggtgtgaaagactacctttgacttggtattataagctggagttatatatgtatttgaaaacagagtaaatacttaagaggccaaatagatgaatggaagaattttaggaactgtgagagggggacaaggtgaagctttcctggccctgggaggaagctggctgtggtagcgtagcgctctctctctctgtctgtggcaggaggcaaagagtagggtgtaattgagtgaaggaatcctgggtagagaccattctcaggtggttgggccaggctaaagactgggagttgggtctatctatgcctttctggctgatttttgtagagacggggttttgccatgttacccaggctggtctcaaactcctgggctcaagcgatcctcctggctcagcctcccaaagtgctgggattacaggcgtgaatcactgcgcctggcttcctcttcctcttgagaaatattcttttcatacagcaagtatgggacagcagtgtcccaggtaaaggacataaatgttacaagtgtctggtcctttctgagggaggctggtgccgctctgcagggtatttgaacctgtggaattggaggaggccatttcactccctgaacccagcctgacaaatcacagtgagaatgttcaccttataggcttgctgtggggctcaggttgaaagtgtggggagtgacactgcctaggcatccagctcagtgtcatccagggcctgtgtccctcccgaacccagggtcaacctgcctgccacaggcactagaaggacgaatctgcctactgcccatgaacggggccctcaagcgtcctgggatctccttctccctcctgtcctgtccttgcccctcaggactgctggaaaataaatcctttaaaatagtgtct

SEQ ID NO: 87264 - DNA, 2858 bp, Homo sapiens
gagacatacaggacagagcatggctcgcctacagactgcactcctggttgtcctcgtcctccttgctgtggcgcttcaagcaactgaggcaggcccctacggcgccaacatggaagacagcgtctgctgccgtgattacgtccgttaccgtctgcccctgcgcgtggtgaaacacttctactggacctcagactcctgcccgaggcctggcgtggtgttgctaaccttcagggataaggagatctgtgccgatcccagagtgccctgggtgaagatgattctcaataagctgagccaatgaagagcctactctgatgaccgtggccttggctcctccaggaaggctcaggagccctacctccctgccattatagctgctccccgccagaagcctgtgccaactctctgcattccctgatctccatccctgtggctgtcacccttggtcacctccgtgctgtcactgccatctcccccctgacccctctaacccatcctctgcctccctccctgcagtcagagggtcctgttcccatcagcgattcccctgcttaaacccttccatgactccccactgccctaagctgaggtcagtctcccaagcctggcatgtggccctctggatctgggttccatctctgtctccagcctgcccacttcccttcatgaatgttgggttctagctccctgttctccaaacccatactacacatcccacttctgggtctttgcctgggatgttgctgacactcagaaagtcccaccacctgcacatgtgtagccccaccagccctccaaggcattgctcgcccaagcagctggtaattccatttcatgtattagatgtcccctggccctctgtcccctcttaataaccctagtcacagtctccgcagattcttgggatttgggggttttctcccccacctctccactagttggaccaaggtttctagctaagttactctagtctccaagcctctagcatagagcactgcagacaggccctggctcagaatcagagcccagaaagtggctgcagacaaaatcaataaaactaatgtccctcccctctccctgccaaaaggcagttacatatcaatacagagactcaaggtcactagaaatgggccagctgggtcaatgtgaagccccaaatttgcccagattcacctttcttcccccactcccttttttttttttttttttttgagatggagtttcgctcttgtcacccacgctggagtgcaatggtgtggtcttggcttattgaagcctctgcctcctgggttcaagtgattctcttgcctcagcctcctgagtagctgggattacaggttcctgctaccacgcccagctaatttttgtatttttagtagagacgaggcttcaccatgttggccaggctggtctcgaactcctgtcctcaggtaatccgcccacctcagcctcccaaagtgctgggattacaggcgtgagccacagtgcctggcctcttccctctccccactgccccccccaactttttttttttttttatggcagggtctcactctgtcgcccaggctggagtgcagtggcgtgatctcggctcactacaacctcgacctcctgggttcaagtgattctcccaccccagcctcccaagtagctgggattacaggtgtgtgccactacggctggctaatttttgtatttttagtagagacaggtttcaccatattggccaggctggtcttgaactcctgacctcaagtgatccaccttccttgtgctcccaaagtgctgagattacaggcgtgagctatcacacccagcctccccctttttttcctaataggagactcctgtacctttcttcgttttacctatgtgtcgtgtctgcttacatttccttctcccctcaggctttttttgggtggtcctccaacctccaatacccaggcctggcctcttcagagtaccccccattccactttccctgcctccttccttaaatagctgacaatcaaattcatgctatggtgtgaaagactacctttgacttggtattataagctggagttatatatgtatttgatgtgagagggggacaaggtgaagctttcctggccctgggaggaagctggctgtggtagcgtagcgctctctctctctgtctgtggcaggaggcaaagagtagggtgtaattgagtgaaggaatcctgggtagagaccattctcaggtggttgggccaggctaaagactgggagttgggtctatctatgcctttctggctgatttttgtagagacggggttttgccatgttacccaggctggtctcaaactcctgggctcaagcgatcctcctggctcagcctcccaaagtgctgggattacaggcgtgaatcactgcgcctggcttcctcttcctcttgagaaatattcttttcatacagcaagtatgggacagcagtgtcccaggtaaaggacataaatgttacaagtgtctggtcctttctgagggaggctggtgccgctctgcagggtatttgaacctgtggaattggaggaggccatttcactccctgaacccagcctgacaaatcacagtgagaatgttcaccttataggcttgctgtggggctcaggttgaaagtgtggggagtgacactgcctaggcatccagctcagtgtcatccagggcctgtgtccctcccgaacccagggtcaacctgcctgccacaggcactagaaggacgaatctgcctactgcccatgaacggggccctcaagcgtcctgggatctccttctccctcctgtcctgtccttgcccctcaggactgctggaaaataaatcctttaaaatagtgtct

SEQ ID NO: 87265 - DNA, 534 bp, Homo sapiens
aactagtgaggtgaaagatctctgtaagaactaaaaacaccaaagatatcagagaggatgaaacaaatgaaaaaacattctatgctcatggataggaagaatcaatatcattaaaatggccatattgtccttattttcaagtatgctattgcactctatgactgatccaaactcctgccagatataattctaaaaatctgtttgttaattttattattttatttttggatttttaaatgcttgggaattgggagatatgcacaattgtctttgctttgttcacaaaattaaatgcgtatttgggtacttataggacactatttgtaaaaacatttatttcttcagacattgatggtcttgtcccagttattaacaacatctacatgtttaagaataaattttcttttctatctacttcttattccattgaaaattacctttctatcctcctactctggaagtctttatgattctgtcctaatcattagtatcccattgcttcttcaagagatgtctgtcagtagaatttctcca

SEQ ID NO: 87266 - DNA, 632 bp, Homo sapiens
atctctgatggctgttttaatggatttttgtaaaccttagggtgtcaaaaggatattagacactatattttaaaggtgtcttttaacatcctttttttctaatactttgcttttggcatgttaagtgtcatttttgataatttgaccaacaaaaatataaattgtggattttgctttttcaggcaagataaataactatgagaggaattagtaaaatatcttatgaaggcataaatctgtttctaacaaaactagatttgattttgctgggattttcatgttgaattgaattttgattttgtaatgtgttgatgctgggtttttaaatttatgaactaggttttgttttttgtgtttttttttgagacagggtctcgttctgttgcccaggctagagtgcggtgggctctatgcgctcactgcaacctccacttcctgggttcaacccaagtaactggaattaaaggcatgctccaccgcactcagctaatttttgtatttttagtggagacagggtttcaccatgttggctaggctggtcttgaactcctgacctcaagtgatctgcctgcttcggcctcccaaagactgcactccagcctgggcgacagaatgagactctgtctccaaaa

SEQ ID NO: 87267 - DNA, 486 bp, Homo sapiens
caagggattctgtggcttcttgaaaaaatgtgatcacaataaactactgtaggaactgaaagtttttgtcctttgtgtatcacagctatatttaattacataaagttgcttcaaagatctgcattcattatcacctcatctcttttgtacttctcttcacagttattttcaaatgaatgtattgagttatagacctttgtggcataatgattgcttttatgaatgtttcacgaccatgtaagaaagaacgtatttgctttattttcagagtccagagataaatgtggttttgtatcttatttctgtattcttattttgtctgtttgatctgccatggactaagagatgaataaaagcctcatatgagtacactgctatcttaagtttctttgcaaatgttgatgccatgtttttgttttgttttgttttgtttcagatggagtcttgctctgttgcccaggctggagtgcagtggcgcaatttcgg

SEQ ID NO: 87268 - DNA, 344 bp, Homo sapiens
agaggacctttccccgtacgccaaatgaaatgtgttgcttattcatttgttcataattttgaggctggagggctattacttgcttttttgggtcttgcaaacatttcatttgggagtaaatgtgacagttcttcattggtattgtctgatcttctgcaggccatttactgctctgagtgctttgtcttcatatgtaaagaagtgattagttggtttgggccacagggtatctagacaactaactactgataagccaccacctgctgggaatgggtaatgacttgattgattgattggagatggagtcttgctctgtcacccaggctggagtgcaatggcacgat

SEQ ID NO: 87269 - DNA, 789 bp, Homo sapiens
catgtgctgagccatcgttagtattttctgtcctttctctttgactcgtgtatagtgtgctcaaactcttaaaattatacactttaatgattatacactttcatgcatctcaattgcatgtaagttatatttcaatatatttgttaaaagtttataattaaaaaaactgtcctagcttgattcaagaaatcttttttatatttaagaaaatgtaatgttatgtattatcagggcaaaagagaaaaaccatatgattaccttgtcatacacagtaaaagcatttggcacaattgaaaacttttttcatgatttataaaaacaaaccccagaaaactctcagcatgataagaagagaaggcaacactttcaaccctattaagggtagatttgaaaaaaactcagaggtaacattatattaaatggcataggattgaatgcttttctattaaatcagagaaaaaagtagaatatctgttgttattctttcaattcagcattatactagagatctaaatcaatgcaataaagtaagaaaaataaaagtattgaaaagattgaaaagaaagaattgaagctgtctttattcacagataatgactgtgtatgttaataatcctagaaatctataaaaatctgccaaaagtaattagtgagtttggtaatgttgcagaatataagctcaatagaagtagtcttttgtatttctgtgtattagcaatgagcatttggaaaatgaaataaaaatacaatttcatttcaagtaacatctaaatacatgttgtgcttaga

SEQ ID NO: 87270 - DNA, 1051 bp, Homo sapiens
ctctgaacctcagcaggggaagattgatgtaaaatccacttggtcagagtgatatatgtagacttgatgtttgagatggttctcagtttagagaatgtgggatatggtagaggtctttgtttttttcccatgtcccaaaaggtgctgggcaagtagcttgaactcgagcctgttttaattataaaatagatcaaactgctctttcttggtgcccttactgctccttgatttttagtgcatttattttgagtatgaatgcataaagtctgagggcctaaattttgttaattttttttaacaaatgggagaggggaatcctcgatagtcacccaattttcctttttttttgagacagtctgactgttgcccaggctggagtgtaatggcgccatctcggctcactgcaacatccagctcctgggtttcagcaattctcctgcctcagcctcctgagtagctgggattacaggcgcccgccatcacgcccggctaatttttgtatttttagtagagacaggattttgccatgtttgccaacctggtctcgaactcttgacctcctgatccaccctcctctgcctcccaaagtgctgggattacaggcgtgagccaccgcgcccagccccatagtcccccaattttctaacagcagttttaaattctgtaacttctcctgtctgtaaacaaggctgtcttttcaaatggctctcctacaggatgtgataattatctattctataaagccgaggtttggagaggtaaatagctatttcacattaacacaataatgtcaatgccctatggaaaagataaaatacttggactatattttaaaggggaatctggggtcatgcatattgaagtttaactagatccctccagatttttggttttgatcctacacatttagatactagttttggattttagacagttggtgctgacagtgtgaaactcctattgcctgcagttaaattgaagctttggtttctcatgtgtaacaggcagtgaagctggtattatactttaagtcctcatttcagaaatagtt

SEQ ID NO: 87271 - DNA, 431 bp, Homo sapiens
catttctctagggagtttactgtgaagaaaaatggccgggtcatagagtacgctatttatttattcatttatatgtttatgccaaattgctctgaagtttttactaatttaaactccaaccactattgtgtgaaagtttgtttttctacactcctcagacttgacattaacagagatgcatgttttttcaatctgaaatgttctcttaaggtaatcttttcctatcagtcacattaaataccttttcataggtattattcattgttcaagtttactcttataagttgaagaacattatttgcatatttgtgctgttagatttttgttcattggatattgataggcatagttaataagtaaacatgctttttaacaaactaacacattgcaggcttcttctatattcttttagatatttagatagatgttac

SEQ ID NO: 87272 - DNA, 1004 bp, Homo sapiens
ccagagcagaagagggcgaggaagaagatgcctcggcccggccgcaacacgtacagcgaccagaagccgccctactcgtacatctcgctgaccgctatggccatccagagctctcccgagaagatgctgccgctgagcgagatctacaagttcatcatggaccgcttcccctactacagggagaacacgcagcgctggcagaacagtctgcgccacaacctctccttcaacgactgcttcatcaagatcccgcggcggccggaccagccaggcaagggcagcttctgggcgctgcacccaagctgcggggacatgttcgagaacggtagcttcctgcggcgctgcaagcgcttcaaggtgcttaagtccgaccacctggcgcccagcaagccagccgacgcgcagtacctgcagcagcaggccaagctgcggctcagcgcgctggcggcctcgggcacgcacctgccacagatgcccgccgccgcctacaacttgggcggcgtggcgcagccctcgggcttcaagcaccccttcgccatcgagaacatcatcgcgcgggaatacaagatgcctggggggctggccttctccgccatgcagccggtgcccgctgcctacccgctccccaaccagttgactaccatgggcagctcgctgggcaccggctggccacacgtgtatggctccgccggcatgatcgattcggccacccccatctccatggcgagtggcgactacagcgcctacggcgtgccgttgaagccgctgtgccacgcggcgggccaaacgctgcccgccatccccgtgcccattaagcccacgccggccgccgtgcccgcgctgcctgcgctgccagcgcccatccccaccttgctctcgaactcgccgccctcgctcagccccacgtcctcgcaaacagccaccagccaaagcagccccgccacccccagcgaaacgctcaccagcccggcctccgccttgcactcggtggccgtgcactgacc

SEQ ID NO: 87273 - DNA, 241 bp, Homo sapiens
ggaaaaattggatatccacatgcagaagaatgaaagtagactcccacttctcaccctatacaaaaatcaacttaaaatgaatcaaagacctaaacctaagatctgaaacaataaaactatgagaagaaaacataagggaaacacttcaggacattggtctgggaaatgattttatgaataaaacctcaaaagcaagggcaacaaaagcaaaaataaacaaatgggataacacgttcgcgag

SEQ ID NO: 87274 - DNA, 252 bp, Homo sapiens
aaaacctgacacatagtaggtgctaatatttggttgaatggaagatattgataatgacaagaggcagataaatgcctaggtacataggggcgaatccctgatgaaatgccaccttcaagccaaaaacagcctgaaggctgaaagaccacactgctggttctggatgaaagccgtgattcagagtgagaacctctgttcatgtttgcccaccctttccccattgattctttctgaataatgctttttaaccaa

SEQ ID NO: 87275 - DNA, 444 bp, Homo sapiens
agccagttttcccagcaccatttattaaatagggaatcctttccccattgcttgtttttctcaggtttgtcaaagatcagatagttgtagatatgcgtaagccagcaatttctatggctatgacttggtttttgacattatccataactaccgaacctctgaaatcactaacacaaacatctcactgtctgataacttcctcttcatccaacttgcatgttcaactactttgttcaattttatctaggatttccaaaccactaaactttctatcttctcccagacctttttttttttttgagacagtcttgctctgttgcccaggctggagtgcagtggtgtgatcttggctcactgcaacctctgcctcccaggttcaagtgattctccagcctcagcttctggagtagttgggactacaggcaggcgctgccatgcccagct

SEQ ID NO: 87276 - DNA, 623 bp, Homo sapiens
atctaacttaattatatactaattatatctaacttaattatatactatatacttaatcttaaattgataccagtagaagcaaatgcattaggaatttgagccatgtctaccactaggcacaccaccactatggaatcagaatctaagtgaagcttgagtaccctttcacatactctgtatattgattcaaaactagtggtaagcactgggcaaaaatggaatagagcttaatggacagccagtaggctcagccatcatattcttgaaaacctagaaaatgccagtattctgggtctcttaaattcattattttaaagtctggatgatctggctgggtgcggcacatcacttgggctcaggaagttcaagatcagcctggacaacatggtgaaacctgtctctacgaaaaatccaaaaaaattagccccgtgtggtagcgcacacctgtagtcccagctattctggaggctgaggcaggagaatcacttgaacctgggagttggaggttgcaatgagctatcacgccactgcactccagcgagggcaacagagcaagactctgtctcaaaaaaaaagaaagtctgaatgatccatattgctggactttgttttttgtttattat

SEQ ID NO: 87277 - DNA, 461 bp, Homo sapiens
ctataatcatggccgtcataggttatggcatggctaggtttatagatagttgggtggttggtgtaaatgagtgaggcaggagtccgaggaggttagttgtggcaataaaaatgattaaggacactagtataagagatcaggttcgtcctttagtgttgtgtatggttatcatttgttttgaggttagtttgattagtcattgttgggcgtacggggaccccgtacgcccaactccacagccaaaagtttgtgtatataaccttattactaaacagcaagttttcttggacccaaagaagcaaaaataaaagcaaacgtgaaatggctccatttggaagatccagtttcataattttatctctgtggttgccaaatacacactctcgtctcttgaaattctcctgtatcccaaaaatctgggtgagggaagacagattccattacttgttacttcaccagga

SEQ ID NO: 87278 - DNA, 832 bp, Homo sapiens
attctttacaaataattcccacgtaacagctatccgtcttctaagagcagacattagattgtgccattcccctgcttattaaaaataacaaacaaacaaaactgatgcttgagcacacttagactaaaatccatacttttttcatggccagagcaaggcagtacttgatctggtctctgcttaattcttcaacttcatctcctagtactcgcctttctctcccactgccccttttataatcgggttattctgtcctattcttctagctcgccagtacagcattattctggccacaagactttgtacttgctgttcctttgcttgacactgctcttcctctaggtcctgacgtaggtggtttcttcttaaatttagctcaggtgttcttttcttttttttttttttttttttagatggagtcttgctctgtcacccgggctggagtgcagtggcacgatctctactcactgcaacctccgcctcccgggttcaagtgattctcctgcctcagcctcccgagtagctgggattacaggcgccggcgaccacgcccagctaatttttgtatttttagtagagagggggtttcaccatgttggccaagctggtctcgaactcctgacctcaggtgatcgcccgcctcagcctcccaaagtgctgggattacaggcgtgagccaccgcacccgacctaggtgttcttttcttttcttttctttctttcaagacggagtttcgctcttgttgtgcaatggcacgatctcggctcactgcaacctccgcctcccgggttcaagcgattctcctgcctcagcctcccaagtagctgggat

SEQ ID NO: 87279 - DNA, 455 bp, Homo sapiens
tttaaagatgtttttaaatgtctcaacctatgtcagtattgatttatctggattttgccaacattgctatattttcttctcgtctaccactttttggaagactaaatggatggcttggagcaaagtctttgtaacctcacaggcacatgtgtgatcttcttttgtaattaagtagctaagacacatttttaaaaaccccttcttttgtgtctagctacttaatttttactttaaaaaaattaacatgtgaactagttgatatagatcagaaaaaacagggtggtaactttgatattaagcttaagctttctggcaaaaccaatagggtccttgtaactttgatattaagcttaagctttctggcaaaaccaataggatcctcgtggaaattagattttttttttttttttttttggaaacggggtgtggggtacccgagcccaaattcgaaacca

SEQ ID NO: 87280 - DNA, 286 bp, Homo sapiens
ccagtttcaaccctcttcaaaaccccccagggcccgcaacaagattgggtcctaccggagagatgattttaggcagaacctagagaaacctcttacattttaatagttaagcatttattttaatgtgtactgaaaaaatataactagcacatcaaaactgtgatttcacacatatgattgcttaggatgagactaatgggggtattaaaaaatggtgggttagtttatagaaaaacattaaggacataatagcgcaggcggtgcgtgggcatgtccgtggggatcc

SEQ ID NO: 87281 - DNA, 339 bp, Homo sapiens
ctctgctcactgagataaatgcatatctgactgcctcctttggaaatgctaatcagaaactcagaaggatgcaaccacttgtctcttatctacctataacctataagtcccctccctgctttgagtcttcctgcctttgcttccagttgtcctgcctttccagactgaaccaatgttcatcttgtgtatgttgactgatgtccccctagaatgtataaaaccaaactgtgctctgaccaccttgggcacatgtcatcaggacctcctgaggctgtgtcccaggtgcatgtcctcaattttggcaaaataagctttctaaattaactgagacctgtctca

SEQ ID NO: 87282 - DNA, 4374 bp, Homo sapiens
tcaggaaggggacattgggtgacccaccccaaggcaggtcagaggggcttgccaaggaaggctccctggggagtggtctctggcctcctctgagtcttccaaccctaatggtgcctggcatagatattctctccacttcagctcgagctcccacaacactctgaggcctgcacccagaggcagtgcccaggagagcgctgtccggcctcggagaatggtggagcccctggaggacagaaggcaagagaacttcttctgtggcccccctgagaagagctatgcaaagctggtgttcatgtccacctcctcgggcagcctatggaacctgcatgccatccattccatgtgtcgcatggaacaggaccagatccgctcccataccagcttcggggctctgtgccagcggacagcagccaaccagtgctgccccagctggtccctgggcaactatctggctgtgctctccaaccgctcctcctgcctggacactacccaagctgacgcagcccgcacactggccctgcttcggacctgtgccctctactaccacagtggcgccttggtgccctcttgtctgggacctgggcagaacaagtccccacgctgtgcccaggttcccaccaagtgctcccagagtagtgccatctaccaactcctgcactttctgcttgacagggactttctgagtccccagaccactgactaccaggtgccttccctcaagtacagcctgctcttcctgcccaccccaaagggtgcttccctcatggacatctacctggaccggctggccaccccctgggggcttgctgacaactacacctctgtcactggcatggacctgggcctcaagcaggagctgctgaggcacttcctggtccaggacacggtgtaccccttgctggctctggttgccatcttcttcggcatggccctgtacctgcgctcactcttcctcacgctcatggtgctgctgggggtgctgggctcactgctggtggccttcttcctttaccaggtggccttccgcatggcctacttccccttcgtcaatctggcagccctcctcctgctgagcagcgtctgcgccaaccacacgctcatcttcttcgacctgtggcgccttagcaagagccagctgccgtcgggggggctggcgcagcgcgtgggccgcaccatgcaccacttcggctacctgctgctggtctccggcctcaccacgagcgcggccttctatgccagctacctgagccgcctgccggccgttcgctgcctcgccctcttcatgggcacggctgtgctggtgcacctggcgctcacgctggtctggctgcccgcctccgccgtgctccacgagcgctacctggcgcgcggctgtgcgcgccgggcgcggggccggtgggagggcagcgcgccccggcggctactgctggcgctgcaccggcggctccgcggcctgcggagggcggcggctggcacctcgcgtctgctcttccagcgcctgctgccctgcggcgtcatcaagttccgctacatctggatctgctggttcgcagcactggcggcagggggcgcctacatcgccggagtcagcccccgcctgcggctgcccacgctgccgccgcccggcggccaggtcttccggcccagccaccccttcgagcgcttcgacgcggagtatcgccagctgttcctgttcgagcagctgccgcagggcgagggcggccacatgcccgtggttttggtgtggggcgtcctgcctgtggacactggcgaccctctggaccctcgtagcaacagcagcctggtgagggaccctgccttctcggccagcggccctgaggcccagcgctggctgctggcactctgtcaccgggcccggaatcagagcttcttcgacaccctgcaggaaggctggcccacgctgtgtttcgtggagaccctccagcgctggatggagagccccagctgcgcccgcctggggcctgacctctgctgcggccactcggacttcccctgggccccccagtttttcctgcactgcctgaaaatgatggctctggagcaaggccccgatggcacccaggacctgggactccgctttgatgcccatggcagcctggccgccctggtcctacaattccagaccaacttccggaacagtccggactacaaccagacccagctcttctacaatgaggtcagccactggctggcagcggagctgggcatggcacctccaggcctccgccgtggttggttcactagccgtctagagctgtatagcctgcagcacagcctgagcactgagcctgctgtggtgctgggcctggctttggcgctggcctttgccacactgctcctgggcacctggaatgttcccctcagcctattctccgtggcagctgtggcaggcaccgtgctgctcactgtaggactcctggttctcctcgagtggcagctcaacactgccgaggccctgtttctctctgcctcagtgggcctctcagtagacttcactgtcaactactgcatctcctatcacctgtgcccacaccctgaccgcctgagccgtgtggccttctctctgcgccagaccagctgcgccacagccgtgggggctgcagccctgtttgcggcaggcgtgctcatgctgcctgccacagtgctgctctatcgcaagctgggcatcatcctcatgatggtcaaatgcgtcagttgtggctttgccagcttcttcttccaatctctctgctgtttcttcgggccagagaagaactgtgggcagatcctctggccctgtgcccacctgccatgggatgctggtactggggaccctggtggggagaaggcaggccgcccacgaccagggtcagtgggagggatgcccgggtcctgctcagagcaatatgagctacagcccctggcacggcgtcggagccccagctttgacaccagcacagccaccagcaagctgtcccaccggccctcagtactctctgaggatctgcagctccatgatggtccgtgctgttcccggcccccaccagcccctgcctccccaagggagctgctgctggaccaccaggcagtcttcagccagtgccctgccctgcagacctcctccccctataagcaggctggccccagccccaaaacccgggccaggcaggactcccaaggggaggaggctgagcccctgccagcctcaccagaagccccagcccactctcctaaggccaaggctgcagatcctcctgatggcttctgttcctcagccagcaccctggaggggctcagcgtctctgatgagacctgcctaagcacctctgagcccagtgcccgtgtaccagattccgtgggtgtgtccccagatgacctggatgacactgggcagccagtccttgagcgaggccagctcaatgggaagcgggacaccctgtggctggcgctgagggagacagtgtatgacccatcattgcccgcttcccatcacagcagcttgtcctggaagggccgaggggggccaggggatggcagccctgtggtgctgcccaatagccagccagacctgccagatgtttggctgcgcaggcccagcactcacacgtcaggctatagcagctgagggggacccggggaggctggacagggcgcggaaccctgtcatggatgacaaggcaagggcagcaataggctggagcccgaaggtatttctccagatccacagggagaggtctcaccctccagctgtggatgttaaaccctgccagatgtcccagccttgatctgtctgctcctactcctcacatctggaggattccagcaggaggggttttggaggggacctgcttgcgacctgctgagggcttgtctgctcccacagcaccatctaagacccctcctctagaagtggggaaggccagatgtgtagcttcgggtatcagaggaggctgacctggcccccatcccaagttacaagaacttcagtgagactaagggacccccatcctagggatcttgtcagggttccttactgaccagaggagcccgcagcaatctccacagcctcctgggtctcacccctttcatgggctcttcatcaggacacttccctctcttttgggagcttctctgggcagaattgggctgggacctctctccccaactgccctgctctcctcatactcaccggtttgaccagaaattctccaaatccagccatagatggctgctgggtgtgcagcaggagaaggaggatggtcagccttggagcatctctcaattacgggacagtccctctttggaagcaggctcctgtgctttcctgtgttaataaacagtaataatcctttccatctctgcacattttag

SEQ ID NO: 87283 - DNA, 380 bp, Homo sapiens
ggtctctggcctcctctgagtcttccaaccctaatggtgcctggcatagatattctctccacttcagctcgagctcccacaacactctgaggcctgcacccagaggcagtgcccaggagagcgctgtccggcctcggagaatggtggagcccctggaggacagaaggcaagagaacttcttctgtggcccccctggtaagctgcagcctggccagttcctggttttaatagtggtccccaccccacctagtaggacaggcaggcccagaacaaatctgggcagacagaaagggaaggtggccagctggccacagtcaagccaaggaagccgggttacagctgggataggggagttctcagatgctccagccagacagggt

SEQ ID NO: 87284 - DNA, 4314 bp, Homo sapiens
gttagtggtctggagagcactacaagccctcacaggccccaggaagctgcttttcctttccccagaccttgagctgaacagctcgagctcccacaacactctgaggcctgcacccagaggcagtgcccaggagagcgctgtccggcctcggagaatggtggagcccctggaggacagaaggcaagagaacttcttctgtggcccccctgagaagagctatgcaaagctggtgttcatgtccacctcctcgggcagcctatggaacctgcatgccatccattccatgtgtcgcatggaacaggaccagatccgctcccataccagcttcggggctctgtgccagcggacagcagccaaccagtgctgccccagctggtccctgggcaactatctggctgtgctctccaaccgctcctcctgcctggacactacccaagctgacgcagcccgcacactggccctgcttcggacctgtgccctctactaccacagtggcgccttggtgccctcttgtctgggacctgggcagaacaagtccccacgctgtgcccaggttcccaccaagtgctcccagagtagtgccatctaccaactcctgcactttctgcttgacagggactttctgagtccccagaccactgactaccaggtgccttccctcaagtacagcctgctcttcctgcccaccccaaagggtgcttccctcatggacatctacctggaccggctggccaccccctgggggcttgctgacaactacacctctgtcactggcatggacctgggcctcaagcaggagctgctgaggcacttcctggtccaggacacggtgtaccccttgctggctctggttgccatcttcttcggcatggccctgtacctgcgctcactcttcctcacgctcatggtgctgctgggggtgctgggctcactgctggtggccttcttcctttaccaggtggccttccgcatggcctacttccccttcgtcaatctggcagccctcctcctgctgagcagcgtctgcgccaaccacacgctcatcttcttcgacctgtggcgccttagcaagagccagctgccgtcgggggggctggcgcagcgcgtgggccgcaccatgcaccacttcggctacctgctgctggtctccggcctcaccacgagcgcggccttctatgccagctacctgagccgcctgccggccgttcgctgcctcgccctcttcatgggcacggctgtgctggtgcacctggcgctcacgctggtctggctgcccgcctccgccgtgctccacgagcgctacctggcgcgcggctgtgcgcgccgggcgcggggccggtgggagggcagcgcgccccggcggctactgctggcgctgcaccggcggctccgcggcctgcggagggcggcggctggcacctcgcgtctgctcttccagcgcctgctgccctgcggcgtcatcaagttccgctacatctggatctgctggttcgcagcactggcggcagggggcgcctacatcgccggagtcagcccccgcctgcggctgcccacgctgccgccgcccggcggccaggtcttccggcccagccaccccttcgagcgcttcgacgcggagtatcgccagctgttcctgttcgagcagctgccgcagggcgagggcggccacatgcccgtggttttggtgtggggcgtcctgcctgtggacactggcgaccctctggaccctcgtagcaacagcagcctggtgagggaccctgccttctcggccagcggccctgaggcccagcgctggctgctggcactctgtcaccgggcccggaatcagagcttcttcgacaccctgcaggaaggctggcccacgctgtgtttcgtggagaccctccagcgctggatggagagccccagctgcgcccgcctggggcctgacctctgctgcggccactcggacttcccctgggccccccagtttttcctgcactgcctgaaaatgatggctctggagcaaggccccgatggcacccaggacctgggactccgctttgatgcccatggcagcctggccgccctggtcctacaattccagaccaacttccggaacagtccggactacaaccagacccagctcttctacaatgaggtcagccactggctggcagcggagctgggcatggcacctccaggcctccgccgtggttggttcactagccgtctagagctgtatagcctgcagcacagcctgagcactgagcctgctgtggtgctgggcctggctttggcgctggcctttgccacactgctcctgggcacctggaatgttcccctcagcctattctccgtggcagctgtggcaggcaccgtgctgctcactgtaggactcctggttctcctcgagtggcagctcaacactgccgaggccctgtttctctctgcctcagtgggcctctcagtagacttcactgtcaactactgcatctcctatcacctgtgcccacaccctgaccgcctgagccgtgtggccttctctctgcgccagaccagctgcgccacagccgtgggggctgcagccctgtttgcggcaggcgtgctcatgctgcctgccacagtgctgctctatcgcaagctgggcatcatcctcatgatggtcaaatgcgtcagttgtggctttgccagcttcttcttccaatctctctgctgtttcttcgggccagagaagaactgtgggcagatcctctggccctgtgcccacctgccatgggatgctggtactggggaccctggtggggagaaggcaggccgcccacgaccagggtcagtgggagggatgcccgggtcctgctcagagcaatatgagctacagcccctggcacggcgtcggagccccagctttgacaccagcacagccaccagcaagctgtcccaccggccctcagtactctctgaggatctgcagctccatgatggtccgtgctgttcccggcccccaccagcccctgcctccccaagggagctgctgctggaccaccaggcagtcttcagccagtgccctgccctgcagacctcctccccctataagcaggctggccccagccccaaaacccgggccaggcaggactcccaaggggaggaggctgagcccctgccagcctcaccagaagccccagcccactctcctaaggccaaggctgcagatcctcctgatggcttctgttcctcagccagcaccctggaggggctcagcgtctctgatgagacctgcctaagcacctctgagcccagtgcccgtgtaccagattccgtgggtgtgtccccagatgacctggatgacactgggcagccagtccttgagcgaggccagctcaatgggaagcgggacaccctgtggctggcgctgagggagacagtgtatgacccatcattgcccgcttcccatcacagcagcttgtcctggaagggccgaggggggccaggggatggcagccctgtggtgctgcccaatagccagccagacctgccagatgtttggctgcgcaggcccagcactcacacgtcaggctatagcagctgagggggacccggggaggctggacagggcgcggaaccctgtcatggatgacaaggcaagggcagcaataggctggagcccgaaggtatttctccagatccacagggagaggtctcaccctccagctgtggatgttaaaccctgccagatgtcccagccttgatctgtctgctcctactcctcacatctggaggattccagcaggaggggttttggaggggacctgcttgcgacctgctgagggcttgtctgctcccacagcaccatctaagacccctcctctagaagtggggaaggccagatgtgtagcttcgggtatcagaggaggctgacctggcccccatcccaagttacaagaacttcagtgagactaagggacccccatcctagggatcttgtcagggttccttactgaccagaggagcccgcagcaatctccacagcctcctgggtctcacccctttcatgggctcttcatcaggacacttccctctcttttgggagcttctctgggcagaattgggctgggacctctctccccaactgccctgctctcctcatactcaccggtttgaccagaaattctccaaatccagccatagatggctgctgggtgtgcagcaggagaaggaggatggtcagccttggagcatctctcaattacgggacagtccctctttggaagcaggctcctgtgctttcctgtgttaataaacagtaataatcctttccatctctgcacattttag

SEQ ID NO: 87285 - DNA, 4140 bp, Homo sapiens
tcaggaaggggacattgggtgacccaccccaaggcaggtcagaggggcttgccaaggaaggctccctggggagtggtctctggcctcctctgagtcttccaaccctaatggtgcctggcatagatattctctccacttcagctcgagctcccacaacactctgaggcctgcacccagaggcagtgcccaggagagcgctgtccggcctcggagaatggtggagcccctggaggacagaaggcaagagaacttcttctgtggcccccctgagaagagctatgcaaagctggtgttcatgtccacctcctcgggcagcctatggaacctgcatgccatccattccatgtgtcgcatggaacaggaccagatccgctcccataccagcttcggggctctgtgccagcggacagcagccaaccagtgctgccccagctggtccctgggcaactatctggctgtgctctccaaccgctcctcctgcctggacactacccaagctgacgcagcccgcacactggccctgcttcggacctgtgccctctactaccacagtggcgccttggtgccctcttgtctgggacctgggcagaacaagtccccacgctgtgcccaggttcccaccaagtgctcccagagtagtgccatctaccaactcctgcactttctgcttgacagggactttctgagtccccagaccactgactaccaggtgccttccctcaagtacagcctgctcttcctgcccaccccaaagggtgcttccctcatggacatctacctggaccggctggccaccccctgggggcttgctgacaactacacctctgtcactggcatggacctgggcctcaagcaggagctgctgaggcacttcctggtccaggacacggtgtaccccttgctggctctggttgccatcttcttcggcatggccctgtacctgcgctcactcttcctcacgctcatggtgctgctgggggtgctgggctcactgctggtggccttcttcctttaccaggtggccttccgcatggcctacttccccttcgtcaatctggcagccctcctcctgctgagcagcgtctgcgccaaccacacgctcatcttcttcgacctgtggcgccttagcaagagccagctgccgtcgggggggctggcgcagcgcgtgggccgcaccatgcaccacttcggctacctgctgctggtctccggcctcaccacgagcgcggccttctatgccagctacctgagccgcctgccggccgttcgctgcctcgccctcttcatgggcacggctgtgctggtgcacctggcgctcacgctggtctggctgcccgcctccgccgtgctccacgagcgctacctggcgcgcggctgtgcgcgccgggcgcggggccggtgggagggcagcgcgccccggcggctactgctggcgctgcaccggcggctccgcggcctgcggagggcggcggctggcacctcgcgtctgctcttccagcgcctgctgccctgcggcgtcatcaagttccgctacatctggatctgctggttcgcagcactggcggcagggggcgcctacatcgccggagtcagcccccgcctgcggctgcccacgctgccgccgcccggcggccaggtcttccggcccagccaccccttcgagcgcttcgacgcggagtatcgccagctgttcctgttcgagcagctgccgcagggcgagggcggccacatgcccgtggttttggtgtggggcgtcctgcctgtggacactggcgaccctctggaccctcgtagcaacagcagcctggtgagggaccctgccttctcggccagcggccctgaggcccagcgctggctgctggcactctgtcaccgggcccggaatcagagcttcttcgacaccctgcaggaaggctggcccacgctgtgtttcgtggagaccctccagcgctggatggagagccccagctgcgcccgcctggggcctgacctctgctgcggccactcggacttcccctgggccccccagtttttcctgcactgcctgaaaatgatggctctggagcaaggccccgatggcacccaggacctgggactccgctttgatgcccatggcagcctggccgccctggtcctacaattccagaccaacttccggaacagtccggactacaaccagacccagctcttctacaatgaggtcagccactggctggcagcggagctgggcatggcacctccaggcctccgccgtggttggttcactagccgtctagagctgtatagcctgcagcacagcctgagcactgagcctgctgtggtgctgggcctggctttggcgctggccttctctctgcgccagaccagctgcgccacagccgtgggggctgcagccctgtttgcggcaggcgtgctcatgctgcctgccacagtgctgctctatcgcaagctgggcatcatcctcatgatggtcaaatgcgtcagttgtggctttgccagcttcttcttccaatctctctgctgtttcttcgggccagagaagaactgtgggcagatcctctggccctgtgcccacctgccatgggatgctggtactggggaccctggtggggagaaggcaggccgcccacgaccagggtcagtgggagggatgcccgggtcctgctcagagcaatatgagctacagcccctggcacggcgtcggagccccagctttgacaccagcacagccaccagcaagctgtcccaccggccctcagtactctctgaggatctgcagctccatgatggtccgtgctgttcccggcccccaccagcccctgcctccccaagggagctgctgctggaccaccaggcagtcttcagccagtgccctgccctgcagacctcctccccctataagcaggctggccccagccccaaaacccgggccaggcaggactcccaaggggaggaggctgagcccctgccagcctcaccagaagccccagcccactctcctaaggccaaggctgcagatcctcctgatggcttctgttcctcagccagcaccctggaggggctcagcgtctctgatgagacctgcctaagcacctctgagcccagtgcccgtgtaccagattccgtgggtgtgtccccagatgacctggatgacactgggcagccagtccttgagcgaggccagctcaatgggaagcgggacaccctgtggctggcgctgagggagacagtgtatgacccatcattgcccgcttcccatcacagcagcttgtcctggaagggccgaggggggccaggggatggcagccctgtggtgctgcccaatagccagccagacctgccagatgtttggctgcgcaggcccagcactcacacgtcaggctatagcagctgagggggacccggggaggctggacagggcgcggaaccctgtcatggatgacaaggcaagggcagcaataggctggagcccgaaggtatttctccagatccacagggagaggtctcaccctccagctgtggatgttaaaccctgccagatgtcccagccttgatctgtctgctcctactcctcacatctggaggattccagcaggaggggttttggaggggacctgcttgcgacctgctgagggcttgtctgctcccacagcaccatctaagacccctcctctagaagtggggaaggccagatgtgtagcttcgggtatcagaggaggctgacctggcccccatcccaagttacaagaacttcagtgagactaagggacccccatcctagggatcttgtcagggttccttactgaccagaggagcccgcagcaatctccacagcctcctgggtctcacccctttcatgggctcttcatcaggacacttccctctcttttgggagcttctctgggcagaattgggctgggacctctctccccaactgccctgctctcctcatactcaccggtttgaccagaaattctccaaatccagccatagatggctgctgggtgtgcagcaggagaaggaggatggtcagccttggagcatctctcaattacgggacagtccctctttggaagcaggctcctgtgctttcctgtgttaataaacagtaataatcctttccatctctgcacattttag

SEQ ID NO: 87286 - DNA, 336 bp, Homo sapiens
caagctcagccaccaacttaaaaaggactggacaatacttttaccactttcccttctcagaattcaggcctgtcctcggaatgctacaaggtacagcccatttgagctcctttttattaggccccagtctcattccagacaccagacgaacttaaactgtgcccccaaataacttgtcatccctactatcttctgtctagtcatactcctattcaccattctcaactactcatacatgccctgctcttgtttacactgccggtttacactgtttctccaagccatcacagctgatatctcctcgtgctatccccaaactgccactcttaactcttg

SEQ ID NO: 87287 - DNA, 159 bp, Homo sapiens
cgcttctcttgaacagttttgagtcagagatttagaccatggagtttttagctagaatgaaaattataatcatttgtgaaatttttacaaagatttggacgtaatcacaggtctactgacttaaatattcaggggtgttggacctagacagataacttt

SEQ ID NO: 87288 - DNA, 608 bp, Homo sapiens
cacctgagtactccccaaacccacagcaacacagcatgggctgcaagagatactgttgctcacacccttgcaccacagcccccagtagaagttcttgctcctaaaacagcgctgggagttcaagatgatctcatccaatatcacctcataacagatggggaaaggcaggcataagaaaggtcatgtgtttgcactttgttagtaccagggatatatatatatgttagttttcatgcagtcaactttgtaggaggtactaagaatactataatcatagtttaaagcaggaaggaactttaaagtttagctactctggcacttttcaacctccacactagggtgtcaagatgtgatgtaagctctcttgcaaatattccataattcatttgatgaatatttattgagcacctagaatatgctgtgcattagggacataagtcagataccacccctgccctcaggacttcatgcagtaatgaggaagggtgacagtaataatcacaagcctaatagtagagtcttattgttgcaagtgaattgtttttttaattttcaatattttttttagagacagggtcttgctctgtcacccaggctgaaaaaaaaaa

SEQ ID NO: 87289 - DNA, 7055 bp, Homo sapiens
agccggcgagcggcagcagctccgggctcgagagcccgcgcccatgccagtgcccatgcggggccgccgccagtgacgccggagaggtgttccccccacactggggctcccactactgcgaggagtgacccacgaaggccacagagatggccggggcttcggtgaaggtggcggtgcgggtccgccccttcaattcccgggaaatgagccgtgactccaagtgcatcattcagatgtctggaagcaccaccaccattgttaaccccaaacagcccaaggagacgcccaaaagcttcagctttgactactcctactggtcgcacacctcacctgaggacatcaactacgcgtcgcagaagcaggtgtaccgggacatcggcgaggagatgctgcagcatgcctttgagggatacaacgtgtgcatcttcgcctatgggcagacgggtgccggcaagtcctacaccatgatgggcaagcaggagaaggaccagcagggcatcatcccacagctctgcgaggacctcttctctcggatcaacgacacgaccaacgacaacatgtcctactccgtggaggtcagctacatggagatttactgtgagcgcgtccgtgacctcctgaaccccaagaacaagggcaaccttcgcgtgagggagcacccactgctggggccctacgtggaggacctctccaagctggctgtcacctcctacaatgacatccaggacctcatggactcagggaacaaggccaggaccgtggcggccaccaacatgaatgagaccagcagtcgctcccacgccgtcttcaacatcatcttcacccagaagcgccatgacgcagagaccaatatcaccacggagaaggtgagcaaaatcagcctggtggacctggctgggagcgagcgggctgactccacgggagccaagggcacgcgcctcaaggagggggccaacatcaacaagtcgctgaccaccctgggcaaggtcatctccgccctggctgaaatggactccggacccaacaagaacaagaaaaagaagaagacagatttcattccgtaccgagattccgtgttgacctggctcctccgggaaaacctgggcggtaactcaaggacagctatggtggcagccctgagtcctgcagacatcaactacgatgagacccttagcacgctgaggtatgctgaccgggccaagcagatccgctgcaatgctgtcatcaatgaggaccccaacaacaagctgatccgcgagctgaaggatgaggtgacccggctgcgggaccttctgtacgcccagggtcttggcgacatcactgacatgaccaatgccctggtgggtatgagcccctcatcctcgctctcagccctgtccagccgcgcggcctccgtgtccagcctccacgagcgcatcttgtttgccccgggcagcgaggaggccattgaaagactgaaggaaacagagaagatcatagctgagctcaatgagacctgggaggagaagctgcggcggacagaagccatccggatggagagggaagccctgctggccgagatgggtgtggccatgagggaggatggcggcaccttgggcgtattctctcccaaaaagacaccacacctcgtcaacctgaacgaggacccgctgatgtctgagtgcctgctctactacatcaaggatgggatcaccagagtgggcagggaggatggcgagaggcggcaggacattgttctgagtgggcacttcatcaaggaggagcactgcgtcttccggagcgactccaggggaggcagcgaagctgtggtgaccttggagccctgtgagggggcagacacctacgtcaatggcaagaaagtcacagagcccagcatcctgcgttcaggaaaccgcatcatcatgggtaagagccatgtgttccggttcaaccaccccgagcaggcccggcaggagcgtgagcgcacgccttgtgcggagacgccagctgagcctgtggactgggccttcgcccagcgtgagctgctggagaagcagggcatcgacatgaagcaggagatggagcagaggctccaggaactggaggaccagtaccgccgcgagcgggaggaggccacctacctgctggagcagcagcggctggactatgagagcaagctggaggctctgcagaagcagatggactccaggtactacccggaggtgaacgaggaggaggaggagcccgaggatgaagtccagtggacagagcgggagtgtgagctggcgctctgggccttccggaagtggaagtggtaccagttcacgtctctgcgggacctgctgtggggcaacgccatcttcctcaaggaggctaatgccatcagcgtggagctgaaaaagaaggtacaattccagtttgtcctcctgacggacacactctactcccctctgccacccgacctgctgcccccagaggccgccaaagaccgagagacgcggcccttcccccgcaccattgtggccgtggaggtccaggaccagaagaacggggccacccactactggacgctggagaagctcaggcagcgtctggacctgatgcgggagatgtacgaccgcgctgcagaggtgccctccagtgtcatcgaggactgtgacaacgtggtgaccggcggagaccccttctatgaccgcttcccctggttccggctggtgggcagggccttcgtgtacctgagcaacctgctgtaccccgttcccctggtacaccgtgtggcaatcgtcagcgagaagggcgaggtgaagggcttcctccgcgtggccgtccaggccatctcagccgatgaagaggcccctgattatggctctggcgtccgccagtcgggaactgctaaaatctcctttgatgaccagcattttgaaaagttccagtccgagtcttgccccgtggtggggatgtcccgctcgggaacctcccaggaagagcttcgcatcgtggagggccagggccagggtgcagacgtggggccctcagccgatgaagtcaacaacaacacctgttcagcagtgcccccagaaggcctcctcctagacagctctgagaaagccgccctggatgggcccctggatgctgccctggaccacctccgcctgggcaacaccttcaccttccgtgtgacagtcctgcaggcgtccagcatctctgccgaatatgccgacatcttctgccagttcaacttcatccaccgccacgacgaggccttctccacagagcccctgaagaacacaggcagaggccccccacttggcttctaccacgtccagaacatcgcagtggaggtgaccaagtccttcattgagtacatcaagagccagcccattgttttcgaggtctttggccactaccagcagcacccgttcccgcccctctgcaaggacgtgctcagccccctgaggccctcgcgccgccacttccctcgggtcatgccactgtccaagccagtgcccgccaccaagctcagcacactgacgcggccctgtccgggaccctgccactgcaagtacgacctgctggtctacttcgagatctgtgagctggaggccaacggcgattacatcccggccgtggtggaccaccgtgggggcatgccatgcatggggaccttcctcctccaccagggcatccagcgacggattacggtgacactactgcatgagacaggcagccatatccgctggaaggaagtgcgcgagctggtcgtgggccgcatccgaaacactccagagaccgacgagtccctgatcgaccccaacatcttgtctctcaacatcctctcttccggatacatccacccagcccaagatgaccggaccttttaccaatttgaggctgcgtgggacagctccatgcacaactctctcctgctgaaccgggtcaccccttatcgagagaaaatctacatgacactctccgcttatatcgagatggagaactgcacccagccggctgttgtcaccaaggacttctgcatggtcttctattcccgtgatgccaagctgccagcctcgcgctccatccgcaacctctttggcagtgggagccttcgggcctcagagagtaaccgtgtgactggtgtgtacgagctcagcctgtgccacgtggctgacgcgggcagcccagggatgcagcgccggcgccgacgagtcctggacacatctgtggcctatgtccggggcgaggagaacctggcaggctggaggccccggagtgacagtctcattctggaccaccagtgggagctggagaagctgagcctcctgcaggaggtggagaagactaggcactacctgctcctgcgggagaagctggagaccgcccagcggcctgtcccggaggcactgtccccggccttcagcgaggactctgagtcccatggctcctccagcgcctcctccccgctctcggctgagggccgcccatcacccctggaggctcccaacgagaggcagcgggagctggccgtcaagtgcttgcgcctgctcacgcacacattcaacagagagtacacacacagccacgtctgcgtcagtgccagcgagagcaagctctccgagatgtctgtcaccctgctccgggacccgtcgatgtcccctctaggggtggccactctcaccccctcctccacttgcccctctctggttgaagggcggtacggtgccactgacctgaggaccccgcagccctgctcccggccagccagcccagagcccgagctgctgccagaggccgactccaagaagctcccttcccctgcccgggcaacagagacagacaaggagccccagcgcctgctggtccctgacatccaggagatccgagtcagcccgatcgtttccaagaaggggtacctgcacttcctggagccgcacacgtcaggctgggccaggcgcttcgtggtggtgcggcgcccctatgcctacatgtacaacagcgacaaggacaccgtggagcggttcgtgctcaacctggccactgcccaggtggagtacagtgaggaccagcaggctatgctcaagacacccaacacattcgcggtgtgcacggaacaccgcggcatcctgctgcaggccgccagcgacaaggacatgcatgactggctgtacgccttcaaccccctcctggccgggaccatacggtccaagctctccagaaggaggtctgcccagatgcgggtctgaacctgagccctcccgtgacagccggcaggcccagcccatcccctccctcatcctcgtctgtcctgtcacctgccgcccagcccctctcctgccagacagcccacgaccgggtcgaccccccaggggacgcccatgccaggcccggggacctgtgccacacgaccagctgtgctcccagcagaggctgtgcgtgtcagttcttcttgcagaatgtgctctggtggaacaagttgggagaggctgggggggccaagggcacaggttacgggggttcttgctgccgttctaatatttttttaagcatagacagacttataattaatatacgttagttagtgacattgaaacagtcaactcggaaattaactataagacttgttctatttataagtatttatttctaatgcctccacatagccctgtaatattcagatggaacccccaaccacctccaccctgtttgttcccacatgtgtctcccaagcctgctagggacaggcagggcagggacagccaccttggaaggccgcagtgaggagctgtctggaccagtggggcaccttggggctagcacacgggtgtatcgcctgggccccaggcttctccatggccacatgggtcctgggtgtatgtgtgggagagtgggggggtgtctttggtgcctgaagtctgcgcggcatggagggtggtgtgagttcctctggtgggagggagaacgcacatctcttctgggcggccacctgaggagtgactccaagaagagttccggcagctttccccaggaaagggtgaggggtgacactcggctctggctctgagatgaggcagacggcacccaggctgtgatctgtcctgggcggggaccaggagggagcggggtcgggatcacctgccagtgtgcagactctgggactgcgtgctgtctccggaccatcagggtagggtggtgggttgagaccaggaagtcagggaagatcggaattcagggcgacggtctaggtgtcgagggctgtggcgcagcctcttcagctgcggcgagaaatggagtgagtcaaggtagcttctgggaagaaatgctgccattagcaggtttcttgcaaagactttcctctctttgttcccagggcagagagtttctgtgagtcccactgagaaaatcccatggggtgggggtatcctggtcggtcggcaatggagggtggctggcttggtggttattgtcttcaaggagctcttcgctgctgcatctgcggtgtccctttgttcttgtcccatttcaccccctctgcagacaccaatgtccgagggccacccaggacaggacgggggtcagccccaagctgagagtctggtcataggagtcatgtccagaggcctagggaggttttagggccctccccacccacacccacaggtcgatttggtctctttttagctcaaggaaagacagtagccaagcaacagagcccctctcccgccgtggcccgtgggagcagttacatcgggtctggtgctccagacctagggcccagcactttcatcagatcctgcctcctggagtgggggaaacgcagcaccccactggttctgaggcccctaccctcccaggctgtcccacgtgatgctgacatgagcctcagagaccccaatcccatgcctgggggtccctgagtggcaaaacatcctacagtggatagtcatacacaacaaaagataatcctgctcaaaatgccaacagtgttcccattgagaaacactgaattactgatccttcacaggtcagttcaaatcatacttgtctttagaaacagttctttatgttaaccctaagcccgg

SEQ ID NO: 87290 - DNA, 912 bp, Homo sapiens
acccacgcgtcggacccacgcggtcggcctccactgccatggagactgcctggctgtgtcctctcagccaggtgccgtgttggccttggctaggacccagagccacactgcagcctccgccgactccctccttccgggcctgctctagtgaggagtgcctaagccaggacccagaaactcagagttgatggtgagaggaggccgcctgagtcaggacacctggcttcttgaaaagttcgctctgccagaaaccacctagggaccacgttagctgccttccttgagctccccaggagtcggtttccacatctgtgaggtggagggctggtgtggaggtgctcatggggtgcggtgcttgggagacagccaggcccagggtggctgctgcttcctgctaagtgggggaggtgagacagatctggaaagccgtctccctcagatggtttcatttaatgctttatactgccgatggagactgcctggctgtgtcctctcagccaggtgccgtgtgtggcttgtgtaggacccagaggcacactgcagcctccgcgactcctccttccgggctgctctagtgaggagtgcctaggccaggacccagaaactcagagttgatggtgagaggaggcggctgagtcaggacaccgtggttcttgaagaagtcggtctggcagaaagcactagggacaacgtaagctggcttcttgaagtccccgggagtcggtttccccccttctgtgagtgggaggctggccgcggacggcgccaaggggagtggggggcctgggaaacacgcgagccgcgggaaaaggggggaccttcccgggcggccagaagaactggggaaccggggccagggcacccaccttgggacaccttgggacacagagaagcataggggaacacaacaac

SEQ ID NO: 87291 - DNA, 717 bp, Homo sapiens
gtaaggccttgtgtcctgtctgaaggtggagaagactaggcactacctgctcctgcgggagaagctggagaccgcccagcggcctgtcccggaggcactgtccccggccttcagcgaggactctgagtcccatggctcctccagcgcctcctccccgctctcggctgagggccgcccatcacccctggaggctcccaacgagaggcagcgggagctggccgtcaagtgcttgcgcctgctcacgcacacattcaacagagagtacacacacagccacgtctgcgtcagtgccagcgagagcaagctctccgagatgtctgtcaccctgctccgggacccgtcgatgtcccctctaggggtggccactctcaccccctcctccacttgcccctctctggttgaagggcggtacggtgccactgacctgaggtgagtgagctccaggctcccggagtggcttctggcaccacggctgacccatgaccatggccgtgactcgggcacagagagcacagaacagggggccccaatggccgagtgccttggggtggccacaggctgagggaagggcctggaggagtggagtccgcagccctctcagagggtgcctgtgccccgccagctccatcctagtgtgtgtgtgttctcttccctgaagaagaccagaaatgggtggaaaataagctaaagctcccctttcctgagacagtgcttata

SEQ ID NO: 87292 - DNA, 412 bp, Homo sapiens
gggttcccagggcacagccgagatggccatgggacgccgggctggataacttcctatggaagaggcctacatggctctttgggccccagggtggaccaaggaccaggggaagcccatctccactccagaggggagacagcttcacagatgggcggacctctaggatgggtgggaggagcagccacccatcaggtaggggtggaatgtccacgtgccccatgcagggatgcagcgccggcgccgacgagtcctggacacatctgtggcctatgtccggggcgaggagaacctggcaggctggaggccccggagtgacagtctcattctggaccaccagtgggagctggagaagctgagcctcctgcaggaggtgaggcagcctcagaggatgaggcccgcacggtggtgtcca

SEQ ID NO: 87293 - DNA, 8846 bp, Homo sapiens
agccggcgagcggcagcagctccgggctcgagagcccgcgcccatgccagtgcccatgcggggccgccgccagtgacgccggagaggtgttccccccacactggggctcccactactgcgaggagtgacccacgaaggccacagagatggccggggcttcggtgaaggtggcggtgcgggtccgccccttcaattcccgggaaatgagccgtgactccaagtgcatcattcagatgtctggaagcaccaccaccattgttaaccccaaacagcccaaggagacgcccaaaagcttcagctttgactactcctactggtcgcacacctcacctgaggacatcaactacgcgtcgcagaagcaggtgtaccgggacatcggcgaggagatgctgcagcatgcctttgagggatacaacgtgtgcatcttcgcctatgggcagacgggtgccggcaagtcctacaccatgatgggcaagcaggagaaggaccagcagggcatcatcccacagctctgcgaggacctcttctctcggatcaacgacacgaccaacgacaacatgtcctactccgtggaggtcagctacatggagatttactgtgagcgcgtccgtgacctcctgaaccccaagaacaagggcaaccttcgcgtgagggagcacccactgctggggccctacgtggaggacctctccaagctggctgtcacctcctacaatgacatccaggacctcatggactcagggaacaaggccaggaccgtggcggccaccaacatgaatgagaccagcagtcgctcccacgccgtcttcaacatcatcttcacccagaagcgccatgacgcagagaccaatatcaccacggagaaggtgagcaaaatcagcctggtggacctggctgggagcgagcgggctgactccacgggagccaagggcacgcgcctcaaggagggggccaacatcaacaagtcgctgaccaccctgggcaaggtcatctccgccctggctgaaatggactccggacccaacaagaacaagaaaaagaagaagacagatttcattccgtaccgagattccgtgttgacctggctcctccgggaaaacctgggcggtaactcaaggacagctatggtggcagccctgagtcctgcagacatcaactacgatgagacccttagcacgctgaggtatgctgaccgggccaagcagatccgctgcaatgctgtcatcaatgaggaccccaacaacaagctgatccgcgagctgaaggatgaggtgacccggctgcgggaccttctgtacgcccagggtcttggcgacatcactgacaccaacactgtgcctggaggacccaaattgaccaatgccctggtgggtatgagcccctcatcctcgctctcagccctgtccagccgcgcggcctccgtgtccagcctccacgagcgcatcttgtttgccccgggcagcgaggaggccattgaaagactgaaggaaacagagaagatcatagctgagctcaatgagacctgggaggagaagctgcggcggacagaagccatccggatggagagggaagccctgctggccgagatgggtgtggccatgagggaggatggcggcaccttgggcgtattctctcccaaaaagacaccacacctcgtcaacctgaacgaggacccgctgatgtctgagtgcctgctctactacatcaaggatgggatcaccagagtgggcagggaggatggcgagaggcggcaggacattgttctgagtgggcacttcatcaaggaggagcactgcgtcttccggagcgactccaggggaggcagcgaagctgtggtgaccttggagccctgtgagggggcagacacctacgtcaatggcaagaaagtcacagagcccagcatcctgcgttcaggaaaccgcatcatcatgggtaagagccatgtgttccggttcaaccaccccgagcaggcccggcaggagcgtgagcgcacgccttgtgcggagacgccagctgagcctgtggactgggccttcgcccagcgtgagctgctggagaagcagggcatcgacatgaagcaggagatggagcagaggctccaggaactggaggaccagtaccgccgcgagcgggaggaggccacctacctgctggagcagcagcggctggactatgagagcaagctggaggctctgcagaagcagatggactccaggtactacccggaggtgaacgaggaggaggaggagcccgaggatgaagtccagtggacagagcgggagtgtgagctggcgctctgggccttccggaagtggaagtggtaccagttcacgtctctgcgggacctgctgtggggcaacgccatcttcctcaaggaggctaatgccatcagcgtggagctgaaaaagaaggtacaattccagtttgtcctcctgacggacacactctactcccctctgccacccgacctgctgcccccagaggccgccaaagaccgagagacgcggcccttcccccgcaccattgtggccgtggaggtccaggaccagaagaacggggccacccactactggacgctggagaagctcaggcagcgtctggacctgatgcgggagatgtacgaccgcgctgcagaggtgccctccagtgtcatcgaggactgtgacaacgtggtgaccggcggagaccccttctatgaccgcttcccctggttccggctggtgggcagggccttcgtgtacctgagcaacctgctgtaccccgttcccctggtacaccgtgtggcaatcgtcagcgagaagggcgaggtgaagggcttcctccgcgtggccgtccaggccatctcagccgatgaagaggcccctgattatggctctggcgtccgccagtcgggaactgctaaaatctcctttgatgaccagcattttgaaaagttccagtccgagtcttgccccgtggtggggatgtcccgctcgggaacctcccaggaagagcttcgcatcgtggagggccagggccagggtgcagacgtggggccctcagccgatgaagtcaacaacaacacctgttcagcagtgcccccagaaggcctcctcctagacagctctgagaaagccgccctggatgggcccctggatgctgccctggaccacctccgcctgggcaacaccttcaccttccgtgtgacagtcctgcaggcgtccagcatctctgccgaatatgccgacatcttctgccagttcaacttcatccaccgccacgacgaggccttctccacagagcccctgaagaacacaggcagaggccccccacttggcttctaccacgtccagaacatcgcagtggaggtgaccaagtccttcattgagtacatcaagagccagcccattgttttcgaggtctttggccactaccagcagcacccgttcccgcccctctgcaaggacgtgctcagccccctgaggccctcgcgccgccacttccctcgggtcatgccactgtccaagccagtgcccgccaccaagctcagcacactgacgcggccctgtccgggaccctgccactgcaagtacgacctgctggtctacttcgagatctgtgagctggaggccaacggcgattacatcccggccgtggtggaccaccgtgggggcatgccatgcatggggaccttcctcctccaccagggcatccagcgacggattacggtgacactactgcatgagacaggcagccatatccgctggaaggaagtgcgcgagctggtcgtgggccgcatccgaaacactccagagaccgacgagtccctgatcgaccccaacatcttgtctctcaacatcctctcttccggatacatccacccagcccaagatgaccggaccttttaccaatttgaggctgcgtgggacagctccatgcacaactctctcctgctgaaccgggtcaccccttatcgagagaaaatctacatgacactctccgcttatatcgagatggagaactgcacccagccggctgttgtcaccaaggacttctgcatggtcttctattcccgtgatgccaagctgccagcctcgcgctccatccgcaacctctttggcagtgggagccttcgggcctcagagagtaaccgtgtgactggtgtgtacgagctcagcctgtgccacgtggctgacgcgggcagcccagggatgcagcgccggcgccgacgagtcctggacacatctgtggcctatgtccggggcgaggagaacctggcaggctggaggccccggagtgacagtctcattctggaccaccagtgggagctggagaagctgagcctcctgcaggaggtggagaagactaggcactacctgctcctgcgggagaagctggagaccgcccagcggcctgtcccggaggcactgtccccggccttcagcgaggactctgagtcccatggctcctccagcgcctcctccccgctctcggctgagggccgcccatcacccctggaggctcccaacgagaggcagcgggagctggccgtcaagtgcttgcgcctgctcacgcacacattcaacagagagtacacacacagccacgtctgcgtcagtgccagcgagagcaagctctccgagatgtctgtcaccctgctccgggacccgtcgatgtcccctctaggggtggccactctcaccccctcctccacttgcccctctctggttgaagggcggtacggtgccactgacctgaggaccccgcagccctgctcccggccagccagcccagagcccgagctgctgccagaggccgactccaagaagctcccttcccctgcccgggcaacagagacagacaaggagccccagcgcctgctggtccctgacatccaggagatccgagtcagcccgatcgtttccaagaaggggtacctgcacttcctggagccgcacacgtcaggctgggccaggcgcttcgtggtggtgcggcgcccctatgcctacatgtacaacagcgacaaggacaccgtggagcggttcgtgctcaacctggccactgcccaggtggagtacagtgaggaccagcaggctatgctcaagacacccaacacattcgcggtgtgcacggaacaccgcggcatcctgctgcaggccgccagcgacaaggacatgcatgactggctgtacgccttcaaccccctcctggccgggaccatacggtccaagctctccagaaggaggtctgcccagatgcgggtctgaacctgagccctcccgtgacagccggcaggcccagcccatcccctccctcatcctcgtctgtcctgtcacctgccgcccagcccctctcctgccagacagcccacgaccgggtcgaccccccaggggacgcccatgccaggcccggggacctgtgccacacgaccagctgtgctcccagcagaggctgtgcgtgtcagttcttcttgcagaatgtgctctggtggaacaagttgggagaggctgggggggccaagggcacaggttacgggggttcttgctgccgttctaatatttttttaagcatagacagacttataattaatatacgttagttagtgacattgaaacagtcaactcggaaattaactataagacttgttctatttataagtatttatttctaatgcctccacatagccctgtaatattcagatggaacccccaaccacctccaccctgtttgttcccacatgtgtctcccaagcctgctagggacaggcagggcagggacagccaccttggaaggccgcagtgaggagctgtctggaccagtggggcaccttggggctagcacacgggtgtatcgcctgggccccaggcttctccatggccacatgggtcctgggtgtatgtgtgggagagtgggggggtgtctttggtgcctgaagtctgcgcggcatggagggtggtgtgagttcctctggtgggagggagaacgcacatctcttctgggcggccacctgaggagtgactccaagaagagttccggcagctttccccaggaaagggtgaggggtgacactcggctctggctctgagatgaggcagacggcacccaggctgtgatctgtcctgggcggggaccaggagggagcggggtcgggatcacctgccagtgtgcagactctgggactgcgtgctgtctccggaccatcagggtagggtggtgggttgagaccaggaagtcagggaagatcggaattcagggcgacggtctaggtgtcgagggctgtggcgcagcctcttcagctgcggcgagaaatggagtgagtcaaggtagcttctgggaagaaatgctgccattagcaggtttcttgcaaagactttcctctctttgttcccagggcagagagtttctgtgagtcccactgagaaaatcccatggggtgggggtatcctggtcggtcggcaatggagggtggctggcttggtggttattgtcttcaaggagctcttcgctgctgcatctgcggtgtccctttgttcttgtcccatttcaccccctctgcagacaccaatgtccgagggccacccaggacaggacgggggtcagccccaagctgagagtctggtcataggagtcatgtccagaggcctagggaggttttagggccctccccacccacacccacaggtcgatttggtctctttttagctcaaggaaagacagtagccaagcaacagagcccctctcccgccgtggcccgtgggagcagttacatcgggtctggtgctccagacctagggcccagcactttcatcagatcctgcctcctggagtgggggaaacgcagcaccccactggttctgaggcccctaccctcccaggctgtcccacgtgatgctgacatgagcctcagagaccccaatcccatgcctgggggagagacagcggctcaggagtgggggagcacgggccttctacaccacatgggaaggctctggcatgaggttttcctttgggaaggttgtttgggcccctgaagttccatctccgagagtggtgtgcagggcaggccagggcccatgctggctgcagtctctgtggctgcctgcctgggccagcctgtttgggagctgggactgtgggctcgccttttcgtacctgggctcaggtgcggtgtggccaccgccaccctcatcccctgcctgggaggctctcccaggggctgatgggggggttctgtgagggagaatcagggctcgggaagccacgcctgggaaggcaggacacaggacacagcagctttctttggaaatctcccaggtgaggattcacatcccaaaataaaattcagaagccaggtggcctgtgctccccatgggtgacctctggaggcagtggaccaagatgcagcaaggagaggatgcagaacagcttcttgcagaagcacctgctccggcatccagcgctgcctggaggcaggaaggagaggcagggcaggacacgctggtctgagatgagggggagccccacgggccccaggcaggctagaggaggcacaggccctgccacggccaactcaggtcagccagcctgaggctgtggcctccaaagggtctgggcgcaccccccaggtcgcaggtgtctgaggccagccaacctgcagagcactcgcggcgtgggtgggctgagtggaggtgcctgggagctgcctaaattcagaagcctccactgccatggagactgcctggctgtgtcctctcagccaggtgccgtgttggccttggctaggacccagagccacactgcagcctccgccgactccctccttccgggcctgctctagtgaggagtgcctaagccaggacccagaaactcagagttgatggtgagaggaggccgcctgagtcaggacacctggcttcttgaaaagttcgctctgccagaaaccacctagggaccacgttagctgccttccttgagctccccaggagtcggtttccacatctgtgaggtggagggctggtgtggaggtgctcatggggtgcggtgcttgggagacagccaggcccagggtggctgctgcttcctgctaagtgggggaggtgagacagatctggaaagccgtctccctcagatggtttcatttaatgctttatactgccgagtctgggggcttgttttggtttgggggcagccatcctccaccagaaagggggagctccttccgctgcggctccagatagatggggatgccgggctccaggccgaccagcacttgggatctgatgggacacggccagtgcctaggggtgccaagtccaaggcctcccactgggagtcatcgctgagaagatgccaatgtttcatccaccggctgcacaggcacaaactcccccacccaggacggctgtgatgaggtggccctccctgtcaaccctggtccctggagtccccagcacctggggccctggtggggctgatgtcacaggtgtttactgtgctgctgcactggtcctatgccagcctcacccatgtggggaccacggaaggcacactcccttacccccggtgccgggccgtgcggtcccccagacggacagcagctgtggcgacctgcgtttctccctgggcctgtgcttcctgtagttagtccgtcccctggttcccctgtggctcagaggccgcgtccctggcttgtacatatgtgattgctgtgggcacaccccagaccccatgtcatagctgccgtcccgacgtcacgacgcctgtcccgatgtcttacacccgagtgttagccctaggctcctgtactgtgcgtgcacttgaggctctgtccaattaagaaataaatgtggctcttactcaacacagtc

SEQ ID NO: 87294 - DNA, 7684 bp, Homo sapiens
gttgatggtttctgtttcttgccttctctgggccccatctcttactttttcccatcttcatcttttttctctccctccctctgtctgtctgcccgccctacccctcctccccatagacgtgtccgaccttgagaacaataaccttaaccgtggcgggacggtgaatgaagcccctgaccctctctccacagtgaccaatgccctggtgggtatgagcccctcatcctcgctctcagccctgtccagccgcgcggcctccgtgtccagcctccacgagcgcatcttgtttgccccgggcagcgaggaggccattgaaagactgaaggaaacagagaagatcatagctgagctcaatgagacctgggaggagaagctgcggcggacagaagccatccggatggagagggaagccctgctggccgagatgggtgtggccatgagggaggatggcggcaccttgggcgtattctctcccaaaaagacaccacacctcgtcaacctgaacgaggacccgctgatgtctgagtgcctgctctactacatcaaggatgggatcaccagagtgggcagggaggatggcgagaggcggcaggacattgttctgagtgggcacttcatcaaggaggagcactgcgtcttccggagcgactccaggggaggcagcgaagctgtggtgaccttggagccctgtgagggggcagacacctacgtcaatggcaagaaagtcacagagcccagcatcctgcgttcaggaaaccgcatcatcatgggtaagagccatgtgttccggttcaaccaccccgagcaggcccggcaggagcgtgagcgcacgccttgtgcggagacgccagctgagcctgtggactgggccttcgcccagcgtgagctgctggagaagcagggcatcgacatgaagcaggagatggagcagaggctccaggaactggaggaccagtaccgccgcgagcgggaggaggccacctacctgctggagcagcagcggctggactatgagagcaagctggaggctctgcagaagcagatggactccaggtactacccggaggtgaacgaggaggaggaggagcccgaggatgaagtccagtggacagagcgggagtgtgagctggcgctctgggccttccggaagtggaagtggtaccagttcacgtctctgcgggacctgctgtggggcaacgccatcttcctcaaggaggctaatgccatcagcgtggagctgaaaaagaaggtacaattccagtttgtcctcctgacggacacactctactcccctctgccacccgacctgctgcccccagaggccgccaaagaccgagagacgcggcccttcccccgcaccattgtggccgtggaggtccaggaccagaagaacggggccacccactactggacgctggagaagctcaggcagcgtctggacctgatgcgggagatgtacgaccgcgctgcagaggtgccctccagtgtcatcgaggactgtgacaacgtggtgaccggcggagaccccttctatgaccgcttcccctggttccggctggtgggcagggccttcgtgtacctgagcaacctgctgtaccccgttcccctggtacaccgtgtggcaatcgtcagcgagaagggcgaggtgaagggcttcctccgcgtggccgtccaggccatctcagccgatgaagaggcccctgattatggctctggcgtccgccagtcgggaactgctaaaatctcctttgatgaccagcattttgaaaagttccagtccgagtcttgccccgtggtggggatgtcccgctcgggaacctcccaggaagagcttcgcatcgtggagggccagggccagggtgcagacgtggggccctcagccgatgaagtcaacaacaacacctgttcagcagtgcccccagaaggcctcctcctagacagctctgagaaagccgccctggatgggcccctggatgctgccctggaccacctccgcctgggcaacaccttcaccttccgtgtgacagtcctgcaggcgtccagcatctctgccgaatatgccgacatcttctgccagttcaacttcatccaccgccacgacgaggccttctccacagagcccctgaagaacacaggcagaggccccccacttggcttctaccacgtccagaacatcgcagtggaggtgaccaagtccttcattgagtacatcaagagccagcccattgttttcgaggtctttggccactaccagcagcacccgttcccgcccctctgcaaggacgtgctcagccccctgaggccctcgcgccgccacttccctcgggtcatgccactgtccaagccagtgcccgccaccaagctcagcacactgacgcggccctgtccgggaccctgccactgcaagtacgacctgctggtctacttcgagatctgtgagctggaggccaacggcgattacatcccggccgtggtggaccaccgtgggggcatgccatgcatggggaccttcctcctccaccagggcatccagcgacggattacggtgacactactgcatgagacaggcagccatatccgctggaaggaagtgcgcgagctggtcgtgggccgcatccgaaacactccagagaccgacgagtccctgatcgaccccaacatcttgtctctcaacatcctctcttccggatacatccacccagcccaagatgaccggaccttttaccaatttgaggctgcgtgggacagctccatgcacaactctctcctgctgaaccgggtcaccccttatcgagagaaaatctacatgacactctccgcttatatcgagatggagaactgcacccagccggctgttgtcaccaaggacttctgcatggtcttctattcccgtgatgccaagctgccagcctcgcgctccatccgcaacctctttggcagtgggagccttcgggcctcagagagtaaccgtgtgactggtgtgtacgagctcagcctgtgccacgtggctgacgcgggcagcccagggatgcagcgccggcgccgacgagtcctggacacatctgtggcctatgtccggggcgaggagaacctggcaggctggaggccccggagtgacagtctcattctggaccaccagtgggagctggagaagctgagcctcctgcaggaggtggagaagactaggcactacctgctcctgcgggagaagctggagaccgcccagcggcctgtcccggaggcactgtccccggccttcagcgaggactctgagtcccatggctcctccagcgcctcctccccgctctcggctgagggccgcccatcacccctggaggctcccaacgagaggcagcgggagctggccgtcaagtgcttgcgcctgctcacgcacacattcaacagagagtacacacacagccacgtctgcgtcagtgccagcgagagcaagctctccgagatgtctgtcaccctgctccgggacccgtcgatgtcccctctaggggtggccactctcaccccctcctccacttgcccctctctggttgaagggcggtacggtgccactgacctgaggaccccgcagccctgctcccggccagccagcccagagcccgagctgctgccagaggccgactccaagaagctcccttcccctgcccgggcaacagagacagacaaggagccccagcgcctgctggtccctgacatccaggagatccgagtcagcccgatcgtttccaagaaggggtacctgcacttcctggagccgcacacgtcaggctgggccaggcgcttcgtggtggtgcggcgcccctatgcctacatgtacaacagcgacaaggacaccgtggagcggttcgtgctcaacctggccactgcccaggtggagtacagtgaggaccagcaggctatgctcaagacacccaacacattcgcggtgtgcacggaacaccgcggcatcctgctgcaggccgccagcgacaaggacatgcatgactggctgtacgccttcaaccccctcctggccgggaccatacggtccaagctctccagaaggaggtctgcccagatgcgggtctgaacctgagccctcccgtgacagccggcaggcccagcccatcccctccctcatcctcgtctgtcctgtcacctgccgcccagcccctctcctgccagacagcccacgaccgggtcgaccccccaggggacgcccatgccaggcccggggacctgtgccacacgaccagctgtgctcccagcagaggctgtgcgtgtcagttcttcttgcagaatgtgctctggtggaacaagttgggagaggctgggggggccaagggcacaggttacgggggttcttgctgccgttctaatatttttttaagcatagacagacttataattaatatacgttagttagtgacattgaaacagtcaactcggaaattaactataagacttgttctatttataagtatttatttctaatgcctccacatagccctgtaatattcagatggaacccccaaccacctccaccctgtttgttcccacatgtgtctcccaagcctgctagggacaggcagggcagggacagccaccttggaaggccgcagtgaggagctgtctggaccagtggggcaccttggggctagcacacgggtgtatcgcctgggccccaggcttctccatggccacatgggtcctgggtgtatgtgtgggagagtgggggggtgtctttggtgcctgaagtctgcgcggcatggagggtggtgtgagttcctctggtgggagggagaacgcacatctcttctgggcggccacctgaggagtgactccaagaagagttccggcagctttccccaggaaagggtgaggggtgacactcggctctggctctgagatgaggcagacggcacccaggctgtgatctgtcctgggcggggaccaggagggagcggggtcgggatcacctgccagtgtgcagactctgggactgcgtgctgtctccggaccatcagggtagggtggtgggttgagaccaggaagtcagggaagatcggaattcagggcgacggtctaggtgtcgagggctgtggcgcagcctcttcagctgcggcgagaaatggagtgagtcaaggtagcttctgggaagaaatgctgccattagcaggtttcttgcaaagactttcctctctttgttcccagggcagagagtttctgtgagtcccactgagaaaatcccatggggtgggggtatcctggtcggtcggcaatggagggtggctggcttggtggttattgtcttcaaggagctcttcgctgctgcatctgcggtgtccctttgttcttgtcccatttcaccccctctgcagacaccaatgtccgagggccacccaggacaggacgggggtcagccccaagctgagagtctggtcataggagtcatgtccagaggcctagggaggttttagggccctccccacccacacccacaggtcgatttggtctctttttagctcaaggaaagacagtagccaagcaacagagcccctctcccgccgtggcccgtgggagcagttacatcgggtctggtgctccagacctagggcccagcactttcatcagatcctgcctcctggagtgggggaaacgcagcaccccactggttctgaggcccctaccctcccaggctgtcccacgtgatgctgacatgagcctcagagaccccaatcccatgcctgggggagagacagcggctcaggagtgggggagcacgggccttctacaccacatgggaaggctctggcatgaggttttcctttgggaaggttgtttgggcccctgaagttccatctccgagagtggtgtgcagggcaggccagggcccatgctggctgcagtctctgtggctgcctgcctgggccagcctgtttgggagctgggactgtgggctcgccttttcgtacctgggctcaggtgcggtgtggccaccgccaccctcatcccctgcctgggaggctctcccaggggctgatgggggggttctgtgagggagaatcagggctcgggaagccacgcctgggaaggcaggacacaggacacagcagctttctttggaaatctcccaggtgaggattcacatcccaaaataaaattcagaagccaggtggcctgtgctccccatgggtgacctctggaggcagtggaccaagatgcagcaaggagaggatgcagaacagcttcttgcagaagcacctgctccggcatccagcgctgcctggaggcaggaaggagaggcagggcaggacacgctggtctgagatgagggggagccccacgggccccaggcaggctagaggaggcacaggccctgccacggccaactcaggtcagccagcctgaggctgtggcctccaaagggtctgggcgcaccccccaggtcgcaggtgtctgaggccagccaacctgcagagcactcgcggcgtgggtgggctgagtggaggtgcctgggagctgcctaaattcagaagcctccactgccatggagactgcctggctgtgtcctctcagccaggtgccgtgttggccttggctaggacccagagccacactgcagcctccgccgactccctccttccgggcctgctctagtgaggagtgcctaagccaggacccagaaactcagagttgatggtgagaggaggccgcctgagtcaggacacctggcttcttgaaaagttcgctctgccagaaaccacctagggaccacgttagctgccttccttgagctccccaggagtcggtttccacatctgtgaggtggagggctggtgtggaggtgctcatggggtgcggtgcttgggagacagccaggcccagggtggctgctgcttcctgctaagtgggggaggtgagacagatctggaaagccgtctccctcagatggtttcatttaatgctttatactgccgagtctgggggcttgttttggtttgggggcagccatcctccaccagaaagggggagctccttccgctgcggctccagatagatggggatgccgggctccaggccgaccagcacttgggatctgatgggacacggccagtgcctaggggtgccaagtccaaggcctcccactgggagtcatcgctgagaagatgccaatgtttcatccaccggctgcacaggcacaaactcccccacccaggacggctgtgatgaggtggccctccctgtcaaccctggtccctggagtccccagcacctggggccctggtggggctgatgtcacaggtgtttactgtgctgctgcactggtcctatgccagcctcacccatgtggggaccacggaaggcacactcccttacccccggtgccgggccgtgcggtcccccagacggacagcagctgtggcgacctgcgtttctccctgggcctgtgcttcctgtagttagtccgtcccctggttcccctgtggctcagaggccgcgtccctggcttgtacatatgtgattgctgtgggcacaccccagaccccatgtcatagctgccgtcccgacgtcacgacgcctgtcccgatgtcttacacccgagtgttagccctaggctcctgtactgtgcgtgcacttgaggctctgtccaattaagaaataaatgtggctcttactcaacacagtc

SEQ ID NO: 87295 - DNA, 8732 bp, Homo sapiens
agccggcgagcggcagcagctccgggctcgagagcccgcgcccatgccagtgcccatgcggggccgccgccagtgacgccggagaggtgttccccccacactggggctcccactactgcgaggagtgacccacgaaggccacagagatggccggggcttcggtgaaggtggcggtgcgggtccgccccttcaattcccgggaaatgagccgtgactccaagtgcatcattcagatgtctggaagcaccaccaccattgttaaccccaaacagcccaaggagacgcccaaaagcttcagctttgactactcctactggtcgcacacctcacctgaggacatcaactacgcgtcgcagaagcaggtgtaccgggacatcggcgaggagatgctgcagcatgcctttgagggatacaacgtgtgcatcttcgcctatgggcagacgggtgccggcaagtcctacaccatgatgggcaagcaggagaaggaccagcagggcatcatcccacagctctgcgaggacctcttctctcggatcaacgacacgaccaacgacaacatgtcctactccgtggaggtcagctacatggagatttactgtgagcgcgtccgtgacctcctgaaccccaagaacaagggcaaccttcgcgtgagggagcacccactgctggggccctacgtggaggacctctccaagctggctgtcacctcctacaatgacatccaggacctcatggactcagggaacaaggccaggaccgtggcggccaccaacatgaatgagaccagcagtcgctcccacgccgtcttcaacatcatcttcacccagaagcgccatgacgcagagaccaatatcaccacggagaaggtgagcaaaatcagcctggtggacctggctgggagcgagcgggctgactccacgggagccaagggcacgcgcctcaaggagggggccaacatcaacaagtcgctgaccaccctgggcaaggtcatctccgccctggctgaaatggactccggacccaacaagaacaagaaaaagaagaagacagatttcattccgtaccgagattccgtgttgacctggctcctccgggaaaacctgggcggtaactcaaggacagctatggtggcagccctgagtcctgcagacatcaactacgatgagacccttagcacgctgaggtatgctgaccgggccaagcagatccgctgcaatgctgtcatcaatgaggaccccaacaacaagctgatccgcgagctgaaggatgaggtgacccggctgcgggaccttctgtacgcccagggtcttggcgacatcactgacatgaccaatgccctggtgggtatgagcccctcatcctcgctctcagccctgtccagccgcgcggcctccgtgtccagcctccacgagcgcatcttgtttgccccgggcagcgaggaggccattgaaagactgaaggaaacagagaagatcatagctgagctcaatgagacctgggaggagaagctgcggcggacagaagccatccggatggagagggaagccctgctggccgagatgggtgtggccatgagggaggatggcggcaccttgggcgtattctctcccaaaaagacaccacacctcgtcaacctgaacgaggacccgctgatgtctgagtgcctgctctactacatcaaggatgggatcaccagagtgggcagggaggatggcgagaggcggcaggacattgttctgagtgggcacttcatcaaggaggagcactgcgtcttccggagcgactccaggggaggcagcgaagctgtggtgaccttggagccctgtgagggggcagacacctacgtcaatggcaagaaagtcacagagcccagcatcctgcgttcaggaaaccgcatcatcatgggtaagagccatgtgttccggttcaaccaccccgagcaggcccggcaggagcgtgagcgcacgccttgtgcggagacgccagctgagcctgtggactgggccttcgcccagcgtgagctgctggagaagcagggcatcgacatgaagcaggagatggagcagaggctccaggaactggaggaccagtaccgccgcgagcgggaggaggccacctacctgctggagcagcagcggctggactatgagagcaagctggaggctctgcagaagcagatggactccaggtactacccggaggtgaacgaggaggaggaggagcccgaggatgaagtccagtggacagagcgggagtgtgagctggcgctctgggccttccggaagtggaagtggtaccagttcacgtctctgcgggacctgctgtggggcaacgccatcttcctcaaggaggctaatgccatcagcgtggagctgaaaaagaaggtacaattccagtttgtcctcctgacggacacactctactcccctctgccacccgacctgctgcccccagaggccgccaaagaccgagagacgcggcccttcccccgcaccattgtggccgtggaggtccaggaccagaagaacggggccacccactactggacgctggagaagctcaggcagcgtctggacctgatgcgggagatgtacgaccgcgctgcagaggtgccctccagtgtcatcgaggactgtgacaacgtggtgaccggcggagaccccttctatgaccgcttcccctggttccggctggtgggcagggccttcgtgtacctgagcaacctgctgtaccccgttcccctggtacaccgtgtggcaatcgtcagcgagaagggcgaggtgaagggcttcctccgcgtggccgtccaggccatctcagccgatgaagaggcccctgattatggctctggcgtccgccagtcgggaactgctaaaatctcctttgatgaccagcattttgaaaagttccagtccgagtcttgccccgtggtggggatgtcccgctcgggaacctcccaggaagagcttcgcatcgtggagggccagggccagggtgcagacgtggggccctcagccgatgaagtcaacaacaacacctgttcagcagtgcccccagaaggcctcctcctagacagctctgagaaagccgccctggatgggcccctggatgctgccctggaccacctccgcctgggcaacaccttcaccttccgtgtgacagtcctgcaggcgtccagcatctctgccgaatatgccgacatcttctgccagttcaacttcatccaccgccacgacgaggccttctccacagagcccctgaagaacacaggcagaggccccccacttggcttctaccacgtccagaacatcgcagtggaggtgaccaagtccttcattgagtacatcaagagccagcccattgttttcgaggtctttggccactaccagcagcacccgttcccgcccctctgcaaggacgtgctcagccccctgaggccctcgcgccgccacttccctcgggtcatgccactgtccaagccagtgcccgccaccaagctcagcacactgacgcggccctgtccgggaccctgccactgcaagtacgacctgctggtctacttcgagatctgtgagctggaggccaacggcgattacatcccggccgtggtggaccaccgtgggggcatgccatgcatggggaccttcctcctccaccagggcatccagcgacggattacggtgacactactgcatgagacaggcagccatatccgctggaaggaagtgcgcgagctggtcgtgggccgcatccgaaacactccagagaccgacgagtccctgatcgaccccaacatcttgtctctcaacatcctctcttccggatacatccacccagcccaagatgaccggaccttttaccaatttgaggctgcgtgggacagctccatgcacaactctctcctgctgaaccgggtcaccccttatcgagagaaaatctacatgacactctccgcttatatcgagatggagaactgcacccagccggctgttgtcaccaaggacttctgcatggtcttctattcccgtgatgccaagctgccagcctcgcgctccatccgcaacctctttggcagtgggagccttcgggcctcagagagtaaccgtgtgactggtgtgtacgagctcagcctgtgccacgtggctgacgcgggcagcccagggatgcagcgccggcgccgacgagtcctggacacatctgtggcctatgtccggggcgaggagaacctggcaggctggaggccccggagtgacagtctcattctggaccaccagtgggagctggagaagctgagcctcctgcaggaggtggagaagactaggcactacctgctcctgcgggagaagctggagaccgcccagcggcctgtcccggaggcactgtccccggccttcagcgaggactctgagtcccatggctcctccagcgcctcctccccgctctcggctgagggccgcccatcacccctggaggctcccaacgagaggcagcgggagctggccgtcaagtgcttgcgcctgctcacgcacacattcaacagagagtacacacacagccacgtctgcgtcagtgccagcgagagcaagctctccgagatgtctgtcaccctgctccgggacccgtcgatgtcccctctaggggtggccactctcaccccctcctccacttgcccctctctggttgaagggcggtacggtgccactgacctgaggaccccgcagccctgctcccggccagccagcccagagcccgagctgctgccagaggccgactccaagaagctcccttcccctgcccgggcaacagagacagacaaggagccccagcgcctgctggtccctgacatccaggagatccgagtcagcccgatcgtttccaagaaggggtacctgcacttcctggagccgcacacgtcaggctgggccaggcgcttcgtggtggtgcggcgcccctatgcctacatgtacaacagcgacaaggacaccgtggagcggttcgtgctcaacctggccactgcccaggtggagtacagtgaggaccagcaggctatgctcaagacacccaacacattcgcggtgtgcacggaacaccgcggcatcctgctgcaggccgccagcgacaaggacatgcatgactggctgtacgccttcaaccccctcctggccgggaccatacggtccaagctctccagaaggaggtctgcccagatgcgggtctgaacctgagccctcccgtgacagccggcaggcccagcccatcccctccctcatcctcgtctgtcctgtgccacacgaccagctgtgctcccagcagaggctgtgcgtgtcagttcttcttgcagaatgtgctctggtggaacaagttgggagaggctgggggggccaagggcacaggttacgggggttcttgctgccgttctaatatttttttaagcatagacagacttataattaatatacgttagttagtgacattgaaacagtcaactcggaaattaactataagacttgttctatttataagtatttatttctaatgcctccacatagccctgtaatattcagatggaacccccaaccacctccaccctgtttgttcccacatgtgtctcccaagcctgctagggacaggcagggcagggacagccaccttggaaggccgcagtgaggagctgtctggaccagtggggcaccttggggctagcacacgggtgtatcgcctgggccccaggcttctccatggccacatgggtcctgggtgtatgtgtgggagagtgggggggtgtctttggtgcctgaagtctgcgcggcatggagggtggtgtgagttcctctggtgggagggagaacgcacatctcttctgggcggccacctgaggagtgactccaagaagagttccggcagctttccccaggaaagggtgaggggtgacactcggctctggctctgagatgaggcagacggcacccaggctgtgatctgtcctgggcggggaccaggagggagcggggtcgggatcacctgccagtgtgcagactctgggactgcgtgctgtctccggaccatcagggtagggtggtgggttgagaccaggaagtcagggaagatcggaattcagggcgacggtctaggtgtcgagggctgtggcgcagcctcttcagctgcggcgagaaatggagtgagtcaaggtagcttctgggaagaaatgctgccattagcaggtttcttgcaaagactttcctctctttgttcccagggcagagagtttctgtgagtcccactgagaaaatcccatggggtgggggtatcctggtcggtcggcaatggagggtggctggcttggtggttattgtcttcaaggagctcttcgctgctgcatctgcggtgtccctttgttcttgtcccatttcaccccctctgcagacaccaatgtccgagggccacccaggacaggacgggggtcagccccaagctgagagtctggtcataggagtcatgtccagaggcctagggaggttttagggccctccccacccacacccacaggtcgatttggtctctttttagctcaaggaaagacagtagccaagcaacagagcccctctcccgccgtggcccgtgggagcagttacatcgggtctggtgctccagacctagggcccagcactttcatcagatcctgcctcctggagtgggggaaacgcagcaccccactggttctgaggcccctaccctcccaggctgtcccacgtgatgctgacatgagcctcagagaccccaatcccatgcctgggggagagacagcggctcaggagtgggggagcacgggccttctacaccacatgggaaggctctggcatgaggttttcctttgggaaggttgtttgggcccctgaagttccatctccgagagtggtgtgcagggcaggccagggcccatgctggctgcagtctctgtggctgcctgcctgggccagcctgtttgggagctgggactgtgggctcgccttttcgtacctgggctcaggtgcggtgtggccaccgccaccctcatcccctgcctgggaggctctcccaggggctgatgggggggttctgtgagggagaatcagggctcgggaagccacgcctgggaaggcaggacacaggacacagcagctttctttggaaatctcccaggtgaggattcacatcccaaaataaaattcagaagccaggtggcctgtgctccccatgggtgacctctggaggcagtggaccaagatgcagcaaggagaggatgcagaacagcttcttgcagaagcacctgctccggcatccagcgctgcctggaggcaggaaggagaggcagggcaggacacgctggtctgagatgagggggagccccacgggccccaggcaggctagaggaggcacaggccctgccacggccaactcaggtcagccagcctgaggctgtggcctccaaagggtctgggcgcaccccccaggtcgcaggtgtctgaggccagccaacctgcagagcactcgcggcgtgggtgggctgagtggaggtgcctgggagctgcctaaattcagaagcctccactgccatggagactgcctggctgtgtcctctcagccaggtgccgtgttggccttggctaggacccagagccacactgcagcctccgccgactccctccttccgggcctgctctagtgaggagtgcctaagccaggacccagaaactcagagttgatggtgagaggaggccgcctgagtcaggacacctggcttcttgaaaagttcgctctgccagaaaccacctagggaccacgttagctgccttccttgagctccccaggagtcggtttccacatctgtgaggtggagggctggtgtggaggtgctcatggggtgcggtgcttgggagacagccaggcccagggtggctgctgcttcctgctaagtgggggaggtgagacagatctggaaagccgtctccctcagatggtttcatttaatgctttatactgccgagtctgggggcttgttttggtttgggggcagccatcctccaccagaaagggggagctccttccgctgcggctccagatagatggggatgccgggctccaggccgaccagcacttgggatctgatgggacacggccagtgcctaggggtgccaagtccaaggcctcccactgggagtcatcgctgagaagatgccaatgtttcatccaccggctgcacaggcacaaactcccccacccaggacggctgtgatgaggtggccctccctgtcaaccctggtccctggagtccccagcacctggggccctggtggggctgatgtcacaggtgtttactgtgctgctgcactggtcctatgccagcctcacccatgtggggaccacggaaggcacactcccttacccccggtgccgggccgtgcggtcccccagacggacagcagctgtggcgacctgcgtttctccctgggcctgtgcttcctgtagttagtccgtcccctggttcccctgtggctcagaggccgcgtccctggcttgtacatatgtgattgctgtgggcacaccccagaccccatgtcatagctgccgtcccgacgtcacgacgcctgtcccgatgtcttacacccgagtgttagccctaggctcctgtactgtgcgtgcacttgaggctctgtccaattaagaaataaatgtggctcttactcaacacagtc

SEQ ID NO: 87296 - DNA, 8666 bp, Homo sapiens
agccggcgagcggcagcagctccgggctcgagagcccgcgcccatgccagtgcccatgcggggccgccgccagtgacgccggagaggtgttccccccacactggggctcccactactgcgaggagtgacccacgaaggccacagagatggccggggcttcggtgaaggtggcggtgcgggtccgccccttcaattcccgggaaatgagccgtgactccaagtgcatcattcagatgtctggaagcaccaccaccattgttaaccccaaacagcccaaggagacgcccaaaagcttcagctttgactactcctactggtcgcacacctcacctgaggacatcaactacgcgtcgcagaagcaggtgtaccgggacatcggcgaggagatgctgcagcatgcctttgagggatacaacgtgtgcatcttcgcctatgggcagacgggtgccggcaagtcctacaccatgatgggcaagcaggagaaggaccagcagggcatcatcccacagctctgcgaggacctcttctctcggatcaacgacacgaccaacgacaacatgtcctactccgtggaggtcagctacatggagatttactgtgagcgcgtccgtgacctcctgaaccccaagaacaagggcaaccttcgcgtgagggagcacccactgctggggccctacgtggaggacctctccaagctggctgtcacctcctacaatgacatccaggacctcatggactcagggaacaaggccaggaccgtggcggccaccaacatgaatgagaccagcagtcgctcccacgccgtcttcaacatcatcttcacccagaagcgccatgacgcagagaccaatatcaccacggagaaggtgagcaaaatcagcctggtggacctggctgggagcgagcgggctgactccacgggagccaagggcacgcgcctcaaggagggggccaacatcaacaagtcgctgaccaccctgggcaaggtcatctccgccctggctgaaatggactccggacccaacaagaacaagaaaaagaagaagacagatttcattccgtaccgagattccgtgttgacctggctcctccgggaaaacctgggcggtaactcaaggacagctatggtggcagccctgagtcctgcagacatcaactacgatgagacccttagcacgctgaggtatgctgaccgggccaagcagatccgctgcaatgctgtcatcaatgaggaccccaacaacaagctgatccgcgagctgaaggatgaggtgacccggctgcgggaccttctgtacgcccagggtcttggcgacatcactgacatgaccaatgccctggtgggtatgagcccctcatcctcgctctcagccctgtccagccgcgcggcctccgtgtccagcctccacgagcgcatcttgtttgccccgggcagcgaggaggccattgaaagactgaaggaaacagagaagatcatagctgagctcaatgagacctgggaggagaagctgcggcggacagaagccatccggatggagagggaagccctgctggccgagatgggtgtggccatgagggaggatggcggcaccttgggcgtattctctcccaaaaagacaccacacctcgtcaacctgaacgaggacccgctgatgtctgagtgcctgctctactacatcaaggatgggatcaccagagtgggcagggaggatggcgagaggcggcaggacattgttctgagtgggcacttcatcaaggaggagcactgcgtcttccggagcgactccaggggaggcagcgaagctgtggtgaccttggagccctgtgagggggcagacacctacgtcaatggcaagaaagtcacagagcccagcatcctgcgttcaggaaaccgcatcatcatgggtaagagccatgtgttccggttcaaccaccccgagcaggcccggcaggagcgtgagcgcacgccttgtgcggagacgccagctgagcctgtggactgggccttcgcccagcgtgagctgctggagaagcagggcatcgacatgaagcaggagatggagcagaggctccaggaactggaggaccagtaccgccgcgagcgggaggaggccacctacctgctggagcagcagcggctggactatgagagcaagctggaggctctgcagaagcagatggactccaggtactacccggaggtgaacgaggaggaggaggagcccgaggatgaagtccagtggacagagcgggagtgtgagctggcgctctgggccttccggaagtggaagtggtaccagttcacgtctctgcgggacctgctgtggggcaacgccatcttcctcaaggaggctaatgccatcagcgtggagctgaaaaagaaggtacaattccagtttgtcctcctgacggacacactctactcccctctgccacccgacctgctgcccccagaggccgccaaagaccgagagacgcggcccttcccccgcaccattgtggccgtggaggtccaggaccagaagaacggggccacccactactggacgctggagaagctcaggcagcgtctggacctgatgcgggagatgtacgaccgcgctgcagaggtgccctccagtgtcatcgaggactgtgacaacgtggtgaccggcggagaccccttctatgaccgcttcccctggttccggctggtgggcagggccttcgtgtacctgagcaacctgctgtaccccgttcccctggtacaccgtgtggcaatcgtcagcgagaagggcgaggtgaagggcttcctccgcgtggccgtccaggccatctcagccgatgaagaggcccctgattatggctctggcgtccgccagtcgggaactgctaaaatctcctttgatgaccagcattttgaaaagttccagtccgagtcttgccccgtggtggggatgtcccgctcgggaacctcccaggaagagcttcgcatcgtggagggccagggccagggtgcagacgtggggccctcagccgatgaagtcaacaacaacacctgttcagcagtgcccccagaaggcctcctcctagacagctctgagaaagccgccctggatgggcccctggatgctgccctggaccacctccgcctgggcaacaccttcaccttccgtgtgacagtcctgcaggcgtccagcatctctgccgaatatgccgacatcttctgccagttcaacttcatccaccgccacgacgaggccttctccacagagcccctgaagaacacaggcagaggccccccacttggcttctaccacgtccagaacatcgcagtggaggtgaccaagtccttcattgagtacatcaagagccagcccattgttttcgaggtctttggccactaccagcagcacccgttcccgcccctctgcaaggacgtgctcagccccctgaggccctcgcgccgccacttccctcgggtcatgccactgtccaagccagtgcccgccaccaagctcagcacactgacgcggccctgtccgggaccctgccactgcaagtacgacctgctggtctacttcgagatctgtgagctggaggccaacggcgattacatcccggccgtggtggaccaccgtgggggcatgccatgcatggggaccttcctcctccaccagggcatccagcgacggattacggtgacactactgcatgagacaggcagccatatccgctggaaggaagtgcgcgagctggtcgtgggccgcatccgaaacactccagagaccgacgagtccctgatcgaccccaacatcttgtctctcaacatcctctcttccggatacatccacccagcccaagatgaccggaccttttaccaatttgaggctgcgtgggacagctccatgcacaactctctcctgctgaaccgggtcaccccttatcgagagaaaatctacatgacactctccgcttatatcgagatggagaactgcacccagccggctgttgtcaccaaggacttctgcatggtcttctattcccgtgatgccaagctgccagcctcgcgctccatccgcaacctctttggcagtgggagccttcgggcctcagagagtaaccgtgtgactggtgtgtacgagctcagcctgtgccacgtggctgacgcgggcagcccagggatgcagcgccggcgccgacgagtcctggacacatctgtggcctatgtccggggcgaggagaacctggcaggctggaggccccggagtgacagtctcattctggaccaccagtgggagctggagaagctgagcctcctgcaggaggtggagaagactaggcactacctgctcctgcgggagaagctggagaccgcccagcggcctgtcccggaggcactgtccccggccttcagcgaggactctgagtcccatggctcctccagcgcctcctccccgctctcggctgagggccgcccatcacccctggaggctcccaacgagaggcagcgggagctggccgtcaagtgcttgcgcctgctcacgcacacattcaacagagagtacacacacagccacgtctgcgtcagtgccagcgagagcaagctctccgagatgtctgtcaccctgctccgggacccgtcgatgtcccctctaggggtggccactctcaccccctcctccacttgcccctctctggttgaagggcggtacggtgccactgacctgaggaccccgcagccctgctcccggccagccagcccagagcccgagctgctgccagaggccgactccaagaagctcccttcccctgcccgggcaacagagacagacaaggagccccagcgcctgctggagccgcacacgtcaggctgggccaggcgcttcgtggtggtgcggcgcccctatgcctacatgtacaacagcgacaaggacaccgtggagcggttcgtgctcaacctggccactgcccaggtggagtacagtgaggaccagcaggctatgctcaagacacccaacacattcgcggtgtgcacggaacaccgcggcatcctgctgcaggccgccagcgacaaggacatgcatgactggctgtacgccttcaaccccctcctggccgggaccatacggtccaagctctccagaaggaggtctgcccagatgcgggtctgaacctgagccctcccgtgacagccggcaggcccagcccatcccctccctcatcctcgtctgtcctgtgccacacgaccagctgtgctcccagcagaggctgtgcgtgtcagttcttcttgcagaatgtgctctggtggaacaagttgggagaggctgggggggccaagggcacaggttacgggggttcttgctgccgttctaatatttttttaagcatagacagacttataattaatatacgttagttagtgacattgaaacagtcaactcggaaattaactataagacttgttctatttataagtatttatttctaatgcctccacatagccctgtaatattcagatggaacccccaaccacctccaccctgtttgttcccacatgtgtctcccaagcctgctagggacaggcagggcagggacagccaccttggaaggccgcagtgaggagctgtctggaccagtggggcaccttggggctagcacacgggtgtatcgcctgggccccaggcttctccatggccacatgggtcctgggtgtatgtgtgggagagtgggggggtgtctttggtgcctgaagtctgcgcggcatggagggtggtgtgagttcctctggtgggagggagaacgcacatctcttctgggcggccacctgaggagtgactccaagaagagttccggcagctttccccaggaaagggtgaggggtgacactcggctctggctctgagatgaggcagacggcacccaggctgtgatctgtcctgggcggggaccaggagggagcggggtcgggatcacctgccagtgtgcagactctgggactgcgtgctgtctccggaccatcagggtagggtggtgggttgagaccaggaagtcagggaagatcggaattcagggcgacggtctaggtgtcgagggctgtggcgcagcctcttcagctgcggcgagaaatggagtgagtcaaggtagcttctgggaagaaatgctgccattagcaggtttcttgcaaagactttcctctctttgttcccagggcagagagtttctgtgagtcccactgagaaaatcccatggggtgggggtatcctggtcggtcggcaatggagggtggctggcttggtggttattgtcttcaaggagctcttcgctgctgcatctgcggtgtccctttgttcttgtcccatttcaccccctctgcagacaccaatgtccgagggccacccaggacaggacgggggtcagccccaagctgagagtctggtcataggagtcatgtccagaggcctagggaggttttagggccctccccacccacacccacaggtcgatttggtctctttttagctcaaggaaagacagtagccaagcaacagagcccctctcccgccgtggcccgtgggagcagttacatcgggtctggtgctccagacctagggcccagcactttcatcagatcctgcctcctggagtgggggaaacgcagcaccccactggttctgaggcccctaccctcccaggctgtcccacgtgatgctgacatgagcctcagagaccccaatcccatgcctgggggagagacagcggctcaggagtgggggagcacgggccttctacaccacatgggaaggctctggcatgaggttttcctttgggaaggttgtttgggcccctgaagttccatctccgagagtggtgtgcagggcaggccagggcccatgctggctgcagtctctgtggctgcctgcctgggccagcctgtttgggagctgggactgtgggctcgccttttcgtacctgggctcaggtgcggtgtggccaccgccaccctcatcccctgcctgggaggctctcccaggggctgatgggggggttctgtgagggagaatcagggctcgggaagccacgcctgggaaggcaggacacaggacacagcagctttctttggaaatctcccaggtgaggattcacatcccaaaataaaattcagaagccaggtggcctgtgctccccatgggtgacctctggaggcagtggaccaagatgcagcaaggagaggatgcagaacagcttcttgcagaagcacctgctccggcatccagcgctgcctggaggcaggaaggagaggcagggcaggacacgctggtctgagatgagggggagccccacgggccccaggcaggctagaggaggcacaggccctgccacggccaactcaggtcagccagcctgaggctgtggcctccaaagggtctgggcgcaccccccaggtcgcaggtgtctgaggccagccaacctgcagagcactcgcggcgtgggtgggctgagtggaggtgcctgggagctgcctaaattcagaagcctccactgccatggagactgcctggctgtgtcctctcagccaggtgccgtgttggccttggctaggacccagagccacactgcagcctccgccgactccctccttccgggcctgctctagtgaggagtgcctaagccaggacccagaaactcagagttgatggtgagaggaggccgcctgagtcaggacacctggcttcttgaaaagttcgctctgccagaaaccacctagggaccacgttagctgccttccttgagctccccaggagtcggtttccacatctgtgaggtggagggctggtgtggaggtgctcatggggtgcggtgcttgggagacagccaggcccagggtggctgctgcttcctgctaagtgggggaggtgagacagatctggaaagccgtctccctcagatggtttcatttaatgctttatactgccgagtctgggggcttgttttggtttgggggcagccatcctccaccagaaagggggagctccttccgctgcggctccagatagatggggatgccgggctccaggccgaccagcacttgggatctgatgggacacggccagtgcctaggggtgccaagtccaaggcctcccactgggagtcatcgctgagaagatgccaatgtttcatccaccggctgcacaggcacaaactcccccacccaggacggctgtgatgaggtggccctccctgtcaaccctggtccctggagtccccagcacctggggccctggtggggctgatgtcacaggtgtttactgtgctgctgcactggtcctatgccagcctcacccatgtggggaccacggaaggcacactcccttacccccggtgccgggccgtgcggtcccccagacggacagcagctgtggcgacctgcgtttctccctgggcctgtgcttcctgtagttagtccgtcccctggttcccctgtggctcagaggccgcgtccctggcttgtacatatgtgattgctgtgggcacaccccagaccccatgtcatagctgccgtcccgacgtcacgacgcctgtcccgatgtcttacacccgagtgttagccctaggctcctgtactgtgcgtgcacttgaggctctgtccaattaagaaataaatgtggctcttactcaacacagtc

SEQ ID NO: 87297 - DNA, 8992 bp, Homo sapiens
agccggcgagcggcagcagctccgggctcgagagcccgcgcccatgccagtgcccatgcggggccgccgccagtgacgccggagaggtgttccccccacactggggctcccactactgcgaggagtgacccacgaaggccacagagatggccggggcttcggtgaaggtggcggtgcgggtccgccccttcaattcccgggaaatgagccgtgactccaagtgcatcattcagatgtctggaagcaccaccaccattgttaaccccaaacagcccaaggagacgcccaaaagcttcagctttgactactcctactggtcgcacacctcacctgaggacatcaactacgcgtcgcagaagcaggtgtaccgggacatcggcgaggagatgctgcagcatgcctttgagggatacaacgtgtgcatcttcgcctatgggcagacgggtgccggcaagtcctacaccatgatgggcaagcaggagaaggaccagcagggcatcatcccacagctctgcgaggacctcttctctcggatcaacgacacgaccaacgacaacatgtcctactccgtggaggtcagctacatggagatttactgtgagcgcgtccgtgacctcctgaaccccaagaacaagggcaaccttcgcgtgagggagcacccactgctggggccctacgtggaggacctctccaagctggctgtcacctcctacaatgacatccaggacctcatggactcagggaacaaggccaggaccgtggcggccaccaacatgaatgagaccagcagtcgctcccacgccgtcttcaacatcatcttcacccagaagcgccatgacgcagagaccaatatcaccacggagaaggtgagcaaaatcagcctggtggacctggctgggagcgagcgggctgactccacgggagccaagggcacgcgcctcaaggagggggccaacatcaacaagtcgctgaccaccctgggcaaggtcatctccgccctggctgaaatggactccggacccaacaagaacaagaaaaagaagaagacagatttcattccgtaccgagattccgtgttgacctggctcctccgggaaaacctgggcggtaactcaaggacagctatggtggcagccctgagtcctgcagacatcaactacgatgagacccttagcacgctgaggtatgctgaccgggccaagcagatccgctgcaatgctgtcatcaatgaggaccccaacaacaagctgatccgcgagctgaaggatgaggtgacccggctgcgggaccttctgtacgcccagggtcttggcgacatcactgacatgaccaatgccctggtgggtatgagcccctcatcctcgctctcagccctgtccagccgcgcggcctccgtgtccagcctccacgagcgcatcttgtttgccccgggcagcgaggaggccattgaaagactgaaggaaacagagaagatcatagctgagctcaatgagacctgggaggagaagctgcggcggacagaagccatccggatggagagggaagccctgctggccgagatgggtgtggccatgagggaggatggcggcaccttgggcgtattctctcccaaaaagacaccacacctcgtcaacctgaacgaggacccgctgatgtctgagtgcctgctctactacatcaaggatgggatcaccagagtgggcagggaggatggcgagaggcggcaggacattgttctgagtgggcacttcatcaaggaggagcactgcgtcttccggagcgactccaggggaggcagcgaagctgtggtgaccttggagccctgtgagggggcagacacctacgtcaatggcaagaaagtcacagagcccagcatcctgcgttcaggaaaccgcatcatcatgggtaagagccatgtgttccggttcaaccaccccgagcaggcccggcaggagcgtgagcgcacgccttgtgcggagacgccagctgagcctgtggactgggccttcgcccagcgtgagctgctggagaagcagggcatcgacatgaagcaggagatggagcagaggctccaggaactggaggaccagtaccgccgcgagcgggaggaggccacctacctgctggagcagcagcggctggactatgagagcaagctggaggctctgcagaagcagatggactccaggtactacccggaggtgaacgaggaggaggaggagcccgaggatgaagtccagtggacagagcgggagtgtgagctggcgctctgggccttccggaagtggaagtggtaccagttcacgtctctgcgggacctgctgtggggcaacgccatcttcctcaaggaggctaatgccatcagcgtggagctgaaaaagaaggtacaattccagtttgtcctcctgacggacacactctactcccctctgccacccgacctgctgcccccagaggccgccaaagaccgagagacgcggcccttcccccgcaccattgtggccgtggaggtccaggaccagaagaacggggccacccactactggacgctggagaagctcaggcagcgtctggacctgatgcgggagatgtacgaccgcgctgcagaggtgccctccagtgtcatcgaggactgtgacaacgtggtgaccggcggagaccccttctatgaccgcttcccctggttccggctggtgggcagggccttcgtgtacctgagcaacctgctgtaccccgttcccctggtacaccgtgtggcaatcgtcagcgagaagggcgaggtgaagggcttcctccgcgtggccgtccaggccatctcagccgatgaagaggcccctgattatggctctggcgtccgccagtcgggaactgctaaaatctcctttgatgaccagcattttgaaaagttccagtccgagtcttgccccgtggtggggatgtcccgctcgggaacctcccaggaagagcttcgcatcgtggagggccagggccagggtgcagacgtggggccctcagccgatgaagtcaacaacaacacctgttcagcagtgcccccagaaggcctcctcctagacagctctgagaaagccgccctggatgggcccctggatgctgccctggaccacctccgcctgggcaacaccttcaccttccgtgtgacagtcctgcaggcgtccagcatctctgccgaatatgccgacatcttctgccagttcaacttcatccaccgccacgacgaggccttctccacagagcccctgaagaacacaggcagaggccccccacttggcttctaccacgtccagaacatcgcagtggaggtgaccaagtccttcattgagtacatcaagagccagcccattgttttcgaggtctttggccactaccagcagcacccgttcccgcccctctgcaaggacgtgctcagccccctgaggccctcgcgccgccacttccctcgggtcatgccactgtccaagccagtgcccgccaccaagctcagcacactgacgcggccctgtccgggaccctgccactgcaagtacgacctgctggtctacttcgagatctgtgagctggaggccaacggcgattacatcccggccgtggtggaccaccgtgggggcatgccatgcatggggaccttcctcctccaccagggcatccagcgacggattacggtgacactactgcatgagacaggcagccatatccgctggaaggaagtgcgcgagctggtcgtgggccgcatccgaaacactccagagaccgacgagtccctgatcgaccccaacatcttgtctctcaacatcctctcttccggatacatccacccagcccaagatgaccggaccttttaccaatttgaggctgcgtgggacagctccatgcacaactctctcctgctgaaccgggtcaccccttatcgagagaaaatctacatgacactctccgcttatatcgagatggagaactgcacccagccggctgttgtcaccaaggacttctgcatggtcttctattcccgtgatgccaagctgccagcctcgcgctccatccgcaacctctttggcagtgggagccttcgggcctcagagagtaaccgtgtgactggtgtgtacgagctcagcctgtgccacgtggctgacgcgggcagcccagggatgcagcgccggcgccgacgagtcctggacacatctgtggcctatgtccggggcgaggagaacctggcaggctggaggccccggagtgacagtctcattctggaccaccagtgggagctggagaagctgagcctcctgcaggaggtggagaagactaggcactacctgctcctgcgggagaagctggagaccgcccagcggcctgtcccggaggcactgtccccggccttcagcgaggactctgagtcccatggctcctccagcgcctcctccccgctctcggctgagggccgcccatcacccctggaggctcccaacgagaggcagcgggagctggccgtcaagtgcttgcgcctgctcacgcacacattcaacagagagtacacacacagccacgtctgcgtcagtgccagcgagagcaagctctccgagatgtctgtcaccctgctccgggacccgtcgatgtcccctctaggggtggccactctcaccccctcctccacttgcccctctctggttgaagggcggtacggtgccactgacctgaggaccccgcagccctgctcccggccagccagcccagagcccgagctgctgccagaggccgactccaagaagctcccttcccctgcccgggcaacagagacagacaaggagccccagcgcctgctggtccctgacatccaggagatccgagtcagcccgatcgtttccaagaaggggtacctgcacttcctggagccgcacacgtcaggctgggccaggcgcttcgtggtggtgcggcgcccctatgcctacatgtacaacagcgacaaggacaccgtggagcggttcgtgctcaacctggccactgcccaggtggagtacagtgaggaccagcaggctatgctcaagacacccaacacattcgcggtgtgcacggaacaccgcggcatcctgctgcaggccgccagcgacaaggacatgcatgactggctgtacgccttcaaccccctcctggccgggaccatacggtccaagctctccagaaggaggtctgcccagatgcgggtctgaacctgagccctcccgtgacagccggcaggcccagcccatcccctccctcatcctcgtctgtcctgtcacctgccgcccagcccctctcctgccagacagcccacgaccgggtcgaccccccaggggacgcccatgccaggcccggggacctgtgccacacgaccagctgtgctcccagcagaggctgtgcgtgtcagttcttcttgcagaatgtgctctggtggaacaagttgggagaggctgggggggccaagggcacaggttacgggggttcttgctgccgttctaatatttttttaagcatagacagacttataattaatatacgttagttagtgacattgaaacagtcaactcggaaattaactataagacttgttctatttataagtatttatttctaatgcctccacatagccctgtaatattcagatggaacccccaaccacctccaccctgtttgttcccacatgtgtctcccaagcctgctagggacaggcagggcagggacagccaccttggaaggccgcagtgaggagctgtctggaccagtggggcaccttggggctagcacacgggtgtatcgcctgggccccaggcttctccatggccacatgggtcctgggtgtatgtgtgggagagtgggggggtgtctttggtgcctgaagtctgcgcggcatggagggtggtgtgagttcctctggtgggagggagaacgcacatctcttctgggcggccacctgaggagtgactccaagaagagttccggcagctttccccaggaaagggtgaggggtgacactcggctctggctctgagatgaggcagacggcacccaggctgtgatctgtcctgggcggggaccaggagggagcggggtcgggatcacctgccagtgtgcagactctgggactgcgtgctgtctccggaccatcagggtagggtggtgggttgagaccaggaagtcagggaagatcggaattcagggcgacggtctaggtgtcgagggctgtggcgcagcctcttcagctgcggcgagaaatggagtgagtcaaggtagcttctgggaagaaatgctgccattagcaggtttcttgcaaagactttcctctctttgttcccagggcagagagtttctgtgagtcccactgagaaaatcccatggggtgggggtatcctggtcggtcggcaatggagggtggctggcttggtggttattgtcttcaaggagctcttcgctgctgcatctgcggtgtccctttgttcttgtcccatttcaccccctctgcagacaccaatgtccgagggccacccaggacaggacgggggtcagccccaagctgagagtctggtcataggagtcatgtccagaggcctagggaggttttagggccctccccacccacacccacaggtcgatttggtctctttttagctcaaggaaagacagtagccaagcaacagagcccctctcccgccgtggcccgtgggagcagttacatcgggtctggtgctccagacctagggcccagcactttcatcagatcctgcctcctggagtgggggaaacgcagcaccccactggttctgaggcccctaccctcccaggctgtcccacgtgatgctgacatgagcctcagagaccccaatcccatgcctgggggagagacagcggctcaggagtgggggagcacgggccttctacaccacatgggaaggctctggcatgaggttttcctttgggaaggttgtttgggcccctgaagttccatctccgagagtggtgtgcagggcaggccagggcccatgctggctgcagtctctgtggctgcctgcctgggccagcctgtttgggagctgggactgtgggctcgccttttcgtacctgggctcaggtgcggtgtggccaccgccaccctcatcccctgcctgggaggctctcccaggggctgatgggggggttctgtgagggagaatcagggctcgggaagccacgcctgggaaggcaggacacaggacacagcagctttctttggaaatctcccaggtgaggattcacatcccaaaataaaattcagaagccaggtggcctgtgctccccatgggtgacctctggaggcagtggaccaagatgcagcaaggagaggatgcagaacagcttcttgcagaagcacctgctccggcatccagcgctgcctggaggcaggaaggagaggcagggcaggacacgctggtctgagatgagggggagccccacgggccccaggcaggctagaggaggcacaggccctgccacggccaactcaggtcagccagcctgaggctgtggcctccaaagggtctgggcgcaccccccaggtcgcaggtgtctgaggccagccaacctgcagagcactcgcggcgtgggtgggctgagtggaggtgcctgggagctgcctaaattcagaagcctccactgccatggagactgcctggctgtgtcctctcagccaggtgccgtgttggccttggctaggacccagagccacactgcagcctccgccgactccctccttccgggcctgctctagtgaggagtgcctaagccaggacccagaaactcagagttgatggtgagaggaggccgcctgagtcaggacacctggcttcttgaaaagttcgctctgccagaaaccacctagggaccacgttagctgccttccttgagctccccaggagtcggtttccacatctgtgaggtggagggctggtgtggaggtgctcatggggtgcggtgcttgggagacagccaggcccagggtggctgctgcttcctgctaagtgggggaggtgagacagatctggaaagccgtctccctcagatggtttcatttaatgctttatactgccgagtctgggggcttgttttggtttgggggcagccatcctccaccagaaagggggagctccttccgctgcggctccagatagatggggatgccgggctccaggccgaccagcacttgggatctgatgggacacggccagtgcctaggggtgccaagtccaaggcctcccactgggagtcatcgctgagaagatgccaatgtttcatccaccggctgcacaggcacaaactcccccacccaggacggctgtgatgaggtggccctccctgtcaaccctggtccctggagtccccagcacctggggccctggtggggctgatgtcacaggtgtttactgtgctgctgcactggtcctatgccagcctcacccatgtggggaccacggaaggcacactcccttacccccggtgccgggccgtgcggtcccccagacggacagcagctgtggcgacctgcgtttctccctgggcctgtgcttcctgtagttagtccgtcccctggttcccctgtggctcagaggccgcgtccctggcttgtacatatgtgattgctgtgggcacaccccagaccccatgtcatagctgccgtcccgacgtcacgacgcctgtcccgatgtcttacacccgagtgttagccctaggctcctgtactgtgcgtgcacttgaggctctgtccaattaagaaataaatgtggctcttactcaacacagtcaaaaaaaaaaacaaaacaacaaacccacatttggaacataaaaaatagagagacaacgccatcttatggggcccccgtgtatgaacaagaaagttggccccataagcgaccccccagggtgaggttcccgcacacccccgggggtaaacgctcacccccgcacttgggttaag

SEQ ID NO: 87298 - DNA, 8840 bp, Homo sapiens
agccggcgagcggcagcagctccgggctcgagagcccgcgcccatgccagtgcccatgcggggccgccgccagtgacgccggagaggtgttccccccacactggggctcccactactgcgaggagtgacccacgaaggccacagagatggccggggcttcggtgaaggtggcggtgcgggtccgccccttcaattcccgggaaatgagccgtgactccaagtgcatcattcagatgtctggaagcaccaccaccattgttaaccccaaacagcccaaggagacgcccaaaagcttcagctttgactactcctactggtcgcacacctcacctgaggacatcaactacgcgtcgcagaagcaggtgtaccgggacatcggcgaggagatgctgcagcatgcctttgagggatacaacgtgtgcatcttcgcctatgggcagacgggtgccggcaagtcctacaccatgatgggcaagcaggagaaggaccagcagggcatcatcccacagctctgcgaggacctcttctctcggatcaacgacacgaccaacgacaacatgtcctactccgtggaggtcagctacatggagatttactgtgagcgcgtccgtgacctcctgaaccccaagaacaagggcaaccttcgcgtgagggagcacccactgctggggccctacgtggaggacctctccaagctggctgtcacctcctacaatgacatccaggacctcatggactcagggaacaaggccaggaccgtggcggccaccaacatgaatgagaccagcagtcgctcccacgccgtcttcaacatcatcttcacccagaagcgccatgacgcagagaccaatatcaccacggagaaggtgagcaaaatcagcctggtggacctggctgggagcgagcgggctgactccacgggagccaagggcacgcgcctcaaggagggggccaacatcaacaagtcgctgaccaccctgggcaaggtcatctccgccctggctgaaatggactccggacccaacaagaacaagaaaaagaagaagacagatttcattccgtaccgagattccgtgttgacctggctcctccgggaaaacctgggcggtaactcaaggacagctatggtggcagccctgagtcctgcagacatcaactacgatgagacccttagcacgctgaggtatgctgaccgggccaagcagatccgctgcaatgctgtcatcaatgaggaccccaacaacaagctgatccgcgagctgaaggatgaggtgacccggctgcgggaccttctgtacgcccagggtcttggcgacatcactgacatgaccaatgccctggtgggtatgagcccctcatcctcgctctcagccctgtccagccgcgcggcctccgtgtccagcctccacgagcgcatcttgtttgccccgggcagcgaggaggccattgaaagactgaaggaaacagagaagatcatagctgagctcaatgagacctgggaggagaagctgcggcggacagaagccatccggatggagagggaagccctgctggccgagatgggtgtggccatgagggaggatggcggcaccttgggcgtattctctcccaaaaagacaccacacctcgtcaacctgaacgaggacccgctgatgtctgagtgcctgctctactacatcaaggatgggatcaccagagtgggcagggaggatggcgagaggcggcaggacattgttctgagtgggcacttcatcaaggaggagcactgcgtcttccggagcgactccaggggaggcagcgaagctgtggtgaccttggagccctgtgagggggcagacacctacgtcaatggcaagaaagtcacagagcccagcatcctgcgttcaggaaaccgcatcatcatgggtaagagccatgtgttccggttcaaccaccccgagcaggcccggcaggagcgtgagcgcacgccttgtgcggagacgccagctgagcctgtggactgggccttcgcccagcgtgagctgctggagaagcagggcatcgacatgaagcaggagatggagcagaggctccaggaactggaggaccagtaccgccgcgagcgggaggaggccacctacctgctggagcagcagcggctggactatgagagcaagctggaggctctgcagaagcagatggactccaggtactacccggaggtgaacgaggaggaggaggagcccgaggatgaagtccagtggacagagcgggagtgtgagctggcgctctgggccttccggaagtggaagtggtaccagttcacgtctctgcgggacctgctgtggggcaacgccatcttcctcaaggaggctaatgccatcagcgtggagctgaaaaagaaggtacaattccagtttgtcctcctgacggacacactctactcccctctgccacccgacctgctgcccccagaggccgccaaagaccgagagacgcggcccttcccccgcaccattgtggccgtggaggtccaggaccagaagaacggggccacccactactggacgctggagaagctcaggcagcgtctggacctgatgcgggagatgtacgaccgcgctgcagaggtgccctccagtgtcatcgaggactgtgacaacgtggtgaccggcggagaccccttctatgaccgcttcccctggttccggctggtgggcagggccttcgtgtacctgagcaacctgctgtaccccgttcccctggtacaccgtgtggcaatcgtcagcgagaagggcgaggtgaagggcttcctccgcgtggccgtccaggccatctcagccgatgaagaggcccctgattatggctctggcgtccgccagtcgggaactgctaaaatctcctttgatgaccagcattttgaaaagttccagtccgagtcttgccccgtggtggggatgtcccgctcgggaacctcccaggaagagcttcgcatcgtggagggccagggccagggtgcagacgtggggccctcagccgatgaagtcaacaacaacacctgttcagcagtgcccccagaaggcctcctcctagacagctctgagaaagccgccctggatgggcccctggatgctgccctggaccacctccgcctgggcaacaccttcaccttccgtgtgacagtcctgcaggcgtccagcatctctgccgaatatgccgacatcttctgccagttcaacttcatccaccgccacgacgaggccttctccacagagcccctgaagaacacaggcagaggccccccacttggcttctaccacgtccagaacatcgcagtggaggtgaccaagtccttcattgagtacatcaagagccagcccattgttttcgaggtctttggccactaccagcagcacccgttcccgcccctctgcaaggacgtgctcagccccctgaggccctcgcgccgccacttccctcgggtcatgccactgtccaagccagtgcccgccaccaagctcagcacactgacgcggccctgtccgggaccctgccactgcaagtacgacctgctggtctacttcgagatctgtgagctggaggccaacggcgattacatcccggccgtggtggaccaccgtgggggcatgccatgcatggggaccttcctcctccaccagggcatccagcgacggattacggtgacactactgcatgagacaggcagccatatccgctggaaggaagtgcgcgagctggtcgtgggccgcatccgaaacactccagagaccgacgagtccctgatcgaccccaacatcttgtctctcaacatcctctcttccggatacatccacccagcccaagatgaccggaccttttaccaatttgaggctgcgtgggacagctccatgcacaactctctcctgctgaaccgggtcaccccttatcgagagaaaatctacatgacactctccgcttatatcgagatggagaactgcacccagccggctgttgtcaccaaggacttctgcatggtcttctattcccgtgatgccaagctgccagcctcgcgctccatccgcaacctctttggcagtgggagccttcgggcctcagagagtaaccgtgtgactggtgtgtacgagctcagcctgtgccacgtggctgacgcgggcagcccagggatgcagcgccggcgccgacgagtcctggacacatctgtggcctatgtccggggcgaggagaacctggcaggctggaggccccggagtgacagtctcattctggaccaccagtgggagctggagaagctgagcctcctgcaggaggtggagaagactaggcactacctgctcctgcgggagaagctggagaccgcccagcggcctgtcccggaggcactgtccccggccttcagcgaggactctgagtcccatggctcctccagcgcctcctccccgctctcggctgagggccgcccatcacccctggaggctcccaacgagaggcagcgggagctggccgtcaagtgcttgcgcctgctcacgcacacattcaacagagagtacacacacagccacgtctgcgtcagtgccagcgagagcaagctctccgagatgtctgtcaccctgctccgggacccgtcgatgtcccctctaggggtggccactctcaccccctcctccacttgcccctctctggttgaagggcggtacggtgccactgacctgaggaccccgcagccctgctcccggccagccagcccagagcccgagctgctgccagaggccgactccaagaagctcccttcccctgcccgggcaacagagacagacaaggagccccagcgcctgctggtccctgacatccaggagatccgagtcagcccgatcgtttccaagaaggggtacctgcacttcctggagccgcacacgtcaggctgggccaggcgcttcgtggtggtgcggcgcccctatgcctacatgtacaacagcgacaaggacaccgtggagcggttcgtgctcaacctggccactgcccaggtggagtacagtgaggaccagcaggctatgctcaagacacccaacacattcgcggtgtgcacggaacaccgcggcatcctgctgcaggccgccagcgacaaggacatgcatgactggctgtacgccttcaaccccctcctggccgggaccatacggtccaagctctccagaaggaggtctgcccagatgcgggtctgaacctgagccctcccgtgacagccggcaggcccagcccatcccctccctcatcctcgtctgtcctgtcacctgccgcccagcccctctcctgccagacagcccacgaccgggtcgaccccccaggggacgcccatgccaggcccggggacctgtgccacacgaccagctgtgctcccagcagaggctgtgcgtgtcagttcttcttgcagaatgtgctctggtggaacaagttgggagaggctgggggggccaagggcacaggttacgggggttcttgctgccgttctaatatttttttaagcatagacagacttataattaatatacgttagttagtgacattgaaacagtcaactcggaaattaactataagacttgttctatttataagtatttatttctaatgcctccacatagccctgtaatattcagatggaacccccaaccacctccaccctgtttgttcccacatgtgtctcccaagcctgctagggacaggcagggcagggacagccaccttggaaggccgcagtgaggagctgtctggaccagtggggcaccttggggctagcacacgggtgtatcgcctgggccccaggcttctccatggccacatgggtcctgggtgtatgtgtgggagagtgggggggtgtctttggtgcctgaagtctgcgcggcatggagggtggtgtgagttcctctggtgggagggagaacgcacatctcttctgggcggccacctgaggagtgactccaagaagagttccggcagctttccccaggaaagggtgaggggtgacactcggctctggctctgagatgaggcagacggcacccaggctgtgatctgtcctgggcggggaccaggagggagcggggtcgggatcacctgccagtgtgcagactctgggactgcgtgctgtctccggaccatcagggtagggtggtgggttgagaccaggaagtcagggaagatcggaattcagggcgacggtctaggtgtcgagggctgtggcgcagcctcttcagctgcggcgagaaatggagtgagtcaaggtagcttctgggaagaaatgctgccattagcaggtttcttgcaaagactttcctctctttgttcccagggcagagagtttctgtgagtcccactgagaaaatcccatggggtgggggtatcctggtcggtcggcaatggagggtggctggcttggtggttattgtcttcaaggagctcttcgctgctgcatctgcggtgtccctttgttcttgtcccatttcaccccctctgcagacaccaatgtccgagggccacccaggacaggacgggggtcagccccaagctgagagtctggtcataggagtcatgtccagaggcctagggaggttttagggccctccccacccacacccacaggtcgatttggtctctttttagctcaaggaaagacagtagccaagcaacagagcccctctcccgccgtggcccgtgggagcagttacatcgggtctggtgctccagacctagggcccagcactttcatcagatcctgcctcctggagtgggggaaacgcagcaccccactggttctgaggcccctaccctcccaggctgtcccacgtgatgctgacatgagcctcagagaccccaatcccatgcctgggggagagacagcggctcaggagtgggggagcacgggccttctacaccacatgggaaggctctggcatgaggttttcctttgggaaggttgtttgggcccctgaagttccatctccgagagtggtgtgcagggcaggccagggcccatgctggctgcagtctctgtggctgcctgcctgggccagcctgtttgggagctgggactgtgggctcgccttttcgtacctgggctcaggtgcggtgtggccaccgccaccctcatcccctgcctgggaggctctcccaggggctgatgggggggttctgtgagggagaatcagggctcgggaagccacgcctgggaaggcaggacacaggacacagcagctttctttggaaatctcccaggtgaggattcacatcccaaaataaaattcagaagccaggtggcctgtgctccccatgggtgacctctggaggcagtggaccaagatgcagcaaggagaggatgcagaacagcttcttgcagaagcacctgctccggcatccagcgctgcctggaggcaggaaggagaggcagggcaggacacgctggtctgagatgagggggagccccacgggccccaggcaggctagaggaggcacaggccctgccacggccaactcaggtcagccagcctgaggctgtggcctccaaagggtctgggcgcaccccccaggtcgcaggtgtctgaggccagccaacctgcagagcactcgcggcgtgggtgggctgagtggaggtgcctgggagctgcctaaattcagaagcctccactgccatggagactgcctggctgtgtcctctcagccaggtgccgtgttggccttggctaggacccagagccacactgcagcctccgccgactccctccttccgggcctgctctagtgaggagtgcctaagccaggacccagaaactcagagttgatggtgagaggaggccgcctgagtcaggacacctggcttcttgaaaagttcgctctgccagaaaccacctagggaccacgttagctgccttccttgagctccccaggagtcggtttccacatctgtgaggtggagggctggtgtggaggtgctcatggggtgcggtgcttgggagacagccaggcccagggtggctgctgcttcctgctaagtgggggaggtgagacagatctggaaagccgtctccctcagatggtttcatttaatgctttatactgccgagtctgggggcttgttttggtttgggggcagccatcctccaccagaaagggggagctccttccgctgcggctccagatagatggggatgccgggctccaggccgaccagcacttgggatctgatgggacacggccagtgcctaggggtgccaagtccaaggcctcccactgggagtcatcgctgagaagatgccaatgtttcatccaccggctgcacaggcacaaactcccccacccaggacggctgtgatgaggtggccctccctgtcaaccctggtccctggagtccccagcacctggggccctggtggggctgatgtcacaggtgtttactgtgctgctgcactggtcctatgccagcctcacccatgtggggaccacggaaggcacactcccttacccccggtgccgggccgtgcggtcccccagacggacagcagctgtggcgacctgcgtttctccctgggcctgtgcttcctgtagttagtccgtcccctggttcccctgtggctcagaggccgcgtccctggcttgtacatatgtgattgctgtgggcacaccccagaccccatgtcatagctgccgtcccgacgtcacgacgcctgtcccgatgtcttacacccgagtgttagccctaggctcctgtactgtgcgtgcacttgaggctctgtccaattaagaaataaatgtggctcttactcaacacagtcaaaaataacaaaagagggggg

SEQ ID NO: 87299 - DNA, 8851 bp, Homo sapiens
agccggcgagcggcagcagctccgggctcgagagcccgcgcccatgccagtgcccatgcggggccgccgccagtgacgccggagaggtgttccccccacactggggctcccactactgcgaggagtgacccacgaaggccacagagatggccggggcttcggtgaaggtggcggtgcgggtccgccccttcaattcccgggaaatgagccgtgactccaagtgcatcattcagatgtctggaagcaccaccaccattgttaaccccaaacagcccaaggagacgcccaaaagcttcagctttgactactcctactggtcgcacacctcacctgaggacatcaactacgcgtcgcagaagcaggtgtaccgggacatcggcgaggagatgctgcagcatgcctttgagggatacaacgtgtgcatcttcgcctatgggcagacgggtgccggcaagtcctacaccatgatgggcaagcaggagaaggaccagcagggcatcatcccacagctctgcgaggacctcttctctcggatcaacgacacgaccaacgacaacatgtcctactccgtggaggtcagctacatggagatttactgtgagcgcgtccgtgacctcctgaaccccaagaacaagggcaaccttcgcgtgagggagcacccactgctggggccctacgtggaggacctctccaagctggctgtcacctcctacaatgacatccaggacctcatggactcagggaacaaggccaggaccgtggcggccaccaacatgaatgagaccagcagtcgctcccacgccgtcttcaacatcatcttcacccagaagcgccatgacgcagagaccaatatcaccacggagaaggtgagcaaaatcagcctggtggacctggctgggagcgagcgggctgactccacgggagccaagggcacgcgcctcaaggagggggccaacatcaacaagtcgctgaccaccctgggcaaggtcatctccgccctggctgaaatggactccggacccaacaagaacaagaaaaagaagaagacagatttcattccgtaccgagattccgtgttgacctggctcctccgggaaaacctgggcggtaactcaaggacagctatggtggcagccctgagtcctgcagacatcaactacgatgagacccttagcacgctgaggtatgctgaccgggccaagcagatccgctgcaatgctgtcatcaatgaggaccccaacaacaagctgatccgcgagctgaaggatgaggtgacccggctgcgggaccttctgtacgcccagggtcttggcgacatcactgacatgaccaatgccctggtgggtatgagcccctcatcctcgctctcagccctgtccagccgcgcggcctccgtgtccagcctccacgagcgcatcttgtttgccccgggcagcgaggaggccattgaaagactgaaggaaacagagaagatcatagctgagctcaatgagacctgggaggagaagctgcggcggacagaagccatccggatggagagggaagccctgctggccgagatgggtgtggccatgagggaggatggcggcaccttgggcgtattctctcccaaaaagacaccacacctcgtcaacctgaacgaggacccgctgatgtctgagtgcctgctctactacatcaaggatgggatcaccagagtgggcagggaggatggcgagaggcggcaggacattgttctgagtgggcacttcatcaaggaggagcactgcgtcttccggagcgactccaggggaggcagcgaagctgtggtgaccttggagccctgtgagggggcagacacctacgtcaatggcaagaaagtcacagagcccagcatcctgcgttcaggaaaccgcatcatcatgggtaagagccatgtgttccggttcaaccaccccgagcaggcccggcaggagcgtgagcgcacgccttgtgcggagacgccagctgagcctgtggactgggccttcgcccagcgtgagctgctggagaagcagggcatcgacatgaagcaggagatggagcagaggctccaggaactggaggaccagtaccgccgcgagcgggaggaggccacctacctgctggagcagcagcggctggactatgagagcaagctggaggctctgcagaagcagatggactccaggtactacccggaggtgaacgaggaggaggaggagcccgaggatgaagtccagtggacagagcgggagtgtgagctggcgctctgggccttccggaagtggaagtggtaccagttcacgtctctgcgggacctgctgtggggcaacgccatcttcctcaaggaggctaatgccatcagcgtggagctgaaaaagaaggtacaattccagtttgtcctcctgacggacacactctactcccctctgccacccgacctgctgcccccagaggccgccaaagaccgagagacgcggcccttcccccgcaccattgtggccgtggaggtccaggaccagaagaacggggccacccactactggacgctggagaagctcaggcagcgtctggacctgatgcgggagatgtacgaccgcgctgcagaggtgccctccagtgtcatcgaggactgtgacaacgtggtgaccggcggagaccccttctatgaccgcttcccctggttccggctggtgggcagggccttcgtgtacctgagcaacctgctgtaccccgttcccctggtacaccgtgtggcaatcgtcagcgagaagggcgaggtgaagggcttcctccgcgtggccgtccaggccatctcagccgatgaagaggcccctgattatggctctggcgtccgccagtcgggaactgctaaaatctcctttgatgaccagcattttgaaaagttccagtccgagtcttgccccgtggtggggatgtcccgctcgggaacctcccaggaagagcttcgcatcgtggagggccagggccagggtgcagacgtggggccctcagccgatgaagtcaacaacaacacctgttcagcagtgcccccagaaggcctcctcctagacagctctgagaaagccgccctggatgggcccctggatgctgccctggaccacctccgcctgggcaacaccttcaccttccgtgtgacagtcctgcaggcgtccagcatctctgccgaatatgccgacatcttctgccagttcaacttcatccaccgccacgacgaggccttctccacagagcccctgaagaacacaggcagaggccccccacttggcttctaccacgtccagaacatcgcagtggaggtgaccaagtccttcattgagtacatcaagagccagcccattgttttcgaggtctttggccactaccagcagcacccgttcccgcccctctgcaaggacgtgctcagccccctgaggccctcgcgccgccacttccctcgggtcatgccactgtccaagccagtgcccgccaccaagctcagcacactgacgcggccctgtccgggaccctgccactgcaagtacgacctgctggtctacttcgagatctgtgagctggaggccaacggcgattacatcccggccgtggtggaccaccgtgggggcatgccatgcatggggaccttcctcctccaccagggcatccagcgacggattacggtgacactactgcatgagacaggcagccatatccgctggaaggaagtgcgcgagctggtcgtgggccgcatccgaaacactccagagaccgacgagtccctgatcgaccccaacatcttgtctctcaacatcctctcttccggatacatccacccagcccaagatgaccggaccttttaccaatttgaggctgcgtgggacagctccatgcacaactctctcctgctgaaccgggtcaccccttatcgagagaaaatctacatgacactctccgcttatatcgagatggagaactgcacccagccggctgttgtcaccaaggacttctgcatggtcttctattcccgtgatgccaagctgccagcctcgcgctccatccgcaacctctttggcagtgggagccttcgggcctcagagagtaaccgtgtgactggtgtgtacgagctcagcctgtgccacgtggctgacgcgggcagcccagggatgcagcgccggcgccgacgagtcctggacacatctgtggcctatgtccggggcgaggagaacctggcaggctggaggccccggagtgacagtctcattctggaccaccagtgggagctggagaagctgagcctcctgcaggaggtggagaagactaggcactacctgctcctgcgggagaagctggagaccgcccagcggcctgtcccggaggcactgtccccggccttcagcgaggactctgagtcccatggctcctccagcgcctcctccccgctctcggctgagggccgcccatcacccctggaggctcccaacgagaggcagcgggagctggccgtcaagtgcttgcgcctgctcacgcacacattcaacagagagtacacacacagccacgtctgcgtcagtgccagcgagagcaagctctccgagatgtctgtcaccctgctccgggacccgtcgatgtcccctctaggggtggccactctcaccccctcctccacttgcccctctctggttgaagggcggtacggtgccactgacctgaggaccccgcagccctgctcccggccagccagcccagagcccgagctgctgccagaggccgactccaagaagctcccttcccctgcccgggcaacagagacagacaaggagccccagcgcctgctggtccctgacatccaggagatccgagtcagcccgatcgtttccaagaaggggtacctgcacttcctggagccgcacacgtcaggctgggccaggcgcttcgtggtggtgcggcgcccctatgcctacatgtacaacagcgacaaggacaccgtggagcggttcgtgctcaacctggccactgcccaggtggagtacagtgaggaccagcaggctatgctcaagacacccaacacattcgcggtgtgcacggaacaccgcggcatcctgctgcaggccgccagcgacaaggacatgcatgactggctgtacgccttcaaccccctcctggccgggaccatacggtccaagctctccagaaggaggtctgcccagatgcgggtctgaacctgagccctcccgtgacagccggcaggcccagcccatcccctccctcatcctcgtctgtcctgtcacctgccgcccagcccctctcctgccagacagcccacgaccgggtcgaccccccaggggacgcccatgccaggcccggggacctgtgccacacgaccagctgtgctcccagcagaggctgtgcgtgtcagttcttcttgcagaatgtgctctggtggaacaagttgggagaggctgggggggccaagggcacaggttacgggggttcttgctgccgttctaatatttttttaagcatagacagacttataattaatatacgttagttagtgacattgaaacagtcaactcggaaattaactataagacttgttctatttataagtatttatttctaatgcctccacatagccctgtaatattcagatggaacccccaaccacctccaccctgtttgttcccacatgtgtctcccaagcctgctagggacaggcagggcagggacagccaccttggaaggccgcagtgaggagctgtctggaccagtggggcaccttggggctagcacacgggtgtatcgcctgggccccaggcttctccatggccacatgggtcctgggtgtatgtgtgggagagtgggggggtgtctttggtgcctgaagtctgcgcggcatggagggtggtgtgagttcctctggtgggagggagaacgcacatctcttctgggcggccacctgaggagtgactccaagaagagttccggcagctttccccaggaaagggtgaggggtgacactcggctctggctctgagatgaggcagacggcacccaggctgtgatctgtcctgggcggggaccaggagggagcggggtcgggatcacctgccagtgtgcagactctgggactgcgtgctgtctccggaccatcagggtagggtggtgggttgagaccaggaagtcagggaagatcggaattcagggcgacggtctaggtgtcgagggctgtggcgcagcctcttcagctgcggcgagaaatggagtgagtcaaggtagcttctgggaagaaatgctgccattagcaggtttcttgcaaagactttcctctctttgttcccagggcagagagtttctgtgagtcccactgagaaaatcccatggggtgggggtatcctggtcggtcggcaatggagggtggctggcttggtggttattgtcttcaaggagctcttcgctgctgcatctgcggtgtccctttgttcttgtcccatttcaccccctctgcagacaccaatgtccgagggccacccaggacaggacgggggtcagccccaagctgagagtctggtcataggagtcatgtccagaggcctagggaggttttagggccctccccacccacacccacaggtcgatttggtctctttttagctcaaggaaagacagtagccaagcaacagagcccctctcccgccgtggcccgtgggagcagttacatcgggtctggtgctccagacctagggcccagcactttcatcagatcctgcctcctggagtgggggaaacgcagcaccccactggttctgaggcccctaccctcccaggctgtcccacgtgatgctgacatgagcctcagagaccccaatcccatgcctgggggagagacagcggctcaggagtgggggagcacgggccttctacaccacatgggaaggctctggcatgaggttttcctttgggaaggttgtttgggcccctgaagttccatctccgagagtggtgtgcagggcaggccagggcccatgctggctgcagtctctgtggctgcctgcctgggccagcctgtttgggagctgggactgtgggctcgccttttcgtacctgggctcaggtgcggtgtggccaccgccaccctcatcccctgcctgggaggctctcccaggggctgatgggggggttctgtgagggagaatcagggctcgggaagccacgcctgggaaggcaggacacaggacacagcagctttctttggaaatctcccaggtgaggattcacatcccaaaataaaattcagaagccaggtggcctgtgctccccatgggtgacctctggaggcagtggaccaagatgcagcaaggagaggatgcagaacagcttcttgcagaagcacctgctccggcatccagcgctgcctggaggcaggaaggagaggcagggcaggacacgctggtctgagatgagggggagccccacgggccccaggcaggctagaggaggcacaggccctgccacggccaactcaggtcagccagcctgaggctgtggcctccaaagggtctgggcgcaccccccaggtcgcaggtgtctgaggccagccaacctgcagagcactcgcggcgtgggtgggctgagtggaggtgcctgggagctgcctaaattcagaagcctccactgccatggagactgcctggctgtgtcctctcagccaggtgccgtgttggccttggctaggacccagagccacactgcagcctccgccgactccctccttccgggcctgctctagtgaggagtgcctaagccaggacccagaaactcagagttgatggtgagaggaggccgcctgagtcaggacacctggcttcttgaaaagttcgctctgccagaaaccacctagggaccacgttagctgccttccttgagctccccaggagtcggtttccacatctgtgaggtggagggctggtgtggaggtgctcatggggtgcggtgcttgggagacagccaggcccagggtggctgctgcttcctgctaagtgggggaggtgagacagatctggaaagccgtctccctcagatggtttcatttaatgctttatactgccgagtctgggggcttgttttggtttgggggcagccatcctccaccagaaagggggagctccttccgctgcggctccagatagatggggatgccgggctccaggccgaccagcacttgggatctgatgggacacggccagtgcctaggggtgccaagtccaaggcctcccactgggagtcatcgctgagaagatgccaatgtttcatccaccggctgcacaggcacaaactcccccacccaggacggctgtgatgaggtggccctccctgtcaaccctggtccctggagtccccagcacctggggccctggtggggctgatgtcacaggtgtttactgtgctgctgcactggtcctatgccagcctcacccatgtggggaccacggaaggcacactcccttacccccggtgccgggccgtgcggtcccccagacggacagcagctgtggcgacctgcgtttctccctgggcctgtgcttcctgtagttagtccgtcccctggttcccctgtggctcagaggccgcgtccctggcttgtacatatgtgattgctgtgggcacaccccagaccccatgtcatagctgccgtcccgacgtcacgacgcctgtcccgatgtcttacacccgagtgttagccctaggctcctgtactgtgcgtgcactggcgaggctaggacactggcgaaggctaggacactggcgaggctaggacactggcaaggctaggacactggcgaggcatgga

SEQ ID NO: 87300 - DNA, 7885 bp, Homo sapiens
agccggcgagcggcagcagctccgggctcgagagcccgcgcccatgccagtgcccatgcggggccgccgccagtgacgccggagaggtgttccccccacactggggctcccactactgcgaggagtgacccacgaaggccacagagatggccggggcttcggtgaaggtggcggtgcgggtccgccccttcaattcccgggaaatgagccgtgactccaagtgcatcattcagatgtctggaagcaccaccaccattgttaaccccaaacagcccaaggagacgcccaaaagcttcagctttgactactcctactggtcgcacacctcacctgaggacatcaactacgcgtcgcagaagcaggtgtaccgggacatcggcgaggagatgctgcagcatgcctttgagggatacaacgtgtgcatcttcgcctatgggcagacgggtgccggcaagtcctacaccatgatgggcaagcaggagaaggaccagcagggcatcatcccacagctctgcgaggacctcttctctcggatcaacgacacgaccaacgacaacatgtcctactccgtggaggtcagctacatggagatttactgtgagcgcgtccgtgacctcctgaaccccaagaacaagggcaaccttcgcgtgagggagcacccactgctggggccctacgtggaggacctctccaagctggctgtcacctcctacaatgacatccaggacctcatggactcagggaacaaggccaggaccgtggcggccaccaacatgaatgagaccagcagtcgctcccacgccgtcttcaacatcatcttcacccagaagcgccatgacgcagagaccaatatcaccacggagaaggtgagcaaaatcagcctggtggacctggctgggagcgagcgggctgactccacgggagccaagggcacgcgcctcaaggagggggccaacatcaacaagtcgctgaccaccctgggcaaggtcatctccgccctggctgaaatggactccggacccaacaagaacaagaaaaagaagaagacagatttcattccgtaccgagattccgtgttgacctggctcctccgggaaaacctgggcggtaactcaaggacagctatggtggcagccctgagtcctgcagacatcaactacgatgagacccttagcacgctgaggtatgctgaccgggccaagcagatccgctgcaatgctgtcatcaatgaggaccccaacaacaagctgatccgcgagctgaaggatgaggtgacccggctgcgggaccttctgtacgcccagggtcttggcgacatcactgacatgaccaatgccctggtgggtatgagcccctcatcctcgctctcagccctgtccagccgcgcggcctccgtgtccagcctccacgagcgcatcttgtttgccccgggcagcgaggaggccattgaaagactgaaggaaacagagaagatcatagctgagctcaatgagacctgggaggagaagctgcggcggacagaagccatccggatggagagggaagccctgctggccgagatgggtgtggccatgagggaggatggcggcaccttgggcgtattctctcccaaaaagacaccacacctcgtcaacctgaacgaggacccgctgatgtctgagtgcctgctctactacatcaaggatgggatcaccagagtgggcagggaggatggcgagaggcggcaggacattgttctgagtgggcacttcatcaaggaggagcactgcgtcttccggagcgactccaggggaggcagcgaagctgtggtgaccttggagccctgtgagggggcagacacctacgtcaatggcaagaaagtcacagagcccagcatcctgcgttcaggaaaccgcatcatcatgggtaagagccatgtgttccggttcaaccaccccgagcaggcccggcaggagcgtgagcgcacgccttgtgcggagacgccagctgagcctgtggactgggccttcgcccagcgtgagctgctggagaagcagggcatcgacatgaagcaggagatggagcagaggctccaggaactggaggaccagtaccgccgcgagcgggaggaggccacctacctgctggagcagcagcggctggactatgagagcaagctggaggctctgcagaagcagatggactccaggtactacccggaggtgaacgaggaggaggaggagcccgaggatgaagtccagtggacagagcgggagtgtgagctggcgctctgggccttccggaagtggaagtggtaccagttcacgtctctgcgggacctgctgtggggcaacgccatcttcctcaaggaggctaatgccatcagcgtggagctgaaaaagaaggtacaattccagtttgtcctcctgacggacacactctactcccctctgccacccgacctgctgcccccagaggccgccaaagaccgagagacgcggcccttcccccgcaccattgtggccgtggaggtccaggaccagaagaacggggccacccactactggacgctggagaagctcaggcagcgtctggacctgatgcgggagatgtacgaccgcgctgcagaggtgccctccagtgtcatcgaggactgtgacaacgtggtgaccggcggagaccccttctatgaccgcttcccctggttccggctggtgggcagggccttcgtgtacctgagcaacctgctgtaccccgttcccctggtacaccgtgtggcaatcgtcagcgagaagggcgaggtgaagggcttcctccgcgtggccgtccaggccatctcagccgatgaagaggcccctgattatggctctggcgtccgccagtcgggaactgctaaaatctcctttgatgaccagcattttgaaaagttccagtccgagtcttgccccgtggtggggatgtcccgctcgggaacctcccaggaagagcttcgcatcgtggagggccagggccagggtgcagacgtggggccctcagccgatgaagtcaacaacaacacctgttcagcagtgcccccagaaggcctcctcctagacagctctgagaaagccgccctggatgggcccctggatgctgccctggaccacctccgcctgggcaacaccttcaccttccgtgtgacagtcctgcaggcgtccagcatctctgccgaatatgccgacatcttctgccagttcaacttcatccaccgccacgacgaggccttctccacagagcccctgaagaacacaggcagaggccccccacttggcttctaccacgtccagaacatcgcagtggaggtgaccaagtccttcattgagtacatcaagagccagcccattgttttcgaggtctttggccactaccagcagcacccgttcccgcccctctgcaaggacgtgctcagccccctgaggccctcgcgccgccacttccctcgggtcatgccactgtccaagccagtgcccgccaccaagctcagcacactgacgcggccctgtccgggaccctgccactgcaagtacgacctgctggtctacttcgagatctgtgagctggaggccaacggcgattacatcccggccgtggtggaccaccgtgggggcatgccatgcatggggaccttcctcctccaccagggcatccagcgacggattacggtgacactactgcatgagacaggcagccatatccgctggaaggaagtgcgcgagctggtcgtgggccgcatccgaaacactccagagaccgacgagtccctgatcgaccccaacatcttgtctctcaacatcctctcttccggatacatccacccagcccaagatgaccggaccttttaccaatttgaggctgcgtgggacagctccatgcacaactctctcctgctgaaccgggtcaccccttatcgagagaaaatctacatgacactctccgcttatatcgagatggagaactgcacccagccggctgttgtcaccaaggacttctgcatggtcttctattcccgtgatgccaagctgccagcctcgcgctccatccgcaacctctttggcagtgggagccttcgggcctcagagagtaaccgtgtgactggtgtgtacgagctcagcctgtgccacgtggctgacgcgggcagcccagggatgcagcgccggcgccgacgagtcctggacacatctgtggcctatgtccggggcgaggagaacctggcaggctggaggccccggagtgacagtctcattctggaccaccagtgggagctggagaagctgagcctcctgcaggaggtggagaagactaggcactacctgctcctgcgggagaagctggagaccgcccagcggcctgtcccggaggcactgtccccggccttcagcgaggactctgagtcccatggctcctccagcgcctcctccccgctctcggctgagggccgcccatcacccctggaggctcccaacgagaggcagcgggagctggccgtcaagtgcttgcgcctgctcacgcacacattcaacagagagtacacacacagccacgtctgcgtcagtgccagcgagagcaagctctccgagatgtctgtcaccctgctccgggacccgtcgatgtcccctctaggggtggccactctcaccccctcctccacttgcccctctctggttgaagggcggtacggtgccactgacctgaggaccccgcagccctgctcccggccagccagcccagagcccgagctgctgccagaggccgactccaagaagctcccttcccctgcccgggcaacagagacagacaaggagccccagcgcctgctggtccctgacatccaggagatccgagtcagcccgatcgtttccaagaaggggtacctgcacttcctggagccgcacacgtcaggctgggccaggcgcttcgtggtggtgcggcgcccctatgcctacatgtacaacagcgacaaggacaccgtggagcggttcgtgctcaacctggccactgcccaggtggagtacagtgaggaccagcaggctatgctcaagacacccaacacattcgcggtgtgcacggaacaccgcggcatcctgctgcaggccgccagcgacaaggacatgcatgactggctgtacgccttcaaccccctcctggccgggaccatacggtccaagctctccagaaggaggtctgcccagatgcgggtctgaacctgagccctcccgtgacagccggcaggcccagcccatcccctccctcatcctcgtctgtcctgtcacctgccgcccagcccctctcctgccagacagcccacgaccgggtcgaccccccaggggacgcccatgccaggcccggggacctgtgccacacgaccagctgtgctcccagcagaggctgtgcgtgtcagttcttcttgcagaatgtgctctggtggaacaagttgggagaggctgggggggccaagggcacaggttacgggggttcttgctgccgttctaatatttttttaagcatagacagacttataattaatatacgttagttagtgacattgaaacagtcaactcggaaattaactataagacttgttctatttataagtatttatttctaatgcctccacatagccctgtaatattcagatggaacccccaaccacctccaccctgtttgttcccacatgtgtctcccaagcctgctagggacaggcagggcagggacagccaccttggaaggccgcagtgaggagctgtctggaccagtggggcaccttggggctagcacacgggtgtatcgcctgggccccaggcttctccatggccacatgggtcctgggtgtatgtgtgggagagtgggggggtgtctttggtgcctgaagtctgcgcggcatggagggtggtgtgagttcctctggtgggagggagaacgcacatctcttctgggcggccacctgaggagtgactccaagaagagttccggcagctttccccaggaaagggtgaggggtgacactcggctctggctctgagatgaggcagacggcacccaggctgtgatctgtcctgggcggggaccaggagggagcggggtcgggatcacctgccagtgtgcagactctgggactgcgtgctgtctccggaccatcagggtagggtggtgggttgagaccaggaagtcagggaagatcggaattcagggcgacggtctaggtgtcgagggctgtggcgcagcctcttcagctgcggcgagaaatggagtgagtcaaggtagcttctgggaagaaatgctgccattagcaggtttcttgcaaagactttcctctctttgttcccagggcagagagtttctgtgagtcccactgagaaaatcccatggggtgggggtatcctggtcggtcggcaatggagggtggctggcttggtggttattgtcttcaaggagctcttcgctgctgcatctgcggtgtccctttgttcttgtcccatttcaccccctctgcagacaccaatgtccgagggccacccaggacaggacgggggtcagccccaagctgagagtctggtcataggagtcatgtccagaggcctagggaggttttagggccctccccacccacacccacaggtcgatttggtctctttttagctcaaggaaagacagtagccaagcaacagagcccctctcccgccgtggcccgtgggagcagttacatcgggtctggtgctccagacctagggcccagcactttcatcagatcctgcctcctggagtgggggaaacgcagcaccccactggttctgaggcccctaccctcccaggctgtcccacgtgatgctgacatgagcctcagagaccccaatcccatgcctgggggagagacagcggctcaggagtgggggagcacgggccttctacaccacatgggaaggctagttcgctctgccagaaaccacctagggaccacgttagctgccttccttgagctccccaggagtcggtttccacatctgtgaggtggagggctggtgtggaggtgctcatggggtgcggtgcttgggagacagccaggcccagggtggctgctgcttcctgctaagtgggggaggtgagacagatctggaaagccgtctccctcagatggtttcatttaatgctttatactgccgagtctgggggcttgttttggtttgggggcagccatcctccaccagaaagggggagctccttccgctgcggctccagatagatggggatgccgggctccaggccgaccagcacttgggatctgatgggacacggccagtgcctaggggtgccaagtccaaggcctcccactgggagtcatcgctgagaagatgccaatgtttcatccaccggctgcacaggcacaaactcccccacccaggacggctgtgatgaggtggccctccctgtcaaccctggtccctggagtccccagcacctggggccctggtggggctgatgtcacaggtgtttactgtgctgctgcactggtcctatgccagcctcacccatgtggggaccacggaaggcacactcccttacccccggtgccgggccgtgcggtcccccagacggacagcagctgtggcgacctgcgtttctccctgggcctgtgcttcctgtagttagtccgtcccctggttcccctgtggctcagaggccgcgtccctggcttgtacatatgtgattgctgtgggcacaccccagaccccatgtcatagctgccgtcccgacgtcacgacgcctgtcccgatgtcttacacccgagtgttagccctaggctcctgtactgtgcgtgcacttgaggctctgtccaattaagaaataaatgtggctcttactcaacacagtc

SEQ ID NO: 87301 - DNA, 3896 bp, Homo sapiens
gtttcctacatccaggagatccagtcagcccgatcgtttccaagaaggggtacctgcacttcctggagccgcacacgtcaggctgggccaggcgcttcgtggtggtgcggcgcccctatgcctacatgtacaacagcgacaaggacaccgtggagcggttcgtgctcaacctggccactgcccaggtggagtacagtgaggaccagcaggctatgctcaagacacccaacacattcgcggtgtgcacggaacaccgcggcatcctgctgcaggccgccagcgacaaggacatgcatgactggctgtacgccttcaaccccctcctggccgggaccatacggtccaagctctccagaaggaggtctgcccagatgcgggtctgaacctgagccctcccgtgacagccggcaggcccagcccatcccctccctcatcctcgtctgtcctgtgccacacgaccagctgtgctcccagcagaggctgtgcgtgtcagttcttcttgcagaatgtgctctggtggaacaagttgggagaggctgggggggccaagggcacaggttacgggggttcttgctgccgttctaatatttttttaagcatagacagacttataattaatatacgttagttagtgacattgaaacagtcaactcggaaattaactataagacttgttctatttataagtatttatttctaatgcctccacatagccctgtaatattcagatggaacccccaaccacctccaccctgtttgttcccacatgtgtctcccaagcctgctagggacaggcagggcagggacagccaccttggaaggccgcagtgaggagctgtctggaccagtggggcaccttggggctagcacacgggtgtatcgcctgggccccaggcttctccatggccacatgggtcctgggtgtatgtgtgggagagtgggggggtgtctttggtgcctgaagtctgcgcggcatggagggtggtgtgagttcctctggtgggagggagaacgcacatctcttctgggcggccacctgaggagtgactccaagaagagttccggcagctttccccaggaaagggtgaggggtgacactcggctctggctctgagatgaggcagacggcacccaggctgtgatctgtcctgggcggggaccaggagggagcggggtcgggatcacctgccagtgtgcagactctgggactgcgtgctgtctccggaccatcagggtagggtggtgggttgagaccaggaagtcagggaagatcggaattcagggcgacggtctaggtgtcgagggctgtggcgcagcctcttcagctgcggcgagaaatggagtgagtcaaggtagcttctgggaagaaatgctgccattagcaggtttcttgcaaagactttcctctctttgttcccagggcagagagtttctgtgagtcccactgagaaaatcccatggggtgggggtatcctggtcggtcggcaatggagggtggctggcttggtggttattgtcttcaaggagctcttcgctgctgcatctgcggtgtccctttgttcttgtcccatttcaccccctctgcagacaccaatgtccgagggccacccaggacaggacgggggtcagccccaagctgagagtctggtcataggagtcatgtccagaggcctagggaggttttagggccctccccacccacacccacaggtcgatttggtctctttttagctcaaggaaagacagtagccaagcaacagagcccctctcccgccgtggcccgtgggagcagttacatcgggtctggtgctccagacctagggcccagcactttcatcagatcctgcctcctggagtgggggaaacgcagcaccccactggttctgaggcccctaccctcccaggctgtcccacgtgatgctgacatgagcctcagagaccccaatcccatgcctgggggagagacagcggctcaggagtgggggagcacgggccttctacaccacatgggaaggctctggcatgaggttttcctttgggaaggttgtttgggcccctgaagttccatctccgagagtggtgtgcagggcaggccagggcccatgctggctgcagtctctgtggctgcctgcctgggccagcctgtttgggagctgggactgtgggctcgccttttcgtacctgggctcaggtgcggtgtggccaccgccaccctcatcccctgcctgggaggctctcccaggggctgatgggggggttctgtgagggagaatcagggctcgggaagccacgcctgggaaggcaggacacaggacacagcagctttctttggaaatctcccaggtgaggattcacatcccaaaataaaattcagaagccaggtggcctgtgctccccatgggtgacctctggaggcagtggaccaagatgcagcaaggagaggatgcagaacagcttcttgcagaagcacctgctccggcatccagcgctgcctggaggcaggaaggagaggcagggcaggacacgctggtctgagatgagggggagccccacgggccccaggcaggctagaggaggcacaggccctgccacggccaactcaggtcagccagcctgaggctgtggcctccaaagggtctgggcgcaccccccaggtcgcaggtgtctgaggccagccaacctgcagagcactcgcggcgtgggtgggctgagtggaggtgcctgggagctgcctaaattcagaagcctccactgccatggagactgcctggctgtgtcctctcagccaggtgccgtgttggccttggctaggacccagagccacactgcagcctccgccgactccctccttccgggcctgctctagtgaggagtgcctaagccaggacccagaaactcagagttgatggtgagaggaggccgcctgagtcaggacacctggcttcttgaaaagttcgctctgccagaaaccacctagggaccacgttagctgccttccttgagctccccaggagtcggtttccacatctgtgaggtggagggctggtgtggaggtgctcatggggtgcggtgcttgggagacagccaggcccagggtggctgctgcttcctgctaagtgggggaggtgagacagatctggaaagccgtctccctcagatggtttcatttaatgctttatactgccgagtctgggggcttgttttggtttgggggcagccatcctccaccagaaagggggagctccttccgctgcggctccagatagatggggatgccgggctccaggccgaccagcacttgggatctgatgggacacggccagtgcctaggggtgccaagtccaaggcctcccactgggagtcatcgctgagaagatgccaatgtttcatccaccggctgcacaggcacaaactcccccacccaggacggctgtgatgaggtggccctccctgtcaaccctggtccctggagtccccagcacctggggccctggtggggctgatgtcacaggtgtttactgtgctgctgcactggtcctatgccagcctcacccatgtggggaccacggaaggcacactcccttacccccggtgccgggccgtgcggtcccccagacggacagcagctgtggcgacctgcgtttctccctgggcctgtgcttcctgtagttagtccgtcccctggttcccctgtggctcagaggccgcgtccctggcttgtacatatgtgattgctgtgggcacaccccagaccccatgtcatagctgccgtcccgacgtcacgacgcctgtcccgatgtcttacacccgagtgttagccctaggctcctgtactgtgcgtgcacttgaggctctgtccaattaagaaataaatgtggctcttactcaacacagtc

SEQ ID NO: 87302 - DNA, 6513 bp, Homo sapiens
agccggcgagcggcagcagctccgggctcgagagcccgcgcccatgccagtgcccatgcggggccgccgccagtgacgccggagaggtgttccccccacactggggctcccactactgcgaggagtgacccacgaaggccacagagatggccggggcttcggtgaaggtggcggtgcgggtccgccccttcaattcccgggaaatgagccgtgactccaagtgcatcattcagatgtctggaagcaccaccaccattgttaaccccaaacagcccaaggagacgcccaaaagcttcagctttgactactcctactggtcgcacacctcacctgaggacatcaactacgcgtcgcagaagcaggtgtaccgggacatcggcgaggagatgctgcagcatgcctttgagggatacaacgtgtgcatcttcgcctatgggcagacgggtgccggcaagtcctacaccatgatgggcaagcaggagaaggaccagcagggcatcatcccacagctctgcgaggacctcttctctcggatcaacgacacgaccaacgacaacatgtcctactccgtggaggtcagctacatggagatttactgtgagcgcgtccgtgacctcctgaaccccaagaacaagggcaaccttcgcgtgagggagcacccactgctggggccctacgtggaggacctctccaagctggctgtcacctcctacaatgacatccaggacctcatggactcagggaacaaggccaggaccgtggcggccaccaacatgaatgagaccagcagtcgctcccacgccgtcttcaacatcatcttcacccagaagcgccatgacgcagagaccaatatcaccacggagaaggtgagcaaaatcagcctggtggacctggctgggagcgagcgggctgactccacgggagccaagggcacgcgcctcaaggagggggccaacatcaacaagtcgctgaccaccctgggcaaggtcatctccgccctggctgaaatggactccggacccaacaagaacaagaaaaagaagaagacagatttcattccgtaccgagattccgtgttgacctggctcctccgggaaaacctgggcggtaactcaaggacagctatggtggcagccctgagtcctgcagacatcaactacgatgagacccttagcacgctgaggtatgctgaccgggccaagcagatccgctgcaatgctgtcatcaatgaggaccccaacaacaagctgatccgcgagctgaaggatgaggtgacccggctgcgggaccttctgtacgcccagggtcttggcgacatcactgacatgaccaatgccctggtgggtatgagcccctcatcctcgctctcagccctgtccagccgcgcggcctccgtgtccagcctccacgagcgcatcttgtttgccccgggcagcgaggaggccattgaaagactgaaggaaacagagaagatcatagctgagctcaatgagacctgggaggagaagctgcggcggacagaagccatccggatggagagggaagccctgctggccgagatgggtgtggccatgagggaggatggcggcaccttgggcgtattctctcccaaaaagacaccacacctcgtcaacctgaacgaggacccgctgatgtctgagtgcctgctctactacatcaaggatgggatcaccagagtgggcagggaggatggcgagaggcggcaggacattgttctgagtgggcacttcatcaaggaggagcactgcgtcttccggagcgactccaggggaggcagcgaagctgtggtgaccttggagccctgtgagggggcagacacctacgtcaatggcaagaaagtcacagagcccagcatcctgcgttcaggaaaccgcatcatcatgggtaagagccatgtgttccggttcaaccaccccgagcaggcccggcaggagcgtgagcgcacgccttgtgcggagacgccagctgagcctgtggactgggccttcgcccagcgtgagctgctggagaagcagggcatcgacatgaagcaggagatggagcagaggctccaggaactggaggaccagtaccgccgcgagcgggaggaggccacctacctgctggagcagcagcggctggactatgagagcaagctggaggctctgcagaagcagatggactccaggtactacccggaggtgaacgaggaggaggaggagcccgaggatgaagtccagtggacagagcgggagtgtgagctggcgctctgggccttccggaagtggaagtggtaccagttcacgtctctgcgggacctgctgtggggcaacgccatcttcctcaaggaggctaatgccatcagcgtggagctgaaaaagaaggtacaattccagtttgtcctcctgacggacacactctactcccctctgccacccgacctgctgcccccagaggccgccaaagaccgagagacgcggcccttcccccgcaccattgtggccgtggaggtccaggaccagaagaacggggccacccactactggacgctggagaagctcaggcagcgtctggacctgatgcgggagatgtacgaccgcgctgcagaggtgccctccagtgtcatcgaggactgtgacaacgtggtgaccggcggagaccccttctatgaccgcttcccctggttccggctggtgggcagggccttcgtgtacctgagcaacctgctgtaccccgttcccctggtacaccgtgtggcaatcgtcagcgagaagggcgaggtgaagggcttcctccgcgtggccgtccaggccatctcagccgatgaagaggcccctgattatggctctggcgtccgccagtcgggaactgctaaaatctcctttgatgaccagcattttgaaaagttccagtccgagtcttgccccgtggtggggatgtcccgctcgggaacctcccaggaagagcttcgcatcgtggagggccagggccagggtgcagacgtggggccctcagccgatgaagtcaacaacaacacctgttcagcagtgcccccagaaggcctcctcctagacagctctgagaaagccgccctggatgggcccctggatgctgccctggaccacctccgcctgggcaacaccttcaccttccgtgtgacagtcctgcaggcgtccagcatctctgccgaatatgccgacatcttctgccagttcaacttcatccaccgccacgacgaggccttctccacagagcccctgaagaacacaggcagaggccccccacttggcttctaccacgtccagaacatcgcagtggaggtgaccaagtccttcattgagtacatcaagagccagcccattgttttcgaggtctttggccactaccagcagcacccgttcccgcccctctgcaaggacgtgctcagccccctgaggccctcgcgccgccacttccctcgggtcatgccactgtccaagccagtgcccgccaccaagctcagcacactgacgcggccctgtccgggaccctgccactgcaagtacgacctgctggtctacttcgagatctgtgagctggaggccaacggcgattacatcccggccgtggtggaccaccgtgggggcatgccatgcatggggaccttcctcctccaccagggcatccagcgacggattacggtgacactactgcatgagacaggcagccatatccgctggaaggaagtgcgcgagctggtcgtgggccgcatccgaaacactccagagaccgacgagtccctgatcgaccccaacatcttgtctctcaacatcctctcttccggatacatccacccagcccaagatgaccggaccttttaccaatttgaggctgcgtgggacagctccatgcacaactctctcctgctgaaccgggtcaccccttatcgagagaaaatctacatgacactctccgcttatatcgagatggagaactgcacccagccggctgttgtcaccaaggacttctgcatggtcttctattcccgtgatgccaagctgccagcctcgcgctccatccgcaacctctttggcagtgggagccttcgggcctcagagagtaaccgtgtgactggtgtgtacgagctcagcctgtgccacgtggctgacgcgggcagcccagggatgcagcgccggcgccgacgagtcctggacacatctgtggcctatgtccggggcgaggagaacctggcaggctggaggccccggagtgacagtctcattctggaccaccagtgggagctggagaagctgagcctcctgcaggaggtggagaagactaggcactacctgctcctgcgggagaagctggagaccgcccagcggcctgtcccggaggcactgtccccggccttcagcgaggactctgagtcccatggctcctccagcgcctcctccccgctctcggctgagggccgcccatcacccctggaggctcccaacgagaggcagcgggagctggccgtcaagtgcttgcgcctgctcacgcacacattcaacagagagtacacacacagccacgtctgcgtcagtgccagcgagagcaagctctccgagatgtctgtcaccctgctccgggacccgtcgatgtcccctctaggggtggccactctcaccccctcctccacttgcccctctctggttgaagggcggtacggtgccactgacctgaggaccccgcagccctgctcccggccagccagcccagagcccgagctgctgccagaggccgactccaagaagctcccttcccctgcccgggcaacagagacagacaaggagccccagcgcctgctggtccctgacatccaggagatccgagtcagcccgatcgtttccaagaaggggtacctgcacttcctggagccgcacacgtcaggctgggccaggcgcttcgtggtggtgcggcgcccctatgcctacatgtacaacagcgacaaggacaccgtggagcggttcgtgctcaacctggccactgcccaggtggagtacagtgaggaccagcaggctatgctcaagacacccaacacattcgcggtgtgcacggaacaccgcggcatcctgctgcaggccgccagcgacaaggacatgcatgactggctgtacgccttcaaccccctcctggccgggaccatacggtccaagctctccagaaggaggtctgcccagatgcgggtctgaacctgagccctcccgtgacagccggcaggcccagcccatcccctccctcatcctcgtctgtcctgtcacctgccgcccagcccctctcctgccagacagcccacgaccgggtcgaccccccaggggacgcccatgccaggcccggggacctgtgccacacgaccagctgtgctcccagcagaggctgtgcgtgtcagttcttcttgcagaatgtgctctggtggaacaagttgggagaggctgggggggccaagggcacaggttacgggggttcttgctgccgttctaatatttttttaagcatagacagacttataattaatatacgttagttagtgacattgaaacagtcaactcggaaattaactataagacttgttctatttataagtatttatttctaatgcctccacatagccctgtaatattcagatggaacccccaaccacctccaccctgtttgttcccacatgtgtctcccaagcctgctagggacaggcagggcagggacagccaccttggaaggccgcagtgaggagctgtctggaccagtggggcaccttggggctagcacacgggtgtatcgcctgggccccaggcttctccatggccacatgggtcctgggtgtatgtgtgggagagtgggggggtgtctttggtgcctgaagtctgcgcggcatggagggtggtgtgagttcctctggtgggagggagaacgcacatctcttctgggcggccacctgaggagtgactccaagaagagttccggcagctttccccaggaaagggtgaggggtgacactcggctctggctctgagatgaggcagacggcacccaggctgtgatctgtcctgggcggggacctggagtccccagcacctggggccctggtggggctgatgtcacaggtgtttactgtgctgctgcactggtcctatgccagcctcacccatgtggggaccacggaaggcacactcccttacccccggtgccgggccgtgcggtcccccagacggacagcagctgtggcgacctgcgtttctccctgggcctgtgcttcctgtagttagtccgtcccctggttcccctgtggctcagaggccgcgtccctggcttgtacatatgtgattgctgtgggcacaccccagaccccatgtcatagctgccgtcccgacgtcacgacgcctgtcccgatgtcttacacccgagtgttagccctaggctcctgtactgtgcgtgcacttgaggctctgtccaattaagaaataaatgtggctcttactcaacacagtc

SEQ ID NO: 87303 - DNA, 4999 bp, Homo sapiens
agccggcgagcggcagcagctccgggctcgagagcccgcgcccatgccagtgcccatgcggggccgccgccagtgacgccggagaggtgttccccccacactggggctcccactactgcgaggagtgacccacgaaggccacagagatggccggggcttcggtgaaggtggcggtgcgggtccgccccttcaattcccgggaaatgagccgtgactccaagtgcatcattcagatgtctggaagcaccaccaccattgttaaccccaaacagcccaaggagacgcccaaaagcttcagctttgactactcctactggtcgcacacctcacctgaggacatcaactacgcgtcgcagaagcaggtgtaccgggacatcggcgaggagatgctgcagcatgcctttgagggatacaacgtgtgcatcttcgcctatgggcagacgggtgccggcaagtcctacaccatgatgggcaagcaggagaaggaccagcagggcatcatcccacagctctgcgaggacctcttctctcggatcaacgacacgaccaacgacaacatgtcctactccgtggaggtcagctacatggagatttactgtgagcgcgtccgtgacctcctgaaccccaagaacaagggcaaccttcgcgtgagggagcacccactgctggggccctacgtggaggacctctccaagctggctgtcacctcctacaatgacatccaggacctcatggactcagggaacaaggccaggaccgtggcggccaccaacatgaatgagaccagcagtcgctcccacgccgtcttcaacatcatcttcacccagaagcgccatgacgcagagaccaatatcaccacggagaaggtgagcaaaatcagcctggtggacctggctgggagcgagcgggctgactccacgggagccaagggcacgcgcctcaaggagggggccaacatcaacaagtcgctgaccaccctgggcaaggtcatctccgccctggctgaaatggactccggacccaacaagaacaagaaaaagaagaagacagatttcattccgtaccgagattccgtgttgacctggctcctccgggaaaacctgggcggtaactcaaggacagctatggtggcagccctgagtcctgcagacatcaactacgatgagacccttagcacgctgaggtatgctgaccgggccaagcagatccgctgcaatgctgtcatcaatgaggaccccaacaacaagctgatccgcgagctgaaggatgaggtgacccggctgcgggaccttctgtacgcccagggtcttggcgacatcactgacatgaccaatgccctggtgggtatgagcccctcatcctcgctctcagccctgtccagccgcgcggcctccgtgtccagcctccacgagcgcatcttgtttgccccgggcagcgaggaggccattgaaagactgaaggaaacagagaagatcatagctgagctcaatgagacctgggaggagaagctgcggcggacagaagccatccggatggagagggaagccctgctggccgagatgggtgtggccatgagggaggatggcggcaccttgggcgtattctctcccaaaaagacaccacacctcgtcaacctgaacgaggacccgctgatgtctgagtgcctgctctactacatcaaggatgggatcaccagagtgggcagggaggatggcgagaggcggcaggacattgttctgagtgggcacttcatcaaggaggagcactgcgtcttccggagcgactccaggggaggcagcgaagctgtggtgaccttggagccctgtgagggggcagacacctacgtcaatggcaagaaagtcacagagcccagcatcctgcgttcaggaaaccgcatcatcatgggtaagagccatgtgttccggttcaaccaccccgagcaggcccggcaggagcgtgagcgcacgccttgtgcggagacgccagctgagcctgtggactgggccttcgcccagcgtgagctgctggagaagcagggcatcgacatgaagcaggagatggagcagaggctccaggaactggaggaccagtaccgccgcgagcgggaggaggccacctacctgctggagcagcagcggctggactatgagagcaagctggaggctctgcagaagcagatggactccaggtactacccggaggtgaacgaggaggaggaggagcccgaggatgaagtccagtggacagagcgggagtgtgagctggcgctctgggccttccggaagtggaagtggtaccagttcacgtctctgcgggacctgctgtggggcaacgccatcttcctcaaggaggctaatgccatcagcgtggagctgaaaaagaaggtacaattccagtttgtcctcctgacggacacactctactcccctctgccacccgacctgctgcccccagaggccgccaaagaccgagagacgcggcccttcccccgcaccattgtggccgtggaggtccaggaccagaagaacggggccacccactactggacgctggagaagctcaggcagcgtctggacctgatgcgggagatgtacgaccgcgctgcagaggtgccctccagtgtcatcgaggactgtgacaacgtggtgaccggcggagaccccttctatgaccgcttcccctggttccggctggtgggcagggccttcgtgtacctgagcaacctgctgtaccccgttcccctggtacaccgtgtggcaatcgtcagcgagaagggcgaggtgaagggcttcctccgcgtggccgtccaggccatctcagccgatgaagaggcccctgattatggctctggcgtccgccagtcgggaactgctaaaatctcctttgatgaccagcattttgaaaagttccagtccgagtcttgccccgtggtggggatgtcccgctcgggaacctcccaggaagagcttcgcatcgtggagggccagggccagggtgcagacgtggggccctcagccgatgaagtcaacaacaacacctgttcagcagtgcccccagaaggcctcctcctagacagctctgagaaagccgccctggatgggcccctggatgctgccctggaccacctccgcctgggcaacaccttcaccttccgtgtgacagtcctgcaggcgtccagcatctctgccgaatatgccgacatcttctgccagttcaacttcatccaccgccacgacgaggccttctccacagagcccctgaagaacacaggcagaggccccccacttggcttctaccacgtccagaacatcgcagtggaggtgaccaagtccttcattgagtacatcaagagccagcccattgttttcgaggtctttggccactaccagcagcacccgttcccgcccctctgcaaggacgtgctcagccccctgaggccctcgcgccgccacttccctcgggtcatgccactgtccaagccagtgcccgccaccaagctcagcacactgacgcggccctgtccgggaccctgccactgcaagtacgacctgctggtctacttcgagatctgtgagctggaggccaacggcgattacatcccggccgtggtggaccaccgtgggggcatgccatgcatggggaccttcctcctccaccagggcatccagcgacggattacggtgacactactgcatgagacaggcagccatatccgctggaaggaagtgcgcgagctggtcgtgggccgcatccgaaacactccagagaccgacgagtccctgatcgaccccaacatcttgtctctcaacatcctctcttccggatacatccacccagcccaagatgaccggaccttttaccaatttgaggctgcgtgggacagctccatgcacaactctctcctgctgaaccgggtcaccccttatcgagagaaaatctacatgacactctccgcttatatcgagatggagaactgcacccagccggctgttgtcaccaaggacttctgcatggtcttctattcccgtgatgccaagctgccagcctcgcgctccatccgcaacctctttggcagtgggagccttcgggcctcagagagtaaccgtgtgactggtgtgtacgagctcagcctgtgccacgtggctgacgcgggcagcccagggatgcagcgccggcgccgacgagtcctggacacatctgtggcctatgtccggggcgaggagaacctggcaggctggaggccccggagtgacagtctcattctggaccaccagtgggagctggagaagctgagcctcctgcaggaggtggagaagactaggcactacctgctcctgcgggagaagctggagaccgcccagcggcctgtcccggaggcactgtccccggccttcagcgaggactctgagtcccatggctcctccagcgcctcctccccgctctcggctgagggccgcccatcacccctggaggctcccaacgagaggcagcgggagctggccgtcaagtgcttgcgcctgctcacgcacacattcaacagagagtacacacacagccacgtctgcgtcagtgccagcgagagcaagctctccgagatgtctgtcaccctgctccgggacccgtcgatgtcccctctaggggtggccactctcaccccctcctccacttgcccctctctggttgaagggcggtacggtgccactgacctgaggtgagtgagctccaggctcccggagtggcttctggcaccacggctgacccatgaccatggccgtgactcgggcacagagagcacagaacagggggccccaatggccgagtgccttggggtggccacaggctgagggaagggcctggaggagtggagtccgcagccctctcagagggtgcctgtgccccgccagctccatcctagtgtgtgtgtgttctcttccctgaagaagaccagaaatgggtggaaaataagctaaagctcccctttcctgagacagtgcttata

SEQ ID NO: 87304 - DNA, 984 bp, Homo sapiens
ttcgtctaggtagaggctggttggaatcggccgaggctgagttcgctctgccagaaaccacctagggaccacgttagctgccttccttgagctccccaggagtcggtttccacatctgtgaggtggagggctggtgtggaggtgctcatggggtgcggtgcttgggagacagccaggcccagggtggctgctgcttcctgctaagtgggggaggtgagacagatctggaaagccgtctccctcagatggtttcatttaatgctttatactgccgagtctgggggcttgttttggtttgggggcagccatcctccaccagaaagggggagctccttccgctgcggctccagatagatggggatgccgggctccaggccgaccagcacttgggatctgatgggacacggccagtgcctaggggtgccaagtccaaggcctcccactgggagtcatcgctgagaagatgccaatgtttcatccaccggctgcacaggcacaaactcccccacccaggacggctgtgatgaggtggccctccctgtcaaccctggtccctggagtccccagcacctggggccctggtggggctgatgtcacaggtgtttactgtgctgctgcactggtcctatgccagcctcacccatgtggggaccacggaaggcacactcccttacccccggtgccgggccgtgcggtcccccagacggacagcagctgtggcgacctgcgtttctccctgggcctgtgcttcctgtagttagtccgtcccctggttcccctgtggctcagaggccgcgtccctggcttgtacatatgtgattgctgtgggcacaccccagaccccatgtcatagctgccgtcccgacgtcacgacgcctgtcccgatgtcttacacccgagtgttagccctaggctcctgtactgtgcgtgcacttgaggctctgtccaattaagaaataaatgtggctcttactcaacacagtc

SEQ ID NO: 87305 - DNA, 4191 bp, Homo sapiens
agccggcgagcggcagcagctccgggctcgagagcccgcgcccatgccagtgcccatgcggggccgccgccagtgacgccggagaggtgttccccccacactggggctcccactactgcgaggagtgacccacgaaggccacagagatggccggggcttcggtgaaggtggcggtgcgggtccgccccttcaattcccgggaaatgagccgtgactccaagtgcatcattcagatgtctggaagcaccaccaccattgttaaccccaaacagcccaaggagacgcccaaaagcttcagctttgactactcctactggtcgcacacctcacctgaggacatcaactacgcgtcgcagaagcaggtgtaccgggacatcggcgaggagatgctgcagcatgcctttgagggatacaacgtgtgcatcttcgcctatgggcagacgggtgccggcaagtcctacaccatgatgggcaagcaggagaaggaccagcagggcatcatcccacagctctgcgaggacctcttctctcggatcaacgacacgaccaacgacaacatgtcctactccgtggaggtcagctacatggagatttactgtgagcgcgtccgtgacctcctgaaccccaagaacaagggcaaccttcgcgtgagggagcacccactgctggggccctacgtggaggacctctccaagctggctgtcacctcctacaatgacatccaggacctcatggactcagggaacaaggccaggaccgtggcggccaccaacatgaatgagaccagcagtcgctcccacgccgtcttcaacatcatcttcacccagaagcgccatgacgcagagaccaatatcaccacggagaaggtgagcaaaatcagcctggtggacctggctgggagcgagcgggctgactccacgggagccaagggcacgcgcctcaaggagggggccaacatcaacaagtcgctgaccaccctgggcaaggtcatctccgccctggctgaaatggactccggacccaacaagaacaagaaaaagaagaagacagatttcattccgtaccgagattccgtgttgacctggctcctccgggaaaacctgggcggtaactcaaggacagctatggtggcagccctgagtcctgcagacatcaactacgatgagacccttagcacgctgaggtatgctgaccgggccaagcagatccgctgcaatgctgtcatcaatgaggaccccaacaacaagctgatccgcgagctgaaggatgaggtgacccggctgcgggaccttctgtacgcccagggtcttggcgacatcactgacatgaccaatgccctggtgggtatgagcccctcatcctcgctctcagccctgtccagccgcgcggcctccgtgtccagcctccacgagcgcatcttgtttgccccgggcagcgaggaggccattgaaagactgaaggaaacagagaagatcatagctgagctcaatgagacctgggaggagaagctgcggcggacagaagccatccggatggagagggaagccctgctggccgagatgggtgtggccatgagggaggatggcggcaccttgggcgtattctctcccaaaaagacaccacacctcgtcaacctgaacgaggacccgctgatgtctgagtgcctgctctactacatcaaggatgggatcaccagagtgggcagggaggatggcgagaggcggcaggacattgttctgagtgggcacttcatcaaggaggagcactgcgtcttccggagcgactccaggggaggcagcgaagctgtggtgaccttggagccctgtgagggggcagacacctacgtcaatggcaagaaagtcacagagcccagcatcctgcgttcaggaaaccgcatcatcatgggtaagagccatgtgttccggttcaaccaccccgagcaggcccggcaggagcgtgagcgcacgccttgtgcggagacgccagctgagcctgtggactgggccttcgcccagcgtgagctgctggagaagcagggcatcgacatgaagcaggagatggagcagaggctccaggaactggaggaccagtaccgccgcgagcgggaggaggccacctacctgctggagcagcagcggctggactatgagagcaagctggaggctctgcagaagcagatggactccaggtactacccggaggtgaacgaggaggaggaggagcccgaggatgaagtccagtggacagagcgggagtgtgagctggcgctctgggccttccggaagtggaagtggtaccagttcacgtctctgcgggacctgctgtggggcaacgccatcttcctcaaggaggctaatgccatcagcgtggagctgaaaaagaaggtacaattccagtttgtcctcctgacggacacactctactcccctctgccacccgacctgctgcccccagaggccgccaaagaccgagagacgcggcccttcccccgcaccattgtggccgtggaggtccaggaccagaagaacggggccacccactactggacgctggagaagctcaggcagcgtctggacctgatgcgggagatgtacgaccgcgctgcagaggtgccctccagtgtcatcgaggactgtgacaacgtggtgaccggcggagaccccttctatgaccgcttcccctggttccggctggtgggcagggccttcgtgtacctgagcaacctgctgtaccccgttcccctggtacaccgtgtggcaatcgtcagcgagaagggcgaggtgaagggcttcctccgcgtggccgtccaggccatctcagccgatgaagaggcccctgattatggctctggcgtccgccagtcgggaactgctaaaatctcctttgatgaccagcattttgaaaagttccagtccgagtcttgccccgtggtggggatgtcccgctcgggaacctcccaggaagagcttcgcatcgtggagggccagggccagggtgcagacgtggggccctcagccgatgaagtcaacaacaacacctgttcagcagtgcccccagaaggcctcctcctagacagctctgagaaagccgccctggatgggcccctggatgctgccctggaccacctccgcctgggcaacaccttcaccttccgtgtgacagtcctgcaggcgtccagcatctctgccgaatatgccgacatcttctgccagttcaacttcatccaccgccacgacgaggccttctccacagagcccctgaagaacacaggcagaggccccccacttggcttctaccacgtccagaacatcgcagtggaggtgaccaagtccttcattgagtacatcaagagccagcccattgttttcgaggtctttggccactaccagcagcacccgttcccgcccctctgcaaggacgtgctcagccccctgaggccctcgcgccgccacttccctcgggtcatgccactgtccaagccagtgcccgccaccaagctcagcacactgacgcggccctgtccgggaccctgccactgcaagtacgacctgctggtctacttcgagatctgtgagctggaggccaacggcgattacatcccggccgtggtggaccaccgtgggggcatgccatgcatggggaccttcctcctccaccagggcatccagcgacggattacggtgacactactgcatgagacaggcagccatatccgctggaaggaagtgcgcgagctggtcgtgggccgcatccgaaacactccagagaccgacgagtccctgatcgaccccaacatcttgtctctcaacatcctctcttccggatacatccacccagcccaagatgaccggaccttttaccaatttgaggctgcgtgggacagctccatgcacaactctctcctgctgaaccgggtcaccccttatcgagagaaaatctacatgacactctccgcttatatcgagatggagaactgcacccagccggctgttgtcaccaaggacttctgcatggtcttctattcccgtgatgccaagctgccagcctcgcgctccatccgcaacctctttggcagtgggagccttcgggcctcagagagtaaccgtgtgactggtgtgtacgagctcagcctgtgccacgtggctgacgcgggcagcccaggtaggtatctgccctgctctcactgggtgg

SEQ ID NO: 87306 - DNA, 633 bp, Homo sapiens
tgatgagctggtccaagttagtcgggacgcagcacttgggatctgatgggacacggccagtgcctaggggtgccaagtccaaggcctcccactgggagtcatcgctgagaagatgccaatgtttcatccaccggctgcacaggcacaaactcccccacccaggacggctgtgatgaggtggccctccctgtcaaccctggtccctggagtccccagcacctggggccctggtggggctgatgtcacaggtgtttactgtgctgctgcactggtcctatgccagcctcacccatgtggggaccacggaaggcacactcccttacccccggtgccgggccgtgcggtcccccagacggacagcagctgtggcgacctgcgtttctccctgggcctgtgcttcctgtagttagtccgtcccctggttcccctgtggctcagaggccgcgtccctggcttgtacatatgtgattgctgtgggcacaccccagaccccatgtcatagctgccgtcccgacgtcacgacgcctgtcccgatgtcttacacccgagtgttagccctaggctcctgtactgtgcgtgcacttgaggctctgtccaattaagaaataaatgtggctcttactcaacacagtc

SEQ ID NO: 87307 - DNA, 3361 bp, Homo sapiens
agccggcgagcggcagcagctccgggctcgagagcccgcgcccatgccagtgcccatgcggggccgccgccagtgacgccggagaggtgttccccccacactggggctcccactactgcgaggagtgacccacgaaggccacagagatggccggggcttcggtgaaggtggcggtgcgggtccgccccttcaattcccgggaaatgagccgtgactccaagtgcatcattcagatgtctggaagcaccaccaccattgttaaccccaaacagcccaaggagacgcccaaaagcttcagctttgactactcctactggtcgcacacctcacctgaggacatcaactacgcgtcgcagaagcaggtgtaccgggacatcggcgaggagatgctgcagcatgcctttgagggatacaacgtgtgcatcttcgcctatgggcagacgggtgccggcaagtcctacaccatgatgggcaagcaggagaaggaccagcagggcatcatcccacagctctgcgaggacctcttctctcggatcaacgacacgaccaacgacaacatgtcctactccgtggaggtcagctacatggagatttactgtgagcgcgtccgtgacctcctgaaccccaagaacaagggcaaccttcgcgtgagggagcacccactgctggggccctacgtggaggacctctccaagctggctgtcacctcctacaatgacatccaggacctcatggactcagggaacaaggccaggaccgtggcggccaccaacatgaatgagaccagcagtcgctcccacgccgtcttcaacatcatcttcacccagaagcgccatgacgcagagaccaatatcaccacggagaaggtgagcaaaatcagcctggtggacctggctgggagcgagcgggctgactccacgggagccaagggcacgcgcctcaaggagggggccaacatcaacaagtcgctgaccaccctgggcaaggtcatctccgccctggctgaaatggactccggacccaacaagaacaagaaaaagaagaagacagatttcattccgtaccgagattccgtgttgacctggctcctccgggaaaacctgggcggtaactcaaggacagctatggtggcagccctgagtcctgcagacatcaactacgatgagacccttagcacgctgaggtatgctgaccgggccaagcagatccgctgcaatgctgtcatcaatgaggaccccaacaacaagctgatccgcgagctgaaggatgaggtgacccggctgcgggaccttctgtacgcccagggtcttggcgacatcactgacatgaccaatgccctggtgggtatgagcccctcatcctcgctctcagccctgtccagccgcgcggcctccgtgtccagcctccacgagcgcatcttgtttgccccgggcagcgaggaggccattgaaagactgaaggaaacagagaagatcatagctgagctcaatgagacctgggaggagaagctgcggcggacagaagccatccggatggagagggaagccctgctggccgagatgggtgtggccatgagggaggatggcggcaccttgggcgtattctctcccaaaaagacaccacacctcgtcaacctgaacgaggacccgctgatgtctgagtgcctgctctactacatcaaggatgggatcaccagagtgggcagggaggatggcgagaggcggcaggacattgttctgagtgggcacttcatcaaggaggagcactgcgtcttccggagcgactccaggggaggcagcgaagctgtggtgaccttggagccctgtgagggggcagacacctacgtcaatggcaagaaagtcacagagcccagcatcctgcgttcaggaaaccgcatcatcatgggtaagagccatgtgttccggttcaaccaccccgagcaggcccggcaggagcgtgagcgcacgccttgtgcggagacgccagctgagcctgtggactgggccttcgcccagcgtgagctgctggagaagcagggcatcgacatgaagcaggagatggagcagaggctccaggaactggaggaccagtaccgccgcgagcgggaggaggccacctacctgctggagcagcagcggctggactatgagagcaagctggaggctctgcagaagcagatggactccaggtactacccggaggtgaacgaggaggaggaggagcccgaggatgaagtccagtggacagagcgggagtgtgagctggcgctctgggccttccggaagtggaagtggtaccagttcacgtctctgcgggacctgctgtggggcaacgccatcttcctcaaggaggctaatgccatcagcgtggagctgaaaaagaaggtacaattccagtttgtcctcctgacggacacactctactcccctctgccacccgacctgctgcccccagaggccgccaaagaccgagagacgcggcccttcccccgcaccattgtggccgtggaggtccaggaccagaagaacggggccacccactactggacgctggagaagctcaggcagcgtctggacctgatgcgggagatgtacgaccgcgctgcagaggtgccctccagtgtcatcgaggactgtgacaacgtggtgaccggcggagaccccttctatgaccgcttcccctggttccggctggtgggcagggccttcgtgtacctgagcaacctgctgtaccccgttcccctggtacaccgtgtggcaatcgtcagcgagaagggcgaggtgaagggcttcctccgcgtggccgtccaggccatctcagccgatgaagaggcccctgattatggctctggcgtccgccagtcgggaactgctaaaatctcctttgatgaccagcattttgaaaagttccagtccgagtcttgccccgtggtggggatgtcccgctcgggaacctcccaggaagagcttcgcatcgtggagggccagggccagggtgcagacgtggggccctcagccgatgaagtcaacaacaacacctgttcagcagtgcccccagaaggcctcctcctagacagctctgagaaagccgccctggatgggcccctggatgctgccctggaccacctccgcctgggcaacaccttcaccttccgtgtgacagtcctgcaggcgtccagcatctctgccgaatatgccgacatcttctgccagttcaacttcatccaccgccacgacgaggccttctccacagagcccctgaagaacacaggcagaggccccccacttggcttctaccacgtccagaacatcgcagtggagtaccaagtccttcattgagcaatccgtactgaaccggtaca

SEQ ID NO: 87308 - DNA, 577 bp, Homo sapiens
gccctccctggctgactgtccccccattcctgcagctctgcgaggacctcttctctcggatcaacgacacgaccaacgacaacatgtcctactccgtggaggtcagctacatggagatttactgtgagcgcgtccgtgacctcctgaaccccaagaacaagggcaaccttcgcgtgagggagcacccactgctggggccctacgtggaggacctctccaagctggctgtcacctcctacaatgacatccaggacctcatggactcagggaacaaggccaggaccgtggcggccaccaacatgaatgagaccagcagtcgctcccacgccgtcttcaacatcatcttcacccagaagcgccatgacgcagagaccaatatcaccacggagaaggtgagcaaaatcagcctggtggacctggctgggagcgagcgggctgactccacgggagccaagggcacgcgcctcaaggagggggccaacatcaacaagccacggtcaacccacaagccacggtcaacccacaagccacggtcaacccacgagccacggtcaaccacaagccacggtcaacccac

SEQ ID NO: 87309 - DNA, 8819 bp, Homo sapiens
agccggcgagcggcagcagctccgggctcgagagcccgcgcccatgccagtgcccatgcggggccgccgccagtgacgccggagaggtgttccccccacactggggctcccactactgcgaggagtgacccacgaaggccacagagatggccggggcttcggtgaaggtggcggtgcgggtccgccccttcaattcccgggaaatgagccgtgactccaagtgcatcattcagatgtctggaagcaccaccaccattgttaaccccaaacagcccaaggagacgcccaaaagcttcagctttgactactcctactggtcgcacacctcacctgaggacatcaactacgcgtcgcagaagcaggtgtaccgggacatcggcgaggagatgctgcagcatgcctttgagggatacaacgtgtgcatcttcgcctatgggcagacgggtgccggcaagtcctacaccatgatgggcaagcaggagaaggaccagcagggcatcatcccacagctctgcgaggacctcttctctcggatcaacgacacgaccaacgacaacatgtcctactccgtggaggtcagctacatggagatttactgtgagcgcgtccgtgacctcctgaaccccaagaacaagggcaaccttcgcgtgagggagcacccactgctggggccctacgtggaggacctctccaagctggctgtcacctcctacaatgacatccaggacctcatggactcagggaacaaggccaggaccgtggcggccaccaacatgaatgagaccagcagtcgctcccacgccgtcttcaacatcatcttcacccagaagcgccatgacgcagagaccaatatcaccacggagaaggtgagcaaaatcagcctggtggacctggctgggagcgagcgggctgactccacgggagccaagggcacgcgcctcaaggagggggccaacatcaacaagtcgctgaccaccctgggcaaggtcatctccgccctggctgaaatggactccggacccaacaagaacaagaaaaagaagaagacagatttcattccgtaccgagattccgtgttgacctggctcctccgggaaaacctgggcggtaactcaaggacagctatggtggcagccctgagtcctgcagacatcaactacgatgagacccttagcacgctgaggtatgctgaccgggccaagcagatccgctgcaatgctgtcatcaatgaggaccccaacaacaagctgatccgcgagctgaaggatgaggtgacccggctgcgggaccttctgtacgcccagggtcttggcgacatcactgacatgaccaatgccctggtgggtatgagcccctcatcctcgctctcagccctgtccagccgcgcggcctccgtgtccagcctccacgagcgcatcttgtttgccccgggcagcgaggaggccattgaaagactgaaggaaacagagaagatcatagctgagctcaatgagacctgggaggagaagctgcggcggacagaagccatccggatggagagggaagccctgctggccgagatgggtgtggccatgagggaggatggcggcaccttgggcgtattctctcccaaaaagacaccacacctcgtcaacctgaacgaggacccgctgatgtctgagtgcctgctctactacatcaaggatgggatcaccagagtgggcagggaggatggcgagaggcggcaggacattgttctgagtgggcacttcatcaaggaggagcactgcgtcttccggagcgactccaggggaggcagcgaagctgtggtgaccttggagccctgtgagggggcagacacctacgtcaatggcaagaaagtcacagagcccagcatcctgcgttcaggaaaccgcatcatcatgggtaagagccatgtgttccggttcaaccaccccgagcaggcccggcaggagcgtgagcgcacgccttgtgcggagacgccagctgagcctgtggactgggccttcgcccagcgtgagctgctggagaagcagggcatcgacatgaagcaggagatggagcagaggctccaggaactggaggaccagtaccgccgcgagcgggaggaggccacctacctgctggagcagcagcggctggactatgagagcaagctggaggctctgcagaagcagatggactccaggtactacccggaggtgaacgaggaggaggaggagcccgaggatgaagtccagtggacagagcgggagtgtgagctggcgctctgggccttccggaagtggaagtggtaccagttcacgtctctgcgggacctgctgtggggcaacgccatcttcctcaaggaggctaatgccatcagcgtggagctgaaaaagaaggtacaattccagtttgtcctcctgacggacacactctactcccctctgccacccgacctgctgcccccagaggccgccaaagaccgagagacgcggcccttcccccgcaccattgtggccgtggaggtccaggaccagaagaacggggccacccactactggacgctggagaagctcaggcagcgtctggacctgatgcgggagatgtacgaccgcgctgcagaggtgccctccagtgtcatcgaggactgtgacaacgtggtgaccggcggagaccccttctatgaccgcttcccctggttccggctggtgggcagggccttcgtgtacctgagcaacctgctgtaccccgttcccctggtacaccgtgtggcaatcgtcagcgagaagggcgaggtgaagggcttcctccgcgtggccgtccaggccatctcagccgatgaagaggcccctgattatggctctggcgtccgccagtcgggaactgctaaaatctcctttgatgaccagcattttgaaaagttccagtccgagtcttgccccgtggtggggatgtcccgctcgggaacctcccaggaagagcttcgcatcgtggagggccagggccagggtgcagacgtggggccctcagccgatgaagtcaacaacaacacctgttcagcagtgcccccagaaggcctcctcctagacagctctgagaaagccgccctggatgggcccctggatgctgccctggaccacctccgcctgggcaacaccttcaccttccgtgtgacagtcctgcaggcgtccagcatctctgccgaatatgccgacatcttctgccagttcaacttcatccaccgccacgacgaggccttctccacagagcccctgaagaacacaggcagaggccccccacttggcttctaccacgtccagaacatcgcagtggaggtgaccaagtccttcattgagtacatcaagagccagcccattgttttcgaggtctttggccactaccagcagcacccgttcccgcccctctgcaaggacgtgctcagccccctgaggccctcgcgccgccacttccctcgggtcatgccactgtccaagccagtgcccgccaccaagctcagcacactgacgcggccctgtccgggaccctgccactgcaagtacgacctgctggtctacttcgagatctgtgagctggaggccaacggcgattacatcccggccgtggtggaccaccgtgggggcatgccatgcatggggaccttcctcctccaccagggcatccagcgacggattacggtgacactactgcatgagacaggcagccatatccgctggaaggaagtgcgcgagctggtcgtgggccgcatccgaaacactccagagaccgacgagtccctgatcgaccccaacatcttgtctctcaacatcctctcttccggatacatccacccagcccaagatgaccggaccttttaccaatttgaggctgcgtgggacagctccatgcacaactctctcctgctgaaccgggtcaccccttatcgagagaaaatctacatgacactctccgcttatatcgagatggagaactgcacccagccggctgttgtcaccaaggacttctgcatggtcttctattcccgtgatgccaagctgccagcctcgcgctccatccgcaacctctttggcagtgggagccttcgggcctcagagagtaaccgtgtgactggtgtgtacgagctcagcctgtgccacgtggctgacgcgggcagcccagggatgcagcgccggcgccgacgagtcctggacacatctgtggcctatgtccggggcgaggagaacctggcaggctggaggccccggagtgacagtctcattctggaccaccagtgggagctggagaagctgagcctcctgcaggaggtggagaagactaggcactacctgctcctgcgggagaagctggagaccgcccagcggcctgtcccggaggcactgtccccggccttcagcgaggactctgagtcccatggctcctccagcgcctcctccccgctctcggctgagggccgcccatcacccctggaggctcccaacgagaggcagcgggagctggccgtcaagtgcttgcgcctgctcacgcacacattcaacagagagtacacacacagccacgtctgcgtcagtgccagcgagagcaagctctccgagatgtctgtcaccctgctccgggacccgtcgatgtcccctctaggggtggccactctcaccccctcctccacttgcccctctctggttgaagggcggtacggtgccactgacctgaggaccccgcagccctgctcccggccagccagcccagagcccgagctgctgccagaggccgactccaagaagctcccttcccctgcccgggcaacagagacagacaaggagccccagcgcctgctggtccctgacatccaggagatccgagtcagcccgatcgtttccaagaaggggtacctgcacttcctggagccgcacacgtcaggctgggccaggcgcttcgtggtggtgcggcgcccctatgcctacatgtacaacagcgacaaggacaccgtggagcggttcgtgctcaacctggccactgcccaggtggagtacagtgaggaccagcaggctatgctcaagacacccaacacattcgcggtgtgcacggaacaccgcggcatcctgctgcaggccgccagcgacaaggacatgcatgactggctgtacgccttcaaccccctcctggccgggaccatacggtccaagctctccagaaggaggtctgcccagatgcgggtctgaacctgagccctcccgtgacagccggcaggcccagcccatcccctccctcatcctcgtctgtcctgtcacctgccgcccagcccctctcctgccagacagcccacgaccgggtcgaccccccaggggacgcccatgccaggcccggggacctgtgccacacgaccagctgtgctcccagcagaggctgtgcgtgtcagttcttcttgcagaatgtgctctggtggaacaagttgggagaggctgggggggccaagggcacaggttacgggggttcttgctgccgttctaatatttttttaagcatagacagacttataattaatatacgttagttagtgacattgaaacagtcaactcggaaattaactataagacttgttctatttataagtatttatttctaatgcctccacatagccctgtaatattcagatggaacccccaaccacctccaccctgtttgttcccacatgtgtctcccaagcctgctagggacaggcagggcagggacagccaccttggaaggccgcagtgaggagctgtctggaccagtggggcaccttggggctagcacacgggtgtatcgcctgggccccaggcttctccatggccacatgggtcctgggtgtatgtgtgggagagtgggggggtgtctttggtgcctgaagtctgcgcggcatggagggtggtgtgagttcctctggtgggagggagaacgcacatctcttctgggcggccacctgaggagtgactccaagaagagttccggcagctttccccaggaaagggtgaggggtgacactcggctctggctctgagatgaggcagacggcacccaggctgtgatctgtcctgggcggggaccaggagggagcggggtcgggatcacctgccagtgtgcagactctgggactgcgtgctgtctccggaccatcagggtagggtggtgggttgagaccaggaagtcagggaagatcggaattcagggcgacggtctaggtgtcgagggctgtggcgcagcctcttcagctgcggcgagaaatggagtgagtcaaggtagcttctgggaagaaatgctgccattagcaggtttcttgcaaagactttcctctctttgttcccagggcagagagtttctgtgagtcccactgagaaaatcccatggggtgggggtatcctggtcggtcggcaatggagggtggctggcttggtggttattgtcttcaaggagctcttcgctgctgcatctgcggtgtccctttgttcttgtcccatttcaccccctctgcagacaccaatgtccgagggccacccaggacaggacgggggtcagccccaagctgagagtctggtcataggagtcatgtccagaggcctagggaggttttagggccctccccacccacacccacaggtcgatttggtctctttttagctcaaggaaagacagtagccaagcaacagagcccctctcccgccgtggcccgtgggagcagttacatcgggtctggtgctccagacctagggcccagcactttcatcagatcctgcctcctggagtgggggaaacgcagcaccccactggttctgaggcccctaccctcccaggctgtcccacgtgatgctgacatgagcctcagagaccccaatcccatgcctgggggagagacagcggctcaggagtgggggagcacgggccttctacaccacatgggaaggctctggcatgaggttttcctttgggaaggttgtttgggcccctgaagttccatctccgagagtggtgtgcagggcaggccagggcccatgctggctgcagtctctgtggctgcctgcctgggccagcctgtttgggagctgggactgtgggctcgccttttcgtacctgggctcaggtgcggtgtggccaccgccaccctcatcccctgcctgggaggctctcccaggggctgatgggggggttctgtgagggagaatcagggctcgggaagccacgcctgggaaggcaggacacaggacacagcagctttctttggaaatctcccaggtgaggattcacatcccaaaataaaattcagaagccaggtggcctgtgctccccatgggtgacctctggaggcagtggaccaagatgcagcaaggagaggatgcagaacagcttcttgcagaagcacctgctccggcatccagcgctgcctggaggcaggaaggagaggcagggcaggacacgctggtctgagatgagggggagccccacgggccccaggcaggctagaggaggcacaggccctgccacggccaactcaggtcagccagcctgaggctgtggcctccaaagggtctgggcgcaccccccaggtcgcaggtgtctgaggccagccaacctgcagagcactcgcggcgtgggtgggctgagtggaggtgcctgggagctgcctaaattcagaagcctccactgccatggagactgcctggctgtgtcctctcagccaggtgccgtgttggccttggctaggacccagagccacactgcagcctccgccgactccctccttccgggcctgctctagtgaggagtgcctaagccaggacccagaaactcagagttgatggtgagaggaggccgcctgagtcaggacacctggcttcttgaaaagttcgctctgccagaaaccacctagggaccacgttagctgccttccttgagctccccaggagtcggtttccacatctgtgaggtggagggctggtgtggaggtgctcatggggtgcggtgcttgggagacagccaggcccagggtggctgctgcttcctgctaagtgggggaggtgagacagatctggaaagccgtctccctcagatggtttcatttaatgctttatactgccgagtctgggggcttgttttggtttgggggcagccatcctccaccagaaagggggagctccttccgctgcggctccagatagatggggatgccgggctccaggccgaccagcacttgggatctgatgggacacggccagtgcctaggggtgccaagtccaaggcctcccactgggagtcatcgctgagaagatgccaatgtttcatccaccggctgcacaggcacaaactcccccacccaggacggctgtgatgaggtggccctccctgtcaaccctggtccctggagtccccagcacctggggccctggtggggctgatgtcacaggtgtttactgtgctgctgcactggtcctatgccagcctcacccatgtggggaccacggaaggcacactcccttacccccggtgccgggccgtgcggtcccccagacggacagcagctgtggcgacctgcgtttctccctgggcctgtgcttcctgtagttagtccgtcccctggttcccctgtggctcagaggccgcgtccctggcttgtacatatgtgattgctgtgggcacaccccagaccccatgtcatagctgccgtcccgacgtcacgacgcctgtcccgatgtcttacacccgagtgttagccctaggctcctgtactgtgcgtgcacttgaggctctgtccaattaagaaataaatgtggctcttactcaacacagtc

SEQ ID NO: 87310 - DNA, 6816 bp, Homo sapiens
atcagctcggtcctcactgtacatgtccacaagggcatcgacatgaagcaggagatggagcagaggctccaggaactggaggaccagtaccgccgcgagcgggaggaggccacctacctgctggagcagcagcggctggactatgagagcaagctggaggctctgcagaagcagatggactccaggtactacccggaggtgaacgaggaggaggaggagcccgaggatgaagtccagtggacagagcgggagtgtgagctggcgctctgggccttccggaagtggaagtggtaccagttcacgtctctgcgggacctgctgtggggcaacgccatcttcctcaaggaggctaatgccatcagcgtggagctgaaaaagaaggtacaattccagtttgtcctcctgacggacacactctactcccctctgccacccgacctgctgcccccagaggccgccaaagaccgagagacgcggcccttcccccgcaccattgtggccgtggaggtccaggaccagaagaacggggccacccactactggacgctggagaagctcaggcagcgtctggacctgatgcgggagatgtacgaccgcgctgcagaggtgccctccagtgtcatcgaggactgtgacaacgtggtgaccggcggagaccccttctatgaccgcttcccctggttccggctggtgggcagggccttcgtgtacctgagcaacctgctgtaccccgttcccctggtacaccgtgtggcaatcgtcagcgagaagggcgaggtgaagggcttcctccgcgtggccgtccaggccatctcagccgatgaagaggcccctgattatggctctggcgtccgccagtcgggaactgctaaaatctcctttgatgaccagcattttgaaaagttccagtccgagtcttgccccgtggtggggatgtcccgctcgggaacctcccaggaagagcttcgcatcgtggagggccagggccagggtgcagacgtggggccctcagccgatgaagtcaacaacaacacctgttcagcagtgcccccagaaggcctcctcctagacagctctgagaaagccgccctggatgggcccctggatgctgccctggaccacctccgcctgggcaacaccttcaccttccgtgtgacagtcctgcaggcgtccagcatctctgccgaatatgccgacatcttctgccagttcaacttcatccaccgccacgacgaggccttctccacagagcccctgaagaacacaggcagaggccccccacttggcttctaccacgtccagaacatcgcagtggaggtgaccaagtccttcattgagtacatcaagagccagcccattgttttcgaggtctttggccactaccagcagcacccgttcccgcccctctgcaaggacgtgctcagccccctgaggccctcgcgccgccacttccctcgggtcatgccactgtccaagccagtgcccgccaccaagctcagcacactgacgcggccctgtccgggaccctgccactgcaagtacgacctgctggtctacttcgagatctgtgagctggaggccaacggcgattacatcccggccgtggtggaccaccgtgggggcatgccatgcatggggaccttcctcctccaccagggcatccagcgacggattacggtgacactactgcatgagacaggcagccatatccgctggaaggaagtgcgcgagctggtcgtgggccgcatccgaaacactccagagaccgacgagtccctgatcgaccccaacatcttgtctctcaacatcctctcttccggatacatccacccagcccaagatgaccggaccttttaccaatttgaggctgcgtgggacagctccatgcacaactctctcctgctgaaccgggtcaccccttatcgagagaaaatctacatgacactctccgcttatatcgagatggagaactgcacccagccggctgttgtcaccaaggacttctgcatggtcttctattcccgtgatgccaagctgccagcctcgcgctccatccgcaacctctttggcagtgggagccttcgggcctcagagagtaaccgtgtgactggtgtgtacgagctcagcctgtgccacgtggctgacgcgggcagcccagggatgcagcgccggcgccgacgagtcctggacacatctgtggcctatgtccggggcgaggagaacctggcaggctggaggccccggagtgacagtctcattctggaccaccagtgggagctggagaagctgagcctcctgcaggaggtggagaagactaggcactacctgctcctgcgggagaagctggagaccgcccagcggcctgtcccggaggcactgtccccggccttcagcgaggactctgagtcccatggctcctccagcgcctcctccccgctctcggctgagggccgcccatcacccctggaggctcccaacgagaggcagcgggagctggccgtcaagtgcttgcgcctgctcacgcacacattcaacagagagtacacacacagccacgtctgcgtcagtgccagcgagagcaagctctccgagatgtctgtcaccctgctccgggacccgtcgatgtcccctctaggggtggccactctcaccccctcctccacttgcccctctctggttgaagggcggtacggtgccactgacctgaggaccccgcagccctgctcccggccagccagcccagagcccgagctgctgccagaggccgactccaagaagctcccttcccctgcccgggcaacagagacagacaaggagccccagcgcctgctggtccctgacatccaggagatccgagtcagcccgatcgtttccaagaaggggtacctgcacttcctggagccgcacacgtcaggctgggccaggcgcttcgtggtggtgcggcgcccctatgcctacatgtacaacagcgacaaggacaccgtggagcggttcgtgctcaacctggccactgcccaggtggagtacagtgaggaccagcaggctatgctcaagacacccaacacattcgcggtgtgcacggaacaccgcggcatcctgctgcaggccgccagcgacaaggacatgcatgactggctgtacgccttcaaccccctcctggccgggaccatacggtccaagctctccagaaggaggtctgcccagatgcgggtctgaacctgagccctcccgtgacagccggcaggcccagcccatcccctccctcatcctcgtctgtcctgtcacctgccgcccagcccctctcctgccagacagcccacgaccgggtcgaccccccaggggacgcccatgccaggcccggggacctgtgccacacgaccagctgtgctcccagcagaggctgtgcgtgtcagttcttcttgcagaatgtgctctggtggaacaagttgggagaggctgggggggccaagggcacaggttacgggggttcttgctgccgttctaatatttttttaagcatagacagacttataattaatatacgttagttagtgacattgaaacagtcaactcggaaattaactataagacttgttctatttataagtatttatttctaatgcctccacatagccctgtaatattcagatggaacccccaaccacctccaccctgtttgttcccacatgtgtctcccaagcctgctagggacaggcagggcagggacagccaccttggaaggccgcagtgaggagctgtctggaccagtggggcaccttggggctagcacacgggtgtatcgcctgggccccaggcttctccatggccacatgggtcctgggtgtatgtgtgggagagtgggggggtgtctttggtgcctgaagtctgcgcggcatggagggtggtgtgagttcctctggtgggagggagaacgcacatctcttctgggcggccacctgaggagtgactccaagaagagttccggcagctttccccaggaaagggtgaggggtgacactcggctctggctctgagatgaggcagacggcacccaggctgtgatctgtcctgggcggggaccaggagggagcggggtcgggatcacctgccagtgtgcagactctgggactgcgtgctgtctccggaccatcagggtagggtggtgggttgagaccaggaagtcagggaagatcggaattcagggcgacggtctaggtgtcgagggctgtggcgcagcctcttcagctgcggcgagaaatggagtgagtcaaggtagcttctgggaagaaatgctgccattagcaggtttcttgcaaagactttcctctctttgttcccagggcagagagtttctgtgagtcccactgagaaaatcccatggggtgggggtatcctggtcggtcggcaatggagggtggctggcttggtggttattgtcttcaaggagctcttcgctgctgcatctgcggtgtccctttgttcttgtcccatttcaccccctctgcagacaccaatgtccgagggccacccaggacaggacgggggtcagccccaagctgagagtctggtcataggagtcatgtccagaggcctagggaggttttagggccctccccacccacacccacaggtcgatttggtctctttttagctcaaggaaagacagtagccaagcaacagagcccctctcccgccgtggcccgtgggagcagttacatcgggtctggtgctccagacctagggcccagcactttcatcagatcctgcctcctggagtgggggaaacgcagcaccccactggttctgaggcccctaccctcccaggctgtcccacgtgatgctgacatgagcctcagagaccccaatcccatgcctgggggagagacagcggctcaggagtgggggagcacgggccttctacaccacatgggaaggctctggcatgaggttttcctttgggaaggttgtttgggcccctgaagttccatctccgagagtggtgtgcagggcaggccagggcccatgctggctgcagtctctgtggctgcctgcctgggccagcctgtttgggagctgggactgtgggctcgccttttcgtacctgggctcaggtgcggtgtggccaccgccaccctcatcccctgcctgggaggctctcccaggggctgatgggggggttctgtgagggagaatcagggctcgggaagccacgcctgggaaggcaggacacaggacacagcagctttctttggaaatctcccaggtgaggattcacatcccaaaataaaattcagaagccaggtggcctgtgctccccatgggtgacctctggaggcagtggaccaagatgcagcaaggagaggatgcagaacagcttcttgcagaagcacctgctccggcatccagcgctgcctggaggcaggaaggagaggcagggcaggacacgctggtctgagatgagggggagccccacgggccccaggcaggctagaggaggcacaggccctgccacggccaactcaggtcagccagcctgaggctgtggcctccaaagggtctgggcgcaccccccaggtcgcaggtgtctgaggccagccaacctgcagagcactcgcggcgtgggtgggctgagtggaggtgcctgggagctgcctaaattcagaagcctccactgccatggagactgcctggctgtgtcctctcagccaggtgccgtgttggccttggctaggacccagagccacactgcagcctccgccgactccctccttccgggcctgctctagtgaggagtgcctaagccaggacccagaaactcagagttgatggtgagaggaggccgcctgagtcaggacacctggcttcttgaaaagttcgctctgccagaaaccacctagggaccacgttagctgccttccttgagctccccaggagtcggtttccacatctgtgaggtggagggctggtgtggaggtgctcatggggtgcggtgcttgggagacagccaggcccagggtggctgctgcttcctgctaagtgggggaggtgagacagatctggaaagccgtctccctcagatggtttcatttaatgctttatactgccgagtctgggggcttgttttggtttgggggcagccatcctccaccagaaagggggagctccttccgctgcggctccagatagatggggatgccgggctccaggccgaccagcacttgggatctgatgggacacggccagtgcctaggggtgccaagtccaaggcctcccactgggagtcatcgctgagaagatgccaatgtttcatccaccggctgcacaggcacaaactcccccacccaggacggctgtgatgaggtggccctccctgtcaaccctggtccctggagtccccagcacctggggccctggtggggctgatgtcacaggtgtttactgtgctgctgcactggtcctatgccagcctcacccatgtggggaccacggaaggcacactcccttacccccggtgccgggccgtgcggtcccccagacggacagcagctgtggcgacctgcgtttctccctgggcctgtgcttcctgtagttagtccgtcccctggttcccctgtggctcagaggccgcgtccctggcttgtacatatgtgattgctgtgggcacaccccagaccccatgtcatagctgccgtcccgacgtcacgacgcctgtcccgatgtcttacacccgagtgttagccctaggctcctgtactgtgcgtgcacttgaggctctgtccaattaagaaataaatgtggctcttactcaacacagtc

SEQ ID NO: 87311 - DNA, 6780 bp, Homo sapiens
caagcgctagatggtagggcgtgtccatcgagaggtgcaggaaccagctgcgtcgcgagggtccatcgtaggactccgtacctgcggcatgcgcgctgggtgctgtacgacagcttactgggtgctgagtggaagcagatggactccaggtactacccggaggtgaacgaggaggaggaggagcccgaggatgaagtccagtggacagagcgggagtgtgagctggcgctctgggccttccggaagtggaagtggtaccagttcacgtctctgcgggacctgctgtggggcaacgccatcttcctcaaggaggctaatgccatcagcgtggagctgaaaaagaaggtacaattccagtttgtcctcctgacggacacactctactcccctctgccacccgacctgctgcccccagaggccgccaaagaccgagagacgcggcccttcccccgcaccattgtggccgtggaggtccaggaccagaagaacggggccacccactactggacgctggagaagctcaggcagcgtctggacctgatgcgggagatgtacgaccgcgctgcagaggtgccctccagtgtcatcgaggactgtgacaacgtggtgaccggcggagaccccttctatgaccgcttcccctggttccggctggtgggcagggccttcgtgtacctgagcaacctgctgtaccccgttcccctggtacaccgtgtggcaatcgtcagcgagaagggcgaggtgaagggcttcctccgcgtggccgtccaggccatctcagccgatgaagaggcccctgattatggctctggcgtccgccagtcgggaactgctaaaatctcctttgatgaccagcattttgaaaagttccagtccgagtcttgccccgtggtggggatgtcccgctcgggaacctcccaggaagagcttcgcatcgtggagggccagggccagggtgcagacgtggggccctcagccgatgaagtcaacaacaacacctgttcagcagtgcccccagaaggcctcctcctagacagctctgagaaagccgccctggatgggcccctggatgctgccctggaccacctccgcctgggcaacaccttcaccttccgtgtgacagtcctgcaggcgtccagcatctctgccgaatatgccgacatcttctgccagttcaacttcatccaccgccacgacgaggccttctccacagagcccctgaagaacacaggcagaggccccccacttggcttctaccacgtccagaacatcgcagtggaggtgaccaagtccttcattgagtacatcaagagccagcccattgttttcgaggtctttggccactaccagcagcacccgttcccgcccctctgcaaggacgtgctcagccccctgaggccctcgcgccgccacttccctcgggtcatgccactgtccaagccagtgcccgccaccaagctcagcacactgacgcggccctgtccgggaccctgccactgcaagtacgacctgctggtctacttcgagatctgtgagctggaggccaacggcgattacatcccggccgtggtggaccaccgtgggggcatgccatgcatggggaccttcctcctccaccagggcatccagcgacggattacggtgacactactgcatgagacaggcagccatatccgctggaaggaagtgcgcgagctggtcgtgggccgcatccgaaacactccagagaccgacgagtccctgatcgaccccaacatcttgtctctcaacatcctctcttccggatacatccacccagcccaagatgaccggaccttttaccaatttgaggctgcgtgggacagctccatgcacaactctctcctgctgaaccgggtcaccccttatcgagagaaaatctacatgacactctccgcttatatcgagatggagaactgcacccagccggctgttgtcaccaaggacttctgcatggtcttctattcccgtgatgccaagctgccagcctcgcgctccatccgcaacctctttggcagtgggagccttcgggcctcagagagtaaccgtgtgactggtgtgtacgagctcagcctgtgccacgtggctgacgcgggcagcccagggatgcagcgccggcgccgacgagtcctggacacatctgtggcctatgtccggggcgaggagaacctggcaggctggaggccccggagtgacagtctcattctggaccaccagtgggagctggagaagctgagcctcctgcaggaggtggagaagactaggcactacctgctcctgcgggagaagctggagaccgcccagcggcctgtcccggaggcactgtccccggccttcagcgaggactctgagtcccatggctcctccagcgcctcctccccgctctcggctgagggccgcccatcacccctggaggctcccaacgagaggcagcgggagctggccgtcaagtgcttgcgcctgctcacgcacacattcaacagagagtacacacacagccacgtctgcgtcagtgccagcgagagcaagctctccgagatgtctgtcaccctgctccgggacccgtcgatgtcccctctaggggtggccactctcaccccctcctccacttgcccctctctggttgaagggcggtacggtgccactgacctgaggaccccgcagccctgctcccggccagccagcccagagcccgagctgctgccagaggccgactccaagaagctcccttcccctgcccgggcaacagagacagacaaggagccccagcgcctgctggtccctgacatccaggagatccgagtcagcccgatcgtttccaagaaggggtacctgcacttcctggagccgcacacgtcaggctgggccaggcgcttcgtggtggtgcggcgcccctatgcctacatgtacaacagcgacaaggacaccgtggagcggttcgtgctcaacctggccactgcccaggtggagtacagtgaggaccagcaggctatgctcaagacacccaacacattcgcggtgtgcacggaacaccgcggcatcctgctgcaggccgccagcgacaaggacatgcatgactggctgtacgccttcaaccccctcctggccgggaccatacggtccaagctctccagaaggaggtctgcccagatgcgggtctgaacctgagccctcccgtgacagccggcaggcccagcccatcccctccctcatcctcgtctgtcctgtcacctgccgcccagcccctctcctgccagacagcccacgaccgggtcgaccccccaggggacgcccatgccaggcccggggacctgtgccacacgaccagctgtgctcccagcagaggctgtgcgtgtcagttcttcttgcagaatgtgctctggtggaacaagttgggagaggctgggggggccaagggcacaggttacgggggttcttgctgccgttctaatatttttttaagcatagacagacttataattaatatacgttagttagtgacattgaaacagtcaactcggaaattaactataagacttgttctatttataagtatttatttctaatgcctccacatagccctgtaatattcagatggaacccccaaccacctccaccctgtttgttcccacatgtgtctcccaagcctgctagggacaggcagggcagggacagccaccttggaaggccgcagtgaggagctgtctggaccagtggggcaccttggggctagcacacgggtgtatcgcctgggccccaggcttctccatggccacatgggtcctgggtgtatgtgtgggagagtgggggggtgtctttggtgcctgaagtctgcgcggcatggagggtggtgtgagttcctctggtgggagggagaacgcacatctcttctgggcggccacctgaggagtgactccaagaagagttccggcagctttccccaggaaagggtgaggggtgacactcggctctggctctgagatgaggcagacggcacccaggctgtgatctgtcctgggcggggaccaggagggagcggggtcgggatcacctgccagtgtgcagactctgggactgcgtgctgtctccggaccatcagggtagggtggtgggttgagaccaggaagtcagggaagatcggaattcagggcgacggtctaggtgtcgagggctgtggcgcagcctcttcagctgcggcgagaaatggagtgagtcaaggtagcttctgggaagaaatgctgccattagcaggtttcttgcaaagactttcctctctttgttcccagggcagagagtttctgtgagtcccactgagaaaatcccatggggtgggggtatcctggtcggtcggcaatggagggtggctggcttggtggttattgtcttcaaggagctcttcgctgctgcatctgcggtgtccctttgttcttgtcccatttcaccccctctgcagacaccaatgtccgagggccacccaggacaggacgggggtcagccccaagctgagagtctggtcataggagtcatgtccagaggcctagggaggttttagggccctccccacccacacccacaggtcgatttggtctctttttagctcaaggaaagacagtagccaagcaacagagcccctctcccgccgtggcccgtgggagcagttacatcgggtctggtgctccagacctagggcccagcactttcatcagatcctgcctcctggagtgggggaaacgcagcaccccactggttctgaggcccctaccctcccaggctgtcccacgtgatgctgacatgagcctcagagaccccaatcccatgcctgggggagagacagcggctcaggagtgggggagcacgggccttctacaccacatgggaaggctctggcatgaggttttcctttgggaaggttgtttgggcccctgaagttccatctccgagagtggtgtgcagggcaggccagggcccatgctggctgcagtctctgtggctgcctgcctgggccagcctgtttgggagctgggactgtgggctcgccttttcgtacctgggctcaggtgcggtgtggccaccgccaccctcatcccctgcctgggaggctctcccaggggctgatgggggggttctgtgagggagaatcagggctcgggaagccacgcctgggaaggcaggacacaggacacagcagctttctttggaaatctcccaggtgaggattcacatcccaaaataaaattcagaagccaggtggcctgtgctccccatgggtgacctctggaggcagtggaccaagatgcagcaaggagaggatgcagaacagcttcttgcagaagcacctgctccggcatccagcgctgcctggaggcaggaaggagaggcagggcaggacacgctggtctgagatgagggggagccccacgggccccaggcaggctagaggaggcacaggccctgccacggccaactcaggtcagccagcctgaggctgtggcctccaaagggtctgggcgcaccccccaggtcgcaggtgtctgaggccagccaacctgcagagcactcgcggcgtgggtgggctgagtggaggtgcctgggagctgcctaaattcagaagcctccactgccatggagactgcctggctgtgtcctctcagccaggtgccgtgttggccttggctaggacccagagccacactgcagcctccgccgactccctccttccgggcctgctctagtgaggagtgcctaagccaggacccagaaactcagagttgatggtgagaggaggccgcctgagtcaggacacctggcttcttgaaaagttcgctctgccagaaaccacctagggaccacgttagctgccttccttgagctccccaggagtcggtttccacatctgtgaggtggagggctggtgtggaggtgctcatggggtgcggtgcttgggagacagccaggcccagggtggctgctgcttcctgctaagtgggggaggtgagacagatctggaaagccgtctccctcagatggtttcatttaatgctttatactgccgagtctgggggcttgttttggtttgggggcagccatcctccaccagaaagggggagctccttccgctgcggctccagatagatggggatgccgggctccaggccgaccagcacttgggatctgatgggacacggccagtgcctaggggtgccaagtccaaggcctcccactgggagtcatcgctgagaagatgccaatgtttcatccaccggctgcacaggcacaaactcccccacccaggacggctgtgatgaggtggccctccctgtcaaccctggtccctggagtccccagcacctggggccctggtggggctgatgtcacaggtgtttactgtgctgctgcactggtcctatgccagcctcacccatgtggggaccacggaaggcacactcccttacccccggtgccgggccgtgcggtcccccagacggacagcagctgtggcgacctgcgtttctccctgggcctgtgcttcctgtagttagtccgtcccctggttcccctgtggctcagaggccgcgtccctggcttgtacatatgtgattgctgtgggcacaccccagaccccatgtcatagctgccgtcccgacgtcacgacgcctgtcccgatgtcttacacccgagtgttagccctaggctcctgtactgtgcgtgcacttgaggctctgtccaattaagaaataaatgtggctcttactcaacacagtc

SEQ ID NO: 87312 - DNA, 5795 bp, Homo sapiens
gcaaaaaacacctagatacagcagtgcccccagaaggcctcctcctagacagctctgagaaagccgccctggatgggcccctggatgctgccctggaccacctccgcctgggcaacaccttcaccttccgtgtgacagtcctgcaggcgtccagcatctctgccgaatatgccgacatcttctgccagttcaacttcatccaccgccacgacgaggccttctccacagagcccctgaagaacacaggcagaggccccccacttggcttctaccacgtccagaacatcgcagtggaggtgaccaagtccttcattgagtacatcaagagccagcccattgttttcgaggtctttggccactaccagcagcacccgttcccgcccctctgcaaggacgtgctcagccccctgaggccctcgcgccgccacttccctcgggtcatgccactgtccaagccagtgcccgccaccaagctcagcacactgacgcggccctgtccgggaccctgccactgcaagtacgacctgctggtctacttcgagatctgtgagctggaggccaacggcgattacatcccggccgtggtggaccaccgtgggggcatgccatgcatggggaccttcctcctccaccagggcatccagcgacggattacggtgacactactgcatgagacaggcagccatatccgctggaaggaagtgcgcgagctggtcgtgggccgcatccgaaacactccagagaccgacgagtccctgatcgaccccaacatcttgtctctcaacatcctctcttccggatacatccacccagcccaagatgaccggaccttttaccaatttgaggctgcgtgggacagctccatgcacaactctctcctgctgaaccgggtcaccccttatcgagagaaaatctacatgacactctccgcttatatcgagatggagaactgcacccagccggctgttgtcaccaaggacttctgcatggtcttctattcccgtgatgccaagctgccagcctcgcgctccatccgcaacctctttggcagtgggagccttcgggcctcagagagtaaccgtgtgactggtgtgtacgagctcagcctgtgccacgtggctgacgcgggcagcccagggatgcagcgccggcgccgacgagtcctggacacatctgtggcctatgtccggggcgaggagaacctggcaggctggaggccccggagtgacagtctcattctggaccaccagtgggagctggagaagctgagcctcctgcaggaggtggagaagactaggcactacctgctcctgcgggagaagctggagaccgcccagcggcctgtcccggaggcactgtccccggccttcagcgaggactctgagtcccatggctcctccagcgcctcctccccgctctcggctgagggccgcccatcacccctggaggctcccaacgagaggcagcgggagctggccgtcaagtgcttgcgcctgctcacgcacacattcaacagagagtacacacacagccacgtctgcgtcagtgccagcgagagcaagctctccgagatgtctgtcaccctgctccgggacccgtcgatgtcccctctaggggtggccactctcaccccctcctccacttgcccctctctggttgaagggcggtacggtgccactgacctgaggaccccgcagccctgctcccggccagccagcccagagcccgagctgctgccagaggccgactccaagaagctcccttcccctgcccgggcaacagagacagacaaggagccccagcgcctgctggtccctgacatccaggagatccgagtcagcccgatcgtttccaagaaggggtacctgcacttcctggagccgcacacgtcaggctgggccaggcgcttcgtggtggtgcggcgcccctatgcctacatgtacaacagcgacaaggacaccgtggagcggttcgtgctcaacctggccactgcccaggtggagtacagtgaggaccagcaggctatgctcaagacacccaacacattcgcggtgtgcacggaacaccgcggcatcctgctgcaggccgccagcgacaaggacatgcatgactggctgtacgccttcaaccccctcctggccgggaccatacggtccaagctctccagaaggaggtctgcccagatgcgggtctgaacctgagccctcccgtgacagccggcaggcccagcccatcccctccctcatcctcgtctgtcctgtcacctgccgcccagcccctctcctgccagacagcccacgaccgggtcgaccccccaggggacgcccatgccaggcccggggacctgtgccacacgaccagctgtgctcccagcagaggctgtgcgtgtcagttcttcttgcagaatgtgctctggtggaacaagttgggagaggctgggggggccaagggcacaggttacgggggttcttgctgccgttctaatatttttttaagcatagacagacttataattaatatacgttagttagtgacattgaaacagtcaactcggaaattaactataagacttgttctatttataagtatttatttctaatgcctccacatagccctgtaatattcagatggaacccccaaccacctccaccctgtttgttcccacatgtgtctcccaagcctgctagggacaggcagggcagggacagccaccttggaaggccgcagtgaggagctgtctggaccagtggggcaccttggggctagcacacgggtgtatcgcctgggccccaggcttctccatggccacatgggtcctgggtgtatgtgtgggagagtgggggggtgtctttggtgcctgaagtctgcgcggcatggagggtggtgtgagttcctctggtgggagggagaacgcacatctcttctgggcggccacctgaggagtgactccaagaagagttccggcagctttccccaggaaagggtgaggggtgacactcggctctggctctgagatgaggcagacggcacccaggctgtgatctgtcctgggcggggaccaggagggagcggggtcgggatcacctgccagtgtgcagactctgggactgcgtgctgtctccggaccatcagggtagggtggtgggttgagaccaggaagtcagggaagatcggaattcagggcgacggtctaggtgtcgagggctgtggcgcagcctcttcagctgcggcgagaaatggagtgagtcaaggtagcttctgggaagaaatgctgccattagcaggtttcttgcaaagactttcctctctttgttcccagggcagagagtttctgtgagtcccactgagaaaatcccatggggtgggggtatcctggtcggtcggcaatggagggtggctggcttggtggttattgtcttcaaggagctcttcgctgctgcatctgcggtgtccctttgttcttgtcccatttcaccccctctgcagacaccaatgtccgagggccacccaggacaggacgggggtcagccccaagctgagagtctggtcataggagtcatgtccagaggcctagggaggttttagggccctccccacccacacccacaggtcgatttggtctctttttagctcaaggaaagacagtagccaagcaacagagcccctctcccgccgtggcccgtgggagcagttacatcgggtctggtgctccagacctagggcccagcactttcatcagatcctgcctcctggagtgggggaaacgcagcaccccactggttctgaggcccctaccctcccaggctgtcccacgtgatgctgacatgagcctcagagaccccaatcccatgcctgggggagagacagcggctcaggagtgggggagcacgggccttctacaccacatgggaaggctctggcatgaggttttcctttgggaaggttgtttgggcccctgaagttccatctccgagagtggtgtgcagggcaggccagggcccatgctggctgcagtctctgtggctgcctgcctgggccagcctgtttgggagctgggactgtgggctcgccttttcgtacctgggctcaggtgcggtgtggccaccgccaccctcatcccctgcctgggaggctctcccaggggctgatgggggggttctgtgagggagaatcagggctcgggaagccacgcctgggaaggcaggacacaggacacagcagctttctttggaaatctcccaggtgaggattcacatcccaaaataaaattcagaagccaggtggcctgtgctccccatgggtgacctctggaggcagtggaccaagatgcagcaaggagaggatgcagaacagcttcttgcagaagcacctgctccggcatccagcgctgcctggaggcaggaaggagaggcagggcaggacacgctggtctgagatgagggggagccccacgggccccaggcaggctagaggaggcacaggccctgccacggccaactcaggtcagccagcctgaggctgtggcctccaaagggtctgggcgcaccccccaggtcgcaggtgtctgaggccagccaacctgcagagcactcgcggcgtgggtgggctgagtggaggtgcctgggagctgcctaaattcagaagcctccactgccatggagactgcctggctgtgtcctctcagccaggtgccgtgttggccttggctaggacccagagccacactgcagcctccgccgactccctccttccgggcctgctctagtgaggagtgcctaagccaggacccagaaactcagagttgatggtgagaggaggccgcctgagtcaggacacctggcttcttgaaaagttcgctctgccagaaaccacctagggaccacgttagctgccttccttgagctccccaggagtcggtttccacatctgtgaggtggagggctggtgtggaggtgctcatggggtgcggtgcttgggagacagccaggcccagggtggctgctgcttcctgctaagtgggggaggtgagacagatctggaaagccgtctccctcagatggtttcatttaatgctttatactgccgagtctgggggcttgttttggtttgggggcagccatcctccaccagaaagggggagctccttccgctgcggctccagatagatggggatgccgggctccaggccgaccagcacttgggatctgatgggacacggccagtgcctaggggtgccaagtccaaggcctcccactgggagtcatcgctgagaagatgccaatgtttcatccaccggctgcacaggcacaaactcccccacccaggacggctgtgatgaggtggccctccctgtcaaccctggtccctggagtccccagcacctggggccctggtggggctgatgtcacaggtgtttactgtgctgctgcactggtcctatgccagcctcacccatgtggggaccacggaaggcacactcccttacccccggtgccgggccgtgcggtcccccagacggacagcagctgtggcgacctgcgtttctccctgggcctgtgcttcctgtagttagtccgtcccctggttcccctgtggctcagaggccgcgtccctggcttgtacatatgtgattgctgtgggcacaccccagaccccatgtcatagctgccgtcccgacgtcacgacgcctgtcccgatgtcttacacccgagtgttagccctaggctcctgtactgtgcgtgcacttgaggctctgtccaattaagaaataaatgtggctcttactcaacacagtc

SEQ ID NO: 87313 - DNA, 8851 bp, Homo sapiens
agccggcgagcggcagcagctccgggctcgagagcccgcgcccatgccagtgcccatgcggggccgccgccagtgacgccggagaggtgttccccccacactggggctcccactactgcgaggagtgacccacgaaggccacagagatggccggggcttcggtgaaggtggcggtgcgggtccgccccttcaattcccgggaaatgagccgtgactccaagtgcatcattcagatgtctggaagcaccaccaccattgttaaccccaaacagcccaaggagacgcccaaaagcttcagctttgactactcctactggtcgcacacctcacctgaggacatcaactacgcgtcgcagaagcaggtgtaccgggacatcggcgaggagatgctgcagcatgcctttgagggatacaacgtgtgcatcttcgcctatgggcagacgggtgccggcaagtcctacaccatgatgggcaagcaggagaaggaccagcagggcatcatcccacagctctgcgaggacctcttctctcggatcaacgacacgaccaacgacaacatgtcctactccgtggaggtcagctacatggagatttactgtgagcgcgtccgtgacctcctgaaccccaagaacaagggcaaccttcgcgtgagggagcacccactgctggggccctacgtggaggacctctccaagctggctgtcacctcctacaatgacatccaggacctcatggactcagggaacaaggccaggaccgtggcggccaccaacatgaatgagaccagcagtcgctcccacgccgtcttcaacatcatcttcacccagaagcgccatgacgcagagaccaatatcaccacggagaaggtgagcaaaatcagcctggtggacctggctgggagcgagcgggctgactccacgggagccaagggcacgcgcctcaaggagggggccaacatcaacaagtcgctgaccaccctgggcaaggtcatctccgccctggctgaaatggactccggacccaacaagaacaagaaaaagaagaagacagatttcattccgtaccgagattccgtgttgacctggctcctccgggaaaacctgggcggtaactcaaggacagctatggtggcagccctgagtcctgcagacatcaactacgatgagacccttagcacgctgaggtatgctgaccgggccaagcagatccgctgcaatgctgtcatcaatgaggaccccaacaacaagctgatccgcgagctgaaggatgaggtgacccggctgcgggaccttctgtacgcccagggtcttggcgacatcactgacatgaccaatgccctggtgggtatgagcccctcatcctcgctctcagccctgtccagccgcgcggcctccgtgtccagcctccacgagcgcatcttgtttgccccgggcagcgaggaggccattgaaagactgaaggaaacagagaagatcatagctgagctcaatgagacctgggaggagaagctgcggcggacagaagccatccggatggagagggaagccctgctggccgagatgggtgtggccatgagggaggatggcggcaccttgggcgtattctctcccaaaaagacaccacacctcgtcaacctgaacgaggacccgctgatgtctgagtgcctgctctactacatcaaggatgggatcaccagagtgggcagggaggatggcgagaggcggcaggacattgttctgagtgggcacttcatcaaggaggagcactgcgtcttccggagcgactccaggggaggcagcgaagctgtggtgaccttggagccctgtgagggggcagacacctacgtcaatggcaagaaagtcacagagcccagcatcctgcgttcaggaaaccgcatcatcatgggtaagagccatgtgttccggttcaaccaccccgagcaggcccggcaggagcgtgagcgcacgccttgtgcggagacgccagctgagcctgtggactgggccttcgcccagcgtgagctgctggagaagcagggcatcgacatgaagcaggagatggagcagaggctccaggaactggaggaccagtaccgccgcgagcgggaggaggccacctacctgctggagcagcagcggctggactatgagagcaagctggaggctctgcagaagcagatggactccaggtactacccggaggtgaacgaggaggaggaggagcccgaggatgaagtccagtggacagagcgggagtgtgagctggcgctctgggccttccggaagtggaagtggtaccagttcacgtctctgcgggacctgctgtggggcaacgccatcttcctcaaggaggctaatgccatcagcgtggagctgaaaaagaaggtacaattccagtttgtcctcctgacggacacactctactcccctctgccacccgacctgctgcccccagaggccgccaaagaccgagagacgcggcccttcccccgcaccattgtggccgtggaggtccaggaccagaagaacggggccacccactactggacgctggagaagctcaggcagcgtctggacctgatgcgggagatgtacgaccgcgctgcagaggtgccctccagtgtcatcgaggactgtgacaacgtggtgaccggcggagaccccttctatgaccgcttcccctggttccggctggtgggcagggccttcgtgtacctgagcaacctgctgtaccccgttcccctggtacaccgtgtggcaatcgtcagcgagaagggcgaggtgaagggcttcctccgcgtggccgtccaggccatctcagccgatgaagaggcccctgattatggctctggcgtccgccagtcgggaactgctaaaatctcctttgatgaccagcattttgaaaagttccagtccgagtcttgccccgtggtggggatgtcccgctcgggaacctcccaggaagagcttcgcatcgtggagggccagggccagggtgcagacgtggggccctcagccgatgaagtcaacaacaacacctgttcagcagtgcccccagaaggcctcctcctagacagctctgagaaagccgccctggatgggcccctggatgctgccctggaccacctccgcctgggcaacaccttcaccttccgtgtgacagtcctgcaggcgtccagcatctctgccgaatatgccgacatcttctgccagttcaacttcatccaccgccacgacgaggccttctccacagagcccctgaagaacacaggcagaggccccccacttggcttctaccacgtccagaacatcgcagtggaggtgaccaagtccttcattgagtacatcaagagccagcccattgttttcgaggtctttggccactaccagcagcacccgttcccgcccctctgcaaggacgtgctcagccccctgaggccctcgcgccgccacttccctcgggtcatgccactgtccaagccagtgcccgccaccaagctcagcacactgacgcggccctgtccgggaccctgccactgcaagtacgacctgctggtctacttcgagatctgtgagctggaggccaacggcgattacatcccggccgtggtggaccaccgtgggggcatgccatgcatggggaccttcctcctccaccagggcatccagcgacggattacggtgacactactgcatgagacaggcagccatatccgctggaaggaagtgcgcgagctggtcgtgggccgcatccgaaacactccagagaccgacgagtccctgatcgaccccaacatcttgtctctcaacatcctctcttccggatacatccacccagcccaagatgaccggaccttttaccaatttgaggctgcgtgggacagctccatgcacaactctctcctgctgaaccgggtcaccccttatcgagagaaaatctacatgacactctccgcttatatcgagatggagaactgcacccagccggctgttgtcaccaaggacttctgcatggtcttctattcccgtgatgccaagctgccagcctcgcgctccatccgcaacctctttggcagtgggagccttcgggcctcagagagtaaccgtgtgactggtgtgtacgagctcagcctgtgccacgtggctgacgcgggcagcccagggatgcagcgccggcgccgacgagtcctggacacatctgtggcctatgtccggggcgaggagaacctggcaggctggaggccccggagtgacagtctcattctggaccaccagtgggagctggagaagctgagcctcctgcaggaggtggagaagactaggcactacctgctcctgcgggagaagctggagaccgcccagcggcctgtcccggaggcactgtccccggccttcagcgaggactctgagtcccatggctcctccagcgcctcctccccgctctcggctgagggccgcccatcacccctggaggctcccaacgagaggcagcgggagctggccgtcaagtgcttgcgcctgctcacgcacacattcaacagagagtacacacacagccacgtctgcgtcagtgccagcgagagcaagctctccgagatgtctgtcaccctgctccgggacccgtcgatgtcccctctaggggtggccactctcaccccctcctccacttgcccctctctggttgaagggcggtacggtgccactgacctgaggaccccgcagccctgctcccggccagccagcccagagcccgagctgctgccagaggccgactccaagaagctcccttcccctgcccgggcaacagagacagacaaggagccccagcgcctgctggtccctgacatccaggagatccgagtcagcccgatcgtttccaagaaggggtacctgcacttcctggagccgcacacgtcaggctgggccaggcgcttcgtggtggtgcggcgcccctatgcctacatgtacaacagcgacaaggacaccgtggagcggttcgtgctcaacctggccactgcccaggtggagtacagtgaggaccagcaggctatgctcaagacacccaacacattcgcggtgtgcacggaacaccgcggcatcctgctgcaggccgccagcgacaaggacatgcatgactggctgtacgccttcaaccccctcctggccgggaccatacggtccaagctctccagaaggaggtctgcccagatgcgggtctgaacctgagccctcccgtgacagccggcaggcccagcccatcccctccctcatcctcgtctgtcctgtcacctgccgcccagcccctctcctgccagacagcccacgaccgggtcgaccccccaggggacgcccatgccaggcccggggacctgtgccacacgaccagctgtgctcccagcagaggctgtgcgtgtcagttcttcttgcagaatgtgctctggtggaacaagttgggagaggctgggggggccaagggcacaggttacgggggttcttgctgccgttctaatatttttttaagcatagacagacttataattaatatacgttagttagtgacattgaaacagtcaactcggaaattaactataagacttgttctatttataagtatttatttctaatgcctccacatagccctgtaatattcagatggaacccccaaccacctccaccctgtttgttcccacatgtgtctcccaagcctgctagggacaggcagggcagggacagccaccttggaaggccgcagtgaggagctgtctggaccagtggggcaccttggggctagcacacgggtgtatcgcctgggccccaggcttctccatggccacatgggtcctgggtgtatgtgtgggagagtgggggggtgtctttggtgcctgaagtctgcgcggcatggagggtggtgtgagttcctctggtgggagggagaacgcacatctcttctgggcggccacctgaggagtgactccaagaagagttccggcagctttccccaggaaagggtgaggggtgacactcggctctggctctgagatgaggcagacggcacccaggctgtgatctgtcctgggcggggaccaggagggagcggggtcgggatcacctgccagtgtgcagactctgggactgcgtgctgtctccggaccatcagggtagggtggtgggttgagaccaggaagtcagggaagatcggaattcagggcgacggtctaggtgtcgagggctgtggcgcagcctcttcagctgcggcgagaaatggagtgagtcaaggtagcttctgggaagaaatgctgccattagcaggtttcttgcaaagactttcctctctttgttcccagggcagagagtttctgtgagtcccactgagaaaatcccatggggtgggggtatcctggtcggtcggcaatggagggtggctggcttggtggttattgtcttcaaggagctcttcgctgctgcatctgcggtgtccctttgttcttgtcccatttcaccccctctgcagacaccaatgtccgagggccacccaggacaggacgggggtcagccccaagctgagagtctggtcataggagtcatgtccagaggcctagggaggttttagggccctccccacccacacccacaggtcgatttggtctctttttagctcaaggaaagacagtagccaagcaacagagcccctctcccgccgtggcccgtgggagcagttacatcgggtctggtgctccagacctagggcccagcactttcatcagatcctgcctcctggagtgggggaaacgcagcaccccactggttctgaggcccctaccctcccaggctgtcccacgtgatgctgacatgagcctcagagaccccaatcccatgcctgggggagagacagcggctcaggagtgggggagcacgggccttctacaccacatgggaaggctctggcatgaggttttcctttgggaaggttgtttgggcccctgaagttccatctccgagagtggtgtgcagggcaggccagggcccatgctggctgcagtctctgtggctgcctgcctgggccagcctgtttgggagctgggactgtgggctcgccttttcgtacctgggctcaggtgcggtgtggccaccgccaccctcatcccctgcctgggaggctctcccaggggctgatgggggggttctgtgagggagaatcagggctcgggaagccacgcctgggaaggcaggacacaggacacagcagctttctttggaaatctcccaggtgaggattcacatcccaaaataaaattcagaagccaggtggcctgtgctccccatgggtgacctctggaggcagtggaccaagatgcagcaaggagaggatgcagaacagcttcttgcagaagcacctgctccggcatccagcgctgcctggaggcaggaaggagaggcagggcaggacacgctggtctgagatgagggggagccccacgggccccaggcaggctagaggaggcacaggccctgccacggccaactcaggtcagccagcctgaggctgtggcctccaaagggtctgggcgcaccccccaggtcgcaggtgtctgaggccagccaacctgcagagcactcgcggcgtgggtgggctgagtggaggtgcctgggagctgcctaaattcagaagcctccactgccatggagactgcctggctgtgtcctctcagccaggtgccgtgttggccttggctaggacccagagccacactgcagcctccgccgactccctccttccgggcctgctctagtgaggagtgcctaagccaggacccagaaactcagagttgatggtgagaggaggccgcctgagtcaggacacctggcttcttgaaaagttcgctctgccagaaaccacctagggaccacgttagctgccttccttgagctccccaggagtcggtttccacatctgtgaggtggagggctggtgtggaggtgctcatggggtgcggtgcttgggagacagccaggcccagggtggctgctgcttcctgctaagtgggggaggtgagacagatctggaaagccgtctccctcagatggtttcatttaatgctttatactgccgagtctgggggcttgttttggtttgggggcagccatcctccaccagaaagggggagctccttccgctgcggctccagatagatggggatgccgggctccaggccgaccagcacttgggatctgatgggacacggccagtgcctaggggtgccaagtccaaggcctcccactgggagtcatcgctgagaagatgccaatgtttcatccaccggctgcacaggcacaaactcccccacccaggacggctgtgatgaggtggccctccctgtcaaccctggtccctggagtccccagcacctggggccctggtggggctgatgtcacaggtgtttactgtgctgctgcactggtcctatgccagcctcacccatgtggggaccacggaaggcacactcccttacccccggtgccgggccgtgcggtcccccagacggacagcagctgtggcgacctgcgtttctccctgggcctgtgcttcctgtagttagtccgtcccctggttcccctgtggctcagaggccgcgtccctggcttgtacatatgtgattgctgtgggcacaccccagaccccatgtcatagctgccgtcccgacgtcacgacgcctgtcccgatgtcttacacccgagtgttagccctaggctcctgtactgtgcgtgcacttgaggctctgtccaattaagaaataaatgtggctcttactcaacacagtcctcaccatatacgggatccgctagatcaacca

SEQ ID NO: 87314 - DNA, 2762 bp, Homo sapiens
cacgcgtcggttccggcagctttccccaggagggagcggggtcgggatcacctgccagtgtgcagactctgggactgcgtgctgtctccggaccatcagggtagggtggtgggttgagaccaggaagtcagggaagatcggaattcagggcgacggtctaggtgtcgagggctgtggcgcagcctcttcagctgcggcgagaaatggagtgagtcaaggtagcttctgggaagaaatgctgccattagcaggtttcttgcaaagactttcctctctttgttcccagggcagagagtttctgtgagtcccactgagaaaatcccatggggtgggggtatcctggtcggtcggcaatggagggtggctggcttggtggttattgtcttcaaggagctcttcgctgctgcatctgcggtgtccctttgttcttgtcccatttcaccccctctgcagacaccaatgtccgagggccacccaggacaggacgggggtcagccccaagctgagagtctggtcataggagtcatgtccagaggcctagggaggttttagggccctccccacccacacccacaggtcgatttggtctctttttagctcaaggaaagacagtagccaagcaacagagcccctctcccgccgtggcccgtgggagcagttacatcgggtctggtgctccagacctagggcccagcactttcatcagatcctgcctcctggagtgggggaaacgcagcaccccactggttctgaggcccctaccctcccaggctgtcccacgtgatgctgacatgagcctcagagaccccaatcccatgcctgggggagagacagcggctcaggagtgggggagcacgggccttctacaccacatgggaaggctctggcatgaggttttcctttgggaaggttgtttgggcccctgaagttccatctccgagagtggtgtgcagggcaggccagggcccatgctggctgcagtctctgtggctgcctgcctgggccagcctgtttgggagctgggactgtgggctcgccttttcgtacctgggctcaggtgcggtgtggccaccgccaccctcatcccctgcctgggaggctctcccaggggctgatgggggggttctgtgagggagaatcagggctcgggaagccacgcctgggaaggcaggacacaggacacagcagctttctttggaaatctcccaggtgaggattcacatcccaaaataaaattcagaagccaggtggcctgtgctccccatgggtgacctctggaggcagtggaccaagatgcagcaaggagaggatgcagaacagcttcttgcagaagcacctgctccggcatccagcgctgcctggaggcaggaaggagaggcagggcaggacacgctggtctgagatgagggggagccccacgggccccaggcaggctagaggaggcacaggccctgccacggccaactcaggtcagccagcctgaggctgtggcctccaaagggtctgggcgcaccccccaggtcgcaggtgtctgaggccagccaacctgcagagcactcgcggcgtgggtgggctgagtggaggtgcctgggagctgcctaaattcagaagcctccactgccatggagactgcctggctgtgtcctctcagccaggtgccgtgttggccttggctaggacccagagccacactgcagcctccgccgactccctccttccgggcctgctctagtgaggagtgcctaagccaggacccagaaactcagagttgatggtgagaggaggccgcctgagtcaggacacctggcttcttgaaaagttcgctctgccagaaaccacctagggaccacgttagctgccttccttgagctccccaggagtcggtttccacatctgtgaggtggagggctggtgtggaggtgctcatggggtgcggtgcttgggagacagccaggcccagggtggctgctgcttcctgctaagtgggggaggtgagacagatctggaaagccgtctccctcagatggtttcatttaatgctttatactgccgagtctgggggcttgttttggtttgggggcagccatcctccaccagaaagggggagctccttccgctgcggctccagatagatggggatgccgggctccaggccgaccagcacttgggatctgatgggacacggccagtgcctaggggtgccaagtccaaggcctcccactgggagtcatcgctgagaagatgccaatgtttcatccaccggctgcacaggcacaaactcccccacccaggacggctgtgatgaggtggccctccctgtcaaccctggtccctggagtccccagcacctggggccctggtggggctgatgtcacaggtgtttactgtgctgctgcactggtcctatgccagcctcacccatgtggggaccacggaaggcacactcccttacccccggtgccgggccgtgcggtcccccagacggacagcagctgtggcgacctgcgtttctccctgggcctgtgcttcctgtagttagtccgtcccctggttcccctgtggctcagaggccgcgtccctggcttgtacatatgtgattgctgtgggcacaccccagaccccatgtcatagctgccgtcccgacgtcacgacgcctgtcccgatgtcttacacccgagtgttagccctaggctcctgtactgtgcgtgcacttgaggctctgtccaattaagaaataaatgtggctcttactcaacacagtc

SEQ ID NO: 87315 - DNA, 5564 bp, Homo sapiens
agccggcgagcggcagcagctccgggctcgagagcccgcgcccatgccagtgcccatgcggggccgccgccagtgacgccggagaggtgttccccccacactggggctcccactactgcgaggagtgacccacgaaggccacagagatggccggggcttcggtgaaggtggcggtgcgggtccgccccttcaattcccgggaaatgagccgtgactccaagtgcatcattcagatgtctggaagcaccaccaccattgttaaccccaaacagcccaaggagacgcccaaaagcttcagctttgactactcctactggtcgcacacctcacctgaggacatcaactacgcgtcgcagaagcaggtgtaccgggacatcggcgaggagatgctgcagcatgcctttgagggatacaacgtgtgcatcttcgcctatgggcagacgggtgccggcaagtcctacaccatgatgggcaagcaggagaaggaccagcagggcatcatcccacagctctgcgaggacctcttctctcggatcaacgacacgaccaacgacaacatgtcctactccgtggaggtcagctacatggagatttactgtgagcgcgtccgtgacctcctgaaccccaagaacaagggcaaccttcgcgtgagggagcacccactgctggggccctacgtggaggacctctccaagctggctgtcacctcctacaatgacatccaggacctcatggactcagggaacaaggccaggaccgtggcggccaccaacatgaatgagaccagcagtcgctcccacgccgtcttcaacatcatcttcacccagaagcgccatgacgcagagaccaatatcaccacggagaaggtgagcaaaatcagcctggtggacctggctgggagcgagcgggctgactccacgggagccaagggcacgcgcctcaaggagggggccaacatcaacaagtcgctgaccaccctgggcaaggtcatctccgccctggctgaaatggactccggacccaacaagaacaagaaaaagaagaagacagatttcattccgtaccgagattccgtgttgacctggctcctccgggaaaacctgggcggtaactcaaggacagctatggtggcagccctgagtcctgcagacatcaactacgatgagacccttagcacgctgaggtatgctgaccgggccaagcagatccgctgcaatgctgtcatcaatgaggaccccaacaacaagctgatccgcgagctgaaggatgaggtgacccggctgcgggaccttctgtacgcccagggtcttggcgacatcactgacatgaccaatgccctggtgggtatgagcccctcatcctcgctctcagccctgtccagccgcgcggcctccgtgtccagcctccacgagcgcatcttgtttgccccgggcagcgaggaggccattgaaagactgaaggaaacagagaagatcatagctgagctcaatgagacctgggaggagaagctgcggcggacagaagccatccggatggagagggaagccctgctggccgagatgggtgtggccatgagggaggatggcggcaccttgggcgtattctctcccaaaaagacaccacacctcgtcaacctgaacgaggacccgctgatgtctgagtgcctgctctactacatcaaggatgggatcaccagagtgggcagggaggatggcgagaggcggcaggacattgttctgagtgggcacttcatcaaggaggagcactgcgtcttccggagcgactccaggggaggcagcgaagctgtggtgaccttggagccctgtgagggggcagacacctacgtcaatggcaagaaagtcacagagcccagcatcctgcgttcaggaaaccgcatcatcatgggtaagagccatgtgttccggttcaaccaccccgagcaggcccggcaggagcgtgagcgcacgccttgtgcggagacgccagctgagcctgtggactgggccttcgcccagcgtgagctgctggagaagcagggcatcgacatgaagcaggagatggagcagaggctccaggaactggaggaccagtaccgccgcgagcgggaggaggccacctacctgctggagcagcagcggctggactatgagagcaagctggaggctctgcagaagcagatggactccaggtactacccggaggtgaacgaggaggaggaggagcccgaggatgaagtccagtggacagagcgggagtgtgagctggcgctctgggccttccggaagtggaagtggtaccagttcacgtctctgcgggacctgctgtggggcaacgccatcttcctcaaggaggctaatgccatcagcgtggagctgaaaaagaaggtacaattccagtttgtcctcctgacggacacactctactcccctctgccacccgacctgctgcccccagaggccgccaaagaccgagagacgcggcccttcccccgcaccattgtggccgtggaggtccaggaccagaagaacggggccacccactactggacgctggagaagctcaggcagcgtctggacctgatgcgggagatgtacgaccgcgctgcagaggtgccctccagtgtcatcgaggactgtgacaacgtggtgaccggcggagaccccttctatgaccgcttcccctggttccggctggtgggcagggccttcgtgtacctgagcaacctgctgtaccccgttcccctggtacaccgtgtggcaatcgtcagcgagaagggcgaggtgaagggcttcctccgcgtggccgtccaggccatctcagccgatgaagaggcccctgattatggctctggcgtccgccagtcgggaactgctaaaatctcctttgatgaccagcattttgaaaagttccagtccgagtcttgccccgtggtggggatgtcccgctcgggaacctcccaggaagagcttcgcatcgtggagggccagggccagggtgcagacgtggggccctcagccgatgaagtcaacaacaacacctgttcagcagtgcccccagaaggcctcctcctagacagctctgagaaagccgccctggatgggcccctggatgctgccctggaccacctccgcctgggcaacaccttcaccttccgtgtgacagtcctgcaggcgtccagcatctctgccgaatatgccgacatcttctgccagttcaacttcatccaccgccacgacgaggccttctccacagagcccctgaagaacacaggcagaggccccccacttggcttctaccacgtccagaacatcgcagtggaggtgaccaagtccttcattgagtacatcaagagccagcccattgttttcgaggtctttggccactaccagcagcacccgttcccgcccctctgcaaggacgtgctcagccccctgaggccctcgcgccgccacttccctcgggtcatgccactgtccaagccagtgcccgccaccaagctcagcacactgacgcggccctgtccgggaccctgccactgcaagtacgacctgctggtctacttcgagatctgtgagctggaggccaacggcgattacatcccggccgtggtggaccaccgtgggggcatgccatgcatggggaccttcctcctccaccagggcatccagcgacggattacggtgacactactgcatgagacaggcagccatatccgctggaaggaagtgcgcgagctggtcgtgggccgcatccgaaacactccagagaccgacgagtccctgatcgaccccaacatcttgtctctcaacatcctctcttccggatacatccacccagcccaagatgaccggaccttttaccaatttgaggctgcgtgggacagctccatgcacaactctctcctgctgaaccgggtcaccccttatcgagagaaaatctacatgacactctccgcttatatcgagatggagaactgcacccagccggctgttgtcaccaaggacttctgcatggtcttctattcccgtgatgccaagctgccagcctcgcgctccatccgcaacctctttggcagtgggagccttcgggcctcagagagtaaccgtgtgactggtgtgtacgagctcagcctgtgccacgtggctgacgcgggcagcccagggatgcagcgccggcgccgacgagtcctggacacatctgtggcctatgtccggggcgaggagaacctggcaggctggaggccccggagtgacagtctcattctggaccaccagtgggagctggagaagctgagcctcctgcaggaggtggagaagactaggcactacctgctcctgcgggagaagctggagaccgcccagcggcctgtcccggaggcactgtccccggccttcagcgaggactctgagtcccatggctcctccagcgcctcctccccgctctcggctgagggccgcccatcacccctggaggctcccaacgagaggcagcgggagctggccgtcaagtgcttgcgcctgctcacgcacacattcaacagagagtacacacacagccacgtctgcgtcagtgccagcgagagcaagctctccgagatgtctgtcaccctgctccgggacccgtcgatgtcccctctaggggtggccactctcaccccctcctccacttgcccctctctggttgaagggcggtacggtgccactgacctgaggaccccgcagccctgctcccggccagccagcccagagcccgagctgctgccagaggccgactccaagaagctcccttcccctgcccgggcaacagagacagacaaggagccccagcgcctgctggtccctgacatccaggagatccgagtcagcccgatcgtttccaagaaggggtacctgcacttcctggagccgcacacgtcaggctgggccaggcgcttcgtggtggtgcggcgcccctatgcctacatgtacaacagcgacaaggacaccgtggagcggttcgtgctcaacctggccactgcccaggtggagtacagtgaggaccagcaggctatgctcaagacacccaacacattcgcggtgtgcacggaacaccgcggcatcctgctgcaggccgccagcgacaaggacatgcatgactggctgtacgccttcaaccccctcctggccgggaccatacggtccaagctctccagaaggaggtctgcccagatgcgggtctgaacctgagccctcccgtgacagccggcaggcccagcccatcccctccctcatcctcgtctgtcctgtcacctgccgcccagcccctctcctgccagacagcccacgaccgggtcgaccccccaggggacgcccatgccaggcccggggacctgtgccacacgaccagctgtgctcccagcagaggctgtgcgtgtcagttcttcttgcagaatgtgctctggtggaacaagttgggagaggctgggggggccaagggcacaggttacgggggttcttgctgccgttctaatatttttttaagcatagacagacttataattaatatacgttagttagtgacattga

SEQ ID NO: 87316 - DNA, 790 bp, Homo sapiens
acaggagcctagggctaacactcgggtgtaagacatcgggacgggcgtcgtgacgtcgggacggcagctatgacatggagagtctgggggcttgttttggtttgggggcagccatcctccaccagaaagggggagctccttccgctgcggctccagatagatggggatgccgggctccaggccgaccagcacttgggatctgatgggacacggccagtgcctaggggtgccaagtccaaggcctcccactgggagtcatcgctgagaagatgccaatgtttcatccaccggctgcacaggcacaaactcccccacccaggacggctgtgatgaggtggccctccctgtcaaccctggtccctggagtccccagcacctggggccctggtggggctgatgtcacaggtgtttactgtgctgctgcactggtcctatgccagcctcacccatgtggggaccacggaaggcacactcccttacccccggtgccgggccgtgcggtcccccagacggacagcagctgtggcgacctgcgtttctccctgggcctgtgcttcctgtagttagtccgtcccctggttcccctgtggctcagaggccgcgtccctggcttgtacatatgtgattgctgtgggcacaccccagaccccatgtcatagctgccgtcccgacgtcacgacgcctgtcccgatgtcttacacccgagtgttagccctaggctcctgtactgtgcgtgcacttgaggctctgtccaattaagaaataaatgtggctcttactcaacacagtc

SEQ ID NO: 87317 - DNA, 333 bp, Homo sapiens
ttctgtttcttgccttctctgggccccatctcttactttttcccatcttcatcttttttctctccctccctctgtctgtctgcccgccctacccctcctccccatagacgtgtccgaccttgagaacaataaccttaaccgtggcgggacggtgaatgaagcccctgaccctctctccacagtgaccaatgccctggtgggtatgagcccctcatcctcgctctcagccctgtccagccgcgcggcctccgtgtccagcctccacgagcgcatcttgtttgccccgggcagcgaggaggccattgaaagactgaaggtgagggcaccacctgg

SEQ ID NO: 87318 - DNA, 414 bp, Homo sapiens
gctacctcaagaaatatatacagtagagttcagagctgatgtatacttgtatgacctgaagcatatgcacacaggaataaagtaaaacaagaccctccccgtccataatggagagagagagcccactcaatgaatatgtgccctggcatagtgtgagagtgggaaacaaatctgtttttctgtcagttttagttccagttttcctctcttgtgggcatttggctgcatcaaggatgaatctagtgtttaaaggaaatatttttggtatgccattgccgctgtaacatctgctactttccttgtatgtccataagaaacactgtgtactttgtgcattatttaaagggaatttgcaagcataatcatgactctaggtaacttaggatatcccgtgtaaggtatgattccactgtc

SEQ ID NO: 87319 - DNA, 472 bp, Homo sapiens
tgagcacgtcgtggcctcctggaactggctgctcccacgtgtcctgaagaaggtggggtctgtgacccagagaggagcaaggggagtttgccaagaacagacatcctctgccactcttgatcccctgacgcacacggggcaagctcctttggggtcgaacagaacagaccagttgtttggagtaggtcagtaccatggggttctgcacgcgcttcagggtgccggcgtgccctcgaggctgtctgcaggatgctgtgtgtgtgcagtgcacattactgctggtgggagtccatagttctcaaaagcttttcctgactgccccaccctctcaaaaaagtaaagcaggccgggggcagtggctcatgcctgtaatcccagcactttgggaggccgaggtgggcggatcacgaggtcaggagatcgagaccatcctggctaacacggtgaaaccccgtctctactttaaaaaaaa

SEQ ID NO: 87320 - DNA, 427 bp, Homo sapiens
ctatctccacctcccaccttctctgtctcctttctgtcacaggcatgttctttttttgaaagagttttctgagattgctgcctccacttcctcaccttacaatcattactcaaccctctgtcattaggcttctctccccaaaacaccctgggccccccagcacgtggagcactggcaaagatgaacaatgacctttttgttgctgaatcccatccagtggcactttgctgtcctatgtcacttgacttcccccacaggataaaactagtcacaattcctcatttcctaaactctctttttggttcacatgacattattattattatttggtaatcctcccaactctctggcctctccttcaggcactcccctcaccctaagactgctccattaaaaagtctacattagctctctgctattctcactc

SEQ ID NO: 87321 - DNA, 402 bp, Homo sapiens
tttcattatcttgagaactggtagagaattctgggtgtctttctcagcttgttctgtctcccctttggtgtgcttctttctaatttgctctttgtaatctgctattctcttttgagagtgacagaattacataatttctgggaatactattggatacttaatctttttatcctgttctatgaagggactatagtgtggtggttcaaagcttatgctgtggagtcaaaatgcagttttttcagttactaaattgatgatctttggctacctgtttaacttccctaagtcagtgtatagaaggttaacggtacttacctcacagggatgttggatttaatgaagtggtatctataaagtgcccagcacaatgcctaacacaaagtaagtacagaaatagttacc

SEQ ID NO: 87322 - DNA, 633 bp, Homo sapiens
tgtctctcttccatgctctgagaattatataaaagcatcccagctaaggctggagtgaaggggttggggaaagttaagcaaaggctaacttgaccaataggctcaatagattcagtcttgttggccaggcccacttgaagggttttttgtttcatcttggagaaggacagtgaggtcatggtataattgttatgagtaaagtcaagaacagcttctaggtaaaagtaattatgtacccaaaaggagttgaagggaaaatcaatttaggtttacattaaacatccttcaagttcttatctttaaatggagtttcagtgtctcccaaaggctggatgagttttacagttataaccactggattgtgagaccataggacatttgaacaatcttttcttctacccatctagaaaagcatcttttttatataccaaatttttacacatatatccacatctgtttttgaaatctagagcagaggtactcaaagtttggttcatggactagtgccagttcacaaattgttaatgttttataatgagataagtacggaagttgagagtaaccatttagaaactgtgtaggaatttaaaaagtaatatctgacaaatttaataataaaaatggaggcttgta

SEQ ID NO: 87323 - DNA, 419 bp, Homo sapiens
agatgtggtggtttatgcttgtaatcccagctacttgggagacataggcaggaggattgcttgagcccaggagtttgaggctgcagtaagttatgattgtgccactgcattccagcctgggcaacaaaacaagacctcatctcaaaaaaaaaaaaaaaaaaagcaaatatcatatgaaaaaatacaatttccattcaagattttcaaaaacaaacaacaacaaaaaaactctcagcaagctagaaatagaagagaatttcctcaacttgaaaaaatacatctgcaaaactcctatagctaatatcacactccatggtaaacgatttattttccactatgatcaggattaaagtaaagttctcctttctcaccacttctttttgacgttataactggaatcccaactagcacaacaacac

SEQ ID NO: 87324 - DNA, 223 bp, Homo sapiens
aacaaacaaacaaacccaaaaaacaataagaccaataaactgacaacaatatcctcaaggaggttataacaaaataacatttttattgttattttaaaagtaaaacatgtatattgtggaacatttaggaaaatagaaacttaaaagccagcaaaccaaattcctatttataattcccccttttaaatagtatcaaataaactactgccacattacattaggg

SEQ ID NO: 87325 - DNA, 357 bp, Homo sapiens
aactttggagacattattctattttcatctggagtcattaatgagaatttcaatggcaatttcattcttacccattataggtcatagtttgcttttgttagctgttttcccttcgaagctttaacatcttatcttctagatattcagaaatttcatgagaatctgtttaggagtgggctgtttatttaattcacaatgctcaaaagtttgtgggccttatcaaactgaagacatcatgtcttctttttggctgtggaaatagtcatgtataatttctctttgtgttctgggagatttatttgactctattttctagttcttatactaaaaaattttaattatagctattttatttta

SEQ ID NO: 87326 - DNA, 2031 bp, Homo sapiens
  misc_feature (1354)..(1354): n is a, c, g, or t
  misc_feature (1673)..(1674): n is a, c, g, or t
  misc_feature (1702)..(1702): n is a, c, g, or t
ccggcggagccttaacaagtggtcgggcgggcggacgaggcgggcgatggccctgcggccgggacgcgaacagggaccatgcagggcaacggcagcgcgctgcccaacgcctcccagcccgtgctccgcggggacggcgcgcggccctcgtggctggcgtccgccctagcctgcgtcctcatcttcaccatcgtggtggacatcctgggcaacctcctggtcatcctgtcggtgtatcggaacaagaagctcaggaacgcaggaaacatctttgtggtgagcttagcggtggcagacctggtggtggccatttatccgtacccgttggtgctgatgtcgatatttaacaacgggtggaacctgggctatctgcactgccaagtcagtgggttcctgatgggcctgagcgtcatcggctccatattcaacatcaccggcatcgccatcaaccgctactgctacatctgccacagtctcaagtacgacaaactgtacagcagcaagaactccctctgctacgtgctcctcatatggctcctgacgctggcggccgtcctgcccaacctccgtgcagggactctccagtacgacccgaggatctactcgtgcaccttcgcccagtccgtcagctccgcctacaccatcgccgtggtggttttccacttcctcgtccccatgatcatagtcatcttctgttacctgagaatatggatcctggttctccaggtcagacagagggtgaaacctgaccgcaaacccaaactgaaaccacaggacttcaggaattttgtcaccatgtttgtggtttttgtcctctttgccatttgctgggctcctctgaacttcattggcctggccgtggcctctgaccccgccagcatggtgcctaggatcccagagtggctgtttgtggccagttactacatggcgtatttcaacagctgcctcaatgccattatatacgggctactgaaccaaaatttcaggaaggaatacaggagaattatagtctcgctctgtacagccagggtgttctttgtggacagctctaacgacgtggccgatagggttaaatggaaaccgtctccactgatgaccaacaataatgtagtaaaggtggactccgtttaaaaaagcaccacgttccgggtgagatggacacgctgcgcaaggcctcgctcttgacagatgtctgggaaagcagagtggtggaggaaacttccaacttttacctggctgctgccatagtttctgagctaacgtgctgtcagcattataaacccctccaatctactagtcaagagaagtacagaatgtatggagagttacatgttaactgaggaatgcggttcanggctggggtgagagtaagctgctgaatgcattcaggggaaggagtgtgcaaacttttattgtaaatgagtgccacaaaaggggtaattgcattcttcttcactttttgaagacttctagcagaaaaatgaaagagaattttatttataaatgagcaaatggaacaattttttttctgtaaatggaacaaacaatgaaagtggggtgagtgcctcttattacagagggaaaggctgaacataaatcagttaatggctcatcaacaatcacaaccacaaccaacaccacaaacctttcagctggcagagttagcattgggnngctatactcatggtcataaatgtttgcngctctatattacaagttgtgcatgcaaccagataaagaactaaatcataggccgggcacagtcgctcacacctgtaatctcagcactttgggaggctgaggtgggcagatcaactgagttcaggagtttgagaccaccctgggcaacatgatgaaatcccatctctaaaaaaatacaaaaaattatctgggcatggtgcacacgcctgtaatcccagctactcaggagactgagttaggagaatcccttgagccccagaggcagaggttgtggtgagccgagatcgcgccagtacattccaacttaggctacagaatgagactctgccc

SEQ ID NO: 87327 - DNA, 326 bp, Homo sapiens
ggctcccctgctctgtacgctgatattggaggaaaacaagctctgcccactacccacgtggccactggtcactcctacagaatacacttggatgcatcctcgccatggggggcttccgggcctccttgcggtctgcctgtcattctcactgggctccgcctcctccagacttagagaacattgcaatggtgagacacgctttcccatgcagtcagggccatctcttggggttctggagggagctcgcccttgagaatcagaggtccccaaggctctgcttctgacctgaagtcaccacttcgccctcatcctgtcccagcgcagaa

SEQ ID NO: 87328 - DNA, 436 bp, Homo sapiens
gaaagaatttgtactttgaaaagccaagacaagtactacccctcaccatcagcctaaaaataaacttactgacatattacataaataagaaagggtgctcacaccgcccgctgagctctgtgatgtagccgcttgcggagactgcaagcagccacggcgcgccctcttccgtgggaatggaaacatctgccacacgtgccggaagccaagtggtggcgacaactgcgcgccactccgcggcctaccgcgcagatcctctacgtgtgtcctcgcgagacaagctcaccgaaatggccgcgtccagtcaaggaaacattgagggaaattttgagtcactggaccttacggaatttgctaagaagcagccatggtggcgtaagctgttcgggcaggaatctggaccttcagcagaaaagtatagcatggcaacccagct

SEQ ID NO: 87329 - DNA, 202 bp, Homo sapiens
ctcccttccaccagctcccttccaccagcctcccttccaccactcccgtccaccagcctcccttccaccatcaaggaaacattgagggaaattttgagtcactggaccttacggaatttgctaagaagcagccatggtggcgtaagctgttcgggcaggaatctggaccttcagcagaaaagtatagcatggcaacccagct

SEQ ID NO: 87330 - DNA, 574 bp, Homo sapiens
caggagtgatgatattggtcctgaaggccacattaagtcttttggttgatttttgaaaacagaatgacttcaagaggtttacgaagggtgtgtgtgtgtgtgggcatgcatgcgtgcatgtgtgtgtaggagagaggtatattaacacgtttgcattttaaaatgatttttctggtttttctgagaaaatggactggatggggcaaaagtggaagcaggatgaaccagtggggaggctgtaacagtcgtccaggtaacacatgatgatggcaaggtggtaacagtaagatgatgagaactggataaactcaaaaacactgagtattacattagttagagttgaagtgtgaggcggaaagatgtagagaaaggaaattaatttgatttgagtggatttgacttagaaggcaacattttgagacacctagaatgatggcttctaataggctttcccagagccaaatggaggggttttctggaccctcagccatgtgctatggtgttaccaccatgtttgcttgcatctgttggagaagaagctaccccttcctctgcatggtggccgccttgcaag

SEQ ID NO: 87331 - DNA, 317 bp, Homo sapiens
gaacgtactcacatgtttacatgccctcttccaaccaagattcaggtctgctcctttgtccccatctccttcagaagcccatacctttttactattacttttctttcatgtctgtctcattaaaactctatttcctgattctagattctattaagctgacttaaactgagatcatttgaaaaagcataagcaaaaggcctcggtttatcaggttttatcatataagctgaagtatctagtcaacagttaaccactactttagcaaactcagttatgaacatgcttcccaacttagattcacttggatatgtacctca

SEQ ID NO: 87332 - DNA, 440 bp, Homo sapiens
agcttgcagtgagccgagattgtgccaccgcactccagcctgggtgacagagcgagattccgtctcaaaaaacaacagcaacaaaacaaaaccctcgaggggccactctcctgtctttactccttttcccttctctattctttcaccagaagccctcatttgaccagtgaactcctaggccctcttgacccgcacattagctgggcgatttccttgttctgctaattcctaattctgcttaaaatgtatttggatttctgtttttgaacacttatgatgccaggcactgtaatgcttgaaacccgatctttccctagagaatgtaacatacgtttttattcatttaatcacttcattatgccggggttaattatgtttattttataattggtaataaaggccacatttatttttgtaactgtttaaagagcgacaaaaaa

SEQ ID NO: 87333 - DNA, 2898 bp, Homo sapiens
  misc_feature (2887)..(2889): n is a, c, g, or t
  misc_feature (2895)..(2896): n is a, c, g, or t
atggagtcagggcagccggctcgacggattgccatggcgccgctgctggagtacgagcgacagctggtgctggaactgctcgacactgacgggctagtagtgtgcgcccgcgggctcggcgcggaccggctcctctaccactttctccagctgcactgccacccagcctgcctggtgctggtgctcaacacgcagccggccgaggaggagtattttatcaatcagctgaagatagaaggagttgaacacctccctcgccgtgtaacaaatgaaatcacaagcaacagtcgctatgaagtttacacacaaggtggtgttatatttgcgacaagtaggatacttgtggttgacttcttgactgatagaataccttcagatttaattactggcatcttggtgtatagagcccacagaataatcgagtcttgtcaagaagcattcatcttgcgcctctttcgccagaaaaacaaacgtggttttattaaagctttcacagacaatgctgttgcctttgatactggtttttgtcatgtggaaagagtgatgagaaatctttttgtgaggaaactgtatctgtggccaaggttccatgtagcagtaaactcatttttagaacagcacaaacctgaagttgtagaaatccatgtttctatgacacctaccatgcttgctatacagactgctatactggacattttaaatgcatgtctaaaggaactaaaatgccataacccatcgcttgaagtggaagatttatctttagaaaatgctattggaaaaccttttgacaagacaatccgccattatctggatcctttgtggcaccagcttggagccaagactaaatccttagttcaggatttgaagatattacgaactttgctgcagtatctctctcagtatgattgtgtcacatttcttaatcttctggaatctctgagagcaacggaaaaagcttttggtcagaattcaggttggctgtttcttgactccagcacctcgatgtttataaatgctcgagcaagggtttatcatcttccagatgccaaaatgagtaaaaaagaaaaaatatctgaaaaaatggaaattaaagaaggggaagaaacaaaaaaggaactggtcctagaaagcaacccaaagtgggaggcactgactgaagtattaaaagaaattgaggcagaaaataaggagagtgaagctcttggtggtccaggtcaagtactgatttgtgcaagtgatgaccgaacatgttcccagctgagagactatatcactcttggagcggaggccttcttattgaggctctacaggaaaacctttgagaaggatagcaaagctgaagaagtctggatgaaatttaggaaggaagacagttcaaagagaattaggaaatctcacaaaagacctaaagacccccaaaacaaagaacgggcttctaccaaagaaagaaccctcaaaaagaaaaaacggaagttgaccttaactcaaatggtaggaaaacctgaagaactggaagaggaaggagatgtcgaggaaggatatcgtcgagaaataagcagtagcccagaaagctgcccggaagaaattaagcatgaagaatttgatgtaaatttgtcatcggatgctgctttcggaatcctgaaagaacccctcactatcatccatccgcttctgggttgcagcgacccctatgctctgacaagggtactacatgaagtggagccaagatacgtggttctttatgacgcagagctaacctttgttcggcagcttgaaatttacagggcgagtaggcctgggaaacctctgagggtttactttcttatatacggaggttcaactgaggaacaacgctatctcactgctttgcggaaagaaaaggaagcttttgaaaaactcataagggaaaaagcaagcatggttgtccctgaagaaagagaaggcagagatgaaacaaacttagacctagtaagaggcacagcatctgcagatgtttccactgacactcggaaagccggtggccaggaacagaatggtacacagcaaagcatagttgtggatatgcgtgaatttcgaagtgagcttccatctctgatccatcgtcggggcattgacattgaacccgtgactttagaggttggagattacatcctcactccagaaatgtgcgtggagcgcaagagtatcagtgatttaatcggctctttaaataacggccgcctctacagccagtgcatctccatgtcccgctactacaagcgtcccgtgcttctgattgagtttgaccctagcaagcctttctctctcacttcccgaggtgccttgtttcaggagatctccagcaatgacattagttccaaactcactcttcttacacttcacttccccagactacggattctctggtgcccctctcctcatgcaacggcggagttgtttgaggagctgaaacaaagcaagccacagcctgatgcggcgacagcactggccattacagcagattctgaaacccttcccgagtcagagaagtataatcctggtccccaagacttcttgttaaaaatgccaggggtgaatgccaaaaactgccgctccttgatgcaccacgttaagaacatcgcagaattagcagccctgtcacaagacgagctcacgagtattctggggaatgctgcaaatgccaaacagctttatgatttcattcacacctcttttgcagaagtcgtatcaaaaggaaaagggaaaaagtgaacagtgatggctgttttcttatcccatgcctgtacttttcagcggctccttgccagacatcataggtcattattaattattggtttgctatttcattcttttccaatgctcttaatgattgtacggtggaccagannncagganncc

SEQ ID NO: 87334 - DNA, 3475 bp, Homo sapiens
atggagtcagggcagccggctcgacggattgccatggcgccgctgctggagtacgagcgacagctggtgctggaactgctcgacactgacgggctagtagtgtgcgcccgcgggctcggcgcggaccggctcctctaccactttctccagctgcactgccacccagcctgcctggtgctggtgctcaacacgcagccggccgaggaggagtattttatcaatcagctgaagatagaaggagttgaacacctccctcgccgtgtaacaaatgaaatcacaagcaacagtcgctatgaagtttacacacaaggtggtgttatatttgcgacaagtaggatacttgtggttgacttcttgactgatagaataccttcagatttaattactggcatcttggtgtatagagcccacagaataatcgagtcttgtcaagaagcattcatcttgcgcctctttcgccagaaaaacaaacgtggttttattaaagctttcacagacaatgctgttgcctttgatactggtttttgtcatgtggaaagagtgatgagaaatctttttgtgaggaaactgtatctgtggccaaggttccatgtagcagtaaactcatttttagaacagcacaaacctgaagttgtagaaatccatgtttctatgacacctaccatgcttgctatacagactgctatactggacattttaaatgcatgtctaaaggaactaaaatgccataacccatcgcttgaagtggaagatttatctttagaaaatgctattggaaaaccttttgacaagacaatccgccattatctggatcctttgtggcaccagcttggagccaagactaaatccttagttcaggatttgaagatattacgaactttgctgcagtatctctctcagtatgattgtgtcacatttcttaatcttctggaatctctgagagcaacggaaaaagcttttggtcagaattcaggttggctgtttcttgactccagcacctcgatgtttataaatgctcgagcaagggtttatcatcttccagatgccaaaatgagtaaaaaagaaaaaatatctgaaaaaatggaaattaaagaaggggaagaaacaaaaaaggaactggtcctagaaagcaacccaaagtgggaggcactgactgaagtattaaaagaaattgaggcagaaaataaggagagtgaagctcttggtggtccaggtcaagtactgatttgtgcaagtgatgaccgaacatgttcccagctgagagactatatcactcttggagcggaggccttcttattgaggctctacaggaaaacctttgagaaggatagcaaagctgaagaagtctggatgaaatttaggaaggaagacagttcaaagagaattaggaaatctcacaaaagacctaaagacccccaaaacaaagaacgggcttctaccaaagaaagaaccctcaaaaagaaaaaacggaagttgaccttaactcaaatggcagtagcccagaaagctgcccggaagaaattaagcatgaagaatttgatgtaaatttgtcatcggatgctgctttcggaatcctgaaagaacccctcactatcatccatccgcttctgggttgcagcgacccctatgctctgacaagggtactacatgaagtggagccaagatacgtggttctttatgacgcagagctaacctttgttcggcagcttgaaatttacagggcgagtaggcctgggaaacctctgagggtttactttcttatatacggaggttcaactgaggaacaacgctatctcactgctttgcggaaagaaaaggaagcttttgaaaaactcataagatctaccgtataagatatgagccaccttgaagacaggaattcttgcgtgatcacgattatatccaaagtacctagagcaccacgcaggaacactccataaatgtttttcaataaatgcatgaggaaaaagcaagcatggttgtccctgaagaaagagaaggcagagatgaaacaaacttagacctagtaagaggcacagcatctgcagatgtttccactgacactcggaaagccggtggccaggaacagaatggtacacagcaaagcatagttgtggatatgcgtgaatttcgaagtgagcttccatctctgatccatcgtcggggcattgacattgaacccgtgactttagaggttggagattacatcctcactccagaaatgtgcgtggagcgcaagagtatcagtgatttaatcggctctttaaataacggccgcctctacagccagtgcatctccatgtcccgctactacaagcgtcccgtgcttctgattgagtttgaccctagcaagcctttctctctcacttcccgaggtgccttgtttcaggagatctccagcaatgacattagttccaaactcactcttcttacacttcacttccccagactacggattctctggtgcccctctcctcatgcaacggcggagttgtttgaggagctgaaacaaagcaagccacagcctgatgcggcgacagcactggccattacagcagattctgaaacccttcccgagtcagagaagtataatcctggtccccaagacttcttgttaaaaatgccaggggtgaatgccaaaaactgccgctccttgatgcaccacgttaagaacatcgcagaattagcagccctgtcacaagacgagctcacgagtattctggggaatgctgcaaatgccaaacagctttatgatttcattcacacctcttttgcagggagggaaaagagcaggcacaagaaagctaccatttttaacagtccttgttatctagtgcaacataaataacagtcttaattgcacttatacccatgtcctgtggctctccaaatctggtctttgctgttgtgtctgctggacgcttgaactgatgtttgtgtaggaaatcatgttctgaccctttgtctacaaaggagccttctggaacactgagaagaaacatctctttgccattcctgaccagttctctctaccacattttcttcagctccatacttctgcctgtctgctctaaggaaatttcatggagccttcctactactaattcaagacagtctcctcaaaaactggttgactactcttctaatgaccctaacatatgtagcatatactataatttcattgttccaaattagtatttttaaagcaaaatgaattacctatttgcaaaagttaatgatgaaggagctcttagaattctcaatttttgcacatattcagtctcctaatatcagagatccctaagtccagctggctagttacagagttttttcagacttcctcgtttctcagctcttatatcctaagacaccagcatcatatgctctagaaatacaacctaattggcagtgagccgagatcgcaccactgcacccctgcctgggcgacagagtgagactttgtctctattacaaa

SEQ ID NO: 87335 - DNA, 2931 bp, Homo sapiens
atggagtcagggcagccggctcgacggattgccatggcgccgctgctggagtacgagcgacagctggtgctggaactgctcgacactgacgggctagtagtgtgcgcccgcgggctcggcgcggaccggctcctctaccactttctccagctgcactgccacccagcctgcctggtgctggtgctcaacacgcagccggccgaggaggagtattttatcaatcagctgaagatagaaggagttgaacacctccctcgccgtgtaacaaatgaaatcacaagcaacagtcgctatgaagtttacacacaaggtggtgttatatttgcgacaagtaggatacttgtggttgacttcttgactgatagaataccttcagatttaattactggcatcttggtgtatagagcccacagaataatcgagtcttgtcaagaagcattcatcttgcgcctctttcgccagaaaaacaaacgtggttttattaaagctttcacagacaatgctgttgcctttgatactggtttttgtcatgtggaaagagtgatgagaaatctttttgtgaggaaactgtatctgtggccaaggttccatgtagcagtaaactcatttttagaacagcacaaacctgaagttgtagaaatccatgtttctatgacacctaccatgcttgctatacagactgctatactggacattttaaatgcatgtctaaaggaactaaaatgccataacccatcgcttgaagtggaagatttatctttagaaaatgctattggaaaaccttttgacaagacaatccgccattatctggatcctttgtggcaccagcttggagccaagactaaatccttagttcaggatttgaagatattacgaactttgctgcagtatctctctcagtatgattgtgtcacatttcttaatcttctggaatctctgagagcaacggaaaaagcttttggtcagaattcaggttggctgtttcttgactccagcacctcgatgtttataaatgctcgagcaagggtttatcatcttccagatgccaaaatgagtaaaaaagaaaaaatatctgaaaaaatggaaattaaagaaggggaagaaacaaaaaaggaactggtcctagaaagcaacccaaagtgggaggcactgactgaagtattaaaagaaattgaggcagaaaataaggagagtgaagctcttggtggtccaggtcaagtactgatttgtgcaagtgatgaccgaacatgttcccagctgagagactatatcactcttggagcggaggccttcttattgaggctctacaggaaaacctttgagaaggatagcaaagctgaagaagtctggatgaaatttaggaaggaagacagttcaaagagaattaggaaatctcacaaaagacctaaagacccccaaaacaaagaacgggcttctaccaaagaaagaaccctcaaaaagaaaaaacggaagttgaccttaactcaaatggtaggaaaacctgaagaactggaagaggaaggagatgtcgaggaaggatatcgtcgagaaataagcagtagcccagaaagctgcccggaagaaattaagcatgaagaatttgatgtaaatttgtcatcggatgctgctttcggaatcctgaaagaacccctcactatcatccatccgcttctgggttgcagcgacccctatgctctgacaagggtactacatgaagtggagccaagatacgtggttctttatgacgcagagctaacctttgttcggcagcttgaaatttacagggcgagtaggcctgggaaacctctgagggtttactttcttatatacggaggttcaactgaggaacaacgctatctcactgctttgcggaaagaaaaggaagcttttgaaaaactcataagggaaaaagcaagcatggttgtccctgaagaaagagaaggcagagatgaaacaaacttagacctagtaagaggcacagcatctgcagatgtttccactgacactcggaaagccggtggccaggaacagaatggtacacagcaaagcatagttgtggatatgcgtgaatttcgaagtgagcttccatctctgatccatcgtcggggcattgacattgaacccgtgactttagaggttggagattacatcctcactccagaaatgtgcgtggagcgcaagagtatcagtgatttaatcggctctttaaataacggccgcctctacagccagtgcatctccatgtcccgctactacaagcctaccatttttaacagtccttgttatctagtgcaacataaataacagtcttaattgcacttatacccatgtcctgtggctctccaaatctggtctttgctgttgtgtctgctggacgcttgaactgatgtttgtgtaggaaatcatgttctgaccctttgtctacaaaggagccttctggaacactgagaagaaacatctctttgccattcctgaccagttctctctaccacattttcttcagctccatacttctgcctgtctgctctaaggaaatttcatggagccttcctactactaattcaagacagtctcctcaaaaactggttgactactcttctaatgaccctaacatatgtagcatatactataatttcattgttccaaattagtatttttaaagcaaaatgaattacctatttgcaaaagttaatgatgaaggagctcttagaattctcaatttttgcacatattcagtctcctaatatcagagatccctaagtccagctggctagttacagagttttttcagacttcctcgtttctcagctcttatatcctaagacaccagcatcatatgctctagaaatacaacctaattggcagtgagccgagatcgcaccactgcacccctgcctgggcgacagagtgagactttgtctctattacaaa

SEQ ID NO: 87336 - DNA, 2579 bp, Homo sapiens
cttacacctcagtagtactttcataagattaaatagtctggcttcaactttactgaaaagatttaagtaatcttgccagagaggagaaagcatttgatcaatacctaagaccctttttaaatagtttgtaaattgtggatctttaataccaaagggtaagatgtcttcccttcgggtgaaggaataagggggcacagggaaactaggaggacaagtgaggtaatagtaacataatgttgttttctattttcaggtcaagtactgatttgtgcaagtgatgaccgaacatgttcccagctgagagactatatcactcttggagcggaggccttcttattgaggctctacaggaaaacctttgagaaggatagcaaagctgaagaagtctggatgaaatttaggaaggaagacagttcaaagagaattaggaaatctcacaaaagacctaaagacccccaaaacaaagaacgggcttctaccaaagaaagaaccctcaaaaagaaaaaacggaagttgaccttaactcaaatggtaggaaaacctgaagaactggaagaggaaggagatgtcgaggaaggatatcgtcgagaaataagcagtagcccagaaagctgcccggaagaaattaagcatgaagaatttgatgtaaatttgtcatcggatgctgctttcggaatcctgaaagaacccctcactatcatccatccgcttctgggttgcagcgacccctatgctctgacaagggtactacatgaagtggagccaagatacgtggttctttatgacgcagagctaacctttgttcggcagcttgaaatttacagggcgagtaggcctgggaaacctctgagggtttactttcttatatacggaggttcaactgaggaacaacgctatctcactgctttgcggaaagaaaaggaagcttttgaaaaactcataagatctaccgtataagatatgagccaccttgaagacaggaattcttgcgtgatcacgattatatccaaagtacctagagcaccacgcaggaacactccataaatgtttttcaataaatgcatgaggaaaaagcaagcatggttgtccctgaagaaagagaaggcagagatgaaacaaacttagacctagtaagaggcacagcatctgcagatgtttccactgacactcggaaagccggtggccaggaacagaatggtacacagcaaagcatagttgtggatatgcgtgaatttcgaagtgagcttccatctctgatccatcgtcggggcattgacattgaacccgtgactttagaggttggagattacatcctcactccagaaatgtgcgtggagcgcaagagtatcagtgatttaatcggctctttaaataacggccgcctctacagccagtgcatctccatgtcccgctactacaagcgtcccgtgcttctgattgagtttgaccctagcaagcctttctctctcacttcccgaggtgccttgtttcaggagatctccagcaatgacattagttccaaactcactcttcttacacttcacttccccagactacggattctctggtgcccctctcctcatgcaacggcggagttgtttgaggagctgaaacaaagcaagccacagcctgatgcggcgacagcactggccattacagcagattctgaaacccttcccgagtcagagaagtataatcctggtccccaagacttcttgttaaaaatgccaggggtgaatgccaaaaactgccgctccttgatgcaccacgttaagaacatcgcagaattagcagccctgtcacaagacgagctcacgagtattctggggaatgctgcaaatgccaaacagctttatgatttcattcacacctcttttgcagggagggaaaagagcaggcacaagaaagctaccatttttaacagtccttgttatctagtgcaacataaataacagtcttaattgcacttatacccatgtcctgtggctctccaaatctggtctttgctgttgtgtctgctggacgcttgaactgatgtttgtgtaggaaatcatgttctgaccctttgtctacaaaggagccttctggaacactgagaagaaacatctctttgccattcctgaccagttctctctaccacattttcttcagctccatacttctgcctgtctgctctaaggaaatttcatggagccttcctactactaattcaagacagtctcctcaaaaactggttgactactcttctaatgaccctaacatatgtagcatatactataatttcattgttccaaattagtatttttaaagcaaaatgaattacctatttgcaaaagttaatgatgaaggagctcttagaattctcaatttttgcacatattcagtctcctaatatcagagatccctaagtccagctggctagttacagagttttttcagacttcctcgtttctcagctcttatatcctaagacaccagcatcatatgctctagaaatacaacctaattggcagtgagccgagatcgcaccactgcacccctgcctgggcgacagagtgagactttgtctctattacaaa

SEQ ID NO: 87337 - DNA, 2607 bp, Homo sapiens
ccttaagtagatctttttcaggaaagcagattccatctaacattataaagaaagcttaaataaatgggcatatgtactgatgctcgtgttatctgttgttttaaaagcctttggaagactttatgggtaaatattatcacatagaatgagatatttttatttctctacagaaacaaaaaaggaactggtcctagaaagcaacccaaagtgggaggcactgactgaagtattaaaagaaattgaggcagaaaataaggagagtgaagctcttggtggtccaggtcaagtactgatttgtgcaagtgatgaccgaacatgttcccagctgagagactatatcactcttggagcggaggccttcttattgaggctctacaggaaaacctttgagaaggatagcaaagctgaagaagtctggatgaaatttaggaaggaagacagttcaaagagaattaggaaatctcacaaaagacctaaagacccccaaaacaaagaacgggcttctaccaaagaaagaaccctcaaaaagaaaaaacggaagttgaccttaactcaaatggtaggaaaacctgaagaactggaagaggaaggagatgtcgaggaaggatatcgtcgagaaataagcagtagcccagaaagctgcccggaagaaattaagcatgaagaatttgatgtaaatttgtcatcggatgctgctttcggaatcctgaaagaacccctcactatcatccatccgcttctgggttgcagcgacccctatgctctgacaagggtactacatgaagtggagccaagatacgtggttctttatgacgcagagctaacctttgttcggcagcttgaaatttacagggcgagtaggcctgggaaacctctgagggtttactttcttatatacggaggttcaactgaggaacaacgctatctcactgctttgcggaaagaaaaggaagcttttgaaaaactcataagatctaccgtataagatatgagccaccttgaagacaggaattcttgcgtgatcacgattatatccaaagtacctagagcaccacgcaggaacactccataaatgtttttcaataaatgcatgaggaaaaagcaagcatggttgtccctgaagaaagagaaggcagagatgaaacaaacttagacctagtaagaggcacagcatctgcagatgtttccactgacactcggaaagccggtggccaggaacagaatggtacacagcaaagcatagttgtggatatgcgtgaatttcgaagtgagcttccatctctgatccatcgtcggggcattgacattgaacccgtgactttagaggttggagattacatcctcactccagaaatgtgcgtggagcgcaagagtatcagtgatttaatcggctctttaaataacggccgcctctacagccagtgcatctccatgtcccgctactacaagcgtcccgtgcttctgattgagtttgaccctagcaagcctttctctctcacttcccgaggtgccttgtttcaggagatctccagcaatgacattagttccaaactcactcttcttacacttcacttccccagactacggattctctggtgcccctctcctcatgcaacggcggagttgtttgaggagctgaaacaaagcaagccacagcctgatgcggcgacagcactggccattacagcagattctgaaacccttcccgagtcagagaagtataatcctggtccccaagacttcttgttaaaaatgccaggggtgaatgccaaaaactgccgctccttgatgcaccacgttaagaacatcgcagaattagcagccctgtcacaagacgagctcacgagtattctggggaatgctgcaaatgccaaacagctttatgatttcattcacacctcttttgcagggagggaaaagagcaggcacaagaaagctaccatttttaacagtccttgttatctagtgcaacataaataacagtcttaattgcacttatacccatgtcctgtggctctccaaatctggtctttgctgttgtgtctgctggacgcttgaactgatgtttgtgtaggaaatcatgttctgaccctttgtctacaaaggagccttctggaacactgagaagaaacatctctttgccattcctgaccagttctctctaccacattttcttcagctccatacttctgcctgtctgctctaaggaaatttcatggagccttcctactactaattcaagacagtctcctcaaaaactggttgactactcttctaatgaccctaacatatgtagcatatactataatttcattgttccaaattagtatttttaaagcaaaatgaattacctatttgcaaaagttaatgatgaaggagctcttagaattctcaatttttgcacatattcagtctcctaatatcagagatccctaagtccagctggctagttacagagttttttcagacttcctcgtttctcagctcttatatcctaagacaccagcatcatatgctctagaaatacaacctaattggcagtgagccgagatcgcaccactgcacccctgcctgggcgacagagtgagactttgtctctattacaaa

SEQ ID NO: 87338 - DNA, 473 bp, Homo sapiens
gctgtgttttaaatgacctccaattttattcttaaataacagcaaattcctattaacaacattgcaaatattaaaataacttgcttttacgccatcactggaaatgtcaacgcagtgaaaaaagtcaaataatgtcatggtattgttacgagaaaagttctgacatcacatagccctgaaaatatcttgggggcccctgggagttcacggaccacacccagaaaaccactggtccagctgaacagcgacagatcacagtagtgggaggcggtgtggttggtaggaagacaggatgacagccagttacgtatgtaggtcatgtgaccatcagagactgttttaaattaaccataaattgatggcactttttcttttaacttttcatattaggttggctgtttcttgactccagcacctcgatgtttataaatgctcgagcaagggtttatcatcttccagatgccaaaatgagt

SEQ ID NO: 87339 - DNA, 601 bp, Homo sapiens
gaaataagcagtagcccagaaagctgcccggaagaaattaagcatgaagaatttgatgtaaatttgtcatcggatgctgctttcggaatcctgaaagaacccctcactatcatccatccgcttctgggttgcagcgacccctatgctctgacaagggtactacatgaagtggagccaagatacgtggttctttatgacgcagagctaacctttgttcggcagcttgaaatttacagggcgagtaggcctgggaaacctctgaggcaagttataaagaatcacagctttcagttgcacagttctttaggatttaacccagaaactataccagttgcatgttagttttctttaatatccgttacgatgctgcttatgtttatgaaaccttattttgcttcctgatgaatctgggaagttggataggaaggatgtcaagtatcacagcagaacaacaaaccaaggggactgctcttgttctcgttacgtgctgctgtgcgttctctcctttattctttgggtattggtttgcatcgtatggggtactgtatctgaaaaagtctgggaaatgcataatattctaatttctaacaaaagttaatat

SEQ ID NO: 87340 - DNA, 3539 bp, Homo sapiens
atggagtcagggcagccggctcgacggattgccatggcgccgctgctggagtacgagcgacagctggtgctggaactgctcgacactgacgggctagtagtgtgcgcccgcgggctcggcgcggaccggctcctctaccactttctccagctgcactgccacccagcctgcctggtgctggtgctcaacacgcagccggccgaggaggagtattttatcaatcagctgaagatagaaggagttgaacacctccctcgccgtgtaacaaatgaaatcacaagcaacagtcgctatgaagtttacacacaaggtggtgttatatttgcgacaagtaggatacttgtggttgacttcttgactgatagaataccttcagatttaattactggcatcttggtgtatagagcccacagaataatcgagtcttgtcaagaagcattcatcttgcgcctctttcgccagaaaaacaaacgtggttttattaaagctttcacagacaatgctgttgcctttgatactggtttttgtcatgtggaaagagtgatgagaaatctttttgtgaggaaactgtatctgtggccaaggttccatgtagcagtaaactcatttttagaacagcacaaacctgaagttgtagaaatccatgtttctatgacacctaccatgcttgctatacagactgctatactggacattttaaatgcatgtctaaaggaactaaaatgccataacccatcgcttgaagtggaagatttatctttagaaaatgctattggaaaaccttttgacaagacaatccgccattatctggatcctttgtggcaccagcttggagccaagactaaatccttagttcaggatttgaagatattacgaactttgctgcagtatctctctcagtatgattgtgtcacatttcttaatcttctggaatctctgagagcaacggaaaaagcttttggtcagaattcaggttggctgtttcttgactccagcacctcgatgtttataaatgctcgagcaagggtttatcatcttccagatgccaaaatgagtaaaaaagaaaaaatatctgaaaaaatggaaattaaagaaggggaagaaacaaaaaaggaactggtcctagaaagcaacccaaagtgggaggcactgactgaagtattaaaagaaattgaggcagaaaataaggagagtgaagctcttggtggtccaggtcaagtactgatttgtgcaagtgatgaccgaacatgttcccagctgagagactatatcactcttggagcggaggccttcttattgaggctctacaggaaaacctttgagaaggatagcaaagctgaagaagtctggatgaaatttaggaaggaagacagttcaaagagaattaggaaatctcacaaaagacctaaagacccccaaaacaaagaacgggcttctaccaaagaaagaaccctcaaaaagaaaaaacggaagttgaccttaactcaaatggtaggaaaacctgaagaactggaagaggaaggagatgtcgaggaaggatatcgtcgagaaataagcagtagcccagaaagctgcccggaagaaattaagcatgaagaatttgatgtaaatttgtcatcggatgctgctttcggaatcctgaaagaacccctcactatcatccatccgcttctgggttgcagcgacccctatgctctgacaagggtactacatgaagtggagccaagatacgtggttctttatgacgcagagctaacctttgttcggcagcttgaaatttacagggcgagtaggcctgggaaacctctgagggtttactttcttatatacggaggttcaactgaggaacaacgctatctcactgctttgcggaaagaaaaggaagcttttgaaaaactcataagatctaccgtataagatatgagccaccttgaagacaggaattcttgcgtgatcacgattatatccaaagtacctagagcaccacgcaggaacactccataaatgtttttcaataaatgcatgaggaaaaagcaagcatggttgtccctgaagaaagagaaggcagagatgaaacaaacttagacctagtaagaggcacagcatctgcagatgtttccactgacactcggaaagccggtggccaggaacagaatggtacacagcaaagcatagttgtggatatgcgtgaatttcgaagtgagcttccatctctgatccatcgtcggggcattgacattgaacccgtgactttagaggttggagattacatcctcactccagaaatgtgcgtggagcgcaagagtatcagtgatttaatcggctctttaaataacggccgcctctacagccagtgcatctccatgtcccgctactacaagcgtcccgtgcttctgattgagtttgaccctagcaagcctttctctctcacttcccgaggtgccttgtttcaggagatctccagcaatgacattagttccaaactcactcttcttacacttcacttccccagactacggattctctggtgcccctctcctcatgcaacggcggagttgtttgaggagctgaaacaaagcaagccacagcctgatgcggcgacagcactggccattacagcagattctgaaacccttcccgagtcagagaagtataatcctggtccccaagacttcttgttaaaaatgccaggggtgaatgccaaaaactgccgctccttgatgcaccacgttaagaacatcgcagaattagcagccctgtcacaagacgagctcacgagtattctggggaatgctgcaaatgccaaacagctttatgatttcattcacacctcttttgcagggagggaaaagagcaggcacaagaaagctaccatttttaacagtccttgttatctagtgcaacataaataacagtcttaattgcacttatacccatgtcctgtggctctccaaatctggtctttgctgttgtgtctgctggacgcttgaactgatgtttgtgtaggaaatcatgttctgaccctttgtctacaaaggagccttctggaacactgagaagaaacatctctttgccattcctgaccagttctctctaccacattttcttcagctccatacttctgcctgtctgctctaaggaaatttcatggagccttcctactactaattcaagacagtctcctcaaaaactggttgactactcttctaatgaccctaacatatgtagcatatactataatttcattgttccaaattagtatttttaaagcaaaatgaattacctatttgcaaaagttaatgatgaaggagctcttagaattctcaatttttgcacatattcagtctcctaatatcagagatccctaagtccagctggctagttacagagttttttcagacttcctcgtttctcagctcttatatcctaagacaccagcatcatatgctctagaaatacaacctaattggcagtgagccgagatcgcaccactgcacccctgcctgggcgacagagtgagactttgtctctattacaaa

SEQ ID NO: 87341 - DNA, 2839 bp, Homo sapiens
cacaggaaataatccttttgaaagtatgatttgtattaagaataactatacttaacatattttagcaataccaaattttattcttgttttagacaatccgccattatctggatcctttgtggcaccagcttggagccaagactaaatccttagttcaggatttgaagatattacgaactttgctgcagtatctctctcagtatgattgtgtcacatttcttaatcttctggaatctctgagagcaacggaaaaagcttttggtcagaattcaggttggctgtttcttgactccagcacctcgatgtttataaatgctcgagcaagggtttatcatcttccagatgccaaaatgagtaaaaaagaaaaaatatctgaaaaaatggaaattaaagaaggggaagaaacaaaaaaggaactggtcctagaaagcaacccaaagtgggaggcactgactgaagtattaaaagaaattgaggcagaaaataaggagagtgaagctcttggtggtccaggtcaagtactgatttgtgcaagtgatgaccgaacatgttcccagctgagagactatatcactcttggagcggaggccttcttattgaggctctacaggaaaacctttgagaaggatagcaaagctgaagaagtctggatgaaatttaggaaggaagacagttcaaagagaattaggaaatctcacaaaagacctaaagacccccaaaacaaagaacgggcttctaccaaagaaagaaccctcaaaaagaaaaaacggaagttgaccttaactcaaatggtaggaaaacctgaagaactggaagaggaaggagatgtcgaggaaggatatcgtcgagaaataagcagtagcccagaaagctgcccggaagaaattaagcatgaagaatttgatgtaaatttgtcatcggatgctgctttcggaatcctgaaagaacccctcactatcatccatccgcttctgggttgcagcgacccctatgctctgacaagggtactacatgaagtggagccaagatacgtggttctttatgacgcagagctaacctttgttcggcagcttgaaatttacagggcgagtaggcctgggaaacctctgagggtttactttcttatatacggaggttcaactgaggaacaacgctatctcactgctttgcggaaagaaaaggaagcttttgaaaaactcataagatctaccgtataagatatgagccaccttgaagacaggaattcttgcgtgatcacgattatatccaaagtacctagagcaccacgcaggaacactccataaatgtttttcaataaatgcatgaggaaaaagcaagcatggttgtccctgaagaaagagaaggcagagatgaaacaaacttagacctagtaagaggcacagcatctgcagatgtttccactgacactcggaaagccggtggccaggaacagaatggtacacagcaaagcatagttgtggatatgcgtgaatttcgaagtgagcttccatctctgatccatcgtcggggcattgacattgaacccgtgactttagaggttggagattacatcctcactccagaaatgtgcgtggagcgcaagagtatcagtgatttaatcggctctttaaataacggccgcctctacagccagtgcatctccatgtcccgctactacaagcgtcccgtgcttctgattgagtttgaccctagcaagcctttctctctcacttcccgaggtgccttgtttcaggagatctccagcaatgacattagttccaaactcactcttcttacacttcacttccccagactacggattctctggtgcccctctcctcatgcaacggcggagttgtttgaggagctgaaacaaagcaagccacagcctgatgcggcgacagcactggccattacagcagattctgaaacccttcccgagtcagagaagtataatcctggtccccaagacttcttgttaaaaatgccaggggtgaatgccaaaaactgccgctccttgatgcaccacgttaagaacatcgcagaattagcagccctgtcacaagacgagctcacgagtattctggggaatgctgcaaatgccaaacagctttatgatttcattcacacctcttttgcagggagggaaaagagcaggcacaagaaagctaccatttttaacagtccttgttatctagtgcaacataaataacagtcttaattgcacttatacccatgtcctgtggctctccaaatctggtctttgctgttgtgtctgctggacgcttgaactgatgtttgtgtaggaaatcatgttctgaccctttgtctacaaaggagccttctggaacactgagaagaaacatctctttgccattcctgaccagttctctctaccacattttcttcagctccatacttctgcctgtctgctctaaggaaatttcatggagccttcctactactaattcaagacagtctcctcaaaaactggttgactactcttctaatgaccctaacatatgtagcatatactataatttcattgttccaaattagtatttttaaagcaaaatgaattacctatttgcaaaagttaatgatgaaggagctcttagaattctcaatttttgcacatattcagtctcctaatatcagagatccctaagtccagctggctagttacagagttttttcagacttcctcgtttctcagctcttatatcctaagacaccagcatcatatgctctagaaatacaacctaattggcagtgagccgagatcgcaccactgcacccctgcctgggcgacagagtgagactttgtctctattacaaa

SEQ ID NO: 87342 - DNA, 2983 bp, Homo sapiens
atggagtcagggcagccggctcgacggattgccatggcgccgctgctggagtacgagcgacagctggtgctggaactgctcgacactgacgggctagtagtgtgcgcccgcgggctcggcgcggaccggctcctctaccactttctccagctgcactgccacccagcctgcctggtgctggtgctcaacacgcagccggccgaggaggagtattttatcaatcagctgaagatagaaggagttgaacacctccctcgccgtgtaacaaatgaaatcacaagcaacagtcgctatgaagtttacacacaaggtggtgttatatttgcgacaagtaggatacttgtggttgacttcttgactgatagaataccttcagatttaattactggcatcttggtgtatagagcccacagaataatcgagtcttgtcaagaagcattcatcttgcgcctctttcgccagaaaaacaaacgtggttttattaaagctttcacagacaatgctgttgcctttgatactggtttttgtcatgtggaaagagtgatgagaaatctttttgtgaggaaactgtatctgtggccaaggttccatgtagcagtaaactcatttttagaacagcacaaacctgaagttgtagaaatccatgtttctatgacacctaccatgcttgctatacagactgctatactggacattttaaatgcatgtctaaaggaactaaaatgccataacccatcgcttgaagtggaagatttatctttagaaaatgctattggaaaaccttttgacaagacaatccgccattatctggatcctttgtggcaccagcttggagccaagactaaatccttagttcaggatttgaagatattacgaactttgctgcagtatctctctcagtatgattgtgtcacatttcttaatcttctggaatcttaggaaaacctgaagaactggaagaggaaggagatgtcgaggaaggatatcgtcgagaaataagcagtagcccagaaagctgcccggaagaaattaagcatgaagaatttgatgtaaatttgtcatcggatgctgctttcggaatcctgaaagaacccctcactatcatccatccgcttctgggttgcagcgacccctatgctctgacaagggtactacatgaagtggagccaagatacgtggttctttatgacgcagagctaacctttgttcggcagcttgaaatttacagggcgagtaggcctgggaaacctctgagggtttactttcttatatacggaggttcaactgaggaacaacgctatctcactgctttgcggaaagaaaaggaagcttttgaaaaactcataagatctaccgtataagatatgagccaccttgaagacaggaattcttgcgtgatcacgattatatccaaagtacctagagcaccacgcaggaacactccataaatgtttttcaataaatgcatgaggaaaaagcaagcatggttgtccctgaagaaagagaaggcagagatgaaacaaacttagacctagtaagaggcacagcatctgcagatgtttccactgacactcggaaagccggtggccaggaacagaatggtacacagcaaagcatagttgtggatatgcgtgaatttcgaagtgagcttccatctctgatccatcgtcggggcattgacattgaacccgtgactttagaggttggagattacatcctcactccagaaatgtgcgtggagcgcaagagtatcagtgatttaatcggctctttaaataacggccgcctctacagccagtgcatctccatgtcccgctactacaagcgtcccgtgcttctgattgagtttgaccctagcaagcctttctctctcacttcccgaggtgccttgtttcaggagatctccagcaatgacattagttccaaactcactcttcttacacttcacttccccagactacggattctctggtgcccctctcctcatgcaacggcggagttgtttgaggagctgaaacaaagcaagccacagcctgatgcggcgacagcactggccattacagcagattctgaaacccttcccgagtcagagaagtataatcctggtccccaagacttcttgttaaaaatgccaggggtgaatgccaaaaactgccgctccttgatgcaccacgttaagaacatcgcagaattagcagccctgtcacaagacgagctcacgagtattctggggaatgctgcaaatgccaaacagctttatgatttcattcacacctcttttgcagggagggaaaagagcaggcacaagaaagctaccatttttaacagtccttgttatctagtgcaacataaataacagtcttaattgcacttatacccatgtcctgtggctctccaaatctggtctttgctgttgtgtctgctggacgcttgaactgatgtttgtgtaggaaatcatgttctgaccctttgtctacaaaggagccttctggaacactgagaagaaacatctctttgccattcctgaccagttctctctaccacattttcttcagctccatacttctgcctgtctgctctaaggaaatttcatggagccttcctactactaattcaagacagtctcctcaaaaactggttgactactcttctaatgaccctaacatatgtagcatatactataatttcattgttccaaattagtatttttaaagcaaaatgaattacctatttgcaaaagttaatgatgaaggagctcttagaattctcaatttttgcacatattcagtctcctaatatcagagatccctaagtccagctggctagttacagagttttttcagacttcctcgtttctcagctcttatatcctaagacaccagcatcatatgctctagaaatacaacctaattggcagtgagccgagatcgcaccactgcacccctgcctgggcgacagagtgagactttgtctctattacaaa

SEQ ID NO: 87343 - DNA, 2283 bp, Homo sapiens
cacaggaaataatccttttgaaagtatgatttgtattaagaataactatacttaacatattttagcaataccaaattttattcttgttttagacaatccgccattatctggatcctttgtggcaccagcttggagccaagactaaatccttagttcaggatttgaagatattacgaactttgctgcagtatctctctcagtatgattgtgtcacatttcttaatcttctggaatcttaggaaaacctgaagaactggaagaggaaggagatgtcgaggaaggatatcgtcgagaaataagcagtagcccagaaagctgcccggaagaaattaagcatgaagaatttgatgtaaatttgtcatcggatgctgctttcggaatcctgaaagaacccctcactatcatccatccgcttctgggttgcagcgacccctatgctctgacaagggtactacatgaagtggagccaagatacgtggttctttatgacgcagagctaacctttgttcggcagcttgaaatttacagggcgagtaggcctgggaaacctctgagggtttactttcttatatacggaggttcaactgaggaacaacgctatctcactgctttgcggaaagaaaaggaagcttttgaaaaactcataagatctaccgtataagatatgagccaccttgaagacaggaattcttgcgtgatcacgattatatccaaagtacctagagcaccacgcaggaacactccataaatgtttttcaataaatgcatgaggaaaaagcaagcatggttgtccctgaagaaagagaaggcagagatgaaacaaacttagacctagtaagaggcacagcatctgcagatgtttccactgacactcggaaagccggtggccaggaacagaatggtacacagcaaagcatagttgtggatatgcgtgaatttcgaagtgagcttccatctctgatccatcgtcggggcattgacattgaacccgtgactttagaggttggagattacatcctcactccagaaatgtgcgtggagcgcaagagtatcagtgatttaatcggctctttaaataacggccgcctctacagccagtgcatctccatgtcccgctactacaagcgtcccgtgcttctgattgagtttgaccctagcaagcctttctctctcacttcccgaggtgccttgtttcaggagatctccagcaatgacattagttccaaactcactcttcttacacttcacttccccagactacggattctctggtgcccctctcctcatgcaacggcggagttgtttgaggagctgaaacaaagcaagccacagcctgatgcggcgacagcactggccattacagcagattctgaaacccttcccgagtcagagaagtataatcctggtccccaagacttcttgttaaaaatgccaggggtgaatgccaaaaactgccgctccttgatgcaccacgttaagaacatcgcagaattagcagccctgtcacaagacgagctcacgagtattctggggaatgctgcaaatgccaaacagctttatgatttcattcacacctcttttgcagggagggaaaagagcaggcacaagaaagctaccatttttaacagtccttgttatctagtgcaacataaataacagtcttaattgcacttatacccatgtcctgtggctctccaaatctggtctttgctgttgtgtctgctggacgcttgaactgatgtttgtgtaggaaatcatgttctgaccctttgtctacaaaggagccttctggaacactgagaagaaacatctctttgccattcctgaccagttctctctaccacattttcttcagctccatacttctgcctgtctgctctaaggaaatttcatggagccttcctactactaattcaagacagtctcctcaaaaactggttgactactcttctaatgaccctaacatatgtagcatatactataatttcattgttccaaattagtatttttaaagcaaaatgaattacctatttgcaaaagttaatgatgaaggagctcttagaattctcaatttttgcacatattcagtctcctaatatcagagatccctaagtccagctggctagttacagagttttttcagacttcctcgtttctcagctcttatatcctaagacaccagcatcatatgctctagaaatacaacctaattggcagtgagccgagatcgcaccactgcacccctgcctgggcgacagagtgagactttgtctctattacaaa

SEQ ID NO: 87344 - DNA, 372 bp, Homo sapiens
gcttctctttcctatagtgaaaagagtactgcttctgagatgggcagaggacacaaggatgagtcaagacaaaggggaatttagaaaaaaaagacagtatgagatttcccacccaatagcctctgtgttttcactaaagaagcaggattagctgctgagagtaagagggtacaatagaagtttgggatacatttattttttcctattaattcacaatagcatttcttcagtgatgcaaaaacctgtgaggaagagcaaaaggaaggaaagacatgtcctgccagtcactttcactttgtgccttgcatcttgagaaatctagggtgagaatagcactgaaatacccacaggacctcaagacagaagcagggt

SEQ ID NO: 87345 - DNA, 477 bp, Homo sapiens
gccaatcttatcattaccctaatatgactgcctgagacatttcagctgggtaatgataaaagaacaaggcagaactaatgtgaacaaacttcttgagtttctggctttctttgcaatgtgtcttcctaaggaagggactttagtaataatgtagtcttccctcttcccgaagaggcccatgtgtaagcatctcagacctataggctcatcagctattaataaagctaacactattattccccagattctcttcgaatctcccttgcaaataaccaaggagataaagcttctttttgcttgagagttggaaccaaagctgcaaacctaccttaggaacactgtgtacagagccactaggcaaggaatggcagagaagtttcacatggtgtgcctgctctgacgggtaggatgtagacagctgtgttgggaagggggttgtgttcagaccaggattgaatggcagtgtctgccatggcc

SEQ ID NO: 87346 - DNA, 392 bp, Homo sapiens
ggaatcagcattcctcactttccacctagccaaatactcagggactgcgtcctctcctaaggcatcttcccagagttctcccttggactcttggcataatttctctaccaggggagccctaggtttccatggaaatatcctgtgaccaaccacaggagacagagagggaagagaaagaggagattcatgttcttagtcatatttgcacccttccaacacctaacgctttgctgggtgttttgctaactgtaaataggcatattctagtaccaaagccaaagtacttcaggaacaaatacagaacgaagtaacatcagaagtgtcttaactaagaaatgtcatacttcttcatcagactcttcatctttagttcaaatgtctagtgttaaaat

SEQ ID NO: 87347 - DNA, 832 bp, Homo sapiens
caggcttcgaaaggcccagagcagggacagggcatctatgcagggccactttccaccagcaaagctcagaacggaatcagcaagagtaggtgggagggagggtggctgggggctgtccaggtgaggggctgcagggatggagggaagcattatcaaggggggaggctaattcacctcccaccaaaaacccagcatcgggccagccacagtgctggccacgcaaatatccacgaggtagcctccacctccaccagtaagcccttgactcctgggagctgctcagggactccagctcctggaggttacacggattcccaagctgggaacccctgaattattttaggggatctctcatcccgtatgtgcagccaacactgctggtagaccaaacaaatactatgtttcacacgtgaacatctttcaaaccaaaatagaagctgctttgataaataaaattcacagactccaaagttatctaaaaattggttcttaacagcttcctgtcatcctgtagtttttcaatcttggatattaacccttgtgtgtggggttaatatggcatgggggcagggggtgtctcataatttctgatgataaacaggtctcttccctttacttgaaaagcccgggagtgcaaatggagttcccatacttcacggtgtgggggaaggatcagaggatgaggcctgtactgctggacctcgggtggagaccgcagcccagggctccctgctctgcagggctctggaagatgaggggatctgggggcccagagccaggcaccccagtgttactggcctgcctgcccccagcagaccagcagtcctccaag

SEQ ID NO: 87348 - DNA, 403 bp, Homo sapiens
tgaagaactctccacgttgaagtctgtcctctgctttttctacaggggattttctgtcccatgaaaccctagtcataggttgcctcccagaaacagtgatactttgagccagctgcacaactggtctttagctgtatttgatcagtaaagcacttaaaatttgtattacttttaagtcctggcaaactacagacaaatgttttaaacatgtaaaatatctatattcctctcatagtttcatctggaaggctattcttgaggtggtgtggtctagttggtaaaatgatgggttcagaggtaagaatccatggctcttcactaaatagctgtgtgggtttgggcaacttggttaaccactccacacctgtttttcccatctgtgaaatgaaggggttgaccagat

SEQ ID NO: 87349 - DNA, 2765 bp, Homo sapiens
agctcactggggcttccttccgtctcgctcggagtttccctctgcgttcgctccgcgctgctggaggctgtcgtcccaatgctccccaaacggcggcgagcgcgggtcgggtcccctagcggcgatgccgcttcctccacgccgccctcgacgcgcttcccgggagtcgccatctacctggtcgagcctcgcatgggtcgcagccgccgggccttcctcacaggcctggcgcgctccaaaggcttccgcgtccttgacgcctgcagctccgaagcgacacatgttgtgatggaagagacctcagcagaggaggccgtcagctggcaggagcgcaggatggcagctgctcccccgggttgcacccccccagctctgctggacataagctggttaacagagagcctgggagctgggcagcctgtacctgtggagtgccggcaccgcctggaggtggctgggccaaggaaggggcctctgagcccagcatggatgcctgcctatgcctgccagcgccctacgcccctcacacaccacaacactggcctctccgaggctctggagatactggccgaggcagcaggctttgaaggcagtgagggccgcctcctcaccttctgcagagcagcctcggtgctcaaggcccttcccagccctgtcacaaccctgagccagctgcaggggcttccccactttggagaacactcctctagggttgtccaggagctgctggagcatggagtgtgtgaggaggtggagagagttcggcgctcagagaggtaccagaccatgaagctcttcacccagatcttcggggtcggtgtgaagactgctgaccggtggtaccgggaaggactgcgaaccttagatgacctccgagagcagccccagaaactaacccaacagcagaaagcggggctccagcaccaccaggacctgagcaccccagtcctgcggtccgatgtagatgccctgcagcaggtggtggaggaagctgtggggcaggccctgcctggggccaccgtcacgctgaccggcggcttccgcaggtaagaaggcccgacgtgcccctctggcttggcttcagacccctccccagtgaagggacctgagtcggggaccctgaagcgggcccactcgttggaagggatgtggcctggggctggagtgagcaggccgtgtccctgagtcagagtcagactgacgccctcagggggaagttgcagggccatgacgtggacttcctcatcacccaccccaaggagggtcaggaggcggggctgctgcctagagtgatgtgccgcctgcaggaccagggcctcatcctgtaccaccagcaccagcacagctgctgtgagtcccctacccgcctggcccaacagagccacatggacgcttttgagagaagtttctgcattttccgcctaccacaacctccaggggctgctgtggggggatccacgaggccctgcccatcctggaaggccgtgagagtggacttggtagttgcacccgtcagccagttccctttcgccctgctcggttggactggctccaagcttttccagcgggagctgcgccgcttcagccggaaggagaagggcctgtggctgaacagccatgggctgtttgacccggagcagaagacatttttccaagcggcttcagaggaagacatcttcagacacctgggccttgagtaccttcctccagagcagagaaacgcctgagcctgcctgtgtcccccacttccactcaggaaattgggctgcccccaacctggccactgaatgtctccaggcagatatgctgccccctgacccccaccttcacccctccccgccaaggcctggctcttccggaggtcaattgtgcctgcaggatcagttgagcccctgctggtgtgctgcagggtgtgatgaggtgggagccctcagtgccagcctcatcactgtgtgaccctgggtctgctcttagcctccccatggctcacgttcctgccctggatgggatgtgagtggggcccacatcgtggagctgtggtggggcctgcagtcatgaatggcaagtggtccctgatgtgcagtgtctcattagttgcactgcagttaactgtggctcctgcagggcaccctgcccagaatgcccagaagagaaccatgcatacctgcactgcatttgagagccatgagctggaggctgtggttcgtgccagcaaggagcctactgtctggtgtgctgtaggcatctggagagggagagggcctgggtaggagctgggaggaagataattttcaactatggggcttcagtactgcagcgccccgagccaggctctgtgcttctgcctttaaggcctgttctcagcacaatgtctcaaaaataggtcatatcctgccactcccgtcgcagagccctttaatggttccaaaccctaagtccacacatagcccctggctctggcatctctccagccccactggccccgagctgcttgactcaccggcttcctatttgatgcacccaggcccccttgtggccaactccctccccttctcactgaggcagaagcactgaggtgggctggacatgggtgccctccacgtccctcatatccccaggcacactctggcctcaggttttgccctggccatgtcatctacctggagtgggccctccccttcttcaggccttgaatcaaaagccactttgttaggcgaggatttcccagaccactcatcacattaaaaaatattttgaaaacatgc

SEQ ID NO: 87350 - DNA, 2818 bp, Homo sapiens
agctcactggggcttccttccgtctcgctcggagtttccctctgcgttcgctccgcgctgctggaggctgtcgtcccaatgctccccaaacggcggcgagcgcgggtcgggtcccctagcggcgatgccgcttcctccacgccgccctcgacgcgcttcccgggagtcgccatctacctggtcgagcctcgcatgggtcgcagccgccgggccttcctcacaggcctggcgcgctccaaaggcttccgcgtccttgacgcctgcagctccgaagcgacacatgttgtgatggaagagacctcagcagaggaggccgtcagctggcaggagcgcaggatggcagctgctcccccgggttgcacccccccagctctgctggacataagctggttaacagagagcctgggagctgggcagcctgtacctgtggagtgccggcaccgcctggaggtggctgggccaaggaaggggcctctgagcccagcatggatgcctgcctatgcctgccagcgccctacgcccctcacacaccacaacactggcctctccgaggctctggagatactggccgaggcagcaggctttgaaggcagtgagggccgcctcctcaccttctgcagagcagcctcggtgctcaaggcccttcccagccctgtcacaaccctgagccagctgcaggggcttccccactttggagaacactcctctagggttgtccaggagctgctggagcatggagtgtgtgaggaggtggagagagttcggcgctcagagaggtaccagaccatgaagctcttcacccagatcttcggggtcggtgtgaagactgctgaccggtggtaccgggaaggactgcgaaccttagatgacctccgagagcagccccagaaactaacccaacagcagaaagcggggctccagcaccaccaggacctgagcaccccagtcctgcggtccgatgtagatgccctgcagcaggtggtggaggaagctgtggggcaggccctgcctggggccaccgtcacgctgaccggcggcttccgcaggtaagaaggcccgacgtgcccctctggcttggcttcagacccctccccagtgaagggacctgagtcggggaccctgaagcgggcccactcgttggaagggatgtggcctggggctggagtgagcaggccgtgtccctgagtcagagtcagactgacgccctcagggggaagttgcagggccatgacgtggacttcctcatcacccaccccaaggagggtcaggaggcggggctgctgcctagagtgatgtgccgcctgcaggaccagggcctcatcctgtaccaccagcaccagcacagctgctgtgagtcccctacccgcctggcccaacagagccacatggacgcttttgagagaagtttctgcattttccgcctaccacaacctccaggggctgctgtggggggatccacgaggccctgcccatcctggaaggccgtgagagtggacttggtagttgcacccgtcagccagttccctttcgccctgctcggttggactggctccaagcttttccagcgggagctgcgccgcttcagccggaaggagaagggcctgtggctgaacagccatgggctgtttgacccggagcagggaagcagcagtggcaagactcctaggtcacggaagtcctgcttctgttgcagaagacatttttccaagcggcttcagaggaagacatcttcagacacctgggccttgagtaccttcctccagagcagagaaacgcctgagcctgcctgtgtcccccacttccactcaggaaattgggctgcccccaacctggccactgaatgtctccaggcagatatgctgccccctgacccccaccttcacccctccccgccaaggcctggctcttccggaggtcaattgtgcctgcaggatcagttgagcccctgctggtgtgctgcagggtgtgatgaggtgggagccctcagtgccagcctcatcactgtgtgaccctgggtctgctcttagcctccccatggctcacgttcctgccctggatgggatgtgagtggggcccacatcgtggagctgtggtggggcctgcagtcatgaatggcaagtggtccctgatgtgcagtgtctcattagttgcactgcagttaactgtggctcctgcagggcaccctgcccagaatgcccagaagagaaccatgcatacctgcactgcatttgagagccatgagctggaggctgtggttcgtgccagcaaggagcctactgtctggtgtgctgtaggcatctggagagggagagggcctgggtaggagctgggaggaagataattttcaactatggggcttcagtactgcagcgccccgagccaggctctgtgcttctgcctttaaggcctgttctcagcacaatgtctcaaaaataggtcatatcctgccactcccgtcgcagagccctttaatggttccaaaccctaagtccacacatagcccctggctctggcatctctccagccccactggccccgagctgcttgactcaccggcttcctatttgatgcacccaggcccccttgtggccaactccctccccttctcactgaggcagaagcactgaggtgggctggacatgggtgccctccacgtccctcatatccccaggcacactctggcctcaggttttgccctggccatgtcatctacctggagtgggccctccccttcttcaggccttgaatcaaaagccactttgttaggcgaggatttcccagaccactcatcacattaaaaaatattttgaaaacatgc

SEQ ID NO: 87351 - DNA, 2872 bp, Homo sapiens
agctcactggggcttccttccgtctcgctcggagtttccctctgcgttcgctccgcgctgctggaggctgtcgtcccaatgctccccaaacggcggcgagcgcgggtcgggtcccctagcggcgatgccgcttcctccacgccgccctcgacgcgcttcccgggagtcgccatctacctggtcgagcctcgcatgggtcgcagccgccgggccttcctcacaggcctggcgcgctccaaaggcttccgcgtccttgacgcctgcagctccgaagcgacacatgttgtgatggaagagacctcagcagaggaggccgtcagctggcaggagcgcaggatggcagctgctcccccgggttgcacccccccagctctgctggacataagctggttaacagagagcctgggagctgggcagcctgtacctgtggagtgccggcaccgcctggaggcctttcttcctcaccaagtagatgacacagcaactccgagcgggatgacccatgggttagcaggagcctgtcctctggatgctataaggctcccggcctctgacaggtggctgggccaaggaaggggcctctgagcccagcatggatgcctgcctatgcctgccagcgccctacgcccctcacacaccacaacactggcctctccgaggctctggagatactggccgaggcagcaggctttgaaggcagtgagggccgcctcctcaccttctgcagagcagcctcggtgctcaaggcccttcccagccctgtcacaaccctgagccagctgcaggggcttccccactttggagaacactcctctagggttgtccaggagctgctggagcatggagtgtgtgaggaggtggagagagttcggcgctcagagaggtaccagaccatgaagctcttcacccagatcttcggggtcggtgtgaagactgctgaccggtggtaccgggaaggactgcgaaccttagatgacctccgagagcagccccagaaactaacccaacagcagaaagcggggctccagcaccaccaggacctgagcaccccagtcctgcggtccgatgtagatgccctgcagcaggtggtggaggaagctgtggggcaggccctgcctggggccaccgtcacgctgaccggcggcttccgcaggtaagaaggcccgacgtgcccctctggcttggcttcagacccctccccagtgaagggacctgagtcggggaccctgaagcgggcccactcgttggaagggatgtggcctggggctggagtgagcaggccgtgtccctgagtcagagtcagactgacgccctcagggggaagttgcagggccatgacgtggacttcctcatcacccaccccaaggagggtcaggaggcggggctgctgcctagagtgatgtgccgcctgcaggaccagggcctcatcctgtaccaccagcaccagcacagctgctgtgagtcccctacccgcctggcccaacagagccacatggacgcttttgagagaagtttctgcattttccgcctaccacaacctccaggggctgctgtggggggatccacgaggccctgcccatcctggaaggccgtgagagtggacttggtagttgcacccgtcagccagttccctttcgccctgctcggttggactggctccaagcttttccagcgggagctgcgccgcttcagccggaaggagaagggcctgtggctgaacagccatgggctgtttgacccggagcagaagacatttttccaagcggcttcagaggaagacatcttcagacacctgggccttgagtaccttcctccagagcagagaaacgcctgagcctgcctgtgtcccccacttccactcaggaaattgggctgcccccaacctggccactgaatgtctccaggcagatatgctgccccctgacccccaccttcacccctccccgccaaggcctggctcttccggaggtcaattgtgcctgcaggatcagttgagcccctgctggtgtgctgcagggtgtgatgaggtgggagccctcagtgccagcctcatcactgtgtgaccctgggtctgctcttagcctccccatggctcacgttcctgccctggatgggatgtgagtggggcccacatcgtggagctgtggtggggcctgcagtcatgaatggcaagtggtccctgatgtgcagtgtctcattagttgcactgcagttaactgtggctcctgcagggcaccctgcccagaatgcccagaagagaaccatgcatacctgcactgcatttgagagccatgagctggaggctgtggttcgtgccagcaaggagcctactgtctggtgtgctgtaggcatctggagagggagagggcctgggtaggagctgggaggaagataattttcaactatggggcttcagtactgcagcgccccgagccaggctctgtgcttctgcctttaaggcctgttctcagcacaatgtctcaaaaataggtcatatcctgccactcccgtcgcagagccctttaatggttccaaaccctaagtccacacatagcccctggctctggcatctctccagccccactggccccgagctgcttgactcaccggcttcctatttgatgcacccaggcccccttgtggccaactccctccccttctcactgaggcagaagcactgaggtgggctggacatgggtgccctccacgtccctcatatccccaggcacactctggcctcaggttttgccctggccatgtcatctacctggagtgggccctccccttcttcaggccttgaatcaaaagccactttgttaggcgaggatttcccagaccactcatcacattaaaaaatattttgaaaacatgc

SEQ ID NO: 87352 - DNA, 1756 bp, Homo sapiens
aggctggtacggtccgaagtgttatatgcctagagtgatgtgccgcctgcaggaccaggcctcatcctgtaccaccagcaccagcacagctgctgtgagtcccctacccgcctggcccaacagagccacatggacgcttttgagagaagtttctgcattttccgcctaccacaacctccaggggctgctgtggggggatccacgaggccctgcccatcctggaaggccgtgagagtggacttggtagttgcacccgtcagccagttccctttcgccctgctcggttggactggctccaagcttttccagcgggagctgcgccgcttcagccggaaggagaagggcctgtggctgaacagccatgggctgtttgacccggagcaggtacattgttggggactggggacagcaaacagcacccatagtccgctccctgacccacaatctgaaatggccccagacccctccagcctgaaacccataggacccgaatctgggtctccacacacagttcctggccctcaagagcacaccccacctcggcgctgggctcttccccaccctcagtcttcctgcagggaagcagcagtggcaagactcctaggtcacggaagtcctgcttctgttgcagaagacatttttccaagcggcttcagaggaagacatcttcagacacctgggccttgagtaccttcctccagagcagagaaacgcctgagcctgcctgtgtcccccacttccactcaggaaattgggctgcccccaacctggccactgaatgtctccaggcagatatgctgccccctgacccccaccttcacccctccccgccaaggcctggctcttccggaggtcaattgtgcctgcaggatcagttgagcccctgctggtgtgctgcagggtgtgatgaggtgggagccctcagtgccagcctcatcactgtgtgaccctgggtctgctcttagcctccccatggctcacgttcctgccctggatgggatgtgagtggggcccacatcgtggagctgtggtggggcctgcagtcatgaatggcaagtggtccctgatgtgcagtgtctcattagttgcactgcagttaactgtggctcctgcagggcaccctgcccagaatgcccagaagagaaccatgcatacctgcactgcatttgagagccatgagctggaggctgtggttcgtgccagcaaggagcctactgtctggtgtgctgtaggcatctggagagggagagggcctgggtaggagctgggaggaagataattttcaactatggggcttcagtactgcagcgccccgagccaggctctgtgcttctgcctttaaggcctgttctcagcacaatgtctcaaaaataggtcatatcctgccactcccgtcgcagagccctttaatggttccaaaccctaagtccacacatagcccctggctctggcatctctccagccccactggccccgagctgcttgactcaccggcttcctatttgatgcacccaggcccccttgtggccaactccctccccttctcactgaggcagaagcactgaggtgggctggacatgggtgccctccacgtccctcatatccccaggcacactctggcctcaggttttgccctggccatgtcatctacctggagtgggccctccccttcttcaggccttgaatcaaaagccactttgttaggcgaggatttcccagaccactcatcacattaaaaaatattttgaaaacatgc

SEQ ID NO: 87353 - DNA, 1763 bp, Homo sapiens
gccactgcctcctgctctctccacaccaccggatggtctcagccacgcccgcctctccccacagggcctcatcctgtaccaccagcaccagcacagctgctgtgagtcccctacccgcctggcccaacagagccacatggacgcttttgagagaagtttctgcattttccgcctaccacaacctccaggggctgctgtggggggatccacgaggccctgcccatcctggaaggccgtgagagtggacttggtagttgcacccgtcagccagttccctttcgccctgctcggttggactggctccaagcttttccagcgggagctgcgccgcttcagccggaaggagaagggcctgtggctgaacagccatgggctgtttgacccggagcaggtacattgttggggactggggacagcaaacagcacccatagtccgctccctgacccacaatctgaaatggccccagacccctccagcctgaaacccataggacccgaatctgggtctccacacacagttcctggccctcaagagcacaccccacctcggcgctgggctcttccccaccctcagtcttcctgcagggaagcagcagtggcaagactcctaggtcacggaagtcctgcttctgttgcagaagacatttttccaagcggcttcagaggaagacatcttcagacacctgggccttgagtaccttcctccagagcagagaaacgcctgagcctgcctgtgtcccccacttccactcaggaaattgggctgcccccaacctggccactgaatgtctccaggcagatatgctgccccctgacccccaccttcacccctccccgccaaggcctggctcttccggaggtcaattgtgcctgcaggatcagttgagcccctgctggtgtgctgcagggtgtgatgaggtgggagccctcagtgccagcctcatcactgtgtgaccctgggtctgctcttagcctccccatggctcacgttcctgccctggatgggatgtgagtggggcccacatcgtggagctgtggtggggcctgcagtcatgaatggcaagtggtccctgatgtgcagtgtctcattagttgcactgcagttaactgtggctcctgcagggcaccctgcccagaatgcccagaagagaaccatgcatacctgcactgcatttgagagccatgagctggaggctgtggttcgtgccagcaaggagcctactgtctggtgtgctgtaggcatctggagagggagagggcctgggtaggagctgggaggaagataattttcaactatggggcttcagtactgcagcgccccgagccaggctctgtgcttctgcctttaaggcctgttctcagcacaatgtctcaaaaataggtcatatcctgccactcccgtcgcagagccctttaatggttccaaaccctaagtccacacatagcccctggctctggcatctctccagccccactggccccgagctgcttgactcaccggcttcctatttgatgcacccaggcccccttgtggccaactccctccccttctcactgaggcagaagcactgaggtgggctggacatgggtgccctccacgtccctcatatccccaggcacactctggcctcaggttttgccctggccatgtcatctacctggagtgggccctccccttcttcaggccttgaatcaaaagccactttgttaggcgaggatttcccagaccactcatcacattaaaaaatattttgaaaacatgc

SEQ ID NO: 87354 - DNA, 740 bp, Homo sapiens
tgcatgttttcaaaatatttttgaatgtcatgaatggcaagtggtccctgatgtgcagtgtctcattagttgcactgcagttaactgtggctcctgcagggcaccctgcccagaatgcccagaagagaaccatgcatacctgcactgcatttgagagccatgagctggaggctgtggttcgtgccagcaaggagcctactgtctggtgtgctgtaggcatctggagagggagagggcctgggtaggagctgggaggaagataattttcaactatggggcttcagtactgcagcgccccgagccaggctctgtgcttctgcctttaaggcctgttctcagcacaatgtctcaaaaataggtcatatcctgccactcccgtcgcagagccctttaatggttccaaaccctaagtccacacatagcccctggctctggcatctctccagccccactggccccgagctgcttgactcaccggcttcctatttgatgcacccaggcccccttgtggccaactccctccccttctcactgaggcagaagcactgaggtgggctggacatgggtgccctccacgtccctcatatccccaggcacactctggcctcaggttttgccctggccatgtcatctacctggagtgggccctccccttcttcaggccttgaatcaaaagccactttgttaggcgaggatttcccagaccactcatcacattaaaaaatattttgaaaacatgc

SEQ ID NO: 87355 - DNA, 1733 bp, Homo sapiens
  misc_feature (1681)..(1681): n is a, c, g, or t
  misc_feature (1689)..(1689): n is a, c, g, or t
agctcactggggcttccttccgtctcgctcggagtttccctctgcgttcgctccgcgctgctggaggctgtcgtcccaatgctccccaaacggcggcgagcgcgggtcgggtcccctagcggcgatgccgcttcctccacgccgccctcgacgcgcttcccgggagtcgccatctacctggtcgagcctcgcatgggtcgcagccgccgggccttcctcacaggcctggcgcgctccaaaggcttccgcgtccttgacgcctgcagctccgaagcgacacatgttgtgatggaagagacctcagcagaggaggccgtcagctggcaggagcgcaggatggcagctgctcccccgggttgcacccccccagctctgctggacataagctggttaacagagagcctgggagctgggcagcctgtacctgtggagtgccggcaccgcctggaggtggctgggccaaggaaggggcctctgagcccagcatggatgcctgcctatgcctgccagcgccctacgcccctcacacaccacaacactggcctctccgaggctctggagatactggccgaggcagcaggctttgaaggcagtgagggccgcctcctcaccttctgcagagcagcctcggtgctcaaggcccttcccagccctgtcacaaccctgagccagctgcaggggcttccccactttggagaacactcctctagggttgtccaggagctgctggagcatggagtgtgtgaggaggtggagagagttcggcgctcagagaggtaccagaccatgaagctcttcacccagatcttcggggtcggtgtgaagactgctgaccggtggtaccgggaaggactgcgaaccttagatgacctccgagagcagccccagaaactaacccaacagcagaaagcggggctccagcaccaccaggacctgagcaccccagtcctgcggtccgatgtagatgccctgcagcaggtggtggaggaagctgtggggcaggccctgcctggggccaccgtcacgctgaccggcggcttccgcaggtaagaaggcccgacgtgcccctctggcttggcttcagacccctccccagtgaagggacctgagtcggggaccctgaagcgggcccactcgttggaagggatgtggcctggggctggagtgagcaggccgtgtccctgagtcagagtcagactgacgccctcagggggaagttgcagggccatgacgtggacttcctcatcacccaccccaaggagggtcaggaggcggggctgctgcctagagtgatgtgccgcctgcaggaccagggcctcatcctgtaccaccagcaccagcacagctgctgtgagtcccctacccgcctggcccaacagagccacatggacgcttttgagagaagtttctgcattttccgcctaccacaacctccaggggctgctgtggggggatccacgaggccctgcccatcctggaaggccgtgagagtggacttggtagttgcacccgtcagccagttccctttcgccctgctcggttggactggctccaagcttttccagcgggagctgcgccgcttcagccggaaggagaagggcctgtggctgaacagccatgggctgtttgacccggagcagaagacagtgttgcaagcgggttcagaggaggacatcttganacaccggnggcgtggagacggtgctgcagagcgtaggcgcgtgcgtggctgg

SEQ ID NO: 87356 - DNA, 710 bp, Homo sapiens
ccatcttccatccttttaccacctcttggtcccactttatgcataaggaaaaacagccatcaaaagagatagcctgtggcatgactgtatcaacatcagtatccttatatttggttgcaaaattatagttttgtaaggggttaaccttttgggggagctgggtaaaaggcacatgggatctccctctgtgctatttcttttaactgcgagtgaatctacaactgtctcaaaataaaagtttaaaatttaaagggggagagaagatagtgtcaggcttagattgggatctcactctgctccctgccctagcctcaccttcctcggaggcctctcctggtcctgcaatgacggggccccaggttgatcacctcatgctggtgagggatgggggctcggtgtggtgggcaggctgggtgagtcaggagggccggtgttgccccagggctccagcaccaccaggacctgagcaccccagtcctgcggtccgatgtagatgccctgcagcaggtggtggaggaagctgtggggcaggccctgcctggggccaccgtcacgctgaccggcggcttccgcaggtaagaaggcccgacgtgcccctctggcttggcttcagacccctccccagtgaagggacctgagtcggggaccctgaagcgggcccactcgttggaagggatgtggcctggggctggagtgagcaggccgtgtcc

SEQ ID NO: 87357 - DNA, 2601 bp, Homo sapiens
agctcactggggcttccttccgtctcgctcggagtttccctctgcgttcgctccgcgctgctggaggctgtcgtcccaatgctccccaaacggcggcgagcgcgggtcgggtcccctagcggcgatgccgcttcctccacgccgccctcgacgcgcttcccgggagtcgccatctacctggtcgagcctcgcatgggtcgcagccgccgggccttcctcacaggcctggcgcgctccaaaggcttccgcgtccttgacgcctgcagctccgaagcgacacatgttgtgatggaagagacctcagcagaggaggccgtcagctggcaggagcgcaggatggcagctgctcccccgggttgcacccccccagctctgctggacataagctggttaacagagagcctgggagctgggcagcctgtacctgtggagtgccggcaccgcctggaggtggctgggccaaggaaggggcctctgagcccagcatggatgcctgcctatgcctgccagcgccctacgcccctcacacaccacaacactggcctctccgaggctctggagatactggccgaggcagcaggctttgaaggcagtgagggccgcctcctcaccttctgcagagcagcctcggtgctcaaggcccttcccagccctgtcacaaccctgagccagctgcaggggcttccccactttggagaacactcctctagggttgtccaggagctgctggagcatggagtgtgtgaggaggtggagagagttcggcgctcagagaggtaccagaccatgaagctcttcacccagatcttcggggtcggtgtgaagactgctgaccggtggtaccgggaaggactgcgaaccttagatgacctccgagagcagccccagaaactaacccaacagcagaaagcggggctccagcaccaccaggacctgagcaccccagtcctgcggtccgatgtagatgccctgcagcaggtggtggaggaagctgtggggcaggccctgcctggggccaccgtcacgctgaccggcggcttccgcagggggaagttgcagggccatgacgtggacttcctcatcacccaccccaaggagggtcaggaggcggggctgctgcctagagtgatgtgccgcctgcaggaccagggcctcatcctgtaccaccagcaccagcacagctgctgtgagtcccctacccgcctggcccaacagagccacatggacgcttttgagagaagtttctgcattttccgcctaccacaacctccaggggctgctgtggggggatccacgaggccctgcccatcctggaaggccgtgagagtggacttggtagttgcacccgtcagccagttccctttcgccctgctcggttggactggctccaagcttttccagcgggagctgcgccgcttcagccggaaggagaagggcctgtggctgaacagccatgggctgtttgacccggagcagaagacatttttccaagcggcttcagaggaagacatcttcagacacctgggccttgagtaccttcctccagagcagagaaacgcctgagcctgcctgtgtcccccacttccactcaggaaattgggctgcccccaacctggccactgaatgtctccaggcagatatgctgccccctgacccccaccttcacccctccccgccaaggcctggctcttccggaggtcaattgtgcctgcaggatcagttgagcccctgctggtgtgctgcagggtgtgatgaggtgggagccctcagtgccagcctcatcactgtgtgaccctgggtctgctcttagcctccccatggctcacgttcctgccctggatgggatgtgagtggggcccacatcgtggagctgtggtggggcctgcagtcatgaatggcaagtggtccctgatgtgcagtgtctcattagttgcactgcagttaactgtggctcctgcagggcaccctgcccagaatgcccagaagagaaccatgcatacctgcactgcatttgagagccatgagctggaggctgtggttcgtgccagcaaggagcctactgtctggtgtgctgtaggcatctggagagggagagggcctgggtaggagctgggaggaagataattttcaactatggggcttcagtactgcagcgccccgagccaggctctgtgcttctgcctttaaggcctgttctcagcacaatgtctcaaaaataggtcatatcctgccactcccgtcgcagagccctttaatggttccaaaccctaagtccacacatagcccctggctctggcatctctccagccccactggccccgagctgcttgactcaccggcttcctatttgatgcacccaggcccccttgtggccaactccctccccttctcactgaggcagaagcactgaggtgggctggacatgggtgccctccacgtccctcatatccccaggcacactctggcctcaggttttgccctggccatgtcatctacctggagtgggccctccccttcttcaggccttgaatcaaaagccactttgttaggcgaggatttcccagaccactcatcacattaaaaaatattttgaaaacatgc

SEQ ID NO: 87358 - DNA, 3055 bp, Homo sapiens
agctcactggggcttccttccgtctcgctcggagtttccctctgcgttcgctccgcgctgctggaggctgtcgtcccaatgctccccaaacggcggcgagcgcgggtcgggtcccctagcggcgatgccgcttcctccacgccgccctcgacgcgcttcccgggagtcgccatctacctggtcgagcctcgcatgggtcgcagccgccgggccttcctcacaggcctggcgcgctccaaaggcttccgcgtccttgacgcctgcagctccgaagcgacacatgttgtgatggaagagacctcagcagaggaggccgtcagctggcaggagcgcaggatggcagctgctcccccgggttgcacccccccagctctgctggacataagctggttaacagagagcctgggagctgggcagcctgtacctgtggagtgccggcaccgcctggaggtggctgggccaaggaaggggcctctgagcccagcatggatgcctgcctatgcctgccagcgccctacgcccctcacacaccacaacactggcctctccgaggctctggagatactggccgaggcagcaggctttgaaggcagtgagggccgcctcctcaccttctgcagagcagcctcggtgctcaaggcccttcccagccctgtcacaaccctgagccagctgcaggggcttccccactttggagaacactcctctagggttgtccaggagctgctggagcatggagtgtgtgaggaggtggagagagttcggcgctcagagaggtaccagaccatgaagctcttcacccagatcttcggggtcggtgtgaagactgctgaccggtggtaccgggaaggactgcgaaccttagatgacctccgagagcagccccagaaactaacccaacagcagaaagcggggctccagcaccaccaggacctgagcaccccagtcctgcggtccgatgtagatgccctgcagcaggtggtggaggaagctgtggggcaggccctgcctggggccaccgtcacgctgaccggcggcttccgcaggtaagaaggcccgacgtgcccctctggcttggcttcagacccctccccagtgaagggacctgagtcggggaccctgaagcgggcccactcgttggaagggatgtggcctggggctggagtgagcaggccgtgtccctgagtcagagtcagactgacgccctcagggggaagttgcagggccatgacgtggacttcctcatcacccaccccaaggagggtcaggaggcggggctgctgcctagagtgatgtgccgcctgcaggaccagggcctcatcctgtaccaccagcaccagcacagctgctgtgagtcccctacccgcctggcccaacagagccacatggacgcttttgagagaagtttctgcattttccgcctaccacaacctccaggggctgctgtggggggatccacgaggccctgcccatcctggaaggccgtgagagtggacttggtagttgcacccgtcagccagttccctttcgccctgctcggttggactggctccaagcttttccagcgggagctgcgccgcttcagccggaaggagaagggcctgtggctgaacagccatgggctgtttgacccggagcagaagacatttttccaagcggcttcagaggaagacatcttcagacacctgggccttgagtaccttcctccagagcagagaaacgcctgagcctgcctgtgtcccccacttccactcaggaaattgggctgcccccaacctggccactgaatgtctccaggcagatatgctgccccctgacccccaccttcacccctccccgccaaggcctggctcttccggaggtcaattgtgcctgcaggatcagttgagcccctgctggtgtgctgcagggtgtgatgaggtgggagccctcagtgccagcctcatcactgtgtgaccctgggtctgctcttagcctccccatggctcacgttcctgccctggatgggatgtgagtggggcccacatcgtggagctgtggtggggcctgcagtcatgaatggcaagtggtccctgatgtgcagtgtctcattagttgcactgcagttaactgtggctcctgcagggcaccctgcccagaatgcccagaagagaaccatgcatacctgcactgcatttgagagccatgagctggaggctgtggttcgtgccagcaaggagcctactgtctggtgtgctgtaggcatctggagagggagagggcctgggtaggagctgggaggaagataattttcaactatggggcttcagtactgcagcgccccgagccaggctctgtgcttctgcctttaaggcctgttctcagcacaatgtctcaaaaataggtcatatcctgccactcccgtcgcagagccctttaatggttccaaaccctaagtccacacatagcccctggctctggcatctctccagccccactggccccgagctgcttgactcaccggcttcctatttgatgcacccaggcccccttgtggccaactccctccccttctcactgaggcagaagcactgaggtgggctggacatgggtgccctccacgtccctcatatccccaggcacactctggcctcaggttttgccctggccatgtcatctacctggagtgggccctccccttcttcaggccttgaatcaaaagccactttgttaggcgaggatttcccagaccactcatcacattaaaaaatattttgaaaacatgcagtaaagttgactcttggggtgcagtttttgcacacgtagggcacaccaggtccatccccagaacacttcccatgctgtcctattgtggtcatgtgcttctccacccccacccacttagcggtgctacatccctatagttttgctttctctagaatgtcatgtaaatagaaccaaactatatttaacctttggactggcctctccccacagcctaatgcctttgacgttcctgcaggttgctgggtatgttgagtttgtaatttgttccatgccatgggtgttctacagt

SEQ ID NO: 87359 - DNA, 2007 bp, Homo sapiens
agctcactggggcttccttccgtctcgctcggagtttccctctgcgttcgctccgcgctgctggaggctgtcgtcccaatgctccccaaacggcggcgagcgcgggtcgggtcccctagcggcgatgccgcttcctccacgccgccctcgacgcgcttcccgggagtcgccatctacctggtcgagcctcgcatgggtcgcagccgccgggccttcctcacaggcctggcgcgctccaaaggcttccgcgtccttgacgcctgcagctccgaagcgacacatgttgtgatggaagagacctcagcagaggaggccgtcagctggcaggagcgcaggatggcagctgctcccccgggttgcacccccccagctctgctggacataagctggttaacagagagcctgggagctgggcagcctgtacctgtggagtgccggcaccgcctggaggtggctgggccaaggaaggggcctctgagcccagcatggatgcctgcctatgcctgccagcgccctacgcccctcacacaccacaacactggcctctccgaggctctggagatactggccgaggcagcaggctttgaaggcagtgagggccgcctcctcaccttctgcagagcagcctcggtgctcaaggcccttcccagccctgtcacaaccctgagccagctgcaggggcttccccactttggagaacactcctctagggttgtccaggagctgctggagcatggagtgtgtgaggaggtggagagagttcggcgctcagagaggtaccagaccatgaagctcttcacccagatcttcggggtcggtgtgaagactgctgaccggtggtaccgggaaggactgcgaaccttagatgacctccgagagcagccccagaaactaacccaacagcagaaagcggggctccagcaccaccaggacctgagcaccccagtcctgcggtccgatgtagatgccctgcagcaggtggtggaggaagctgtggggcaggccctgcctggggccaccgtcacgctgaccggcggcttccgcaggtaagaaggcccgacgtgcccctctggcttggcttcagacccctccccagtgaagggacctgagtcggggaccctgaagcgggcccactcgttggaagggatgtggcctggggctggagtgagcaggccgtgtccctgagtcagagtcagactgacgccctcagggggaagttgcagggccatgacgtggacttcctcatcacccaccccaaggagggtcaggaggcggggctgctgcctagagtgatgtgccgcctgcaggaccagggcctcatcctgtaccaccagcaccagcacagctgctgtgagtcccctacccgcctggcccaacagagccacatggacgcttttgagagaagtttctgcattttccgcctaccacaacctccaggggctgctgtggggggatccacgaggccctgcccatcctggaaggccgtgagagtggacttggtagttgcacccgtcagccagttccctttcgccctgctcggttggactggctccaagcttttccagcgggagctgcgccgcttcagccggaaggagaagggcctgtggctgaacagccatgggctgtttgacccggagcagaagacatttttccaagcggcttcagaggaagacatcttcagacacctgggccttgagtaccttcctccagagcagagaaacgcctgagcctgcctgtgtcccccacttccactcaggaaattgggctgcccccaacctggccactgaatgtctccaggcagatatgctgcccctgaggtgggctggacatgggtgccctccacgtccctcatatccccaggcacactctggcctcaggttttgccctggccatgtcatctacctggagtgggccctccccttcttcaggccttgaatcaaaagccactttgttaggcgaggatttcccagaccactcatcacattaaaaaatattttgaaaacatgc

SEQ ID NO: 87360 - DNA, 383 bp, Homo sapiens
aaaccagttctttagatttatattgcttggcttaatactgaatacccagggttaaatgttcttgcatgcaattagagattgtccataagatgtcggaagcggcatctgaggcactctgcttctttatcgagtatttaaactaagcttggcaaaaccaggttaactgacaaatggtatagaaacaggaaagtactttcaaaactacaaaacaccaagcaacattattaacattatgatcgttgcattagccagtcttccacttactagaggaatataagtccatttttacatggctaaaagtagacttctttagtgaatgtacttacatatagaaaatccaaaagaactatctgtatcagacactatctgatagaagatttatc

SEQ ID NO: 87361 - DNA, 371 bp, Homo sapiens
ctgaaagacagatattgtaggagaataccattcctaacaatgtggtccaaaccaagttttaaataaaaagtccccaagtgcctgaggaatacctaaaatattccctataaattattattaggcaaaagaggaaaatcggtgtaaaataatttagaaaacaaaaggaatgctaattttctaattttatagacgggaacttaagctatactcagaagcaaacatattagaaagagtgaaagagagagaagtgagatgaggaagggaggtgtactagtccgttttcacgcaactgataaaaacatatctgagtgggcaatttacaaaagaaagagatttaataagcttagagttccatatggctgggaaggctt

SEQ ID NO: 87362 - DNA, 502 bp, Homo sapiens
agagtttattttaaacattgaacattgtttgctgctgttgaaatgaaagtgagagagttacaagctttcttccactgccatctggcaggtttactgatggatcgggttctttaacccatgtaacccctgtgtgtgggagcctattgtcctttgtgttgatcatgcagcctggcttggcctgaactttaaaaagccttacataaagcctatcaaaagcccatcctatagataaatgaagttgaggatgttgcaaaagtcactgaggcctttttggagaaggcttggatatatatttttcattcttcactgaacacatattttgcatgttctctttatgaactggaaaagaggaagataactgtatttggatattttgaaagaaataactgaagctaccaaaaaaaatgattattcttaattaagaaaagtattgtagcatagtagaaaggaaagaaacagcagattagggcgtccatatttcattaaagtaaatgtgggatgt

SEQ ID NO: 87363 - DNA, 609 bp, Homo sapiens
agcatcatgtcctggtgtcagcttctcatctcccatctctccttaacccactcctgtttgtcccttgctgctgtcactctcctgagactcctcttgccaaggtccccagagtcttcacacttacaagccagagctcttcatcccactgctccactccccaagtcttccctaatattgtacagggcatttccattcacctagttgctgagaccaaatacctacattcaagttatcccacaccagactgtgcacaattcctgctatgtccaccttcattggtaggctgctcgcttttgattctgagctgccatttgtcactgctcacctgtatcaccctcgttgcttcttaactctcttctctgcctctattctgccaattatggcctactctcttcaagccatcagcataacttcttaagagcacttcactcccctgctcaaaatctacctaaagtacccatcaaactggaataaaaacttcttcctggccaggcgcagtggctcacacttgtaatcccagtacttcgggatgccgaagtaggcggatcacctgaggtcgggagttcaagactagcctgaccaacatggcgaagcccggtctctacttaa

SEQ ID NO: 87364 - DNA, 752 bp, Homo sapiens
  misc_feature (34)..(34): n is a, c, g, or t
atgccaaacgcgggctgtactgccctgggagtanggacaccagcctctcggttctttgcatggtttctttgtgcgtagcgccagcctctcggttgtttgcccggtgtttctttggccatagcacctgcctcttggttgtttgcacggtgtttctttgtgcatagtacccgcctctctgcttgcacggtgtttctttgtgcgcagcacgcgcctctctgcttacacggtgtttctttgtgcacagcaccagcctctcggttgtttgcccggtgtttctttggccatagcacctgcctctcggttgtttgcccggtgtttctttggccatagcacctgcctcttggttgtttgcatggtgtttctttgtgtgcagcacgcgcctctctgcttacacggtgtttctttgtgcatagcaccagcctctcggttgtttgcccggtgtttctttggccatagcacctgcctctcggttgtttgcacggtgtttctttgtgcgcagcacccgcctctctgcttacatggtgtttctttgtgcatagcaccagcctctcggttgtttgcacagtgtttctttggccatagcaccagcctctcggttgtttgcatggcgtttctttgtgcacagcacccgcctctcagcttgcatggtgtttctttgtgtgtagcaccagactcttggtgaggggagcagctgccctcctccggcagcttctccctgacttagctcatgggatgagcctcctgtagtgacc

SEQ ID NO: 87365 - DNA, 875 bp, Homo sapiens
ttctgtcttcattgcttaaaacacggaactctagatgacagaataagggttgattacaaacaacctgtcctctaaacaggacacagattcatgccagagactcatgttgttattgccttaagcacagaccagagttttattaactttctagacatatttttactaaacatcactggggaccatgctttgttctccctgcccacaccccaccctgtgtacaagagccctttaaaaattgtacacaaccacatacagcagcctatccacttattcaaatcctattgttgctgatgaagtcctgaaggcaaatcacacctaccttcaaacgaatcaaaaaagagcacaaggaccacctgtgctcttgtacctgcaaatggcctagctaattttttcattaggatgtcagtgattcggtcccacaataaggacctgatagcactgtgcaggtgcagtcattaaaggcccaccccttctaggaagcaccaaccacctccctcttcctgcagcaggcttcactttccacttgcagacacacgtctgacgttaggacattcaatcaggtgttcctcatgctccaagcaactggaacccacctgtgttccaagattacctttcaactgaaaagcttttaaaggccaggcacagtggctcacgcccagctgatttcgtctttcactggtagagatggggtttctccggtaggtcaggctggtctcgagctcctgacctcgggtgagctgcctgccttcggtttccggggtgctgggattgcagatgtaagccaccgtgcccagccgattattctccttttgccactgtatccccgatttctccttgtaccactgattccagcagccacaaaggctctttacaca

SEQ ID NO: 87366 - DNA, 2126 bp, Homo sapiens
gaattccggcacacatcagcactcacacagcacacagcacacacacagcacacatcagcgcacacacagcacagcttcatcaccccgcccaccacaccccagctgcgacggcacaccaagctgaagccaccacggacgccccccccacccagccgcaaggtcttccagctgctgcccagcttccccacactcacccggagcaagtcccatgagtctcagctggggaaccgcattgatgacgtctcctcgatgaggtttgatctctcgcatggatccccacagatggtacggagggatatcgggctgtcggtgacgcacaggttctccaccaagtcctggctgtcgcaggtctgccacgtgtgccagaagagcatgatatttggagtgaagtgcaagcattgcaggttgaagtgtcacaacaaatgtaccaaagaagcccctgcctgtagaatatccttcctgccactaactcggcttcggaggacagaatctgtcccctcggacatcaacaacccggtggacagagcagccgaaccccattttggaaccctccccaaagcactgacaaagaaggagcaccctccggccatgaatcacctggactccagcagcaacccttcctccaccacctcctccacaccctcctcaccggcgcccttcccgacatcatccaacccatccagcgccaccacgccccccaacccctcacctggccagcgggacagcaggttcaacttcccagctgcctacttcattcatcatagacagcagtttatctttccagacatttcagcctttgcacacgcagccccgctccctgaagctgccgacggtacccggctcgatgaccagccgaaagcagatgtgttggaagctcacgaagcggaggctgaggagccagaggctggcaagtcagaggcagaagacgatgaggacgaggtggacgacttgccgagctctcgccggccctggcggggccccatctctcgcaaggccagccagaccagcgtgtacctgcaggagtgggacatccccttcgagcaggtagagctgggcgagcccatcgggcagggccgctggggccgggtgcaccgcggccgctggcatggcgaggtggccattcgcctgctggagatggacggccacaaccaggaccacctgaagctcttcaagaaagaggtgatgaactaccggcagacgcggcatgagaacgtggtgctcttcatgggggcctgcatgaacccgccccacctggccattatcaccagcttctgcaaggggcggacgttgcactcgtttgtgagggaccccaagacgtctctggacatcaacaagacgaggcaaatcgctcaggagatcatcaagggcatgggatatcttcatgccaagggcatcgtacacaaagatctcaaatctaagaacgtcttctatgacaacggcaaggtggtcatcacagacttcgggctgtttgggatctcaggcgtggtccgagagggacggcgtgagaaccagctaaagctgtcccacgactggctgtgctatctggcccctgagattgtacgcgagatgacccccgggaaggacgaggatcagctgccattctccaaagctgctgatgtctatgcatttgggactgtttggtatgagctgcaagcaagagactggcccttgaagaaccaggctgcagaggcatccatctggcagattggaagcggggaaggaatgaagcgtgtcctgacttctgtcagcttggggaaggaagtcagtgagatcctgtcggcctgctgggctttcgacctgcaggagagacccagcttcagcctgctgatggacatgctggagaaacttcccaagctgaaccggcggctctcccaccctggacacttctggaagtcagctgagttgtaggcctggctgccttgcatgcaccaggggctttcttcctcctaatcaacaactcagcaccgtgacttctgctaaaatgcaaaatgagatgcgggcactaacccaggggatgccacctctgctgctccagtcgtctctctcgaggctacttcttttgctttgttttaaaaactggccctctgccctctccacgtggcctgcatatgcccaagccggaattc

SEQ ID NO: 87367 - DNA, 441 bp, Homo sapiens
taagtcataaaatattttcataggttttagagttgcagttgttttagttttaagaatttttgtgtgtctttcttttggtcatagaacaatatttgctgatattaattatttctgcctgagagccttgaggtgctagtactaaaaaatgtatagcgaaaacccacctggacctacagctaaaaggcaggcaggataaagatgttactcccaattcctctttccccccatagtattctgggtagtaagaggtatcccaccaaagtctagagctcaaagcctgtcctgtgaatgagtatagagaaactcatcagggctggggccaagctttatgagaatacagcagagctttctatgcttttctgtggaacaaagggggacagcacctagaaaataaaacagaaagaggagcaggacactgtagtcctgtcagttgattggaca

SEQ ID NO: 87368 - DNA, 440 bp, Homo sapiens
tgtaagagtacttacagttggggtcatctaggcaggaaaagtatggtcatgttccccagaactcttagaaatggatcacgaggtagatgagcttacaggaaaccgggccagcatggtgccatagaacagttcccatccctgccaaattcttcagcccttgtgtccaaggtcagatgccttgtcttccacaaaacattccctggcgtccacccttcgtccccttcagctacaagtgaccctcctctcctgcaagtattcatccttctgaaggctgggcgccaggcactaacagacaggcagctgcctcccagacataaggagcatgggtcctaaccaggaataagcttcacagccattgctgtcaggccaagccgtggtccaggcacctgcaggcattaattcgtgtcctcagccccacacccacggggagcaggtgtagt

SEQ ID NO: 87369 - DNA, 280 bp, Homo sapiens
gctgcagattggcatagactcacccagatgttcagagtggttactcagttgcaagttaactaccaatttggggaacttattgaacttctagagtttagagatggaattccatatgagttttatgatattccatagtatctaaacttatttcgggggaaacctccaaataatttaaatccacaaatatgctatacgtcttacaaaatgttgagagtgagaaattaactggaaattgctaaaattacaaaaaagaagcttttacattttgaacattgttttt

SEQ ID NO: 87370 - DNA, 450 bp, Homo sapiens
ctaatcctgtgaaaaacattgtcttaagtgctttacatgtattaactcatttattccttagaacaaacctgtgagaaaaaaggaaaggaaacagtggttaagtaagtgcccaggtttacttaccttaaaatggtagaggcagaactggaatctagctattgtactgcctctgagaggagtaactaacattgcaagaagcatctcagttgggaggccgaggtgggaggatcacttgaggtcaggagttcgagactagcctgaccaacatgatgaaactccgtctctgctaaaaatacaaaaattagctgggcgtagtggcaggtgcctgtaatcccagctactcgggaggctgaggcaggagagtctcttgaacccgggaggtggaggttgcagtgagccgagatcatgccaatgcactctagcctgggcaataagagccaaaagtgaaac

SEQ ID NO: 87371 - DNA, 302 bp, Homo sapiens
cctgcgtcgcggcgcgtcgcgctgctgctcccgccccagccggggccgaagatggggcggcggctgcggttttccacacgacttccttggatctcggggcacacgcgccgatagttcggacgcgagtccgggctggttttgctccgttttactgcgtttgattactaatttaaaagctttgcgttccccgtcgccccggcccgcttttctcctgcattctcccctcggcccccgtccccgccctgcgatcgctggagggggcgtcggggctcgcgcgccagaacccggctcctccgaagccc

SEQ ID NO: 87372 - DNA, 131 bp, Homo sapiens
tggggcctcccagggccggtaaaggcacccaggcacccagattggctgaaaacttctgtgtctgccatttagctactggggacatgctgagggccatggtggcttctggctcagagctaggaaaaaagctg

SEQ ID NO: 87373 - DNA, 883 bp, Homo sapiens
  misc_feature (543)..(543): n is a, c, g, or t
tcatgggaaaaaaatgtctctcgggctgtgagcagtgaattggcttgtgcccaagtaatgtcctcaaggtgtgccatgagagatgaagtcacttggctcattttaccagcttcaggatggcattaagacctgacaaagccaggcaacacgtacaaggaaactaacctgaggcaggaccgtggcactgaaggagtctccctggatgcagcaaaggtggagaccttgtccaagaaaaatgctggacgggcctttaccccaaagaggaaagctgggtcatggaacaaggaaatgaattacatcaagtgaaaatgcacatctgatgcccagtccagaccaagcacgtctgttcctgctgacttcgaatgattgtcaagtggctggactcagatgttagccgtctgtcattgctgctaataacatattcatgtacaaaaacaacagagaggggtatctaggcagctggagccctctgtgttccggactacagattcggggacccaaagaaaatcttttgtgttggacttttggaagtttctccctganaatgttgtcaggcggccttgaggtcagacaccaaaaactcccttaggaccttcgctcaggaaactccacccctgtgttggaatctccttcctctctctcttctccggagggatgccacccggaattccggaatgttgacctggtgtggtttctgcttggagagggtccattggtcattcccacaggattgaatgaatggagaaacccaggcgttaccccttggttggagcgccagtgaaaatggttggggggactccttaaccctttcttgggagtggttgacgagggccgcctggtccttggcgcgtccgggcccgcgaagggtggcccggctggtccc

SEQ ID NO: 87374 - DNA, 606 bp, Homo sapiens
acagcttctactgaatgcgtattgcttttgcaccattgtaaattgtgaacaattgtgagtcaaatcatatagtaagttcaggaccatctgtactgcatcaaggtccccaggacctgaacacaagtggtataaattattcccactcctggataaaaatttgttccaggaaagcaggtaaattagcatgatataaatcttcaaattacttttgcccagtttggagatgatgatccagcatggtgtgaccaacagtgttttctcatcaacaccataagtaattctgcaaaggacatgctgtacactttgcccagatttgtgattatttcctcaagaaatggaattactgggctaaagggagttaacatctttaaggttctagttaaccactgagaaactggcctcaagaaagattggataatgtatatacctgccaattaaagcccatcattgctactgctaaatatattcctttaaatttttttctatttaatagggtgtaaagggcattttattttttattcaatatgccttactttgatcatgaattattaactttcttatgtttattggtcattatacttcttataaagattatttgcatatttt

SEQ ID NO: 87375 - DNA, 225 bp, Homo sapiens
gatctgtcagaaaagacatatttttgagataaaggagtttctaaataatgaattattgtttagtaccagcttttggaatccttacattttaaggaacttgaataatttaaatattagataatgtaactcctcataaaaacagtgtctagacaagggccaatattgcattgagattggatgaacattttattttgcatataattgttgtctataaaacaaaatact

SEQ ID NO: 87376 - DNA, 827 bp, Homo sapiens
cagctgagaagctgctcagcaccagcccctgggtgggcgcagacaggaacttcctgtgggggaagcgggcactactcccggctgctggctctctgaacaccaggctggcagtcactggaaactaggccgatagagcacccaccctgtgggtgcctcgttctgcctcctgctcctcgggcccagccgccctgccagtcgggctgggttccctcttgtgtctttcctgagtccttccggggaggacgaggctgtcttcctcccagccaaccttctgggcacctttcctctcttcccaagctctgcctgggacccttttccttcccctcagcccgtggccgtgctgtgcagccgagccccggcctggtctctggcagctcagggttcactcaggaggcgcaccatccagtcgtttccagtgtgtttgcaattatgccacaatcgatgcaattctagaagattcttcccactccagaaagaaacccaggactctccccctcgcctggcacccacccgtctgctttctggtcactgggtttctctctgctggacgttgagcgtgagtggacccccacgacacgggtgggacgtgcttgctgtctgccctgcactgttttccaggccttccggtgcgtggtggggctgcacgcctcttcccggccgaacgccctttccatgggtgtgcacgccacgccgtctcttcatccgtttaccgacgggcacctgagctgcttccgcttctcctgccatgagtgcctgagtatgggggtcccctgaggcctccccaggtggaccatcttgccagcaccttcctcccgtgaacgggtgaa

SEQ ID NO: 87377 - DNA, 392 bp, Homo sapiens
caatctgttcacgcagcacctttgactaaatgggaatcccatctatctcagagaaatcaccgcacagtgtctgagctatttattttcaaccagataaactccttgaaaagcagtgtcagagcagaattataaggcatttttaatattccctgttttaataaaactctttttatgtttgatttttctttatattctttgtccgcacgtatatagatgtggatacataacatttaacacggttgcaatcagagggtgatctgatttgttaacttaatgtcacatcataaacattttacatgctgttatataatgtacataatcatttttaatgactacataacatcccatcctattgacgaatcattatgtccttaataaaatctcacagttgg

SEQ ID NO: 87378 - DNA, 282 bp, Homo sapiens
gcaacggaaaatatgaaaagcaaggagacagtaaaactcaatttatctacttgtctctttattgtgcatagctgatctctggttccttctgtccctcctctgcccttcattatcttcacaacccctctgggcctaacacatgcccagactattgacatctgttaggggtcgccacttctggagagaattggtgcattcaataggagattttttattgaatagcagtgaaagccatgtgatatatactaacttctcccaaccactcaccacaaaagaaaagaa

SEQ ID NO: 87379 - DNA, 204 bp, Homo sapiens
cccataaattacctcgacatttgcctactgcctttactatacaagtgaatttcagaggcaaacaggtatgtaggcgagctgttttgaagggcacgggtcaggtccaactactcatgaaaaatcctaacgttcttacttctagccttgcacaataggtaaaattcatatctagaaattcacatcgggccgggcacggtggctcac

SEQ ID NO: 87380 - DNA, 481 bp, Homo sapiens
acccaagcttttattataatggggacacatggccctcttgtatggaatatgtttatatttctaggctgtagtctacatttgccttaaaaaaaggaaagcaaaccaggtcagcttaatgataacgtaatgtttagttgcactcatatactcttttctcttatgatttctttcctcaagatcatggtgacttctggtcggcttctgcatcagccaagtgaacctcttatggggtttgctcctgtgactagttcagctgggcccactcctgatctttctgtctctttctctctccttttctctcagcatctaatactgtggcttttgaatatggttgactgtggcacacagtaaaaaagcattttaggctgggcatggtggctcatgcctgtaatgccagcactttggcaggctgaggagggaggattgcttgagcccaggagtttgagactagcctgggaaaaataggaagacctcatcctcc

SEQ ID NO: 87381 - DNA, 315 bp, Homo sapiens
ggtccaatgaagcttcaactcgttttcagctcaaagcagacggcaaatcagcaaaaagcaaaaataatgtatcttactgcattacagacaaaaaaaaaaaaaacagagtgaaactagaactattttcaatagtagttttctgacagctatataaacaaatatagaagacattatggaattagtgatgtgaacgagaacttgtccatgtatcctgcctgccagcaaaggtagagatggctgttatatttgtaatggtttactatgaaggctgttccataaccttcaatatccactatcttggtgtataccaagata

SEQ ID NO: 87382 - DNA, 407 bp, Homo sapiens
tctctctttgcctgggttggtttgatcaactaccatgtctgtgaagaattacccaccctccctccatgtagatgtaattcttctctccccagatcctggaaacagaaacattcccgacttgcacatgactggccagctctttcattcccagcctgggaaagagccagcctgaatctccagggacacctatagggtttttctaaggcccatcctggaaagctgtgaggggcagagacagcccttcggagggagggcgcttctgcgtggccctgatagcagaaagtatcctgcttttgggcttagaacccctgtgtcctagcctggcctctgtggccttaaaccagtcccgttttcctaagcctcagtttaccgatctgtaagatgaggacatagcagtagttctttaa

SEQ ID NO: 87383 - DNA, 323 bp, Homo sapiens
aagaggctcgctggtgtcacacacttctgttagttactcacagatggtgctggctgagacagctgaggaaagaaagctcagtgggtatgcggcccaagacagctccttcgcctggagcagatcagcagagaaactttgattgcactggcaaagccagaagtgtaagaaatttctctttgcataggaaaatttcattcaccagatatataacacgcatttattaagggccttctaaacctgagagggaaatgggaacccacttcccagctccacggtcttatgggcaaacgggaagttaaataagcaaaaacaatacagtgtgg

SEQ ID NO: 87384 - DNA, 363 bp, Homo sapiens
gtcaaaatcctggttaagaagcagttaggaccctccatatacagacaggtacaccattttataaaactgaaagtttatactccagaaataacaaaaggcttctggactacaggatactaggcatagtgagaagtactgtagtaaaaagtgttagtaatacaggagactggtaatctgaatggtaccgacaaacccaagaccacagaacaatgaaaatgatgatcttctgtaaatgaaaccactggaagaatgtcaatatcaatctttgattactgcatccaaaaagtcatgcaactaaatgcagaatgcttcattctgcttttataaggaaaaatttaagggttaaaacaatagctgatactt

SEQ ID NO: 87385 - DNA, 365 bp, Homo sapiens
gtgctgggattacaggcgtgagccaccgcacccggctctgctcctctctgcttataggacattggtgtgaattctccaggcgattgctcagtccttatctctcccttcctactgcttggatggatttttagatcaaacttgcagccccgctctcctgggggataatccctgttgctggtaaccttgtttcctggttgaccttcacgaagaagagcttcagcaaaaactttctccctcagcccagtcatgcaatgtttctcttcctaatgctttcgcaggccctcaagatggaatggaaaagggctgccttcggaaacatttccaggagaagaagctactcagaataaattagccagaaagtgtta

SEQ ID NO: 87386 - DNA, 442 bp, Homo sapiens
ggcataagacgagaatttaagataaaggagctcggggttgtttaggtctcagggtatagctcagctagctattaaatgtgaacatgaatgcaaaagaatttttttacttacttatttatgtatttatttatttagaaacagagtcttgctctgtttcccaggcaggagtgcagtggcgcaatttccgctctctgaaacctccacctgcctggttcaagtgattctcctgcctcagcctcctgagtagctgggattacaggaatgcgccaccacagcgactaatttttgtatttttagtagagacaaggtttcgccacatcagtcaggctggtcttgtgttcttgacctcaagtgatccgcctgcctcgtaaagaatttttttaatgaagataaaccattatttttgtgacaatggtattgcattcctttttttttttttttt

SEQ ID NO: 87387 - DNA, 211 bp, Homo sapiens
acctggcaatcactggaataatatattaaatacttgccccacagcaccacctttcaatcttcagaacttttcccactgacctcctaccccagaaatttgggctttacatccttcccagtactgtagaaatgtaaggacaggatcttcaggaactgggcagcaagaaaagaaagaagcaatttgagagtggaggatgcaaatccctttcccc

SEQ ID NO: 87388 - DNA, 479 bp, Homo sapiens
agccccacctggcccagttactgcaggctgtggtggtgaccatgtctcatctcacacctggtcttttccatcactggcctggcccttgattctgtattttcaaagcaaactggggaggtgggcattagtatctctgttttgccagagaggaaaccgaggctcaaactggtttcaatatgtcatgtaggaaagtagtcatggcccgattcaatcatggctctgccatttaacagctctgtgacactgggtgagtcacttgccctgtctgggtcccagcctttccattcataaaacaaagaggttgagggctagctaggtagcaaacttctcagtataagaaacagatggaatccagagaagctgggagaggagaaggaaacaaaggagaggtgatggcccaacaacctagcagaaagacattttaaaaggatctctagccttagtaacatagcaagaccttgtctctacacaccaaaaaa

SEQ ID NO: 87389 - DNA, 233 bp, Homo sapiens
ttttgtatttttaataaagatgaggtttcactatgtgggcaggctggtcttgaactcctgatctcgtgatccacccgccttggtttcccaaagtgttgggattacaggcatgagccaccacgccaggcctctgatctgctttctcaccaaagaagaaacccaactcaggccctctgataatcccagcactttgggaagccaaagcagatcgatcacaaggtcatgagtttgag

SEQ ID NO: 87390 - DNA, 1178 bp, Homo sapiens
  misc_feature (1107)..(1107): n is a, c, g, or t
aagaccaaaaaaaggccaagggtgttgttggggcgtctgtctaatgtggtgggtctttttttgaggggtctcctaaaataaaatattttgataagcaaaaaagcggcggacacgcaggtttccgagacactaaagcgttttgcagggaaggtgacaacagccagtgtaaaggaacggagagaaatcctcagtgaacttgggaagtgtgttgctggaaaagatcttccagagggagcagtgaaggggctctgcaaattgttctgcttgactctgcatcgatatagagatgcagcctcccgcagggccttgcaggcagccatccagcagttggctgaggcccagccagaagccactgctaagaaccttctacactctctgcagtcttctggtataggctccaaagcaggtgttcccagtaagagcagtggctctgccgccttgctggccttgacctggacctgcctcctggtgcgcattgtctttccatcgagagccaagcgacaaggagacatctggaacaaactggtggaagtgcagtgcctgctcttgctggaggtgctgggtggctcccacaagcacgccgtggatggtgctgtgaagaaactcacgaagctgtggaaagagaaccccgggctggtggaacagtacttgtcagccattctcagcctagagcccaaccagaactatgctggcatgctggggctgctggtgcagttctgcacgagtcacaaggagatggacgtggtcagtcagcacaagagcgccctactggacttttacatgaagaacatcctgatgagcaaagtcaagcctccgaagtacctgttggatagctgtgcccctctgctccgatacctgtcccactcagaatttaaggatctgatactgcccaccatacagaagtccttactgaggagtccagagaatgttattgaaactatttctagtctgctggcatcagtgacgcttgacctcagccagtatgccatggacatcgtgaaaggactggctggtcacctgaaatccaacagtccccgcctgatggatgaagctgtgctggcactgcggaacctggcacgccagtgcagtgactcttcggccatggantccctgaccaagcacctatttgctatcctcggaggctcggaaggaaaactaactgttgtagcccagaagat

SEQ ID NO: 87391 - DNA, 533 bp, Homo sapiens
gccagtgatgagatacttgagaatgtcaggatctaaccagagctttgtgttctctagagcgccctactggacttttacatgaagaacatcctgatgagcaaagtcaagcctccgaagtacctgttggtgagcgagaggtggacgttactcacctggacaactgatcccattttcaattctgggatgctgaactctttttttgcttcttggtccgttcccatgagggctaggtgccttattcctttttctttgtaggatagctgtgcccctctgctccgatacctgtcccactcagaatttaaggatctgatactgcccaccatacagaagtccttactgaggagtccagagaatgttattgaaagtaggttgctgtcaaccaggatggtgggagggagatgagttgcctatatctctattctcgatatttggcaacaagaagtgtgtgtggtaggggggagggaagggggatgtattcattgtttaccttgttaggacccttgggtcttaagggacccttggaccatgggtcc

SEQ ID NO: 87392 - DNA, 878 bp, Homo sapiens
aagaccaaaaaaaggccaagggtgttgttggggcgtctgtctaatgtggtgggtctttttttgaggggtctcctaaaataaaatattttgataagcaaaaaagcggcggacacgcaggtttccgagacactaaagcgttttgcagggaaggtgacaacagccagtgtaaaggaacggagagaaatcctcagtgaacttgggaagtgtgttgctggaaaagatcttccagagggagcagtgaaggggctctgcaaattgttctgcttgactctgcatcgatatagagatgcagcctcccgcagggccttgcaggcagccatccagcagttggctgaggcccagccagaagccactgctaagaaccttctacactctctgcagtcttctggtataggctccaaagcaggtgttcccagtaagagcagtggctctgccgccttgctggccttgacctggacctgcctcctggtgcgcattgtctttccatcgagagccaagcgacaaggagacatctggaacaaactggtggaagtgcagtgcctgctcttgctggaggtgctgggtggctcccacaagcacgccgtggatggtgctgtgaagaaactcacgaagctgtggaaagagaaccccgggctggtggaacagtacttgtcagccattctcagcctagagcccaaccagaactatgctggcatgctggggctgctggtgcagttctgcacgagtcacaaggagatggacgtggtcagtcagcacaagagcgccccctagttttagaagtttcaatagcagggataacataaagatctttgcatgaggtaaatctacagcatagttcatttttagattttgtgctattgaaacattctaaaactagg

SEQ ID NO: 87393 - DNA, 406 bp, Homo sapiens
acaccagtataaccagcacccagatcaagaagtagaaccattccagcactcctgaacctcctcttgatggcatgtgaggtttcgaggccacttttattttcttagtttcgttcatttagcaaatgtctacccaaagcttttctgtaccaggcattttcctagagtcctgttttgttgttgctttttcctcttggggaggaaggtcttaaatatatggggagtgtccagtgggctgagatcatgtctgggcagaatacctgactccagcggcttaccaagtgatttttattgaccgctgtctgtgtaatctctggtttcagatcttccagagggagcagtgaaggggctctgcaaattgttctgcttgactctgcatcgatataggtgagtcccagccaaaggcccc

SEQ ID NO: 87394 - DNA, 1307 bp, Homo sapiens
  misc_feature (1236)..(1236): n is a, c, g, or t
aagaccaaaaaaaggccaagggtgttgttggggcgtctgtctaatgtggtgggtctttttttgaggggtctcctaaaataaaatattttgataagcaaaaaagcggcggacacgcaggtttccgagacactaaagcgttttgcagggaaggtgacaacagccagtgtaaaggaacggagagaaatcctcagtgaacttgggaagtgtgttgctggaaaagatcttccagagggagcagtgaaggggctctgcaaattgttctgcttgactctgcatcgatatagagatgcagcctcccgcagggccttgcaggcagccatccagcagttggctgaggcccagccagaagccactgctaagaaccttctacactctctgcagtcttctggtataggctccaaagcaggtgttcccagtaagagcagtggctctgccgccttgctggccttgacctggacctgcctcctggtgcgcattgtctttccatcgagagccaagcgacaaggagacatctggaacaaactggtggaagtgcagtgcctgctcttgctggaggtgctgggtggctcccacaagcacgccgtggatggtgctgtgaagaaactcacgaagctgtggaaagagaaccccgggctggtggaacagtacttgtcagccattctcagcctagagcccaaccagaactatgctggcatgctggggctgctggtgcagttctgcacgagtcacaaggagatggacgtggtcagtcagcacaagagcgccctactggacttttacatgaagaacatcctgatgagcaaagtcaagcctccgaagtacctgttggtgagcgagaggtggacgttactcacctggacaactgatcccattttcaattctgggatgctgaactctttttttgcttcttggtccgttcccatgagggctaggtgccttattcctttttctttgtaggatagctgtgcccctctgctccgatacctgtcccactcagaatttaaggatctgatactgcccaccatacagaagtccttactgaggagtccagagaatgttattgaaactatttctagtctgctggcatcagtgacgcttgacctcagccagtatgccatggacatcgtgaaaggactggctggtcacctgaaatccaacagtccccgcctgatggatgaagctgtgctggcactgcggaacctggcacgccagtgcagtgactcttcggccatggantccctgaccaagcacctatttgctatcctcggaggctcggaaggaaaactaactgttgtagcccagaagat

SEQ ID NO: 87395 - DNA, 322 bp, Homo sapiens
tgctgagaattacaggcatgagccaccgtgcctggccaattgcatattgtttctaagtggctgccttggccagacgactggtgaggaggatgcttggctgcccctgctcatgagtgagcaggtgagcctcaggtgcagagcgtgactgccaaaggagtaggcgggagtggtggtaggggtaggcctgtgaagagaaggctgtggttccatcggcttgactcagagaaaccgcaggacactggagagtgactgtactaggatggggagccctttaaggacatctgagctgacaccccaagttgaaagaggagcctcctggcct

SEQ ID NO: 87396 - DNA, 412 bp, Homo sapiens
gttccatttttattcactttgaggaagtgttgcctttttttttgatgtacttaaatggctaaaataaaaaagacaatcacaagaaaaaaaaagaagaaaaaataaaaatgaaaataaaaataaaatatccatcaattttaatttcactccagttagagaaagtaaaagctctggtcttagatacatctcttgtatttcatctgtagtgagaagaaagaacactcttcattggcaattatcaaattatttgtttgaagagcatttttccacattcagctccccatcttcttgcataaggaaatggtttaagaaaagctgactttgacttgagaaacaaaatccattgataagatgtgtcttcattgcatctgtctgttctctgggagaaataaaatctgtgtcactctcttgc

SEQ ID NO: 87397 - DNA, 333 bp, Homo sapiens
atgagacttactcactatcgtaagaatagcttgggaaagacccacccccatgattcaactgggtcccacccacaacacatcagaattatgggagctacaatttaagatgagatttggctgtggacacagccagaccatattagactcataatttgccttctgcacagtaagaactgggctgggatacctcatagatcataaacaaatccgcacccatgaaaagatttggagagtcacacaggaaagtcaacagaagccagagagatgagggtcctggactgcatgtcattagtgtggatccttcagcttcacatctcagcagtgggtcagaac

SEQ ID NO: 87398 - DNA, 457 bp, Homo sapiens
tatcttaggcctacccttccatttacttaatttcttcccctttacctactcaaggacattgttccaataattattttgtttcttctgtatcaccagtttttcttctactgagtcattcccacagtatcacaaacatactgttatttttccttaaaataaaaagtccctggtcaggcatggtggctcatgcctataatcccagcactttgcggggcagaggcgggcagtttgcttgagcccaggggtttgagaccagcctgggcaacaaggcaaaactctgtctttacaacgaatacaaaaattagctgggtgtggtggtgcacgcctgtaatctcagctgctagggaggctgaggtgggagaattgcttgagcctgggaggttgaggctgcagtaagctgtgagtgtgccacagcactctggcctggcaacagaacaagatcctgtcaaaaaaataa

SEQ ID NO: 87399 - DNA, 421 bp, Homo sapiens
tgaaaatagatctaccataatctaaaataaaaacaaaattggcaaaagcaaaaactgtctaccagaacaaaagtcaacatcttgtagagaaaacaaatgacccggactccctacaatctatcagcccaatattctacatacaataaaaaaattactacgcatgaaaagaagcaggaaaaagtgacccatatttaaggaaaaaagtagtcaagatcttaaaaagacccaaatgttggaaatagcaggaaataactcaaaatcgctatcataaatatgttcaacaacttaaaagaaaagatggacataatgaatgaacaaatgaggaatagtggtagaaaaaaataaaaacagaggctgggcacagtggctcatgcttgtaatcccagcaccttgggaggccaaggtggaaggactgcttgag

SEQ ID NO: 87400 - DNA, 440 bp, Homo sapiens
aatagtgataatgcgttaactgaactgtcacctgggtttaggggaaaaagttcagttttagacaggttgaacttgaagttgcaggtaggagtccctgcccataggctattggaattactggactagatcttttgggagctagagcaactggagtggtccgagggagagagaagagccaaaggtgaagaacaggccttggggaataatcttggtggagagcaataagtttcacagaaaccaaggggacaacagtctccagcagatgcttaagagaggtgtcatgttttctggaagtggttctcaaccatcagcatcgcttaaggaacttttttctttctttttttttttttttttttcctggagatggagtctcactctgtcgcccaggctggagtgcagtggcatgatctcagctcactgcaacctccgcctcctgggtt

SEQ ID NO: 87401 - DNA, 346 bp, Homo sapiens
ttcaataattatctgccccgacttacaaaaacttctaactgaaccaggagctggataagatataggagaaaaggaaacccaaaacatgagaatacttcattgaagataagcagaaactaacattgcatccaaaggtcattgatctggaaaacatctgagaagtgctctgacaattctgggaaaaaatggaaaagagagaagaaacagagaatcaagtaagtaggttttttaatttgttttaaagagataaggtattgctctgtcgcctgggctggagtgcagtggcatgaccatagctcactgtaaccttgaactcctgggttctcaagtgatctgcctccctcag

SEQ ID NO: 87402 - DNA, 772 bp, Homo sapiens
atttcaaaaaaaacctggaatattcatacatgaggtattctaattagctaaagtacagccagaaaaccttggttgaatacctttcataaacaattctgttttcttatttttgaaattcaggatctggtctcaggcatcacatgattacaggaacttaagaaatagacctggatggttaaggagactggactgaatgaacagcgactctaagagccttgaaagtctggtagaaaagggacatttccagtctttgatagtaatcctttctaaaatttgagagcattaaatgcctagtcatttgaagagtaaggttaattttgctcaactttggaagggattgttgaaagcccttgttttatagttagaaaatcccctcaaattgtaacttatccaaaggtttgatgggaccaaaaagccctctgattccatgttgtcaagtaaagtgaaataataaagatcttgtatttaaaaatcttactgttagtaggcaattgtgagttcaatttaaatcaaacatttgcaattggaaataaccaaaaatcatcaaaatggctacaaaaaggaagaaatcacttaaaaaccctgaaaacaaaaagggaaaacgttttcggctgggcttggtggctcactcctgtaataccaacactttgcgaggccgaggccagtggatcacttgagctcaggagtttgagaccagcctggacaacacagtgaaaccacatgtccacgtccctgtagtcccaactactcaggaggctgaggtgggaacatc

SEQ ID NO: 87403 - DNA, 367 bp, Homo sapiens
gagatgaggtcttgctgtattgcccaggctggagtacagtagtgattcacaatgcagtcatagcacgttgtagcctcaaactcctgggctcaagggatccttctacttaagccttctgagtaactgggactacaggcaccctgctcttggttttttgttttttctaaatggtgtcttttaaggagcagaaagttcgttttgatggtgcccaatttgtcaattttttaatgattagtgctttttccatacatttttataaggtaccggttcttaatagctttactgagatacaattcacacaccatacaattcatccatttgaagtgtacaattcagtggggtttttttttggtgtattcacagagtt

SEQ ID NO: 87404 - DNA, 2057 bp, Homo sapiens
  misc_feature (45)..(45): n is a, c, g, or t
  misc_feature (53)..(53): n is a, c, g, or t
  misc_feature (72)..(72): n is a, c, g, or t
  misc_feature (100)..(100): n is a, c, g, or t
  misc_feature (249)..(249): n is a, c, g, or t
tggaaatggattttaggaggtaatggaaaattccttttggaggangtagtgtnaagttttgggaattggaanacattgttggtagtgtatccaattcttntcctgagatttaaacttactaactgggaatccttaaccaattataatagttttttttctttattttcaaaatggatttcctttggctttggattagacactatgtgctttttttttttaaccatagttcatcggaaatgcagctttttntgaacttcaaagatagaatcccatttttaatgaactgaagtagcaaaatcatctttttcattctttaggaaatagctattgccaaagtgaaggtgtagataatacctagtcttgttacataaaggggatgtggtttgcagaagaattttctttataaaattgaagttttaagggacgtcagtgtttatgccatttttccagttccaaaatgattccattccattctagaaatttgaagtatgtaacctgaaatccttaataaaatttggatttaattttaaaaaaagtaaaaaaaaaaaaaaaaaaaaaaaaaaaaaaaaaaaaaaaaaaaaaaaaagagaagaaaaaaaaaaaaaaaaaaaaaaaaaagaaaaaaaaaaaaaaacaagaaaacaaaaaacagggaacacagagagaggcacccccgatttgcgcgggagtacgatgcccacacacatggacccgcactacacaacagttcgagcgccaacgctgactaactccggagaaaccaaacgcacattgaagatccgcttattattcgactacgagagtgacacacaacgatgacacaaaacatcaacaacaacaaactaatacacacctcatacaatggatgatactatcaaaattatccacagcgcctatacgagcggaaaaacaaaacgcagaaacaccccagagaggcagcaaacgagcaaccagagaccacaccgaacagacgagacacgaagaaaacacacagtattaccaccacccaagcaccgacgaacaaaaaaaaacacataacgccaaaaaaaccacagcaacagacacacaccacacccacaccgccacgaaactaccacccacaaacgaaacaaccaaaacaaaacacgaacgccacctacccacactagcaagaacaattcacctaggactgtacagagagagagaacgaagaagagcacaggaacgaaaaagaagaaggaaaaaggggagagccagccggggcagacaccacccgaaagagacagcagaaggaccaaacatagccacgcagataccaagagcaaacaacacgaaacaaaaagaaaagaaaacaaaacagacaacacactcaccagacccacaggaagaggaagaatagagccgccaccacatcggagactaaggatgattagtaggagtagcgagatacgaaagaagcagatcaacgagtacgactgacatcgagcataacgcacccatcgagcagcagaggagacaaaaataaaaagcaacacaacgacccagacacgaacagacacgtacgcacacagcgcacacacgccaccagtcgacatagcaaagtaataacacgaaatacagcacaaagagcactacaccgcgcagagacgcaaagcacaggacgagcggaaacgacgagaagagatgagagaaaggagaaaagaacgaagaccagacgacgcacacaggacacacgcaataaccaacagaaacgacgaaggacaacaaggaacagacacgcaaagcgaacacgcgacgagcacaacacgcagccacgccacacgcacgacgagtcacgcaccgagcagacgggagcgagacggcactaagccggtaacgcagccgctagaccacccaagccggcgacaaccgcgcacacgcgacgacccgacgcaccgcagcgcgcaacagcggccgagcacgacaggacccacggagcaacgagtcgctcaccaccgccgagcaacgcagcagctccacaccgcaacgcccgtgacgagagtcgccagcacgcagacacgacacgtcaccacgccccg

SEQ ID NO: 87405 - DNA, 649 bp, Homo sapiens
gacctgttcccccggagagaaggctggtgcagcttgagctctgtgggcaagtctgactgggcctttctcacttttgcctgtgtttgccttgcagctgtgtaaatgagtatggaagattatgatttcctgttcaaaattgttttaattggcaacgctggtgtggggaagacgtgcctcgtccgaagattcactcagggtcttttccccccaggtcaaggagccacaattggagttgattttatgattaagacagtggagattaatggtgaaaaagtaaagctacagatctgggacacagcaggtcaagagagatttcggtccattacccagagttactaccgaagcgccaatgccttgatcctcacctatgacattacctgtgaggaatccttccgttgccttcctgagtggctgcgggagatagaacaatatgccagcaacaaggtcatcactgtgttagtgggtaagtaagggctaacgaggagggaaattgatttgtgggcattagaggatttataatcacataaagcttatacattggtgccttccaagaatatagtctttagctaataattcatgcagtcaaccttcagttcttctgcaattgaagagaaaatgaaataggtcctatcccatggtgacagtttag

SEQ ID NO: 87406 - DNA, 332 bp, Homo sapiens
aggatcaccctgatgcacctatctatcaaggtacagtgctctgttatgagcgctgcatctacagtccattatctccacagtattttgggtcatatctggtctgttatcctcatactactcaataatgtgttagagctgagtttttatattaaaatgtcatcaattcgatctgccccttgcgtagtatgataagtgagaatagcaacagatgaaaagtctcacgacccatttttatatcttcgatgataaccttagaaaaattctgctcgtggaagcagattgaactgtcatttatcccctccttcttgtaataatgttactttgacgcgtaa

SEQ ID NO: 87407 - DNA, 2043 bp, Homo sapiens
tgctgggcttgcgattgccgctcgctccagctgagctaagtgtagcagcagcaccagggcagggactgactccagcccttggactcaggacatcgcagaccttcccttgcgtgcgtgactcattcgcacatccatttctgtttatgcctggggtggggagaaaaatcccaaaccagctgtgtaaatgagtatggaagattatgatttcctgttcaaaattgttttaattggcaacgctggtgtggggaagacgtgcctcgtccgaagattcactcagggtcttttccccccaggtcaaggagccacaattggagttgattttatgattaagacagtggagattaatggtgaaaaagtaaagctacagatctgggacacagcaggtcaagagagatttcggtccattacccagagttactaccgaagcgccaatgccttgatcctcacctatgacattacctgtgaggaatccttccgttgccttcctgagtggctgcgggagatagaacaatatgccagcaacaaggtcatcactgtgttagtgggcaacaagattgacctggctgaaaggagagaggtttcccagcagcgagctgaagaattctcagaagctcaggacatgtattatctggagacctcagccaaggaatctgataatgtggagaaactcttccttgacttagcatgccgactcatcagtgaagccagacagaacacacttgtgaacaatgtatcctcacccttacctggagaagggaaaagcatcagctatttgacttgttgtaatttcaactaaaggctgaggcacggagaagaaaaggaatcagcaactgccctgatgggccatgagatgctggggagatctggcgatgactgtggctcccgctctctgaccttctgactcctgtgggctcctgagcttacaaagcatggcaggccaagggcctcgaccacaggccagcattagcagaacatataatggtttcacccttttccagtctggagttggagcaaggagaaaattgcactaggcactccatgatctgcagagcatgttgcttttgtttttttaaaaagcaagtaaaagcgcattcctaaacagagtccggggggaaatgtactgtagggatccctcctgcacatcagtgggtgcatgtgggaactcttctttagggcttcggtggtaatcatctgggggccctggttttcttgtctaccagataaaccaaaactgggaaggccaagtacagtctctgtggtgcgtattgacgaccccatggagattttgaaaagtgttatttctcttgtccacaggcactttcaagaactttgggatgtaaaaatgaaatgaaacctttacccatgaccaacagtaacaatcattgttttaataatatatacaagctccataactccttttggtgctaatgattccgctatttcacagaccaaacgttttagtacattaatgtccttaaatgtgttatatagaaataaaaaaatgggggaagtccatgaatcagcactctttctcaaagtctcattactacctttttaaaggtggatttttgggaaaagagaatacttttccttttatgttcccctctgaatctctaccactttcttgtctctccagccctttatgtaaatgaaaacgtttgcaaaatgaaaaaaataaacaaatggttgatgacattctaatataaaaacttagctctaacacattttgagtagtatgaggaaacagaccagatatgaccaaaatactgtggattaatggactgtagtgcagggctcctagcagagcacagtccttgatagtaggtcacatcttttacttcctggtactctccatcttggacagaccaaggcttaggattttgtagattttttagtatgataagtgagaatagcaacagatgaaaagtctcacgacccatttttatatcttcgatgataaccttagaaaaattctgctcgtggaagcagattgaactgtcatttatcccctccttcttgtaataatgttactttgacgcgtaa

SEQ ID NO: 87408 - DNA, 1932 bp, Homo sapiens
gtcctgtcacacacggcccgagagctgagtgaggagggaatctgaacagctgaaggaggggtccagcctagtgtgacagtcttccaacagggagaagacatctctgttcctgctgtgtaaatgagtatggaagattatgatttcctgttcaaaattgttttaattggcaacgctggtgtggggaagacgtgcctcgtccgaagattcactcagggtcttttccccccaggtcaaggagccacaattggagttgattttatgattaagacagtggagattaatggtgaaaaagtaaagccagagttactaccgaagcgccaatgccttgatcctcacctatgacattacctgtgaggaatccttccgttgccttcctgagtggctgcgggagatagaacaatatgccagcaacaaggtcatcactgtgttagtgggcaacaagattgacctggctgaaaggagagaggtttcccagcagcgagctgaagaattctcagaagctcaggacatgtattatctggagacctcagccaaggaatctgataatgtggagaaactcttccttgacttagcatgccgactcatcagtgaagccagacagaacacacttgtgaacaatgtatcctcacccttacctggagaagggaaaagcatcagctatttgacttgttgtaatttcaactaaaggctgaggcacggagaagaaaaggaatcagcaactgccctgatgggccatgagatgctggggagatctggcgatgactgtggctcccgctctctgaccttctgactcctgtgggctcctgagcttacaaagcatggcaggccaagggcctcgaccacaggccagcattagcagaacatataatggtttcacccttttccagtctggagttggagcaaggagaaaattgcactaggcactccatgatctgcagagcatgttgcttttgtttttttaaaaagcaagtaaaagcgcattcctaaacagagtccggggggaaatgtactgtagggatccctcctgcacatcagtgggtgcatgtgggaactcttctttagggcttcggtggtaatcatctgggggccctggttttcttgtctaccagataaaccaaaactgggaaggccaagtacagtctctgtggtgcgtattgacgaccccatggagattttgaaaagtgttatttctcttgtccacaggcactttcaagaactttgggatgtaaaaatgaaatgaaacctttacccatgaccaacagtaacaatcattgttttaataatatatacaagctccataactccttttggtgctaatgattccgctatttcacagaccaaacgttttagtacattaatgtccttaaatgtgttatatagaaataaaaaaatgggggaagtccatgaatcagcactctttctcaaagtctcattactacctttttaaaggtggatttttgggaaaagagaatacttttccttttatgttcccctctgaatctctaccactttcttgtctctccagccctttatgtaaatgaaaacgtttgcaaaatgaaaaaaataaacaaatggttgatgacattctaatataaaaacttagctctaacacattttgagtagtatgaggaaacagaccagatatgaccaaaatactgtggattaatggactgtagtgcagggctcctagcagagcacagtccttgatagtaggtcacatcttttacttcctggtactctccatcttggacagaccaaggcttaggattttgtagattttttagtatgataagtgagaatagcaacagatgaaaagtctcacgacccatttttatatcttcgatgataaccttagaaaaattctgctcgtggaagcagattgaactgtcatttatcccctccttcttgtaataatgttactttgacgcgtaa

SEQ ID NO: 87409 - DNA, 1625 bp, Homo sapiens
tgctgggcttgcgattgccgctcgctccagctgagctaagtgtagcagcagcaccagggcagggactgactccagcccttggactcaggacatcgcagaccttcccttgcgtgcgtgactcattcgcacatccatttctgtttatgcctggggtggggagaaaaatcccaaaccagctccattggatatgactgtgcactggagccggttgtgctgttctctcagctgtacacacccatcaaatcacagtgcccctgaggacgagagaaaattgaagctgtgtaaatgagtatggaagattatgatttcctgttcaaaattgttttaattggcaacgctggtgtggggaagacgtgcctcgtccgaagattcactcagggtcttttccccccaggtcaaggagccacaattggagttgattttatgattaagacagtggagattaatggtgaaaaagtaaagctacagatctgggacacagcaggtcaagagagatttcggtccattacccagagttactaccgaagcgccaatgccttgatcctcacctatgacattacctgtgaggaatccttccgttgccttcctgagtggctgcgggagatagaacaatatgccagcaacaaggtcatcactgtgttagtgggcaacaagattgacctggctgaaaggagagaggtttcccagcagcgagctgaagaattctcagaagctcaggacatgtattatctggagacctcagccaaggaatctgataatgtggagaaactcttccttgacttagcatgccgactcatcagtgaagccagacagaacacacttgtgaacaatgtatcctcacccttacctggagaagggaaaagcatcagctatttgacttgttgtaatttcaactaaaggctgaggcacggagaagaaaaggaatcagcaactgccctgatgggccatgagatgctggggagatctggcgatgactgtggctcccgctctctgaccttctgactcctgtgggctcctgagcttacaaagcatggcaggccaagggcctcgaccacaggccagcattagcagaacatataatggtttcacccttttccagtctggagttggagcaaggagaaaattgcactaggcactccatgatctgcagagcatgttgcttttgtttttttaaaaagcaagtaaaagcgcattcctaaacagagtccggggggaaatgtactgtagggatccctcctgcacatcagtgggtgcatgtgggaactcttctttagggcttcggtggtaatcatctgggggccctggttttcttgtctaccagataaaccaaaactgggaaggccaagtacagtctctgtggtgcgtattgacgaccccatggagattttgaaaagtgttatttctcttgtccacaggcactttcaagaactttgggatgtaaaaatgaaatgaaacctttacccatgaccaacagtaacaatcattgttttaataatatatacaagctccataactccttttggtgctaatgattccgctatttcacagaccaaacgttttagtacattaatgtccttaaatgtgttatatagaaataaaaaaatgggggaagtccatgaatcagc

SEQ ID NO: 87410 - DNA, 2144 bp, Homo sapiens
tgctgggcttgcgattgccgctcgctccagctgagctaagtgtagcagcagcaccagggcagggactgactccagcccttggactcaggacatcgcagaccttcccttgcgtgcgtgactcattcgcacatccatttctgtttatgcctggggtggggagaaaaatcccaaaccagctccattggatatgactgtgcactggagccggttgtgctgttctctcagctgtacacacccatcaaatcacagtgcccctgaggacgagagaaaattgaagctgtgtaaatgagtatggaagattatgatttcctgttcaaaattgttttaattggcaacgctggtgtggggaagacgtgcctcgtccgaagattcactcagggtcttttccccccaggtcaaggagccacaattggagttgattttatgattaagacagtggagattaatggtgaaaaagtaaagctacagatctgggacacagcaggtcaagagagatttcggtccattacccagagttactaccgaagcgccaatgccttgatcctcacctatgacattacctgtgaggaatccttccgttgccttcctgagtggctgcgggagatagaacaatatgccagcaacaaggtcatcactgtgttagtgggcaacaagattgacctggctgaaaggagagaggtttcccagcagcgagctgaagaattctcagaagctcaggacatgtattatctggagacctcagccaaggaatctgataatgtggagaaactcttccttgacttagcatgccgactcatcagtgaagccagacagaacacacttgtgaacaatgtatcctcacccttacctggagaagggaaaagcatcagctatttgacttgttgtaatttcaactaaaggctgaggcacggagaagaaaaggaatcagcaactgccctgatgggccatgagatgctggggagatctggcgatgactgtggctcccgctctctgaccttctgactcctgtgggctcctgagcttacaaagcatggcaggccaagggcctcgaccacaggccagcattagcagaacatataatggtttcacccttttccagtctggagttggagcaaggagaaaattgcactaggcactccatgatctgcagagcatgttgcttttgtttttttaaaaagcaagtaaaagcgcattcctaaacagagtccggggggaaatgtactgtagggatccctcctgcacatcagtgggtgcatgtgggaactcttctttagggcttcggtggtaatcatctgggggccctggttttcttgtctaccagataaaccaaaactgggaaggccaagtacagtctctgtggtgcgtattgacgaccccatggagattttgaaaagtgttatttctcttgtccacaggcactttcaagaactttgggatgtaaaaatgaaatgaaacctttacccatgaccaacagtaacaatcattgttttaataatatatacaagctccataactccttttggtgctaatgattccgctatttcacagaccaaacgttttagtacattaatgtccttaaatgtgttatatagaaataaaaaaatgggggaagtccatgaatcagcactctttctcaaagtctcattactacctttttaaaggtggatttttgggaaaagagaatacttttccttttatgttcccctctgaatctctaccactttcttgtctctccagccctttatgtaaatgaaaacgtttgcaaaatgaaaaaaataaacaaatggttgatgacattctaatataaaaacttagctctaacacattttgagtagtatgaggaaacagaccagatatgaccaaaatactgtggattaatggactgtagtgcagggctcctagcagagcacagtccttgatagtaggtcacatcttttacttcctggtactctccatcttggacagaccaaggcttaggattttgtagattttttagtatgataagtgagaatagcaacagatgaaaagtctcacgacccatttttatatcttcgatgataaccttagaaaaattctgctcgtggaagcagattgaactgtcatttatcccctccttcttgtaataatgttactttgacgcgtaa

SEQ ID NO: 87411 - DNA, 1747 bp, Homo sapiens
gacccacgcgtccgcggacgcgtgggttatgattaagacagtggagattaatggtgaaaaagtaactacagatctgggacacagcaggtcaagagagatttcggtccattacccagagttactaccgaagcgccaatgccttgatcctcacctatgacattacctgtgaggaatccttccgttgccttcctgagtggctgcgggagatagaacaatatgccagcaacaaggtcatcactgtgttagtgggcaacaagattgacctggctgaaaggagagaggtttcccagcagcgagctgaagaattctcagaagctcaggacatgtattatctggagacctcagccaaggaatctgataatgtggagaaactcttccttgacttagcatgccgactcatcagtgaagccagacagaacacacttgtgaacaatgtatcctcacccttacctggagaagggaaaagcatcagctatttgacttgttgtaatttcaactaaaggctgaggcacggagaagaaaaggaatcagcaactgccctgatgggccatgagatgctggggagatctggcgatgactgtggctcccgctctctgaccttctgactcctgtgggctcctgagcttacaaagcatggcaggccaagggcctcgaccacaggccagcattagcagaacatataatggtttcacccttttccagtctggagttggagcaaggagaaaattgcactaggcactccatgatctgcagagcatgttgcttttgtttttttaaaaagcaagtaaaagcgcattcctaaacagagtccggggggaaatgtactgtagggatccctcctgcacatcagtgggtgcatgtgggaactcttctttagggcttcggtggtaatcatctgggggccctggttttcttgtctaccagataaaccaaaactgggaaggccaagtacagtctctgtggtgcgtattgacgaccccatggagattttgaaaagtgttatttctcttgtccacaggcactttcaagaactttgggatgtaaaaatgaaatgaaacctttacccatgaccaacagtaacaatcattgttttaataatatatacaagctccataactccttttggtgctaatgattccgctatttcacagaccaaacgttttagtacattaatgtccttaaatgtgttatatagaaataaaaaaatgggggaagtccatgaatcagcactctttctcaaagtctcattactacctttttaaaggtggatttttgggaaaagagaatacttttccttttatgttcccctctgaatctctaccactttcttgtctctccagccctttatgtaaatgaaaacgtttgcaaaatgaaaaaaataaacaaatggttgatgacattctaatataaaaacttagctctaacacattttgagtagtatgaggaaacagaccagatatgaccaaaatactgtggattaatggactgtagtgcagggctcctagcagagcacagtccttgatagtaggtcacatcttttacttcctggtactctccatcttggacagaccaaggcttaggattttgtagattttttagtatgataagtgagaatagcaacagatgaaaagtctcacgacccatttttatatcttcgatgataaccttagaaaaattctgctcgtggaagcagattgaactgtcatttatcccctccttcttgtaataatgttactttgacgcgtaa

SEQ ID NO: 87412 - DNA, 2711 bp, Homo sapiens
ccagcttcctctcaagatcaaaaaatttattctggggaaaaatcctatgagtgtgctgaatttggaaagagcttcacctggaagtcacagttcaaggtacatctgaaagttcctacaggagaaaaactctatgtatgtattgaatgtgggagggcttttgtacagaagccagaattcatcacacatcagaaaacccatatgagagagaagccctataagtgcaatgaatgtggaaaatccttttttcaagtatcgtctcttttcaggcatcacagaattcataccggagaaaaactatatgaatgtagtgaatgtgggaaaggtttcccttataactcagatctcagtatacatgagaaaattcatactggagagagacaccatgaatgcactgactgtggcaaagcgttcacacaaaagtccacactcaagattcatcagaaaatccatacaggcgagagatcctacatctgtattgaatgcgggcaggccttcatccagaaaacacaattgattgcacaccgaagaattcatagtggagaaaaaccatatgaatgcaataactgtggcaaatccttcatttccaagtcacaacttcaggtacatcaacgtgttcacacaagagtgaagccctatatatgtaccgaatatgggaaggtcttcagcaataattccaacctcattacacatgagaagattcaaagtagagagaaatcttccatatgtactgagtgtgggaaggcctttacctacaggtcagagttgattattcatcagagaattcacactggagagaaaccttatgaatgcagtgactgtgggagagccttcactcagaagtcagcactcacagtgcatcagagaattcatacaggagaaaaatcgtatatatgcatgaaatgtggactggccttcatccggaaggcacacttgattacacatcaaataattcatactggagagaaaccttataaatgtggtcactgtgggaaattgtttacttccaagtcacaactccatgttcataaacgaattcacacaggagaaaagccctatgtatgcaataaatgtgggaaggcattcaccaaccggtcaaatctcattacacatcagaaaactcatacaggagagaaatcttatatatgttccaaatgtggaaaggccttcacccagaggtcagacttgattacacatcagagaatccatactggggagaagccttatgaatgcaatacttgtggaaaagcctttactcagaagtcaaatcttaatatacatcagaaaattcacactggagagagacagtatgaatgccacgaatgtgggaaagccttcaaccagaaatcaatactcattgttcatcagaaaattcatacaggagagaaaccctatgtatgcactgagtgtggaagagctttcatccgcaagtcaaactttattactcatcaaagaattcatactggagagaagccttatgaatgcagtgactgtgggaagtcctttacctccaagtctcagctcctggtgcatcagccagttcacacaggagagaaaccctatgtgtgtgctgagtgtgggaaagcctttagtggcaggtcaaatctcagtaagcaccagaaaactcataccggagaaaagccctacatttgttctgaatgtgggaagacctttcgacagaagtcagagttgattacacatcacagaattcatactggagagaaaccttatgagtgcagtgactgtgggaagtctttcactaaaaaatcacagctccaagtgcatcagcgaattcacactggagagaagccttacgtgtgtgctgagtgtgggaaggcctttagcaacaggtccaatttgaataaacatcagacaacacacactggagacaaaccctacaagtgtggcatctgtgggaaaggcttcgttcagaaatcagtgttcagtgttcatcagagcagccacgcttgagagaaacagtgtgagaaaacccccctgagggttgggtctgattgtacactgttgcacgcatgcagcagaaaaatatgtatattattgtaaatagaaatgaccacatcagaatgtcacacatggctgttctggagagggcctctgagaaggcactgaatgaggcgagggacccttcctacattgtcaccatccccagtaaaccttgggtcattattcatactgacaaggaaccgagtcaatttggtgaataggaaaagccttctcatgaaaactacaatagaatactgttaccaaattcttcataagaaagatcatattatgggaatgataatcctgtttactgtggattaggtatagtgccaacagtttgaatggtaagacaacataatatatatgatagtgatgaatccttctgtgagttgtttgttccagaacacactgtctagtagaattgtgggtattttcttcttttgaatcgaacacagttgtgcatatccaattccccattgagtatttctatcaagcaagagatactgcaataagacaaactccctgtgtattcagacacagacctcagagcgtatgttgagtccccattgtcatagaaaaagacttacagtccccttcattatctgccaggactctctctgagccccacaggttctcagcacatgtgtttgacacccagcacagtgttttttcttattcttcctttctttctctttctttctttctttctttct

SEQ ID NO: 87413 - DNA, 856 bp, Homo sapiens
agagccctctcgcggccgcggcggcagcagcagcgccagccccagcaacactgaggccgccgccgccgcctggcgctcccgccgcccggcccgacatgagtgaggcggttcgggtaccctcgcccgccactccgctggtggtggcggcggccgcgcctgaggagaggaaagggaaggagtcagagcgcgagaagctgccgcccatcgtatcggcgggcgccggcgcgaccgcgggtttggacagaggagccaaaggccaaatttccactttcagcagttttatttcagctgttagcccgaagaaagaagctgctgaaaacagaagttcacctgcacatcttgttttccctaacatcaagaatgtgagagaaccaccaccaatttgccttgatgttagacaaaaacagcgtacatctatggatgcatcatcatccgaaatgaaggccccagtccttccagaacctattcttcctatccagcccaaaactgtgaaagactttcaggaagatgtagaaaaagttaagtcatcaggagattggaaagcagtacatgatttttatctaacaacgtttgattctttcccagaattaaatgctgcatttaagaaagatgccactgcctcatttaacaccattgaagactctgggattaatgctaaatttgtgaatgctgtgtatgataccttacttaatactgtaagtattatgacatgcaagtaatattattctgtgtctcttctgtatatcaaaagcagccatacaaatattgtaaaaatcaccttataattaccttagaaactctgatacaattttatagtaaatgtagctggaattctcataaagttagattattttat

SEQ ID NO: 87414 - DNA, 1351 bp, Homo sapiens
  misc_feature (17)..(17): n is a, c, g, or t
gatgaggccccgggtantcggccgaggaggaaaggaaattgtctaggtgtcctggtggtggaggtggggggtattttaatttcataattaaaagctctcttcttcggctttcaagtttttactcctatttgtaatgatttgattgaggactgtgcagcagagtttggggtttggacagaggagccaaaggccaaatttccactttcagcagttttatttcagctgttagcccgaagaaagaagctgctgaaaacagaagttcacctgcacatcttgttttccctaacatcaagaatgtgagagaaccaccaccaatttgccttgatgttagacaaaaacagcgtacatctatggatgcatcatcatccgaaatgaaggccccagtccttccagaacctattcttcctatccagcccaaaactgtgaaagactttcaggaagatgtagaaaaagttaagtcatcaggagattggaaagcagtacatgatttttatctaacaacgtttgattctttcccagaattaaatgctgcatttaagaaagatgccactgcctcatttaacaccattgaagactctgggattaatgctaaatttgtgaatgctgtgtatgataccttacttaatactcctcaagacgttcagaagacagtattaaagggaatcattaacagcctgttacgagaatggaaaggtccacgaacaaaagatgatcttagagcatattttatactttttacagaatcctcagtttaataacacatctacgtatgtcatctatgctcacttgctacgacagatagctaccttagtggaagctgaccatcatttcctagttcactggtttaaaaagtaaatcattctatgatattaagaacttttatagtctcacagttttaagtttggtattagtaattttacaataaaatatatttaaatattttcaggtctttagaaatgatgcttatattcacaatgcttcaaaagccagttacaaaaatctactttagtactacataaaggataattaaaaatctgtttttaatgtaagtaaccaatttgtttgcacaagctgttgagaatttctgtctactgccttcactttttatatagcacattcctattattggttttttacgtatctcaaagatggtgactggatttgctcagacactactattttaatgtgtgtctttttattttctatctgtaaattcataaatttcaccattatttaaatggcgctttctccttacctaaaaatgtcattgtaaaatataggctagccatcaatatcaatttgtaaaagcataatacttttttcacagaactatacccacatgaacaatgac

SEQ ID NO: 87415 - DNA, 810 bp, Homo sapiens
gccgctccagtagactgagaaaaaggaaaaggagggggcgacaagaaaggaaaggaaattgtctaggtgtcctggtggtggaggtggggggtattttaatttcataattaaaagctctcttcttcggctttcaagtttttactcctatttgtaatgatttgattgaggactgtgcagcagagtttggggtttggacagaggagccaaaggccaaatttccactttcagcagttttatttcagctgttagcccgaagaaagaagctgctgaaaacagaagttcacctgcacatcttgttttccctaacatcaagaatgtgagagaaccaccaccaatttgccttgatgttagacaaaaacagcgtacatctatggatgcatcatcatccgaaatgaaggccccagtccttccagaacctattcttcctatccagcccaaaactgtgaaagactttcaggaagatgtagaaaaagttaagtcatcaggagattggaaagcagtacatgatttttatctaacaacgtttgattctttcccagaattaaatgctgcatttaagaaagatgccactgcctcatttaacaccattgaagactctgggattaatgctaaatttgtgaatgctgtgtatgataccttacttaatactgtaagtattatgacatgcaagtaatattattctgtgtctcttctgtatatcaaaagcagccatacaaatattgtaaaaatcaccttataattaccttagaaactctgatacaattttatagtaaatgtagctggaattctcataaagttagattattttat

SEQ ID NO: 87416 - DNA, 719 bp, Homo sapiens
ccattaccagatgaagttatcagctgaggtcagtcccagattttgagttgttctgtcaataagtcagttttgaaaaacacatggtgctctcttatttttcacaatttcaggaggtttttttcaataatatttattttttccatgatgtgctgaaatgtacattgtgctagaattttatattttggaaacattaactaaaggcttttcttagtttacaagtattccttcagcgtccctttatcatttaaaagttgtcagaagctgtatgtgtttctccccttgttctttgtgatatatgaggctaactcattttacaatggcaaaagtttcacaaccagcttttacttcgtttttctagcttttaatcaaggaacacccaggttttttgcttttaattggatgatagtgattggtaccatttatgaaggcactttttatgaaggtgctttatatacattttctttttcgatactcaaaacaacccttaagatagagaatatcattcccattttacagataaggacattgagaatcaaagtgtaaggaacatgcctaagggcatatagctagtaagtggtagaattagccctcagacccagatctgtcttaactccaaagcccatgctcttttcactgtatagccgcagtgtaaatgaaagtctctgttaattaaataacaaataggttattgttattttataatctcaaattttgtttcc

SEQ ID NO: 87417 - DNA, 211 bp, Homo sapiens
atctcaaagtgaatgtaatacaaaataattcatttgttttctgttcatgttgaattaatcttgtattttataattttgaaaagtttaatgattcattattttgaatgtgtttttatacttcacagtgagagaaccaccaccaatttgccttgatgttagacaaaaacagcgtacatctatggatgcatcatcatccgaaatgaaggcccca

SEQ ID NO: 87418 - DNA, 1417 bp, Homo sapiens
agagccctctcgcggccgcggcggcagcagcagcgccagccccagcaacactgaggccgccgccgccgcctggcgctcccgccgcccggcccgacatgagtgaggcggttcgggtaccctcgcccgccactccgctggtggtggcggcggccgcgcctgaggagaggaaagggaaggagtcagagcgcgagaagctgccgcccatcgtatcggcgggcgccggcgcgaccgcgggtttggacagaggagccaaaggccaaatttccactttcagcagttttatttcagctgttagcccgaagaaagaagctgctgaaaacagaagttcacctgcacatcttgttttccctaacatcaagaatgtgagagaaccaccaccaatttgccttgatgttagacaaaaacagcgtacatctatggatgcatcatcatccgaaatgaaggccccagtccttccagaacctattcttcctatccagcccaaaactgtgaaagactttcaggaagatgtagaaaaagttaagtcatcaggagattggaaagcagtacatgatttttatctaacaacgtttgattctttcccagaattaaatgctgcatttaagaaagatgccactgcctcatttaacaccattgaagactctgggattaatgctaaatttgtgaatgctgtgtatgataccttacttaatactcctcaagacgttcagaagacagtattaaagggaatcattaacagcctgttacgagaatggaaaggtccacgaacaaaagatgatcttagagcatattttatactttttacagaatcctcagtttaataacacatctacgtatgtcatctatgctcacttgctacgacagatagctaccttagtggaagctgaccatcatttcctagttcactggtttaaaaagtaaatcattctatgatattaagaacttttatagtctcacagttttaagtttggtattagtaattttacaataaaatatatttaaatattttcaggtctttagaaatgatgcttatattcacaatgcttcaaaagccagttacaaaaatctactttagtactacataaaggataattaaaaatctgtttttaatgtaagtaaccaatttgtttgcacaagctgttgagaatttctgtctactgccttcactttttatatagcacattcctattattggttttttacgtatctcaaagatggtgactggatttgctcagacactactattttaatgtgtgtctttttattttctatctgtaaattcataaatttcaccattatttaaatggcgctttctccttacctaaaaatgtcattgtaaaatataggctagccatcaatatcaatttgtaaaagcataatacttttttcacagaactatacccacatgaacaatgac

SEQ ID NO: 87419 - DNA, 398 bp, Homo sapiens
gacaagtcgagagctgatgcagcttccacaaaacctcggccaacccagcagacaactctggagtggatttatccaacagagatgatccctttgggcccaaattgctgtgcttctgtaccccacctcactctgtcaccagatgcaggctgtcccaggaagggtgaccttggctgaagctgtagctgaggctgagcctgaaggaaccgacagctgggggctgtttgcaaagccgtctccctgaagctgggcctcaagtccttcttcgaggtgaggttgggggcagcacatctccatggcatgcagagcttgatgaggagcttgagtttgacctgaccctgaagggcaagtggggctttggtaggcagagaggagcaggaagaacttgccagctaagcaaa

SEQ ID NO: 87420 - DNA, 325 bp, Homo sapiens
taaagatcactttaaaagtgaagcgttagattttcagttttcagcacaatcaagtttcatactctcatgctgcattgacagaagatgtcctacatcctaaatagtgttcctacagaatggtgaaacctctgtcatcttaggtactgtattgctccgagactttcttagagaattggcaaggcctgcagaacagtgtgaatgagcgtcaaaacttgattgtattaaaccattaaaaatcttgggtccgtttcgaagcatatgtcttagtctatgcggactaatccttagcatttctagaatataatataaaacttaaagcttccta

SEQ ID NO: 87421 - DNA, 467 bp, Homo sapiens
aacatcttccacttagcttttttcataatttttgaaatatttatgaaaatttttattagatatctgaaatatggatttgaatttacaacaaagtgagatattggcattctgtattatagctgaattatattggatttgtaagacttaaaagaaaagtgacaaaacccaaaatgacataaggaaaacattcctaattaaaattttttaatttctgaatttcgaatctctaaaaatcataaaattctaaggtgtgtaattgatcttatgaggcctttgtttaggctcctaagcacagatattagctgctgcacatgacaggaaattcaggcacattaattgtctcctagaatgacacattggcaatcagaagaacaaaacaggttctacagtcacttcagtatatcatttacaatgtgccaaaagtttcagagatgcaaactaaaatgagaaagtatgaccaatactct

SEQ ID NO: 87422 - DNA, 3145 bp, Homo sapiens
ccaccagagtccatctgataactaagatggtaactacatgactaacaggccggtgacgtatagagcatggatatgctggacaaaggggtgagtcatatcccaggtaggatgaagcagggtgacttgagatttcactattcagtatggtgcacaatttaaaacttaggaattgtttatttcttggaacttttcgtttaatgtttttggactgcagttagccacaggtaactgaaactgtggaaagtgaggattggaggataagcagagactgtggtattcatttcattgcacagtgcctagaatacagtaggtgtactataaatattttgtaaagggacaacttttctgaaactaaaaatatttatgttttacccaataatttttcttctggaaatttatgctaaggaaatattcagagatgcttacaaagttttatgcatgagtgtccatgttatttgtaattgtgaaaaatgaaaataactcaaaagtttaacagtggtcatctaaagtattgtatacactgtatatataggttgaatagaaggtcatcctattcatttattaatgagaggtacaatctctagggatctgtaaaatctattttgtcttaaccaaagaacaaatttttgacatatcttgaataggatgactataaattatgacttttaaattgttgtaatttttgtactattatctgatatttttatttttatgtattttcgtaagtagtttagagatagtcacattttaaaaatctaagatcaagcaaatgaagcttatttttatgtattcatagtataaaagaccttcagtaaataggtaatatttttgttttattctagaaaacagctccttgaacacagtgagctggcttttcacacattgcagttgttagtgtttactgcccttgccattttaattatgaggctaaagatgtttttgacaccgcacatgtgtgttatggcttccttgatatgctctcgacagctctttggctggctttttcgcagagttcgttttgagaaggttatctttggcattttaacagtgatgtcaatacaaggttatgcaaacctccgtaatcaatggagcataataggagaatttaataatttgcctcaggaagaacttttacagtggatcaaatacagtaccacatcagatgctgtctttgcaggtgccatgcctacaatggcaagcatcaagctgtctacacttcatcccattgtgaatcatccacattacgaagatgcagacttgagggctcggacaaaaatagtttattctacatatagtcgaaaatctgccaaagaagtaagagataaattgttggagttacatgtgaattattatgttttagaagaggcatggtgtgttgtgagaactaagcctggttgcagtatgcttgaaatctgggatgtggaagacccttccaatgcagctaaccctcccttatgtagcgtcctgctcgaagacgccaggccttacttcaccacagtatttcagaatagtgtgtacagagtattaaaggttaactgagaaggatactacccattttactatggcacaatgccgtgtgtcaaaaacaatcaccctttggcttattcacattaataaaaatcacaagctttaataacagacacttaaaaataagataaaaatggattggaaatttttctgattactaaaaggtaaattacttttctgttcattgaatgtcagccttattaagcttgtcatataagttattaaatcattcatgtcatactgcataaacaaatgttcatttcagaattttaaagagaaatgtatataaaagaacaatgaattttaataaatcaggggtatgtaagtcctttttcatccaactaggtgaattgcttcagattttctctagtaccagagggtacctcctcaaactctttgaaccacttaaggcagaagaatgcaagctctgaaatgacatccttaaaatgctgatactggtcacagcctctttacctctgtgaggaaattgtaacagtgtgtcttttaaggtgtttttattttaccagcccttaagaaagatctctaataccttttaatacttttttttaataatttcaagttgaagtgtttttaaaaacactttgttttgtaatgttttgaatctcttgagatgtgtttaccccactagatacatatttgccactggttagttctccatctaagctcaagaggttattcatctctctttagattccagtggcttttcttttaacatccaggtaaaacagaaactgctatggtatacaaccaagttttggggttaaacataatcagaaaagaaaatccagttaaatttatgaagtgagattttcagatcctagatcttgaataaaggaaaggtcttttcatcttgatggccccaaagcttgttggtcatggtctttatttctggccactatcttcttaaataatatatttttaagccctcatttatttttggttttgggtgaggaaagtcatgttttctaagtcctctcccctaataaaacctacccaacaatagtgctttgaaaagtggtagttatcttgaagatactcttgccaaatgcaaagataaacattctttttgtctgctttataaatatgaaatatgccagatctatagtattttaatgtgcatctactttaaatgagtcatcttggggtttttataattcccttatgttcttgcccctctacacttgaaataacaaaatgccttaattttatggattagttctcttatagtagacaggcagctatatgcagcaaaaccaataaagttatttttcaactttcatagttgtaaaatatcttataacagaatacaaaacagctaagaaaacatgccacattttattttagcattttcaaataatttgtttttggtgtaagcacaggataaaaaaggagagcgtcaaagaaaagagacataacacctaacattcataaaaattaacaaagtatattttggatgatgtttttacaggaaatattttaaataagttggtagaacttttaaaatggtactgtattagctaataaaatattcagtacaaatatatgtttggatttatgcattaaaaaactaataaaattatttccaactttaaaaaaa

SEQ ID NO: 87423 - DNA, 3245 bp, Homo sapiens
ccaccagagtccatctgataactaagatggtaactacatgactaacaggccggtgacgtatagagcatggatatgctggacaaaggggtgagtcatatcccaggtaggatgaagcagggtgacttgagatttcactattcagtatggtgcacaatttaaaacttaggaattgtttatttcttggaacttttcgtttaatgtttttggactgcagttagccacaggtaactgaaactgtggaaagtgaggattggaggataagcagagactgtggtattcatttcattgcacagtgcctagaatacagtaggtgtactataaatattttgtaaagggacaacttttctgaaactaaaaatatttatgttttacccaataatttttcttctggaaatttatgctaaggaaatattcagagatgcttacaaagttttatgcatgagtgtccatgttatttgtaattgtgaaaaatgaaaataactcaaaagtttaacagtggtcatctaaagtattgtatacactgtatatataggttgaatagaaggtcatcctattcatttattaatgagaggtacaatctctagggatctgtaaaatctattttgtcttaaccaaagaacaaatttttgacatatcttgaataggatgactataaattatgacttttaaattgttgtaatttttgtactattatctgatatttttatttttatgtattttcgtaagtagtttagagatagtcacattttaaaaatctaagatcaagcaaatgaagcttatttttatgtattcatagtataaaagaccttcagtaaataggtaatatttttgttttattctagaaaacagctccttgaacacagtgagctggcttttcacacattgcagttgttagtgtttactgcccttgccattttaattatgaggctaaagatgtttttgacaccgcacatgtgtgttatggcttccttgatatgctctcgacagctctttggctggctttttcgcagagttcgttttgagaaggttatctttggcattttaacagtgatgtcaatacaaggttatgcaaacctccgtaatcaatggagcataataggagaatttaataatttgcctcaggaagaacttttacagtggatcaaatacagtaccacatcagatgctgtctttgcaggtgccatgcctacaatggcaagcatcaagctgtctacacttcatcccattgtgaatcatccacattacgaagatgcagacttgagggctcggacaaaaatagtttattctacatatagtcgaaaatctgccaaagaagtaagagataaattgttggagttacatgtgaattattatgttttagaagaggcatggtgtgttgtgagaactaagtttatacttcaagatggacaagaagttctatcagctgctgagaaatgatgccagatggtaactcagatatacaagaaatactcaaatgtgctggaaatggcctggttgcagtatgcttgaaatctgggatgtggaagacccttccaatgcagctaaccctcccttatgtagcgtcctgctcgaagacgccaggccttacttcaccacagtatttcagaatagtgtgtacagagtattaaaggttaactgagaaggatactacccattttactatggcacaatgccgtgtgtcaaaaacaatcaccctttggcttattcacattaataaaaatcacaagctttaataacagacacttaaaaataagataaaaatggattggaaatttttctgattactaaaaggtaaattacttttctgttcattgaatgtcagccttattaagcttgtcatataagttattaaatcattcatgtcatactgcataaacaaatgttcatttcagaattttaaagagaaatgtatataaaagaacaatgaattttaataaatcaggggtatgtaagtcctttttcatccaactaggtgaattgcttcagattttctctagtaccagagggtacctcctcaaactctttgaaccacttaaggcagaagaatgcaagctctgaaatgacatccttaaaatgctgatactggtcacagcctctttacctctgtgaggaaattgtaacagtgtgtcttttaaggtgtttttattttaccagcccttaagaaagatctctaataccttttaatacttttttttaataatttcaagttgaagtgtttttaaaaacactttgttttgtaatgttttgaatctcttgagatgtgtttaccccactagatacatatttgccactggttagttctccatctaagctcaagaggttattcatctctctttagattccagtggcttttcttttaacatccaggtaaaacagaaactgctatggtatacaaccaagttttggggttaaacataatcagaaaagaaaatccagttaaatttatgaagtgagattttcagatcctagatcttgaataaaggaaaggtcttttcatcttgatggccccaaagcttgttggtcatggtctttatttctggccactatcttcttaaataatatatttttaagccctcatttatttttggttttgggtgaggaaagtcatgttttctaagtcctctcccctaataaaacctacccaacaatagtgctttgaaaagtggtagttatcttgaagatactcttgccaaatgcaaagataaacattctttttgtctgctttataaatatgaaatatgccagatctatagtattttaatgtgcatctactttaaatgagtcatcttggggtttttataattcccttatgttcttgcccctctacacttgaaataacaaaatgccttaattttatggattagttctcttatagtagacaggcagctatatgcagcaaaaccaataaagttatttttcaactttcatagttgtaaaatatcttataacagaatacaaaacagctaagaaaacatgccacattttattttagcattttcaaataatttgtttttggtgtaagcacaggataaaaaaggagagcgtcaaagaaaagagacataacacctaacattcataaaaattaacaaagtatattttggatgatgtttttacaggaaatattttaaataagttggtagaacttttaaaatggtactgtattagctaataaaatattcagtacaaatatatgtttggatttatgcattaaaaaactaataaaattatttccaactttaaaaaaa

SEQ ID NO: 87424 - DNA, 3070 bp, Homo sapiens
ccaccagagtccatctgataactaagatggtaactacatgactaacaggccggtgacgtatagagcatggatatgctggacaaaggggtgagtcatatcccaggtaggatgaagcagggtgacttgagatttcactattcagtatggtgcacaatttaaaacttaggaattgtttatttcttggaacttttcgtttaatgtttttggactgcagttagccacaggtaactgaaactgtggaaagtgaggattggaggataagcagagactgtggtattcatttcattgcacagtgcctagaatacagtaggtgtactataaatattttgtaaagggacaacttttctgaaactaaaaatatttatgttttacccaataatttttcttctggaaatttatgctaaggaaatattcagagatgcttacaaagttttatgcatgagtgtccatgttatttgtaattgtgaaaaatgaaaataactcaaaagtttaacagtggtcatctaaagtattgtatacactgtatatataggttgaatagaaggtcatcctattcatttattaatgagaggtacaatctctagggatctgtaaaatctattttgtcttaaccaaagaacaaatttttgacatatcttgaataggatgactataaattatgacttttaaattgttgtaatttttgtactattatctgatatttttatttttatgtattttcgtaagtagtttagagatagtcacattttaaaaatctaagatcaagcaaatgaagcttatttttatgtattcatagtataaaagaccttcagtaaataggtaatatttttgttttattctagaaaacagctccttgaacacagtgagctggcttttcacacattgcagttgttagtgtttactgcccttgccattttaattatgaggctaaagatgtttttgacaccgcacatgtgtgttatggcttccttgatatgctctcgacagatgctgtctttgcaggtgccatgcctacaatggcaagcatcaagctgtctacacttcatcccattgtgaatcatccacattacgaagatgcagacttgagggctcggacaaaaatagtttattctacatatagtcgaaaatctgccaaagaagtaagagataaattgttggagttacatgtgaattattatgttttagaagaggcatggtgtgttgtgagaactaagtttatacttcaagatggacaagaagttctatcagctgctgagaaatgatgccagatggtaactcagatatacaagaaatactcaaatgtgctggaaatggcctggttgcagtatgcttgaaatctgggatgtggaagacccttccaatgcagctaaccctcccttatgtagcgtcctgctcgaagacgccaggccttacttcaccacagtatttcagaatagtgtgtacagagtattaaaggttaactgagaaggatactacccattttactatggcacaatgccgtgtgtcaaaaacaatcaccctttggcttattcacattaataaaaatcacaagctttaataacagacacttaaaaataagataaaaatggattggaaatttttctgattactaaaaggtaaattacttttctgttcattgaatgtcagccttattaagcttgtcatataagttattaaatcattcatgtcatactgcataaacaaatgttcatttcagaattttaaagagaaatgtatataaaagaacaatgaattttaataaatcaggggtatgtaagtcctttttcatccaactaggtgaattgcttcagattttctctagtaccagagggtacctcctcaaactctttgaaccacttaaggcagaagaatgcaagctctgaaatgacatccttaaaatgctgatactggtcacagcctctttacctctgtgaggaaattgtaacagtgtgtcttttaaggtgtttttattttaccagcccttaagaaagatctctaataccttttaatacttttttttaataatttcaagttgaagtgtttttaaaaacactttgttttgtaatgttttgaatctcttgagatgtgtttaccccactagatacatatttgccactggttagttctccatctaagctcaagaggttattcatctctctttagattccagtggcttttcttttaacatccaggtaaaacagaaactgctatggtatacaaccaagttttggggttaaacataatcagaaaagaaaatccagttaaatttatgaagtgagattttcagatcctagatcttgaataaaggaaaggtcttttcatcttgatggccccaaagcttgttggtcatggtctttatttctggccactatcttcttaaataatatatttttaagccctcatttatttttggttttgggtgaggaaagtcatgttttctaagtcctctcccctaataaaacctacccaacaatagtgctttgaaaagtggtagttatcttgaagatactcttgccaaatgcaaagataaacattctttttgtctgctttataaatatgaaatatgccagatctatagtattttaatgtgcatctactttaaatgagtcatcttggggtttttataattcccttatgttcttgcccctctacacttgaaataacaaaatgccttaattttatggattagttctcttatagtagacaggcagctatatgcagcaaaaccaataaagttatttttcaactttcatagttgtaaaatatcttataacagaatacaaaacagctaagaaaacatgccacattttattttagcattttcaaataatttgtttttggtgtaagcacaggataaaaaaggagagcgtcaaagaaaagagacataacacctaacattcataaaaattaacaaagtatattttggatgatgtttttacaggaaatattttaaataagttggtagaacttttaaaatggtactgtattagctaataaaatattcagtacaaatatatgtttggatttatgcattaaaaaactaataaaattatttccaactttaaaaaaa

SEQ ID NO: 87425 - DNA, 3126 bp, Homo sapiens
aactgggaggtcttattacagtactgtgcttctttttcaaccatggagaggccacccgtgtgatgtggacaccacctctccgtgaaagtttttcctatcctttccttgtacttcagatgtgtattttaactttgattctcaggacctcaagcaatgatagaaggcccttcattgcactctgtctttccaatgttgcttttatgcttccctggcaatttgctcagtttatactttttacacagatagcatcattatttcccatgtatgttgtgggatacattgaaccaagcaaatttcagaagatcatttatatgaacatgatttcagttacccttagtttcattttgatgtttggaaattcaatgtacttatcttcttattattcttcatctttgttaatgacgtgggcaataattctaaagagaaatgaaattcaaaaactgggagtatctaaactcaacttttggctaattcaaggtagtgcctggtggtgtggaacaatcattttgaaatttctgacatctaaaatcttaggcgtttcagaccacattcgcctgagtgatcttatagcagccagaatcttaaggtatacagattttgatactttaatatatacctgtgctcccgaatttgacttcatggaaaaagcgactccgctgagatacacaaagacattattgcttccagttgttatggtgattacatgttttatctttaaaaagactgttcgtgatatttcatatgttttagctacaaacatttatctaagacagatggagcacagggaaatgtgtcttggcattctaaaaaagaatgaatggagaaccctggacactgttcccataaggagtacatgaagggacttgggatatttaattggataatagaagattgaaggaaaacagctccttgaacacagtgagctggcttttcacacattgcagttgttagtgtttactgcccttgccattttaattatgaggctaaagatgtttttgacaccgcacatgtgtgttatggcttccttgatatgctctcgacagatgctgtctttgcaggtgccatgcctacaatggcaagcatcaagctgtctacacttcatcccattgtgaatcatccacattacgaagatgcagacttgagggctcggacaaaaatagtttattctacatatagtcgaaaatctgccaaagaagtaagagataaattgttggagttacatgtgaattattatgttttagaagaggcatggtgtgttgtgagaactaagtttatacttcaagatggacaagaagttctatcagctgctgagaaatgatgccagatggtaactcagatatacaagaaatactcaaatgtgctggaaatggcctggttgcagtatgcttgaaatctgggatgtggaagacccttccaatgcagctaaccctcccttatgtagcgtcctgctcgaagacgccaggccttacttcaccacagtatttcagaatagtgtgtacagagtattaaaggttaactgagaaggatactacccattttactatggcacaatgccgtgtgtcaaaaacaatcaccctttggcttattcacattaataaaaatcacaagctttaataacagacacttaaaaataagataaaaatggattggaaatttttctgattactaaaaggtaaattacttttctgttcattgaatgtcagccttattaagcttgtcatataagttattaaatcattcatgtcatactgcataaacaaatgttcatttcagaattttaaagagaaatgtatataaaagaacaatgaattttaataaatcaggggtatgtaagtcctttttcatccaactaggtgaattgcttcagattttctctagtaccagagggtacctcctcaaactctttgaaccacttaaggcagaagaatgcaagctctgaaatgacatccttaaaatgctgatactggtcacagcctctttacctctgtgaggaaattgtaacagtgtgtcttttaaggtgtttttattttaccagcccttaagaaagatctctaataccttttaatacttttttttaataatttcaagttgaagtgtttttaaaaacactttgttttgtaatgttttgaatctcttgagatgtgtttaccccactagatacatatttgccactggttagttctccatctaagctcaagaggttattcatctctctttagattccagtggcttttcttttaacatccaggtaaaacagaaactgctatggtatacaaccaagttttggggttaaacataatcagaaaagaaaatccagttaaatttatgaagtgagattttcagatcctagatcttgaataaaggaaaggtcttttcatcttgatggccccaaagcttgttggtcatggtctttatttctggccactatcttcttaaataatatatttttaagccctcatttatttttggttttgggtgaggaaagtcatgttttctaagtcctctcccctaataaaacctacccaacaatagtgctttgaaaagtggtagttatcttgaagatactcttgccaaatgcaaagataaacattctttttgtctgctttataaatatgaaatatgccagatctatagtattttaatgtgcatctactttaaatgagtcatcttggggtttttataattcccttatgttcttgcccctctacacttgaaataacaaaatgccttaattttatggattagttctcttatagtagacaggcagctatatgcagcaaaaccaataaagttatttttcaactttcatagttgtaaaatatcttataacagaatacaaaacagctaagaaaacatgccacattttattttagcattttcaaataatttgtttttggtgtaagcacaggataaaaaaggagagcgtcaaagaaaagagacataacacctaacattcataaaaattaacaaagtatattttggatgatgtttttacaggaaatattttaaataagttggtagaacttttaaaatggtactgtattagctaataaaatattcagtacaaatatatgtttggatttatgcattaaaaaactaataaaattatttccaactttaaaaaaa

SEQ ID NO: 87426 - DNA, 811 bp, Homo sapiens
attttaaaatcttttaaattattgtttaaatttaaagggctcggacaaaaatagtttattctacatatagtcgaaaatctgccaaagaagtaagagataaattgttggagttacatgtgaattattatgttttagaagaggcatggtgtgttgtgagaactaagtgagtattaaccctatgctatctgatatggtatatttttgagcaacaaatgtttcactttattatagtagtcctgattctttaagaatttttattttaaatttattaaaatattatcctggtaccttagtttaaattatttcatctagagacataaaactatactatcaatgaagtagaatttaattccaaacattatagtatatttaatatcctgatttttcaatttaacatcttccacttagcttttttcataatttttgaaatatttatgaaaatttttattagatatctgaaatatggatttgaatttacaacaaagtgagatattggcattctgtattatagctgaattatattggatttgtaagacttaaaagaaaagtgacaaaacccaaaatgacataaggaaaacattcctaattaaaattttttaatttctgaatttcgaatctctaaaaatcataaaattctaaggtgtgtaattgatcttatgaggcctttgtttaggctcctaagcacagatattagctgctgcacatgacaggaaattcaggcacattaattgtctcctagaatgacacattggcaatcagaagaacaaaacaggttctacagtcacttcagtatatcatttacaatgtgcca

SEQ ID NO: 87427 - DNA, 3072 bp, Homo sapiens
aactgggaggtcttattacagtactgtgcttctttttcaaccatggagaggccacccgtgtgatgtggacaccacctctccgtgaaagtttttcctatcctttccttgtacttcagatgtgtattttaactttgattctcaggacctcaagcaatgatagaaggcccttcattgcactctgtctttccaatgttgcttttatgcttccctggcaatttgctcagtttatactttttacacagatagcatcattatttcccatgtatgttgtgggatacattgaaccaagcaaatttcagaagatcatttatatgaacatgatttcagttacccttagtttcattttgatgtttggaaattcaatgtacttatcttcttattattcttcatctttgttaatgacgtgggcaataattctaaagagaaatgaaattcaaaaactgggagtatctaaactcaacttttggctaattcaaggtagtgcctggtggtgtggaacaatcattttgaaatttctgacatctaaaatcttaggcgtttcagaccacattcgcctgagtgatcttatagcagccagaatcttaaggtatacagattttgatactttaatatatacctgtgctcccgaatttgacttcatggaaaaagcgactccgctgagatacacaaagacattattgcttccagttgttatggtgattacatgttttatctttaaaaagactgttcgtgatatttcatatgttttagctacaaacatttatctaagaaaacagctccttgaacacagtgagctggcttttcacacattgcagttgttagtgtttactgcccttgccattttaattatgaggctaaagatgtttttgacaccgcacatgtgtgttatggcttccttgatatgctctcgacagctctttggctggctttttcgcagagttcgttttgagaaggttatctttggcattttaacagtgatgtcaatacaaggttatgcaaacctccgtaatcaatggagcataataggagaatttaataatttgcctcaggaagaacttttacagtggatcaaatacagtaccacatcagatgctgtctttgcaggtgccatgcctacaatggcaagcatcaagctgtctacacttcatcccattgtgaatcatccacattacgaagatgcagacttgagggctcggacaaaaatagtttattctacatatagtcgaaaatctgccaaagaagtaagagataaattgttggagttacatgtgaattattatgttttagaagaggcatggtgtgttgtgagaactaagcctggttgcagtatgcttgaaatctgggatgtggaagacccttccaatgcagctaaccctcccttatgtagcgtcctgctcgaagacgccaggccttacttcaccacagtatttcagaatagtgtgtacagagtattaaaggttaactgagaaggatactacccattttactatggcacaatgccgtgtgtcaaaaacaatcaccctttggcttattcacattaataaaaatcacaagctttaataacagacacttaaaaataagataaaaatggattggaaatttttctgattactaaaaggtaaattacttttctgttcattgaatgtcagccttattaagcttgtcatataagttattaaatcattcatgtcatactgcataaacaaatgttcatttcagaattttaaagagaaatgtatataaaagaacaatgaattttaataaatcaggggtatgtaagtcctttttcatccaactaggtgaattgcttcagattttctctagtaccagagggtacctcctcaaactctttgaaccacttaaggcagaagaatgcaagctctgaaatgacatccttaaaatgctgatactggtcacagcctctttacctctgtgaggaaattgtaacagtgtgtcttttaaggtgtttttattttaccagcccttaagaaagatctctaataccttttaatacttttttttaataatttcaagttgaagtgtttttaaaaacactttgttttgtaatgttttgaatctcttgagatgtgtttaccccactagatacatatttgccactggttagttctccatctaagctcaagaggttattcatctctctttagattccagtggcttttcttttaacatccaggtaaaacagaaactgctatggtatacaaccaagttttggggttaaacataatcagaaaagaaaatccagttaaatttatgaagtgagattttcagatcctagatcttgaataaaggaaaggtcttttcatcttgatggccccaaagcttgttggtcatggtctttatttctggccactatcttcttaaataatatatttttaagccctcatttatttttggttttgggtgaggaaagtcatgttttctaagtcctctcccctaataaaacctacccaacaatagtgctttgaaaagtggtagttatcttgaagatactcttgccaaatgcaaagataaacattctttttgtctgctttataaatatgaaatatgccagatctatagtattttaatgtgcatctactttaaatgagtcatcttggggtttttataattcccttatgttcttgcccctctacacttgaaataacaaaatgccttaattttatggattagttctcttatagtagacaggcagctatatgcagcaaaaccaataaagttatttttcaactttcatagttgtaaaatatcttataacagaatacaaaacagctaagaaaacatgccacattttattttagcattttcaaataatttgtttttggtgtaagcacaggataaaaaaggagagcgtcaaagaaaagagacataacacctaacattcataaaaattaacaaagtatattttggatgatgtttttacaggaaatattttaaataagttggtagaacttttaaaatggtactgtattagctaataaaatattcagtacaaatatatgtttggatttatgcattaaaaaactaataaaattatttccaactttaaaaaaa

SEQ ID NO: 87428 - DNA, 353 bp, Homo sapiens
cttaactttttccagttgctttatttcatgggtttctttctgaggcagctgcatcactcataaatttggatctaagttgaaatactcattaccttcttgatatagtttggaaaggtgtcctctctaaacctcatgttgaaatgtaattcccaatgttggaggtggggcctagtgggaggtgtttgggtcatgggggaggatcccttagggcttggtgccatcctcacaatagtgagtgagttcttgcaagatctggttgtttaaagcgtgtgaatatccagcctcttgctcctgccatgtgagatgcctgctccccttttccttctgctatgactggaagcttcctgaggcct

SEQ ID NO: 87429 - DNA, 445 bp, Homo sapiens
gacagaggagcttggcaaaaggtgtgagcagcctgagagaagaaccaggtagatgaacggagaagctaatgaatcatacagcatttgtcatgggactcagcttcaggctatgtcagactaaatggtgttacacacacttttctgctgagaacaattagaaagctgaattaaacaactaaactatttcaagagattgtagagctgccaagaccaccaggatgcaaggggccaagatgctgaagagaagcacatggaagtaagcctgacatccggagctgcctttcacttcaaggcataagtccctgtgtaagcaacacaggacttgattctatcctactgacctgcttgactctccttgcatcaggagcacattgaatcactaccgctgcacgtccaagggctggacggccaagatgtcaatcaaaatgaaatggcaaagagactc

SEQ ID NO: 87430 - DNA, 298 bp, Homo sapiens
cccaaacatgccccaaacttctctagggatgcctgcccgggctaccatgggctgcttccagacatgatttcaggaaggatgtgggatccacagtgtgtagctttaaggctctgtcacttacctgtcgtggataccaactatggattcagtttcttaacagtggaaatgggtgtgtgttaacatttccaaagcaattgactgtgcttcttcgtcaggtgagcacatgcagcccgtgagacccaggatgccagctgtagctttggtttgcatgaagaatgcacacgtggaaatatttggg

SEQ ID NO: 87431 - DNA, 445 bp, Homo sapiens
tccttggttctaccatgccaactttaccttctcgtccctcagtgggatgctagggcttgggttaattcatctctctccttcaaggcgacatgaagcccctgagaacaggggcatatttttgcccagccattacctacaatgatacaggagtcctgtaatattcgttagagaaatgtgtccactgaacatgaatttcctatcctgttccttctaaaaaggatgcatgagttatcctatattcccaaggcacaacatgactttgttctgatatgtgccaccgtgatcctgtagaatttgttttgtttccagtccctaagaataaatgtctcttaaagtattgtagtcattcactctacatttttatgagttattactggcccacctacaaccatatttcctccgaaattcatccatcctcctggaattacctgattctgaattatta

SEQ ID NO: 87432 - DNA, 221 bp, Homo sapiens
atggaattaggtccttcagtccatttctatgcttatttttgaatttttaaattttaatgtcacatggtcatctttaatgttgcattttctcttaatgtgaaagattaatatatttatcatctttcaagagtagctgttccagttttttaataagcagaacccttatttatgtatttcttcttatttattcaagaaaacctttttgttggatattcttttaa

SEQ ID NO: 87433 - DNA, 281 bp, Homo sapiens
atgctaccctaaaaatgtgattccttggcaaacacagagatttccttccatactgacatgtcccttagcccactggaaatgcatcaggtttgtggttcatcgggtttttgcttctcaaggcatagctcactgtgttatgtgcctaatgagacaacaaggactctagtagcgtcagactaaacaagaaactgcagctcctgtttgttaacaaggctgccactctaaaggcaaaaggacagtttccttccaaaattctgctaagcacagcaggaacctccact

SEQ ID NO: 87434 - DNA, 669 bp, Homo sapiens
ttactgtgaatattccttgacatttgtttaacaagtagaaaagtacagctacaaaccatttatgaatatattttaataggaaaatttcataaagccccaagtaatgaactctttttaattaatggtgatatttggaggataaatatatgctatctttttcttagatttttttccttccatcttcaaaattagagaaataatgataatgatgatgatgacgtgttcactttggcccccaagggtattttgatcattctaaactactacctgctaataaagatgtattttcttacgatttggagacttaatagagcaagttactacatgtagatatgtggttcccattataaacattctaacttcctccttaagtttactggagaaatgtgtttcattgaagatactatgtatgttctctcctttcaaattctgttttcttcaaagagttttccgtcctgtcaagctgctgcctttacaatatgacagtcttgatatctgacatgttgacattgataatactctttgtaacctgttaatgttgtgatcaaaagctttctggattataattgtttagtattggacacatttttttccctcagtgaaatctgaaattttcttctgtgcactaaacctcaaatgtatatattttcactaaattttgcaaactat

SEQ ID NO: 87435 - DNA, 468 bp, Homo sapiens
cttgctgagagagacatttgtaggagaaagaagataagtaggttcataccagaagggccaggactcggatggagcaaatcccagttcttgtcctacaagctgattgtgcgattgagcacaggcctctggaattgtgcagagatgagaaacaggctgaatttgcaaggccacaacatcaggttgtcatgtacccatcattacagcttatgcccagaagtcctgaccctgtgacaggttattatcttaaaaactcatcttcagcccactttttcagagaactaactctttccttagatgttgggccaggatttcactatttacccagagaaactaagagaaagtggcactaggcgtcttgtcttccagatgtgagatttcgatctttctaatgaaattgggggcactttgagactgtcagggtttgttcctgtctcagaatggctcataataaactcactgaaacactca

SEQ ID NO: 87436 - DNA, 427 bp, Homo sapiens
tccacacccctctggagataacctattgtccttgcattgaacatatgcatttgtacctctctttccttaaagaagtgactctcaaaggtggcccatagtgggagcacctgggggcattcccaacctttacacacacacacacacacacacacacacacagattttgatgcctctaccctgcattgatgtagtacactgccagttacccactgtgccagacaagtttgtggtactcaccaactcctctgtaatgtaggggctggaagactgggaactatatttcccagaatctgttgccagcaggcttctggtttaaatttcccgatgagaggcactcactgagaattggaagatagaaggggaacagacgccaaagggttccttcagcagtggtgggcagacacatttgggtttgttttgcagccgc

SEQ ID NO: 87437 - DNA, 282 bp, Homo sapiens
tgagagaaatattacctggcacatgctttaagtaacacagaaaggcaaacagccccacctgtgttaaaggacttccttgggcagatctttgccatctgactttttaaatttcactgtctctgacctttcaaagtctcatgctgggtgacactatatcttggtgcccatcctcactttctcatgaaacaggacaaagatgtaatctgatcaacatctggggctggtgtgcagttaggcgttggaaggatttgacaggaataggaagtgattatctgcaatata

SEQ ID NO: 87438 - DNA, 192 bp, Homo sapiens
gatccacccacctcggcctcccaaagttttgggattacaggcacgagccacagtgccagctgaaaacgtttcctaaacagaagtgcgcagagcatgatggagcccagcctgggcttgacatttggagagaactacagagaagtatccagactgttgttactaataaataaatacataagctccgctgaacga

SEQ ID NO: 87439 - DNA, 396 bp, Homo sapiens
cagtggcatctatggctctaaaatggaaaggaggagtcctggattcaggctactgacttactctgtgaatttacacataacttcctttgagccacagatttagcattctaccagtcacctgatatttctgagcagccacaatattttaaaactatatttaaatctgaatttggatttagcagaattttattttttccatttctattttctatggtcactaaattgaaattacaaccattgtaaaatttgatatcattaaatatgtaggactttatccagtttcaaagtaaagatgtctctaatgtaattaattgttattttcactgatgagactgaaatacaatcagtctgtattgtgtgtgcgtatgtatcagtggtaagaggctatgattagac

SEQ ID NO: 87440 - DNA, 297 bp, Homo sapiens
tgagccgagattgcaccactgcactccagcctgggcgacagagcgagactccgtctcaacaacaacaacaaaaaaaaattatggccaaatctctccaaatgtattgatattcttcagacctataattatagaaagcattacatacttagttccagaaattctccatttccattattgctggataagccatctaaaaagcacttgaagttgatgatgtatgttgtttacactcttgaaaaaacatcctctccaaatagggggaaaggttagaaatgatttgtactgcattgatcaatt

SEQ ID NO: 87441 - DNA, 372 bp, Homo sapiens
gacttcctgacaggcactgccctgctgctctgcccaaacaaattgagtggttgagagaaaggtgaagcagaccccgtctctcattctcagtgattcctgctacctgagtttcttctacccaacaacactgtcccctccatcaccattcaggcctggtgtcccgtgcctcaggagcccatgcagccctcttcacccctcctcctgcccagatggcacaggtacatctgtgcatcttccaacatcctagacaggaagttccctagggaccaaggcaattccatattggacccttcccctttagctcctttaggtaggggataaaacccgtagctcacacactgttgttggaactgtctcccttgcttctcctgc

SEQ ID NO: 87442 - DNA, 285 bp, Homo sapiens
tttaaagaatgattcatttactcaaaaacaatttaggctcaccttttcttcatgtagaagatacaatctaaacatctgctctaccttacagagaattaatgtctcatacatgccaattcagcctcactagagatctcctgtattagtctggaagtccagagaagcagaaccaaaagataggtagatactagatagacatatatgtttgaatatagataaagatataaagagatttattcgaagaaattggctcgcacagttatagaggctgaaaagtctcaagat

SEQ ID NO: 87443 - DNA, 125 bp, Homo sapiens
tagaagacttggtgtgcctcaatgtttaagaatcccatttcatttcttattaatctctcaagagcaaagaaaatcctataattcctgtcagggagtttagactggtgccttatgtggtgctgact

SEQ ID NO: 87444 - DNA, 401 bp, Homo sapiens
gtgggtaattgtatcagactctgcctcccaggtggggtttgagggttctgtgtacctggtgtaggcctgggctaaacagaagagcttctcgttagagcatctccctgtggactggctgcagagttacgatatcattctggttctgctgtgctccccactgccccttttcagctgactctttgctcataggaatacagtggtatgagatagggtcatagaatttggttccagtctaacactcttcctgtttcctgcccgcctgtatgtctctatccattagcagactcctttatgtatgatagagacacatgcacatatgcatacacggacagtccctgacttacagtgtttcatttagaatttttcaacttatgatttattgggagttagccccattgtac

SEQ ID NO: 87445 - DNA, 359 bp, Homo sapiens
aacacttggactacagaagcaactaaaatacaagatatcaaccagaatcaaatgacagtaaaagcatcatatacatcaaacctgtgggacatggccacagccatccttgaagagaaaaatgatagcttataagcattgagagtactaaaggaaaaagacttgaaaatgaataaaacaagctttctactcaagaaactagaaaaagtccacaaaacgaaccaaagaaaaaagctaaggaatgaagaaaggtaaaagcagaaatagatgaaatgtaaaacaaaacatggccaataaaacctaaagctgattctttgaaaatgcaatgaaatagacagactttctgcaggtatgatcaagaa

SEQ ID NO: 87446 - DNA, 430 bp, Homo sapiens
cctgttattattttcagcacaacagaaataggcactgtatgtgaaacacttcagtgttttaactcttaaagatttttaatgaattttatggaatcaagttaaatactaattcccaatgaaaaattctaattaattcaactctattcctcattttcaaactttttcttcaaaggcttttggtttactgagtatgagaatttaagattgttgaaagtcaataagaatgagttaaaatttaaaaacaaagatagaggccgggtgcagtggctcatgcctgtaatcccagcactttgggaggctgaggcaggcggatcacccgaggttgggagttggagaccagcctgaccaacatggggaaaccccgtctctactaaaaatacaaaattagccaggcatggtggcgcatgcctgtagtcccagctactcggga

SEQ ID NO: 87447 - DNA, 186 bp, Homo sapiens
gcgtggcatttaggaagtctgcgatgacctttgagaaagcagtttcagcataatggagcaaagtagcagagtgggtttacactactccttaaggagaatttgaagagaaaggaaagagatgggtcagtggtttgcaagacaggtaagactgaaagaaagttcttttggtggccatttttaagaata

SEQ ID NO: 87448 - DNA, 469 bp, Homo sapiens
ataggaatatgaacttatgaggccaaccccacctggggtttctggcgtgggaaggggctgcctcatcagtgcagggtcacccataagcaggcatgggcactggcagagcaggggcaccaaaagaatcccagtaccattacatgggtgatgttggctatttgatattttgaaaaacatctaaaatgtgtcattgtaggaaaaaccagaactttgctggacttctttacaggcatgtgcatgatggcattgtttcctacattaaattacgtatggaagcaccatcaactttgcagtgcccagagtctctgaagatcttaatctggccctgccgatcatggttgatggggcagtgaactcatttcatctatcatatactttcaaatatgtgtgtgtgtgtgtgggtgggtggggggttcccattatgtaataagaggtaaatgggataagaacagtttctgtgtaaatcctt

SEQ ID NO: 87449 - DNA, 417 bp, Homo sapiens
  misc_feature (314)..(314): n is a, c, g, or t
gcagtaccccaattcagggcaggctggccttgcttctcaaaacttagtagaggaggagagggcaggcaggttttctgtagtgggagcaatagacaggcatcccttccagcaaaagaaaaaaaaataaccctttcttggcagaggcagtgccttactcatctgcacagccctggagcaccaagcctagcctagcacatggtacccacatgtaacagtaacagcccacgtgtacaagctttcccaggtgccagcccccccagaagaatttcaacaatctctagggcaccaaaggtaactacacctccggggtcggngagtactcctccagcattcagaactctgacaatgacctggccgtcgtccaaggcagctcctccttctcccggaaaggctatccctccttgaagggagcccaaa

SEQ ID NO: 87450 - DNA, 585 bp, Homo sapiens
cagaagctaccactcagaacagctgactggctccaggtcacacagcccaggaggagcaacgctgggctgcctcggcgtgtgtgcagtcctgctgtccccaagggcatgtgtgcagtcctgctgtccccaaggccaggtaggggaggtgatgggggaggcagaaagagccatggagggatgtggtgtccccaggagtagggaagcccacagaagaacaggtttccttcagagatgggctggcagcctcacattcctcttatccaatttctcagaagtgtgtgtgtgtgtgtgtgtgtgtgtgtgtgtgtgtgaagttgggggggtcctcctgcctcccggtattctatctctttggggaaatggaggcagatccatagagccccaggggttgggcctccccagcagcccacgcccactgtgaggcctggatcctggcagcctgtatgctctgatcccaagtctaccctggaaattcccaggcacagcatgcctggaggtgtgagccgcctcttagaagctttataatcccggataatgctgctgtaattggcattgtttttccattacaatcctttcattacctga

SEQ ID NO: 87451 - DNA, 387 bp, Homo sapiens
gagttttccaagccctccagatgacttacatgtgtaagtcagggttgagaacagctgacatggagagtggaaggagggtggaatggtggtgtggaagcacatgggctggcagcagattcaccctggtttgaatccggctctgcccttgactggccaagtaaccttgggtgtgcagtccactatataagcctcagttttctcatccataagaacaggggataatactgcctccctcctaggattgtgaggcttagcccatttatgcctgaggttgcccttttttgaatttttgcaatcaaaccttggcaatgaccttcagcagtaggatatcaagaactcctacatgcttagcactccaataatggaatactaggtataaatgcgttt

SEQ ID NO: 87452 - DNA, 435 bp, Homo sapiens
ggggactggaaggcaggaggtggaaagaagtgcaagctatctgacggctagtcatgtcagtgtcaacccagggaaggctgttcaccccgacagcagcaactggctccagcttcctagaaaaagtcactttgacccccgtgtaggtactggctccagtacctacagatggagccctcttttcagagatctgaactcctgctccttaagcctctgctctgagcccctgaggtcccgacatcagccaggtatgtccctcattctagcttccagtttctgatagcctcaacctctttcctttgttgtctcaggtctggggggttataacctgcatgaatccttttgttccctttttgctttttcagtcctctgaaaggtgtttagcaattcttcttttttttccaagacaaggtctcactctgtcacgcaggctggagt

SEQ ID NO: 87453 - DNA, 442 bp, Homo sapiens
gatgcgatatatgcatgtaagaaatctgcacttgtaccctctaaatccatttttaaaatcgaaaaatatcaccgtaagataccgcttcacagccactggaatgactattataagcaaacaaagcaaagagcaaacaagttttggtagggcctggtgggaggtgttttcatcatgggggcaggtccttcatgggtggcttggtaccactctcatagtaatgagtgagttctccctctgaattcattgcaagagttggtcgtttaaaagagtgtggcatgtccccccaccactttctctcttcctcccactttcatcatgtgagatgcatgctcccactctaccttcctgaggctctcaccagaagcagatgctggcaccatgctttctgtacagcctgcagaatcatgaaccaattaaacctcttttctttataaattattca

SEQ ID NO: 87454 - DNA, 134 bp, Homo sapiens
tgcaagctaaggaactgaaattttgtctgaaagtatgtggtcaggtacagaagaagtaacaaaggaaacaagatcgaaattctagaaaagccattttggctgccgtgtggagggtggattacagacgagagaca

SEQ ID NO: 87455 - DNA, 228 bp, Homo sapiens
gcagaatgttaaatttacatatatatgtcaatttaaaatatatatacatttacatttatatgtgaatgtaaatatatacatacatacaagtgtgtgtgtgtgtgtgtgtgtgtgtgtgtgtgtgtccttaggacaaaatatcctataaagagtattgtactacacacagagagggcagaagaatagagcagagcatggggagctcccagaaaggctttgtgaaagcac

SEQ ID NO: 87456 - DNA, 355 bp, Homo sapiens
gggtgggatgaggttatgtgggtggtggagaacccaaggtgggatgagccacttataagacgtgaagagcccagagctccctctctcccctacatgagcacagagtgagaaagcgcctcccgcaagccagggagaaggttcccaccaggaaccccacctgccggcacgtggatctggagtatccagaacagatacatgaaggtgctgttttcagccgcccatctatggcaatgtgttacagcagcctgggtgactaagccagtcactcgtttttcctgaaagcaggcacgtgcccggcacccctgactctgagtggctactaatggggcccctgaaacctgggaaaagcagctga

SEQ ID NO: 87457 - DNA, 398 bp, Homo sapiens
cagggtcttgttatgttgcccagactggagtgcagtggctattcgcaggcatgatcccactactgatcagcgcaggagttttgacctgcttgtttccaatctgggccagttcacccctcattagtaaatctggtggtcccccttcctgggaggtcaccatactgatgctgaacttagtgtggacccccaactggcatagcacagtacagcccagaactcttggactcaagccatcctcctgccgcagcttcccaagtagttgggactacaggcacgcgccaccgtacctggcgacattcttcataaacacatttccttttgctgcttgcagtttgttattccactttcatttctttaactctcttctcaaaccacggacagttataaatccctttcag

SEQ ID NO: 87458 - DNA, 421 bp, Homo sapiens
ttctggttttaagtgctttcagaaatgaagctattgctaactatatagacagatcgatgcaggagagtagaagctctgattcaggctgtatgaatatcaccctagttgtaagtgaagaatgagctgtagaggtctgaacaggaagcaagaagatcagttagaaagccattgtgcttagttttccaggcatgaaatgaaaaggctttgcctcagggggtggcagtggagacagagaaattgagggactcagaatgtaatttggaggaagaactgagaggatttgctgatcaagggagagagagagaagaaagggtgactcttacccatttttggcttgagcaactgcatggataatggttctagggagggatggctctgaggatgtgggaggaaggagggttctgttttggccacacaatct

SEQ ID NO: 87459 - DNA, 1137 bp, Homo sapiens
gcattttggagatcttagaggctgccactcccatcataggcccatattatcaggaccttgagggcagtacacttttaagggggctggggaacccattggaccttggagggtgttttccagggatgcttcaagtttctaatccttgcatcctggtgtagtgttccttggtcaccccagatatggctcctgtgggcccaggtgctgtcctctggaaagtacaagccataaaccttggtggtgtccatatggtgctaactgcaggtatgcagtgtgcacatctgtgaaagcatggatgcctccacccagattccacggagaccctcagagccttgacagataactgccgcgggcaaagagccaccacagagagccccgactagagcaatgcctagcagtcaggggctcagtgctactcctaaaaccccagacctgtagagccaccaacatggaaagccagcttgagagagctgcaggcacccagcctcaacccttgagagcggcaatgtacactgcacatagccaagccatgagtgtagggctacccaaggtctttggggcaaataccccaccctggtgtgtcatgaactttcaggggccaggagacaaatgctgtggtttgaatcaacatcctccctgaccccctggacacacacacttcttacctaagactcaatgtgataatattaagaggtggggccttcagaggtgaataaataaagagggaagagctttattatttattaagaaatttatttattaagaaatactattatgatgtagagtagtgactttataaaaaggctggaagggactagctaggggtccttttttgcccttctatcccttctataatgtgaggacacagtgtatgtcctctccagaggacacggctttcaaggtaccagcttggaatcaaagatcaggccctcaccagacaccaagcctgctgacacctttatcttggagttgcctaaaatgacctaaatgtaagatctgaaagtataaaactgctagaagaaaacatggatatttgattggacaatgatatttggatatgacaccaaaagcctaggcaactaatgcaaaaatagacagggagagtacatcaatcttaaaaaccttatgatggcaaaaaaa

SEQ ID NO: 87460 - DNA, 148 bp, Homo sapiens
gatctaattttcaaatgcaaatcagaacaaaacaaacttataaaatcgtaataccaacaatatgactattttgtctagtgcctgattgtattttgaatatatatgtatgtatgtgtgtgtgtatatatataaacatatgtgtaaatat

SEQ ID NO: 87461 - DNA, 1005 bp, Homo sapiens
gttgctgcccagtttcacactggaagagatcctgtgcaaagatccagcggcctgctttgggttccagtaaacacaaaagtacgtactggcactctgcggattacagactcactgacaacttcatggattcatagatcaagttttgttacattgatccaaggtgaaggcacgccacagcaggttacttgtggccttgttactgtctgtaactccttgagttacagatgaaagttcagctaaagatgaaaagggctccaggcggggcaggaaaggtagcatcgtgaggccagcatctcacctatggcattttgacctaaaagagctgtatcaacagaggtaaagtgacccatacatttaccttggggttagacagcttctagttccttggactatctggaaccatgtctctttctgaaggtgccacatgcagtgaggaacctgccctggcagaggaactcgtgttcatcctctgaggccccttcgtttccaactgagccatgtgcttagcagttgggggtttcctactaatttttcggagaatgttattgtttgaaaagtgctctccacagagcatgtgattagatctttttgttacttgggtgagaatctagagctcctgtcttgccttgacagctaatattcatgcccatctattgtggtcctgtttccaaagaggaacacacaacagagtttctgtgcagtgaaacctgtgtcagacctaaaggaggcaagggctgctgaggagcttgaaatgacccttaaaagatatcaaggagaagagttgtcttcatactctcttctatctgtctgtccatctgtctattcatccattcatccatccagcattcagagcaggtctcccatattttaatgaagggaacctcatttttatttccccaagatctagagattaggaagagtgcagacagtgctgaacggctaaaaagaaacgattcacagcgaggttctccttccttccttatgggaaaccaacaaatcatagcc

SEQ ID NO: 87462 - DNA, 429 bp, Homo sapiens
agtttaactttagagacacggttactgtctgtggctttataatttgtcagtatgaaacatttgttctagaaggtttaaatgttattcctaaacacagggtgctaggctgttccgcctattcttcttcagcagtctagaacaaaagcaaattcattaacgcaacatataaagctatgatccgcggtagagctaattctcaagaaactcattaatttcctctgattacagttcagcccattttccatgttgtcacatagttaaaaacagggggaccccccttcatattacttccagaaaatgtagtttttcctgtgtacatctgattattgttctctccatgatctaaattccttaccaatattggaatatccttcttgctagtacctattgcttgtatcttcttgcttctattatttaatatcactggat

SEQ ID NO: 87463 - DNA, 218 bp, Homo sapiens
tgccgtcttatttcatctctctccgttatttggttcccctgtccttagtcccctttctcccccaatggcatcccaagatgcacaatagtggcaagtgcccagcctgtttccacagcctgatccccaccactgcgttggccagtcacccaagaagcagctggacccatcatctggctctagggatgacccagttccagcacccccgcaaacctccgtct

SEQ ID NO: 87464 - DNA, 483 bp, Homo sapiens
ctggccttcacatcttctaacttgcccttgaactatggtttcctcaacactctagagacttcctaaggtgacctcatctcctctcacagctttgaaaccaccaccaacatgcccctgctcaccagttctctatctggagtctaaacctgtctcctgagttctcagccttctagacatcttcacttaggggttccatgggaccttcaaatgctacaggttaaccaatctttcatcatccaaatatattctaccttgtacaatctagtattggttactggtattaccatccactcaaactatcattttaggagaaaatacctagtttctccttacccataaatctttacatccattgtagtccagtagactctttttcttctattgcaatgtttctcctatggattccttctgcctttgcctcacccagtgcatcatctcttgcctggttttgctgtagtctggtaactggccttcctgctagca

SEQ ID NO: 87465 - DNA, 278 bp, Homo sapiens
gtgagaaggcctaagctagcctgggcccctttcccagggggaagttcactgggagtgcagaactttaaaaatatataggagacgcctcctagaggctgtctcagttagaaaggaggagaattggcatttctaccccaaggggaacctccagacaggtggggcaacagagcccccatcttcagtgagccaagaggaaaacagtcccctaccctctgccctcaaagattcctgagaggaaacccctgtcctccagagctttacaatctaatctaaacaaa

SEQ ID NO: 87466 - DNA, 428 bp, Homo sapiens
tctactaccctgtgcaagacccccctcctctatgagctttcctgttcatgctaatcctgagaacttcccattccacaggtttctgcagctctaatgtgggtcctacagtcacatcctaccttattttacaggtagttattgcataactgctatttgcaaatatatgtcagattgaaataaatgacaatacttacatgcaaagatgctcagggcaatattatttataatcacgaaaaattgtaaacaaaatatccagtagaagattaaactgtgcagacctcctaaacaatagtttataacatataaaatgttcacatgctgtcaagtggaaaaagtaaacaacaattctatttgcatgttttgtaaaaaccaaaaacaaaagattggaagaaaacatattgaaaagttagaatgggtatctttgggtg

SEQ ID NO: 87467 - DNA, 605 bp, Homo sapiens
taaatgtttgttgaatgccttcttgttgaaatccttctcacactaaaacagttcaccttaaacactactttcttcatgaaaatcttaacggccctcatccacaggtctttctccttccttttctagtccttatggcacttaaacctttcactgctgtgtatcatggccatgcgtaagtgtctcattcttctgtgagcctgtaagctggcagaaatgtttctttctttgcttttgtgtctgttgcagtatctcaaacaatctccccaccccacccccaacagcagatacctaataaatgtttgactttaaccactgtaactctaattctggaattccactttgttcttctttatggattctttgcttaggaaaggtaacacttcccccctccattagcacagtagtgtttcttagattttaaatatccaaagctaatgggtgggtgaatgaatgagcccctgaacaatgtctcttcccaaactgccaaacaaagtgccacaatggtccttggtcttatggtcatcagttagggaacaaaagcgtgtgatcggaagttgtaaaaataataataaatgaagctttataaaaaaattaaaatgtctcac

SEQ ID NO: 87468 - DNA, 318 bp, Homo sapiens
tgaaatttttataccgtcaacattcatgcaaaaaaaaaaactattgagggcctttttttctgccatacatttgaattgacttcaaacttcttaatttcttttagtcacttaaaggtttttcacattttcgtggcccaagcataaagatcacctatctgcaggattcaagacacccaatcatttgagtagttctgataggactgctttacagatacgttagcagaggcctttcaaaaagggagtgtttttgtatgttagaagatactataaagccaacaagcaaatatttgcaacttatatgaaaaagaacaaatgaga

SEQ ID NO: 87469 - DNA, 798 bp, Homo sapiens
agttagtccccattttcatcaggaaaccgagtctctgagaacataagtaacttgcccaagatcacaaacccaggtggatgttagagcctgtgctcttaaccactacactgtagaaagaagaattaagtggcaaatttttagataagccttccagcttcttttaaatagagccttcagatccagttcagctgctgaagaagttcccacctttccaagggccctgttgtctatgatgggcatccttttgggtgacaagttcaaaaccttcacagaattttccccagagggcattattttaaaggtgcccaggctgttgggggctttatttctttagtgctgtgttttaggattaaagtagctttatttagcaagtttcaaattaatatatttgaattaaagggaggcagtaaaggagtagaaattatacttaaatacttagtacatgtcgtcagcccacaattcttatttctacagacttagagtatattttaccgaaaagttagtgcccaggtgttagggtagctctggaaaaggcatatctgaaccaaggactaaacaaaatagggagcacttaaaatattttattaatttcctcctttgaagatcataacaaatctgctgcattcccatccatctcaaataaagcaaacccgattaataagcactgtgagccccgtgaggaagagcagaacaacccagacaccaaggattgtgctgataaatgtttaatgactggctttctgggagggagaaagccctggtttgtgcatttgccaattcccatgatgaaaaaatccc

SEQ ID NO: 87470 - DNA, 562 bp, Homo sapiens
ttgtacctttataagaatgtcatagaaattaattgagataatgtaggtaaagttcttagcatgtggcctggctacagaaagctttaataattcactgttatcttagttatattagtagtaatagctgcttgatattacacatctgcccttctgggctgtaattttctccagagtaaggactcagttttgtttatctctacgtgctcccctagcatagggcctgtcatgaatgaggtactctgaataattattggattgaataaagcagtcaaataaattttttcaatcaaaaagttgttttcccagtgactaaacttaagctcacagaggttacctgaactggttttaaacagctgctattaatcagtctcatagattatatcatttaatctttaggcaacttgatgaaaggttcaaataaagccccaggattcaaacctacatctgtgagtcatgagatcaaaacttttccacaaaattttcctgcctctttacaaaatatataagaattctttcttggtcaattactaatagataattactttttgagttataaggtgaa

SEQ ID NO: 87471 - DNA, 649 bp, Homo sapiens
cctaacttttacatacatattagattaatttgagcctacataaaaagaaaacaaatttgtgaggatttgaggggggaaaatcaggggacttcctgtttgcagctcttatcattgggagaacagtaaattagatctagactaatatatttggtttctctaatttatggcaatttgttaactttgtcattgagtggaatgctgaacaaaatttctatggcacataagcaccttgcacagggttcgctttaattctttgagaagctttcaggcatagactatttagtatactgattaaagtatgattaattattaattagtatcttgtcctgtgagaatgcctttagcttcaataggttcatctttacttgaaaataatggaaagctgggtgcagtggctctcgcctactgagtggtgagaggatcacttgaggccaggagtggaagaccaacctaggcaacatagcaagacctcgactctacaaaaattttttttaattagccaggtatggtggtgcacgcctgtagtcccatctactcagaaggctgcggtggaaggatcacttgagcgcaggagttcaggggtcagcagtgaggttcagttgtgtcactgcacttcatcctgggccacaaaatgagaacctgtctttaa

SEQ ID NO: 87472 - DNA, 209 bp, Homo sapiens
caacataatttctaatagcaaaattggtattcaaacattaaacggaggcatcttgagaaattaaacattttttgaagaagagttaacattgcttgcctcatttctgacccacagttttagctatgtttttatgcatggaacagatttccaagtgtggaaatgaattctttgacacagacatagacttagattcatgcagggccagtaac

SEQ ID NO: 87473 - DNA, 637 bp, Homo sapiens
atatatataattttttttttttgagatgcagtctccctctgccgcccaggctggagtgcagtggcaacattactgttcactgcagcctcgactatctgctctcaaccaaacctcccacctcagcttcctgagtagctgtgactgcaggcgcacaccaccatacccggctaatttttgtattttttgtagagtgggggtttcaccatattgctctggctggtctccaactccagagctcaagtgatccactcatctcggcctccaaaagtgttgggattacaggtgtgagccactgcacctggctgtttttttatatttctatgatgtcagtaaactccccttcattcctctccttctcacatcttgaaaaaaggcttctacagaccacagaggccttggtgtgagtggtgggtttggatgtagtttttatggtatatgtgtggaaaatagagggaaggagctgagttttgcttttaggttgacactaagataaaaacaaagagccataccttcagaatggagacacaggatttaggagcagcaggaagctgaagtcagaggggaccataaaatggcaactccccatgtattcacggaaattttgcgcagggcaagtagactgttccaaagggggaaa

SEQ ID NO: 87474 - DNA, 280 bp, Homo sapiens
gcagcccgcactgttattacacatctggtaaatcacctgggccattatccaatgagcggtggtcctgctatgctaacaagtcaggtgtgtgaaaatcacgacaatcattacagtgaaagtactgaactttctcctgaactctttgagagtccaaatatccagttctttgtgttaataatacaaccttagtgtcctgtatccagatcagatcagaagagaatatgcctggaggaggtttatctgctggccttgcatcagccaattcaaatgtcagaatcat

SEQ ID NO: 87475 - DNA, 596 bp, Homo sapiens
ggggggtatgaaataagacctgttttcccctaactaaatcttatgcagaaccccgctgtgtaaagcagatgcaagctgagagactagagctctcccactcatctcctgttacctctcggcgtctccgaggacgcaagggctccagagcctggagcttgaaaacaggtgtgctaggtgattgctacctccatttcccttcttcattaaacaaatctatgagtcttctccagttctctcaatccatttttactgggacgagagttgtcagttttaacttctgtgttaactttaatttatgtgtggtatagaaggatgttttgagagagaaactgatgcgcttaagtcatcatctaacattgtttgggtaactattccaggtgtgcttacacttaccagtttgacattggttatttgtcttatgattgtgtctgtcatcgaaggcataactgattgattacaacaggaaagaagggtagataacaggagagtttaaagataagtgtcattagtaatatactctgtgtgtagatcaatgatgttctggagcattcatgattaccgtatgccttacgggactaagtggacctcatttgctt

SEQ ID NO: 87476 - DNA, 542 bp, Homo sapiens
ggggggtatgaaataagacctgttttcccctaactaaatcttatgcagaaccccgctgtgtaaagcagatgcaagctgagagactagagctctcccactcatctcctgttacctctcggcgtctccgaggacgcaagggctccagagcctggagcttgtctatgagtcttctccagttctctcaatccatttttactgggacgagagttgtcagttttaacttctgtgttaactttaatttatgtgtggtatagaaggatgttttgagagagaaactgatgcgcttaagtcatcatctaacattgtttgggtaactattccaggtgtgcttacacttaccagtttgacattggttatttgtcttatgattgtgtctgtcatcgaaggcataactgattgattacaacaggaaagaagggtagataacaggagagtttaaagataagtgtcattagtaatatactctgtgtgtagatcaatgatgttctggagcattcatgattaccgtatgccttacgggactaagtggacctcatttgctt

SEQ ID NO: 87477 - DNA, 1034 bp, Homo sapiens
gtcatagctgactcttgaggataaaacgacagcacactgaaacacacacagtcaaaaattcacatgtaacttttgactcctccaaaactttactataacctattgtttaccagaagccttaccaataacataaacagttgattaacacgtattttgtatatgtatgtattgtgtactgtattcttacagcaaagtaagctagagaaaagaaactgttactaagaaaatcataaggaaagaaaatatatttactattaagtggatcattataaaggttttcatacttgttatgtttgcattaagtaggctaaaggggaggagtaataggaggattttcatcttgctgtctaagaggtgacagaggtggaagaaaatctgtgtataaatggacccacacagttaaaatctgtgttgttcaagggtcaattgtacttaattttttgattgtttttaaatttttaaatagataatacattgatgtacaaaactcaaaagttacaaaagggtttgcaatgaaaaggaagtccctctttcacccttatttcagtcacaggtgttgctttcagttctttttatatttttactggggtagctgctgcacctacaaacaaacatatttgcctcattcttttttagcagctacttagtaggcaattgattcgttggattctgtgttattaaatattcccctgttggtcaacatttgggtagtttcttgctgttgaaaacattgctgtagagaatattctgtgatatatatcactatgcacttgtctaaatatagccagtagttttataattcctagaaatagaaagtgcatctaaatattttttgtagatgttgccaaatttccctctagagaaaggtgtgtttgctaatttataatcttacaggctctgtaagagactgttttttcctcctgtgccttcaacgataccatgtgttattaaactttttgatcattccaaattaacagcgaaaatttataactcattatagttttaacttgcacttctcttatgggtgagggtga

SEQ ID NO: 87478 - DNA, 999 bp, Homo sapiens
cagtgaacacacacagatgaacatagatatttcacgagtgaaaactccagacctttactataacctattgtttaccagaagccttaccaataacataaacagttgattaacacgtattttgtatatgtatgtattgtgtactgtattcttacagcaaagtaagctagagaaaagaaactgttactaagaaaatcataaggaaagaaaatatatttactattaagtggatcattataaaggttttcatacttgttatgtttgcattaagtaggctaaaggggaggagtaataggaggattttcatcttgctgtctaagaggtgacagaggtggaagaaaatctgtgtataaatggacccacacagttaaaatctgtgttgttcaagggtcaattgtacttaattttttgattgtttttaaatttttaaatagataatacattgatgtacaaaactcaaaagttacaaaagggtttgcaatgaaaaggaagtccctctttcacccttatttcagtcacaggtgttgctttcagttctttttatatttttactggggtagctgctgcacctacaaacaaacatatttgcctcattcttttttagcagctacttagtaggcaattgattcgttggattctgtgttattaaatattcccctgttggtcaacatttgggtagtttcttgctgttgaaaacattgctgtagagaatattctgtgatatatatcactatgcacttgtctaaatatagccagtagttttataattcctagaaatagaaagtgcatctaaatattttttgtagatgttgccaaatttccctctagagaaaggtgtgtttgctaatttataatcttacaggctctgtaagagactgttttttcctcctgtgccttcaacgataccatgtgttattaaactttttgatcattccaaattaacagcgaaaatttataactcattatagttttaacttgcacttctcttatgggtgagggtga

SEQ ID NO: 87479 - DNA, 870 bp, Homo sapiens
tgctgggattacaggtgtgagccaccgtgcccagcctgcatgttgtaatttattaaatgctttttcaacatctgatgagatgattgtatagtttttcccattattctattaatatggtgtctaacactgattgcttttcatatattaaaccagtagctgttggattttgtctgattccagatgacctatgctacctcctagaggagtaaataacattttccacttctgacatttgtggggttttttaatcaattctgaattttatttttgtttacatgagtatagggctctaattttatttttttcccaaaacttcctttgaatattattctagatcttactctgttccactggtctaattgtatacttttctgctaacatggaattattgtatagttgacccttgaacaacaaggggattgggatgccacctttgcaacacacacagtcaaaaattcacatgtaacttttgactcctccaaaactttactataacctattgtttaccagaagccttaccaataacataaacagttgattaacacgtattttgtatatgtatgtattgtgtactgtattcttacagcaaagtaagctagagaaaagaaactgttactaagaaaatcataaggaaagaaaatatatttactattaagtggatcattataaaggttttcatacttgttatgtttgcattaagtaggctaaaggggaggagtaataggaggattttcatcttgctgtctaagaggtgacagaggtggaagaaaatctgtgtataaatggacccacacagttaaaatctgtgttgttcaagggtcaattgtacttaattttttgattgtttttaaatttttaaatagataatac

SEQ ID NO: 87480 - DNA, 379 bp, Homo sapiens
ggggaagggcgccaacaaatgctgagcacttagtagtgccatgtactttactcctcacatgaatcctagtgatgctgcgagaggaatattattttacccacatcttctatatgaggactctcaggctcagagaagttaagtaattaactccaaatcaaacaaagggtaagtgataaagctgggatgccaacccatgcctgtttggctccatatctcacagtctccctccacgatacaacagtgttttccaaagcaatgataggggagaaactctgagcacagactcctggggtagggctccttctacccttttcttgcaaattattgatgctttatgacattgtaagcaaataccatcatcaactgcacatcttcccat

SEQ ID NO: 87481 - DNA, 359 bp, Homo sapiens
tagagatttatacttctgaagaaaatgctaacttaggtaaataactattcccccatgcacactccttgttgcccttcaactgtcaatcagaattacccaaggaaaataaaaatggcaaaatctacataatcactggaaggtaagatagggtgggcaatccataagccacaaacttcaaagaatgaggtcgctttgaagggtttcatctctatcaatatatgatgactttctatgccttgcttagctggaactctacttgtctatatgaatactgccactttggctttcttttttctttcttttatctcccttcttccctccctccctctcttccttttttcctcacttcctccttcctt

SEQ ID NO: 87482 - DNA, 341 bp, Homo sapiens
tcaatgacaacttttaaagatcccatgactggtcacagtgagaactctcttttgcagtcatcctttgcaatgataatatatgcctgtaaactaaggctttaattttttttttttttgagatgaggtctcactctgttgcccagtctagagtgcagcagtttagtcatagctcactgcagcccgaacttctgggctcaagcgatcctccttccatgcctgagtagctgggactacaggcatgtgccatcatgcctagctagtttatcgttattattttttgtagagacagggtctcactatgttgcccaggctggtctcagactcttggcctcaagggattc

SEQ ID NO: 87483 - DNA, 636 bp, Homo sapiens
gatgcttgaaaggataagaaagtctgaattagaggcagctgactttgttttgagaggcgatttttagctttaatgggaaaatactggaaactaaacacacttttgaccaatttatataaccttgctacatataaatttatatgagtaaatgattcagcataacctttttttacaagtaagacttttatgggacatttgaagctgattttaaatgtcagattatttaatcacatctgaattcaaattctaaactaaattgtttctaatatgtaagatcatttctttataatcataatacttgtcctcccctcctttttgtttccctcctgctttttagtttttaactagtaatgagaagaggaggtaatgttgttaccaaagagcaaagtctagttctttggacttaatttgcatgacaagtttttgctcactgtaattagaatttagttaaataaatgtcattttccttaatgttatctatgtttagctcatggaaaaaaaaatgttcttgagcactgggcccctgtgaaaatatacaagttgagtatccctaatctgaaaatctgaaatccaacatgttccaaaatccaaaaccttttcggtgccaacatgatgcacaaagaaaatgcttagtgg

SEQ ID NO: 87484 - DNA, 403 bp, Homo sapiens
gcgtctaaccttctgtctgcgtcgaccttcgctctgcgtcgaccttctgctctgcgtcgaccttcgctctgcgtcgaccttctgctctgcgtcgaccttctgctctgcgtcgaccttcgctctgcgtcgaccttctgccctttgtaatgataagtcaacatgagagtcttcatagagatgatgcagctgaatcccacgtcgtttactaaacaattcagctaagtagccctcaggtctggatggactctaaggacaggcagcatacgatacggaggcctcccggaatcctgcagccccaagtcacccaaccttcccactggctaaagagagaaaggagacacactctattgtcaatttcacccccaaagctttatctatgttcctaggagaagtcacatctata

SEQ ID NO: 87485 - DNA, 495 bp, Homo sapiens
actccatctcaaaaagaaaaaaaagccaaagttttaattttggtgaagtccaatttatcatttgtttcttttgtctgtaccttttttgtattatctaagaaacccttgtctaccccaaggttgcacagacttgcttttcttgtatcactttatgtttttacaggacaatgtagccaaggattacttgtttgatttaaaatttactttttaaaagtaggaacaaccttctttaaaaaatgggttttacaagagtccacagtgtgtggttacattttgacaaagtacaacgagcaaaatcagcgttgttagaagtcaagagagtggccacctgggggagggcagaggtgcgagtggcttctgggagctggggatgttctctttcttgatttgggttctggttacctgtatgtgtttaatttggagaaatgtatctagttgcaaactttttttttttttttttgagacacagttttactcttttgcccaggctggagt

SEQ ID NO: 87486 - DNA, 615 bp, Homo sapiens
cttgctacttggaaagctgggaggaaggctctgtttgagctcagaccaagactgcagtgaaccagaatcccgctactgcactccagctaagtgacaaagcaagaccctgtttttttttgttgttgttgttgtttttttttttttgagacgaagtctcgctctgtcgcccaggctggagggcaatggcactatctcagctcactgcaacctccgcctccggggttcaagcaattctcctgcctcagcctcctgagtagctgggattacaggcgcctgccaccccgcccagctaattcttgtatttttagtagagatagggtttcatcatgttggtcagggtggtctcgaacccctgacctcgtgatccacccgcctcggcctcccaaagtgctgggattacaggcctgagccactgcgcccggccaagaccccgtctcttaaaaaaaggaagaagaaactaaatcagattttcaaagtacagaacatagaaattatttacctggggccgacgcggtggctcacgccccagcacttcgggaggccaaagtgggtggaccacctgaggtcaggagttcaagaccagcctggccaacatagtgaaaccccatctctact

SEQ ID NO: 87487 - DNA, 756 bp, Homo sapiens
  misc_feature (20)..(20): n is a, c, g, or t
tgcaggctgtcggcccggangtatggatcccttggcctggccctcgagcagcgatgctggggtctcagcccagtacccaaatctcccagactgtgggggaggcagagccagaccctgaccctcccagccagaagaatagggctggggtcagagagagggacctaggacctgcctgaggaagactatatggagaaatggggcacacagctggggtcttgcaggatgagtaggagttcaccagacagagacagagaaactacgtgaaggcctgggaatgaacttggttttcccccaggggtgacagggagccatgggagggtttagagcaggggaggggcagggtgagatctggggcttggggtgggggtagctgctggccccagagccagcaggctttgtttacccctcactgtttatacctaggcaggcaaacttccctggcgtctgggcccacccgcagacaagacatagaaagatacaagattaggagccctggaatgcgtgttctcgcggtgcacatggagtgggggaggagccaggccagggctagggacctaaagtgcccccagtctccatccgcagccccagcggccccctgcccctctccagggcgggctgggatgctgggtgtgggcgtctctccctcctctttccctcccacctgcctctcctttctttcctgccctcagctgtctcttgctgtctcccccctttgtctgtctctgccactcccctatctctttgtctccgtgtccc

SEQ ID NO: 87488 - DNA, 439 bp, Homo sapiens
ctgggattacaggcacatgccaccatgcctggctaatttttgtatttttagtagagacggggtttcaccatattggccaggctggtctcgaactcctgaccttgtgatccgcctgccttggccttgcaaagtgctggtattacaggcatgagccaatgtgcctggcctggagcatgtattcttttatgagtggtccttcttctgtggcactgtacacagtgctaagggaagacttttctgtctttccttctacactcccagattctcactgggctaggtgtcccttttataagctcccatttaactctatgctgttattgttgcctctacacttacccctttcaaagtatgaccccttgtacttaaaaacagacctttttaggtttagctgtgtcttgatccaaagaaccacacttaccagagtatgttagttttagag

SEQ ID NO: 87489 - DNA, 427 bp, Homo sapiens
agcttcaaataacaggctgcttctcttgttaggggctaatacaactgatgatgagtttaagttgaagccaatactcatttaacactctggaaattgtagggcccttcagaattacgctaaatctactttgtctgtgctccagaaatgcaacaaagtctggatgacaacacatctgtacacagcatggtttactgaatattttaagcccatagttgagacgtacggctcaggaagaaaaaatattactgatcattgacaatgcacctggtcacccaagaactctaacagagattgctgctttcatacctgttaacacaaaatccattctgcagcccatggatcaaggagtcactttgactttcaagtcttattaccttagaaatacatttcaaagactgtagctgccacagacagtgattcctctgaa

SEQ ID NO: 87490 - DNA, 358 bp, Homo sapiens
ctcagaggatcccatccccggtggtgggtattcggggaggttgaacacagtggcgggatttggggaggttgcacacagtgggggggatttggggaggttgcacagattgcgggggatttggggagattacacagagtgatggggatttggggaggttgcacagagtggtggggatttgaggaggttgcatacatttggttggatttatggaggttgcacagaaaggagatctggggaggttgcacacagtggggggggggatttggggaggtttcacaaagctaggggcatttgaggagaatgcacacagtggggcgatttggggacgttgcacacactgggggggatttgaggaggc

SEQ ID NO: 87491 - DNA, 506 bp, Homo sapiens
ctgcctgctccaagcactgccactgtgtaataggacaaccataggttgacaggtacccaacagagtacggatcagcactgcccaactctgggacgtgccattctaccatatccacaaggccagtgtgaatgccaagccacagaagacagcagagcatgggctgagtcgtcagtgggcaggaacagggcttcccctacagaagcccgggctgcagccctcccagtggtgttcaggcccctcaggcacaccagcaagaccgtactctttccccactaggccaccgaagagaaccctggaagggagcagggcgtgtgtgaggtctctggtttgctgtttgactccttctggcattcagttccatccctctcctcccacccctccccaaattccacttacttcaatatctccattcaaatgcctgcttctcttctaagagaggcatattgccccaccctctccttccccacttacagagagctctatcagaatttacccccacgttctct

SEQ ID NO: 87492 - DNA, 368 bp, Homo sapiens
gtagttatcaaacatcaatatttggcatggattggcgaaatggatatggggggaagaaaggagtctgaccatttctgtaaagggtaaaaccttgagcaaacagactgcatttcttattaggggcactaaagagcagagatgcatttcagaagggaccactcggactgcaccccaacaggctttgtgaaaccaatgatctgggctcaaaattagattctggattacatcaggaaagccagctaccttcagaggataggggatgggagggagagttaagcagtgtatctcacaactgttagccctacaactattacagggcttgcagccttgtaacagacaactccagcactcaaactggacagagctga

SEQ ID NO: 87493 - DNA, 543 bp, Homo sapiens
attgaattcatgcaaactttgatttctatcctaaaatgtctccatgtttataaattttaaaattacaagttatctttgcctccctcctacccctactgtatgaagctgtactgtttttttgtttgtttgttttaatcagtggcttcatagtagccctttcacagagctgggtgctattttacttcagaggcagggttttaaaaccttgaaagtcccttctagcacttttaagacctgatgtgaaaatggagtcgtatacaacacaattaggaggtaactttgttccagggaggggttctgagatgccattatgtcaaagcacttcatgccttctcactgctgcacagtaagcgcgactggctgtgcccatattttgttttgttttgttttgttttgagaaagggtctcactctgtcacccaggttggagtgcagtggcgtgatcttggctcactgcagccttgacctcccaggctcaagcaatcttcccacctcagccttcgagtatctgggactacaggtgtgcactgccatgcccagctaa

SEQ ID NO: 87494 - DNA, 941 bp, Homo sapiens
cctttcaatagagcagtctttcccgctcttctgttctgagaatgcacccggaatgggggaaacccagcaagcagcagagagaaaggctcttcccgggagacctgccgcctctagggtggtcagagaatagcagctgggattttggagagggagaggataggtaaagcagcgtattgaagcatttgcggaggggtgtattagtcctcccaccctgagcacaccaggacggggatgcatccttgccttgtgtgcttgtaaaggcttctttcccttggtatagcaacttcaactgcacctgaacctccaacctctgcccagcctctggtgcagggtggatagaggtctagccagcccttacttcctgaagagagctctgtgggaaactcgaggctacagtagcttcccggctcccagctcctaccctacccccaccaaagcagaaacgggagacggcaacgttctggctgccattagacttacgtctccctcccctacgtcccctagcttcccaagacaggaagaaatgtgcaaaaggcccctccggagaaaactattttgccgttcagctgttctttacagaggatgttattttagtgagacccaggtcctagaccttctgattcctatttatttttttaacagactagtctcaaagtacagcacaaaatctcttctctgccttctcttgtgatgttccagagagcatctgtggttgtgatttggaataagtcatatttatttggtttactgtgcctattcagatctctgtatgttgtgtgtgtttctgtgtcctggaattggatgcgtgggactcgttctgtccgcggagtgcactctttttttcagtgtggcccacatatcttgtaaatgtttgctgaagagttgtgtctatatatagagaaaatatatataaacagagaaatatgtgaatctgttttttt

SEQ ID NO: 87495 - DNA, 393 bp, Homo sapiens
gacggaacgtcctgggattacggaagcgtcacttggatgaggaacgtcactgggatgagaacgtcactgggatgaggaacgtcactttcaacctagaaatcactgtacagctccaataagacatgatcttatttggcaatttcagttaaaaagacagcaagaaacaaaaaaattggtggaaaaagtgatttctcatttcctttcatgtcctataactaaagattagatgtaaagtgttaagacctcagcacaaggaaaccaaaagcttgtgtttgtgcaccaagtctgccacttaatagctctataacctttggtgagtaacttaacctctctcagcctctgcttcctcacctgtaaaatgagaccaatgagaccaatttgtacagtctcatt

SEQ ID NO: 87496 - DNA, 229 bp, Homo sapiens
tggtaagagtgaagccagcagagagagcttggaaaagagaattcagacccatcttcaagttaacaaaaacaattactgactcatacgaagaaatcgggaaagtcaataaaacggatgcttctaaacctgttgatgaagtttttctgaagttgtgaaaatttccaacaaaaaagactaactctaagcctgaaagtatcctttcctttctttttgagccattgcactccgg

SEQ ID NO: 87497 - DNA, 435 bp, Homo sapiens
aggccacacgaatatcaaaaactcagtgagcgacaggtactagaactgatgctgaagaaaattcagggcttttggtactgcttttgagacttccattctggatctttccaaccctttggagtaagaggatggggccatgtggtgtgattgacaagtctttgtgagtcagttaaaggctacagcagctggaagatagagtgtaggtttatctagagcaagactggcaaaccacagtccatgagccaaattcagctcaccttctgttgtggtaaataaagttttattagaacacagccatatgtttctccccacaatggctgagttgagtcactgagacagagaccatatggcccccaatgtctaaaacatcgccatctggccctttacaggaaaggtttgctgagtcctgttccagcccaggtgtgtcctgggcaa

SEQ ID NO: 87498 - DNA, 452 bp, Homo sapiens
acatttcagttttaaaatgcatgctcaccacaggggccctgctcagccacggtctggctgtccccacagcgcctggagactagcccaggcgctccagatggctccatggagacttttttccatgattctcctgtaagatcaacaacaacaacacatttcacaaaccacactttttgactgcacatagaaataaattttgtcacattcctttttcttcaacaaagatgagtgtcacttcaatttcagtttttcttcaatttttcaattttcaatttttttgagcactagagagctagaaatctagaaaacataataaatccctataactttcctttgtagatgaaaggtatttagcaatgcagtctccatgttatagttttataatgttagattttgttagaatagtttgaaaagttgctccacttaatgaattattagattacgtatatacc

SEQ ID NO: 87499 - DNA, 1160 bp, Homo sapiens
cgctactcttatcccctgaggattagaggctgggagaagtatatatgagagtcatatggagattaaatacctgaagtcatgaggagatgatgcactctccaagagagctttgatgacagcctatttatgcagcttctgtcatctgtacacattctcctctttctgtcaacaaagagtttttcttttgcaattgtaaatgtcctctgttttcagagacttttgttggaaaacaaaacaaaatcttgagacatgaaggatctgtaatggacacctgtcgattgtgtctgttcagcagctcctctcccacctgtcttccagtacaacaccttatttcattggagagaaaggttctacctcttctccttaaggttttagtggacagccaaaccagtcttcagtctacagggtgagtatgagatccaggcttgaccaaccatagtcaccacccacttggctacatcaaattgagccagaaagagcctttccctgggaatttatatgtagactttgggaaaaggaagctttcttctctgatgttactagacagcgatgacaaaaccagtgcttgtctggaccatgctccacttcctctccacagcaagatgagcaagctcatctgtagtaggaaagaatgtaggaatgcatcccctgcacagagaaaagcggaggagagaatgagagagagagagagagagagagagagagagagagagagagagagatctgactgtactgctaagtccctgcaatccccaccaaggtctgcaaggtctacttcccctagactacaactacccattacttgtgccaaatattcaataaatcgtaaccttagcagggagagggatgaagagagattgattaatgggtatgtatatacagtatgatagaagaaataagacctagtatttcatcagtcagtagtatgactatagtttacaataatctattgtatatttcaatatagctagaagagaagaattagaatgtttctagcataaagaaaacacaaatatttaaggtgatgggaatctcagttacactgattttatctttacaaggcatatgaatgttttaaattgtcatagtacccccaaaatatgtacatgttatgtatcaataaaacacaaaattaaaaaataaatatttaaacaatcata

SEQ ID NO: 87500 - DNA, 487 bp, Homo sapiens
tcactgcaacctccgcctccctggttcaagagattctcctgcctcagcctcccgagtagctgggactacaggcacatgccaccacactcagctaatttttatgtttttagtagagacagggttttcacatgttggccaggatggtatcgatctcttgaccttgtgatttgcctgacttggcctcccaaagggctgggattataggcgtgagccaccacgcccgaccctaactttttactttgaagtatttcaaacctaagaaaagttcaaaataatacaatcaatattcattcctgtaatctagactcaccagttgttaatatgttgctttttctctctgtatataaatacatattttgggctggacagggtggttcatgcctgtaatcccagtgttttgggaggctgaggcagaaggattgcttgaggcctggagttcaagaccagcctgagcaacatcaagagacttcgtctctaacaaaaatac

SEQ ID NO: 87501 - DNA, 321 bp, Homo sapiens
gcaagatccagttccaaatcaggctaacctgtgctctctttgtatcttttacacctttctttgatggcatgacttacactgtgctgtgaataagataggctttttgccttcaaaggattcacagtctggcaggctgacaaatagctatgttgcagtcttcaaatctagggctcactcttaggctccacacttcggtgtggtaaaaattcaaatagtattatcaaagcaggtaatgaaaagtttcccttctctaaaatcagagcttctgctatgttgcacagttccaggggacactgttgccattatggtctagatatgtgg

SEQ ID NO: 87502 - DNA, 288 bp, Homo sapiens
tgttgttgcagtttgtactgaaagtccttaaatgagcaaagcgaattggacaaacatttatttcaacattacttcttaaataaaactagaagccttatcaaaccttgatttagctttacaaatgttttgtaaacaaataccaagcttattgtataacaagagaaaactaaaactcagcccctcctaagagcagggaatggtctctcacaatctacgccagtcgctgggtgatggcagcacgctgctggcctcttccctcttgcccctgcttccgcagacacacaggtg

SEQ ID NO: 87503 - DNA, 285 bp, Homo sapiens
atcagtccaatgcagattagtatcactttgctcataaaagagagtataaaggttcttgaagtttttgaaaggagcggcttagctgactgttaaggaagctatcttttgtctacaagaaatttatactttttccttctaaatttcacaaacagaatattattagagacaacagaatacatttacaaaaatggcatcagaaataattgaatacattgtgtacaatatcttctattaatgaaataaatgtatattttatatgatatttggtctttatgaaaaaataat

SEQ ID NO: 87504 - DNA, 424 bp, Homo sapiens
tttggtatgtgtgtagggtcatttccagtgttgatcatcttgagcatgttcaatgacagttcaagatggggtaaaagagttcatttccacattcaaataatagagattaaatattataataatatttgctatatccaataaatctatgattaactaaaagtgcttgctttttagcttttcttgatacagctctaaatgaactggaaaccataaaattaccccccaaacggttgcagaattagctcatgttctattgtcaaatcaacattaattagcctcgattctcatttttaaacaatgtaaaagatttttctatcaaatcaagatggcctaacttcaccacattatcttgtgactcatttttagtattatagggcagaatttttagcctcttctcagaagtctacatgctttttcctcgtgc

SEQ ID NO: 87505 - DNA, 430 bp, Homo sapiens
aaaaagactccgtctaaaaaatataaagggcgcccactgtctactgtcagtaggatgggcgggcccattgctgcccaatctgattttcttccccaagagaaacaggaaatctgaatttttacataaaatagccccatttttaaacgtggacaccatggccaggcacagcggttcacgcctgtaatcccaacactttaggaggccaagcgggaaaatcacctgaagttcaagaccagtctggccaacatggtgaaacctcatctctagtaaaaatacaaaaattagccaggcgtagtggtgtgtgtctgtaatcccagctactcggaggctgaggcaggagaattgcctgagcccaggaggcggagattgcagtgagccgagatcgagccactgcactgcagcctgggtggcgagtgaaactctattgcac

SEQ ID NO: 87506 - DNA, 237 bp, Homo sapiens
tgtaatgacctccctcttggatttatctgtaggcaatcctgcttggaaaagtgaaagtgcattctggaacttaaaatattatttgcctgcacttccttttgtgggtcatttggagagttgtaaaaatgagaagaaaaaccttgtttccttaggcaatgacctcttatctcacttcctattttatttatcattgtccctattaatgaaaatattcctggtattttgggcccaagccaa

SEQ ID NO: 87507 - DNA, 368 bp, Homo sapiens
ttctcctgccattccaaaccacttcccattatgccaagatgctaaccctacttcttaatctagagagatcgggccttcttcagagaagctgccctcattcccttaccctctagcctggtccgacgcaccatgtcagacacttgcatagctctctatacttctctttcatagtctgcaggtatctatttgtgttattacttgattaccatctgtcccccatccctatccactcaaagttctgtgagggctggtatagtgtttattaatctaatctctgtaaccaacaaaatgcctggcacatagtatactcaataaacacttgctggttgaatgatgagtatgataggggtatgctctgattagctccg

SEQ ID NO: 87508 - DNA, 492 bp, Homo sapiens
ccaggagcttctcctctcttgccagggctatgagcagaaacctcaaataaaccctgggcagagaaaaccaacttaatgaagaggacgttgctgtttccactggcttctaattttgcagatgcaatgagcacttacggcttttgcagtggttcaggaaaaggcaagaagaagcagattgtcatgttccaaagccctctgatggctgcatggagccagcggtgctgtgactttttttaatagcttcagtacctttgatacgtatgtgcttatttactctttatctatgctctcttcctcccatcagcctgggagctccctggggcaggtctgtttctcccctccagtccggacttcgcaggagctgtgcctcccccatcacacttggagctgtctgaaggcaggggctgtgtctctgccattagactggaagctccccaaggttaaaggtcatatcctcaaatagctttagaatagctttagaacctgagggct

SEQ ID NO: 87509 - DNA, 462 bp, Homo sapiens
aaaaaaagagagagagacagtaaggccatctatagataattaaatatttctctatctaacctggggcaaactcatagtacttgaataaggccaaaaacaaatagaaaattactgtttaagctttcattctgctattgcaaacatttggaaacctctgcaactctttcaactaacatatttgtccttagcggtttttttttttttttttttaagtctgatatatggaatgtttggtgaaccttcctatcaacactgagactggaaactcaaagtacagtccaaatacattgtgttcaatcaccttcaagagccatttttctttttgggtgggaggtgggcagatgggttgagggtgggaagaaaatactattatgcagggtgttttgggaggggggagggtaacataaagagcagtgtacaggcaagttttgttattaaaattgtgtatactgtaaaaagtga

SEQ ID NO: 87510 - DNA, 111 bp, Homo sapiens
agggtgagacctttcaaagctgccaagtgggcaagcttccagcagcagtctgggagcgagcgacagagccaccaagctgggcggcagggcattgagcctcgcgtttcaatt

SEQ ID NO: 87511 - DNA, 142 bp, Homo sapiens
tatactcatggaggttgtatctctccaaaaacagacaaatccaaggctgtgaacaagcatccacatttgaattccattaaaccaaaatctatgttgaacgaagtgaagtctgtacacagcattgcaaatgtgaacacattcc

SEQ ID NO: 87512 - DNA, 332 bp, Homo sapiens
ggaaataaaggtgacatgaactaactattcaatcatgaatggtagaaaaaaatgaaaatgtaacgagatgggatccgggtcaaagtcaggggaggtatagttgaagatattgaaggagtcattatgataccaaagaaaatggaaagaagtggtatccagataggttatccttggagagtatccagggatgtctcttttcctaagaccttagagaaggaaaggatggctgataatatagggaaaagttgacatggaaggattaaataattttttgagaattcacgtaaggaatgataatctgaattttcagggctaggctcagaagcagaaat

SEQ ID NO: 87513 - DNA, 371 bp, Homo sapiens
aggggcgaagaaaggcttagggttgctgattatttacagctccaagccccgggcaggtacacagaattaaaggcctcccaccactccaattgcatttaattttattccgaaaatgactacctgccaataagcctcattgttcaccagcatctctgcaagtactttgaggtactattacccgagttcacttaacaccgcttgacaactttaagcagataacaattgaggtgctggtaatagagtctgtttttttttttaatttttacatttttaccacatgactttatgactctctttatcaagcatgttgaaattaatccatgtgttgattggagtatttcctcacccctgctgtgtattgagacgttggg

SEQ ID NO: 87514 - DNA, 764 bp, Homo sapiens
taaactaggacaactaatatgcttcaaacttccaatgataatgtatagacaagaagacagctctgtcctctaggctgtgcttttagtgccaactttcttaataacatcacctattctgctgacactcactctggaggaataaaactttagagcccctggctaaacaggatctgagaggaaggttggaatccagtggcagtatcgtggctcactgcaacctcaacctgccactctcatgccatccaaccacctcagcctccctagtagctgggactacaggtatacgccacaatgcccaggtttttactcctgggtctgaaaaagtcatcaaatcttggtaattcttagacactgacatcagtcaaagcctcatctgcagacctaggagaaggtgataataaaaatgaactgcttttgtgagacacggggccagaaattaaaactgttcaattgctctaggcccaagcattatttcagaagaggctggcatgaagtggctcaatctcagctcactgcaacctccacctcaaggattgaagcgattctcatgcctcagactccccagtagctggggttacaggtcaaaaactactaccgcaatgagtgggaagtcagatgattaatgtctgctgtttacacagaaacttgcagagatttacagcaagagcataagtatatcaagatgacaataacaacaatgtttaacatctagaagccacttccaacaaaaccatgtggaaggcgggagcaaattgcatagatgt

SEQ ID NO: 87515 - DNA, 322 bp, Homo sapiens
aaaattagagaatgccctaacttagatggtttttgaagcctgtacatttggtattgtttgacccttaagcttttacatctcttagcatggaagacgaagaaagctgtacattgttgcttgagagtctgtacatttagtccagatttgtatttgcactgtcagtatggcaaatgagtgaaaaatgtttaatacactattggatttttttttttttttttttgattcagcttataccagggctgaaaacctcaatttatgttcatgacagtggggatttttttaaatgcctacattctttctaataaactgttggaagacttta

SEQ ID NO: 87516 - DNA, 309 bp, Homo sapiens
ctgcctcagcctcccgagtagctgggactacaggcgcctgccaccatgcccggctaattttttgtattttttagtagagatggggtttcaccgtgttagccaggatggtctcgatctcctgacctcgtgatctgcccccctcagcctcccaaagtgctgggattacaggcatgagccaccgcgcccggccggattttttctttttttgattcagcttataccagggctgaaaacctcaatttatgttcatgacagtggggatttttttaaatgcctacattctttctaataaactgttggaagacttta

SEQ ID NO: 87517 - DNA, 291 bp, Homo sapiens
gcctataggccgcctttttttgggggggaagggtctcgctattgttgcccagactgatgtgcagtggtgcgatcttggctcactgccacctccgcctcccgggttcaagcgattctcatgcctcagcctcccaaagtgctgggattacaggcatgagccaccgcgcccggccggattttttctttttttgattcagcttataccagggctgaaaacctcaatttatgttcatgacagtggggatttttttaaatgcctacattctttctaataaactgttggaagacttta

SEQ ID NO: 87518 - DNA, 209 bp, Homo sapiens
tctccttactttagttctatttttttccccaaagcacagcattagttaacatttacactttttctctcaattaaatataagttctatgaaggtaggaaccctttctgtcatgttcaccacagtatctccaatgcctaggcactgtgtggcacacggtaggtacttaatatttctttactagaagataggaggagggaaggaagaaaaga

SEQ ID NO: 87519 - DNA, 189 bp, Homo sapiens
tagactcaaatataccaaccataagccttagcatccataacttttaagtcagtttctaaatatacacaaaccaaattaagaatcccctaccttttgttaacatttggggataccaggtaaaagacaaacaggaatgctttgtactgtactatttttgttaacttttctgtgagtttgaaattatcccaa

SEQ ID NO: 87520 - DNA, 346 bp, Homo sapiens
gtggcggggtgagtagtttggcgggaaggatggttacaaaacaggtgactcagaatgactcaggtcagagcaggtgatagaggctaggaggggactgttcactgaaactaggggctaggagacgaagggaaagaggaaattaaattttaaaatgaagaacaaagaacaggggagctgaacatactgatgcactggttctttggagaggatctcagaactcattgtactaaacaatttacaggctaaaacctttgaagaagaatttattatatcctacattttgtttttgtttttgagacagggtctcgccccgttgcccaggctggagtgcaatggtgcaatcata

SEQ ID NO: 87521 - DNA, 451 bp, Homo sapiens
tgtgctggcaatgagcgaggctctgtgggcgtaggaccctccgagccatgcgcaggatataatatcctggtgtgctgtttgctaagaccattggaaaagtgcagtattagggtgggagtgacccaattttccaggtgccatttgtcaccccttcccttggctatgaaagagaattccctcaccccttgcacttcccaggtgaggcgatgcctcgccctgcttcggctcatggtcagtgcactgcacccactgtcctgcacccactgtccaacaatccccagtgagatgaacctggtacctcagttggaagtgcagaaatcacccgccttctgcgtcgctcatgctgggagctatagactggagctgttcctattcagccatctttgaactgcccccctatttcaggtaccaatttttttcttttcttttatgtttttgagacagattctca

SEQ ID NO: 87522 - DNA, 944 bp, Homo sapiens
agtccacaaaagagaattttctgatgtgagaatggagggtgttgcctgcaactaccccagatccctgcggtggcagtttaagccgcctcctggagcagattgttaagctgatgcgagtctgggctctgcctcaccacttgtctcagagaatgtccagtgctaggagactcataagttggagagaaacggcctgatttatagaaactgagcgagactccggaccacctgatgcagagaaacctgtgacctgaaaaagtctatttgtgtttcctctaggaatctcggccaagaagacagggacaagctcccaactctgactaccccttttacagggaaaaaaaaaaaatcccgtgccttctttgcagcaagtgacaaatccttgtcatatcgagatggcttttcctcctcctcttcaaacatcttttagcagcaacagcagctcaagtaactggaattatttcagagttaaaatgcaggctttgtagaccctcttagacagacagattcaatttcaaaggaaacttctttggctgggtactcagtgagtgttacacagggatttggggagttaatattcactgtttctgttgttggagaaaaggaaagcagagttgctctttctcattactctccccaacgcacatctgtttcctctcgtatcttggaattaggaagatggaggagacttaagtggtgacccacctagcctcctgatgtatgctgggctcactttaaaactcccaaaacagatggcagttgatcacggttttaaagatcccagcatagactttctgcagcctcccttgttagccactatcagcgcttaacattctgtcatctgaataactccttaaaaatgatagcaatggtagtagaaatttaaaaggaacctcccaaaaaacatgcaaaagcttaccaccccagtaaatcacccgcaacaatgt

SEQ ID NO: 87523 - DNA, 725 bp, Homo sapiens
ctacagagtgggtctaggtccaggtacagtctcagaaccacactgcaaaactggcttagtcaggtagctgctgtatctgctgcttccactgtgaactcaaaaaccacattgcctgtgctgcaggccggaaagctgctgaaccaggaagctgtgctgatgctgctgactgcccctgaggttagagattgactagacatagtgccactgtcatccctgctggagaaggtccgaagcacctccacctctgtgcttccagaggggcactgtggtggccacttaaaatgctcaggctataccatgcactagagcatctacctgggcaagggatatgctgtatgacactctcctgatgctgggcatggctgtgagccaaagcacccaggcagccctgccatcagaagggtaaaccacggacacctgatgccttcctgaaggaagagcactacgcctgccaaaccatcaagcgttgatgctccagcgccttctacccgtggttctccagcctcagcagaagagagagaaattgatgaccctgtcgttgtagcatccccatcacccagcaattaattttagttcaatgcttcaaacgctcttcaggcgcagtgtgcgttcagctgtgtcagctaatggcactggagacacagaaatgaacagagacaacgtgccctcaaggatctcacagtgtgtggtgaggtggacacacacacacatatctaagcacatga

SEQ ID NO: 87524 - DNA, 600 bp, Homo sapiens
tgagatcacactcgtgtcatgaaagtctttgaacggtaggtggaatgggcgtgaacgatggtcgatggggattcggcacggcatggtgagacggtacatcatctcgcatatcagctgttcataacactaatcatggcggcgtgtgggtaaacacactggatggtcgaggacactagcaaatgggggatctcagaagtcttaatgaagtaactatccctgaacactgggatcaatactcagcatccagctgtcaaatcaacaccaagccgcctcctggagcagattgttaagctgatgcgagtctgggctctgcctcaccacttgtctcagagacagagtcttgctctgtcacctaggctggagtgcagtggtgccatcacagctcactgcagcctcgacctccccgtgctcaagtgatcctcacacctcagcctcccgagtagccgcgatcacaagttaaacaaacacagttctttacatcaatgcttccgtccctggccatctggtctcctgtcccctccagacccaaaaccatgggctgggctgcagcaaaatgagggtgtactcagtgcactgaggcccatgtaccatgagagatgg

SEQ ID NO: 87525 - DNA, 416 bp, Homo sapiens
agtccacaaaagagaattttctgatgtgagaatggagggtgttgcctgcaactaccccagatccctgcggtggcagtttaagccgcctcctggagcagattgttaagctgatgcgagtctgggctctgcctcaccacttgtctcagagacagagtcttgctctgtcacctaggctggagtgcagtggtgccatcacagctcactgcagcctcgacctccccgtgctcaagtgatcctcacacctcagcctcccgagtagccgcgatcacaagttaaacaaacacagttctttacatcaatgcttccgtccctggccatctggtctcctgtcccctccagacccaaaaccatgggctgggctgcagcaaaatgagggtgtactcagtgcactgaggcccatgtaccatgagagatgg

SEQ ID NO: 87526 - DNA, 1581 bp, Homo sapiens
ctacagagtgggtctaggtccaggtacagtctcagaaccacactgcaaaactggcttagtcaggtagctgctgtatctgctgcttccactgtgaactcaaaaaccacattgcctgtgctgcaggccggaaagctgctgaaccaggaagctgtgctgatgctgctgactgcccctgaggttagagattgactagacatagtgccactgtcatccctgctggagaaggtccgaagcacctccacctctgtgcttccagaggggcactgtggtggccacttaaaatgctcaggctataccatgcactagagcatctacctgggcaagggatatgctgtatgacactctcctgatgctgggcatggctgtgagccaaagcacccaggcagccctgccatcagaagggtaaaccacggacacctgatgccttcctgaaggaagagcactacgcctgccaaaccatcaagcgttgatgctccagcgccttctacccgtggttctccagcctcagcagaagagagagaaattgatgaccctgtcgttgtagcatccccatcacccagcaattaattttagttcaatgcttcaaacgctcttcaggcgcagtgtgcgttcagctgtgtcagctaatgcaaatgggggatctcagaagtcttaatgaagtaactatccctgaacactgggatcaatactcagcatccagctgtcaaatcaacaccaagccgcctcctggagcagattgttaagctgatgcgagtctgggctctgcctcaccacttgtctcagagaatgtccagtgctaggagactcataagttggagagaaacggcctgatttatagaaactgagcgagactccggaccacctgatgcagagaaacctgtgacctgaaaaagtctatttgtgtttcctctaggaatctcggccaagaagacagggacaagctcccaactctgactaccccttttacagggaaaaaaaaaaaatcccgtgccttctttgcagcaagtgacaaatccttgtcatatcgagatggcttttcctcctcctcttcaaacatcttttagcagcaacagcagctcaagtaactggaattatttcagagttaaaatgcaggctttgtagaccctcttagacagacagattcaatttcaaaggaaacttctttggctgggtactcagtgagtgttacacagggatttggggagttaatattcactgtttctgttgttggagaaaaggaaagcagagttgctctttctcattactctccccaacgcacatctgtttcctctcgtatcttggaattaggaagatggaggagacttaagtggtgacccacctagcctcctgatgtatgctgggctcactttaaaactcccaaaacagatggcagttgatcacggttttaaagatcccagcatagactttctgcagcctcccttgttagccactatcagcgcttaacattctgtcatctgaataactccttaaaaatgatagcaatggtagtagaaatttaaaaggaacctcccaaaaaacatgcaaaagcttaccaccccagtaaatcacccgcaacaatgt

SEQ ID NO: 87527 - DNA, 1280 bp, Homo sapiens
gcctcctgagtagctgggacaacaggcacctgccaccacgcccagctaatcttttttgtatttttagtagagacggggtttcaccttgttagccaggatggtctccatctcctgacctcgtgatctgcctgccttgacctcccaaagtgctgggattacaggcgtgagccaccgcgcccggcctctacagcatattttaaaaggcaaaaagcaaatgggggatctcagaagtcttaatgaagtaactatccctgaacactgggatcaatactcagcatccagctgtcaaatcaacaccaagcgtttcactcgtcgcccagcctagagtgcaatggcgctatttcggctcattataacctccgcctcccgggttcaagcaattcttctgcttcagcgtcccaagtagctgggattacagccgcctcctggagcagattgttaagctgatgcgagtctgggctctgcctcaccacttgtctcagagaatgtccagtgctaggagactcataagttggagagaaacggcctgatttatagaaactgagcgagactccggaccacctgatgcagagaaacctgtgacctgaaaaagtctatttgtgtttcctctaggaatctcggccaagaagacagggacaagctcccaactctgactaccccttttacagggaaaaaaaaaaaatcccgtgccttctttgcagcaagtgacaaatccttgtcatatcgagatggcttttcctcctcctcttcaaacatcttttagcagcaacagcagctcaagtaactggaattatttcagagttaaaatgcaggctttgtagaccctcttagacagacagattcaatttcaaaggaaacttctttggctgggtactcagtgagtgttacacagggatttggggagttaatattcactgtttctgttgttggagaaaaggaaagcagagttgctctttctcattactctccccaacgcacatctgtttcctctcgtatcttggaattaggaagatggaggagacttaagtggtgacccacctagcctcctgatgtatgctgggctcactttaaaactcccaaaacagatggcagttgatcacggttttaaagatcccagcatagactttctgcagcctcccttgttagccactatcagcgcttaacattctgtcatctgaataactccttaaaaatgatagcaatggtagtagaaatttaaaaggaacctcccaaaaaacatgcaaaagcttaccaccccagtaaatcacccgcaacaatgt

SEQ ID NO: 87528 - DNA, 606 bp, Homo sapiens
aaaagtccacaaaagagaattttctgatgtgagaatggagggtgttgcctgcaactaccccagatccctgcggtggcagtttaaggtaggtgggaaggctctagacgtgtgggactggagtcttgtgttctttgcctcaaagctgaattctgactcctctttcagccttataccaatttcccttaagtgaccgtctgcacatagaggtgctattgaggctggagagtggtgagttcagcttcaaggtgcactctagagatagggcttgggcctgtgtgtatttttggaattgctctccaaacattccaaaaactgaaagcttcgaggtccactccaccagctgacctagtttttcagctaaaagaccatggcctggcctcctaaagtcgtatatctatagattccagccaggtgggacccatggtgcccattttgttaattccaaagacacagcatggtgtaggagaaaaaggatggaatttcaaatacagaagtttggagtcagacttatgttgaaggcaaaatgaatcttttgtgtcaaagtcagaaggggccgggggtttactgagaaagggcacaaggagacgttctgagtgatggaaacat

SEQ ID NO: 87529 - DNA, 139 bp, Homo sapiens
taattatctattgctatgtaacaacttacccccaaatgtcacaactctctatcaccttctgcagtttctttctttcttttgttttcttttttttctttttttattttattttttatttttagacagggtcttgctctgt

SEQ ID NO: 87530 - DNA, 891 bp, Homo sapiens
tggcgttcgaccttcgccccacctggaaggcgccggatgcgagactcgcccttggctcggcccgcggccccggccggcgcctcgcccttcaccttcaagtccccgagggagctcggcaactcggcccaaggacaggggcccagcctagccgtcaccgccggcagcgcgctccgggtctggctctggtattcactggcgtatcccgcatccggcctgctcacggcgctccaggcctgccccgcgcgccgaaaccctccgccggacgcggaggaaaagaaggtggtgagcgaagcacggagatgctccgactgctgcgcgggtctcccaagcccaaccgccacccgcgttccgggccagtcccagcccacggcgtggccagcgctgccgccggtccagcgacaatgagggagcccccgggccgcggggcatcttttgagaccatgtggcccacagagaatctaagctcccgccgccgggctccacctcaacggcggagaactcgggcgccgagcatcgcccgatccctacccggcagcggacggctactgggtttgattttcccctccacaggaaagaacgtgcagaggcacaaatcccctcctcttccctcagaggaaagcctgtcccagcggtcccgctgagaacttccgaagccttggcgcggcaggcaggcccctgagccggtgcaccgcgaagttgcattctcaccttcgagtcaccgtggcttaggccgagtaaacgagcacttcatctagcgccgggcgggccccggcaccaagctaagagctcaaaactcctcgaagcgggcgcgcgacgtcgcggtccgagctttcctcgccgcactcccccatcagacctaagatcttttaccttttaaattaaagtgaatcc

SEQ ID NO: 87531 - DNA, 862 bp, Homo sapiens
tctttttagtagagacggggttatgccatattggccaggctggtctcaaactcctgacctcaggtgatccgcccaccttggcctcccaaagtgctgggattacaggcatgagccaccgcacccggcccttgtatgcttttactgatagaaattatttccttcaagaaacgggaatttggctaatttacctcttaaaggaaattaatgctgctttatctaaatgaacagaatagtgagtgaactgataattgtacttaaagtaattgttccaatctttagaatctcctataaaatctaagatacaagtttaccttattttagggtttcaaactaatgtatgttatattttatggaggaaagaactacataatgcagagcagaattttttaacgacgttcttgtatgggttctttagtgagtccaggtacccccttgaaatcgtatgggacaggttgtgtatgtgtgcatttttctgaggagtggatccatgactcaaaaaggttaagaacttctgccctggaaaggaaaagcaaaagattgaagaataaaaacattttgtatttgccaaaacttgttctgtagcagtaagtgtgaaacaagtttgctacatttttctttttggttttacttggttggggcttttttgtttggttggttttaaaggatttaggggattggcaagtcagtttgtcagatgtcaatgaacagaaaacctaagaaaaaaggtagcaaaagttctgctggccccagatggattttgccttaagtaatttcctaatcattagttacagctctgtgtcaaaagatgtacatagaaatttatgctagattcttaacatctttcttactgtgtgcagaaatg

SEQ ID NO: 87532 - DNA, 174 bp, Homo sapiens
ttatccctacatttctgaagatgaaaggaaggctcagagaggtagaggaatttgctgtgggtcacacagcatgtagctcaaattaaaaatcagagctgtcaggatccaaaccttgagctctcttccactttgcatcctgcgtgttcagaggaggagaaagcttttgcgtatggg

SEQ ID NO: 87533 - DNA, 462 bp, Homo sapiens
aaattagctaggcgtgatggtaggcacctgtaatcccagctactcgggaggctgagggaggagaattgcttgaccccaggaggtggaggttgcagtgagcctagatcacaccactgcacttcagcctgagcgacattgactgtctcaaaaaaaaaattaggattattcaatgttgtcatcatttccactcctaaattctgaaatgctttctttggtagaggtgagagtgtggagccacagctagtagagaaggaacagtaggacctgcagcctccctggttttccaggacaagtcattgctgtgtgtggcaggaatgccttacctcaaataacaaaacagtgtgaaaaacgaatttgtgttacatttaaagtttgtaaagcaatgagaaatgtgtgtatcataaagagcatctttaaatttttgctaaaatattagcctcttaaattctctaggaaccccct

SEQ ID NO: 87534 - DNA, 340 bp, Homo sapiens
cagggaacggaatgaggccagagggcctcgggaaagcccgaggaggtgtcgcacaggaagtgtccagaatggaagaggaagcgtccagcaaggaacaggaagaatggacacttgtgaggggaaatcatgtccctcccactaaatgtgctctccacaaggacccggcccgcccttctgtccctgctggatccctgagctggcaccagccctgccctcagagagaacgtccaggagacaggtggaggtgtacgtgtgggtccctggggaaatccatcctccagccgcgggctcccagtcggctcccagcctctcgctccagcttcaccccatggagctcatc

SEQ ID NO: 87535 - DNA, 353 bp, Homo sapiens
cgataacacaatcttcagccgcatcccaagagccatggctcccagagttagggtgctaaacggtcctggtatgatttctactggtcatgtctctcaaggagggctttttaaatctcaacgatgtggtttcgaaggctattaaactatactttatcaaatggagacttaaaactctgaaacaaagaacaggtaaaagaactagaaatattttatctggggaaggaaatattcagagggcacagaaaagatgtcctcaagtattcaaaagggtaattaccttgagatagttgacttattttttttgagacagagtctggctctgtcacccaggctggactgcagtggcgcgatct

SEQ ID NO: 87536 - DNA, 728 bp, Homo sapiens
ggtgggggaaggtgtctgtccatctatccctggcccccagcccatgtggttttggcagcaataaggtgtgtggggtaatgacccctgaaattaaaatggtgtgtgtatgtgaaggaaaggcgggcaaagctatggggagcggtggagtggaaggaacaaaggaggtcagtactgggaacgctgaaggtgggaggccatttcataacattacttgttgatgaaattgccatgaataccttctttgcccatcagcaggcctagcgtcttggcagtcatggtgacaatgacgttgaaggtggggactccaccgatgctcttcatatgaagatccacggtcaattccccatcctgcagcagtgagtccaggaccacagtatatttctggccccccagtgtcagtccattcatgacaaagtttgaccagtctttgccaaccaggacaccaacctcagctggcgtgatgttgaggaaggttttccctgggatggcggcccagatggaaggtgggtccttgttgccaacaatggccgtgtcctaacaggtcccgtccgccacgaggctgtagatggaggtgtccacctggccgttgcgttgctgcaggggctcctctggtcgctgctgttggggccgcctgggctggcgggtgggggaggcggagagctcgatgcaggtgctgtcctcctcgccacgactctgctagctgtgcagtagccctcgctccgccactt

SEQ ID NO: 87537 - DNA, 471 bp, Homo sapiens
agaaaaagatttgcactatgatctatttagggtgagaactgcatgtgattcttcattatgattagtaaaactacgttgaattgtgaataaactgtaacaaattggtatatgatgtttagtttcacatgatctaatgtaaaagtcctaacaactttaagctgctttatattataatcaccttcctaaaaaactgtatatgtatttgattatttgctaagattttaaatttcttgctcttaaatgtgtcttaatctcaacccctctttgtaatccccactaccatggctttagttcacacttttcctcatttattacctacttagccgcctaaattttctccctgcttcaatctcacttactttgaaactgttccccacagtgcaaatctgactatactggccagcctgaattcattctggacatgctttcatgatctggtcccagcctacctctccagcctcatttttcact

SEQ ID NO: 87538 - DNA, 429 bp, Homo sapiens
tggggaggaaactaacttcaaaaacagttgaccaaatttcactttgaataataaaagagttttttatttgtaggctacacaggtttaggtggatatcaaggcaaaaagaataaaagttttgggaaacttctttggctaccatctcaataatggcttatcattaataattattttggccaaggatttttaaagcaaatagagaagagtcactttgaacccttgactgcaaaatcagtgagaagaaaggctaaaatgggaataatcaacaccaacaatgatatgttaatatttcccttgttctatagtagcatggttgaatagatccttctgtaatgatggaaatgtcccaagctacatctgtgctgtctaatatagtagccactagccaactgtggttactgagcacttgaaatgtgctagtgtgactgg

SEQ ID NO: 87539 - DNA, 3581 bp, Homo sapiens
  misc_feature (603)..(603): n is a, c, g, or t
  misc_feature (606)..(606): n is a, c, g, or t
  misc_feature (609)..(609): n is a, c, g, or t
  misc_feature (1071)..(1072): n is a, c, g, or t
  misc_feature (2171)..(2171): n is a, c, g, or t
  misc_feature (2229)..(2229): n is a, c, g, or t
  misc_feature (3012)..(3012): n is a, c, g, or t
  misc_feature (3201)..(3201): n is a, c, g, or t
  misc_feature (3581)..(3581): n is a, c, g, or t
cgccgccgctgcgcctcgggcagccccagcgagcggcaactcccgggctggcgcggctcgctttctggctccttccgcgcggcgagctcagccccgctcgatttttcctcttctgttccagccctctcttgtctgggtggctgtggcggcggcagggggatggggaccccgtgtggggaaggggttgaagatcgatgaagattattgttcttttaaaggatgccttagcttcctcccgccgcctttcctctgagccttcctactagagaccgtgaaccagagtcagggatgtaaagacagggggaaagcacgccgggagctccagccagccggggagaccctcctctctgtggaggggagggggatttccagcgacaggtcattggcgaaggggatcgtcgcggggagaggctccccggagggagcggggaatcccacagccctttgtggtgcccgagcccgtgccgcctgctgagcggggtctgtgggagctagctttgtcagtggaaatgcctgccccagagggatattgcttcagttgacctcattttttaaggaccctggctctgcggctttgtccagttcaaaatggcagaaaaggcnccnccnggcttaaacaggaagacttcaaggtcgacactttcccttcctccagagcctgtggacattatccggagcaaaacatgctccaggagagttaagatcaatgtggggggcctcaaccacgaagtcctgtggagaacgctggacaggctgcccaggacgcgcctggggaagcttcgagactgcaacacacacgagagcctcctggaagtgtgcgacgactataatctgaacgagaacgagtatttctttgatcggcatccaggagccttcacttccattttaaatttctaccggaccgggaaactccatatgatggaagaaatgtgtgcactttcgtttggccaagaacttgattactgggggattgatgagatctacttggagtcctgctgccaggccagatatcatcaaaaaaaagaacaaatgaacgaagaactgaggcgagaggcagagactatgcgaganngagaaggagaagagtttgataatacctgctgccctgataaaaggaagaaactgtgggacttgctggagaaacctaactcatcagtggctgcaaagatcctggccatcgtgtctatcctgttcattgtgctttccaccattgctttgtctctcaatacgctgccggagctgcaggaaacggacgaatttggacaactcaatgacaaccgccaattagcacacgtggaggctgtgtgtattgcatggtttaccatggagtaccttttgcgattcttatcctcaccaaataaatggaagttcttcaaaggcccactgaatgtcattgatttgctggccatcttgccgtactatgtcaccatttttctgacggagtccaacaagagcgtgctgcagttccaaaacgtgaggcgcgtggtccagatcttccgaatcatgcgcatcctcaggatcctgaaactcgccaggcattcgacaggcctgcagtctctgggtttcacccttaggcggagttacaatgaattgggcttgttgatattgtttctggccatggggataatgatattttccagcctggtattttttgctgagaaggatgaagatgctaccaagttcaccagtatccctgcatcattttggtgggccaccatcaccatgaccactgttggctatggtgacatttaccctaaaacattactagggaaaattgtgggaggtctgtgctgtattgctggggttctggttattgcccttcctatcccaattattgtgaacaatttttctgagttttacaaggagcagaaacgccaagagaaagcaattaaaaggagggaggctcttgagcgggccaaaaggaacggaagcatcgtttctatgaacttaaaagatgccttcgctcgaagtatggaactgatagatgtggctgttgagaaggccggagagtccgccaacacaaaggactccgccgacgataatcacctgtcgccaagccggtggaagtgggccaggaaggctctgtcggaaacaagctccaacaagtctttcgagaataagtaccaggaggttagccaaaaagactcccacgagcagctgaacaacacgtnttcctccagcccacagcatctgagtgcccagaaactggagatgctatacaatgaaatnaccaagacacagcctcattctcacccaaacccagactgccaagaaaagcctgagaggccatctgcatatgaagaagagattgaaatggaagaagtggtgtgtccacaggagcagctggccgtggcacagaccgaggtcattgtggacatgaagagcacctccagcatcgacagcttcaccagctgtgccaccgacttcacagagacagagagatcgccgctgccgccgccctccgcctctcacttgcagatgaagttcccaaccgacctcccagggacagaagagcaccaaagagctaggggccccccgtttctaactctatccagagagaaaggacctgctgccagggatggcacgctggagtatgccccagttgacataactgtgaacctcgatgccagtggctcccagtgtgggctacatagtcctttgcagtctgacaatgccaccgacagtcctaagagctctctaaaaggcagcaacccactaaagtccagatccctcaaagtgaactttaaggaaaatagaggcagtgcaccacagaccccgcccagcacagccaggccactgccagtcaccacagctgacttttcgctcactaccccgcagcacatcagtaccatcctcttagaagaaaccccctcccagggagacagacccttgctgggcactgaggtttcagcgccttgtcagggaccttccaaagggctgtcccccaggtttcccaagcagaaactgttccctttctcttcaagagagaggaggagcttcactgaaataganactggtgacgacgaagacttcttagagctcccaggggcaagggaggagaagcaggtggactccagcccaaattgctttgcagataagcctagtgatgggagagaccctttaagagaagagggcagtgtgggctcttcctccccgcaggacacaggtcacaactgtaggcaagacatttaccatgctgtnagtgaagtcaaaaaggacagtagtcaagaagggtgcaagatggaaaatcacttgtttgccccagaaattcattccaacccaggagacacaggttattgtcccacacgtgaaaccagcatgtgactagttacaaaagcaataaattgaaacaaaacaaaacaaaacaaaacttgtttcttaaaaatgcggttaataatgcctgtgaactaaaaaaatgggaagccctccccaaaaaaagtgcataaaatgttatttttgcatggcatgaacagtttagcttaagtactgtttaaataatgagtcaagactgcattttgtaacaaaccaacaaaaatgactgaagaacagtgaacaaataaaaagagctctattaggaaccn

SEQ ID NO: 87540 - DNA, 1543 bp, Homo sapiens
  misc_feature (19)..(19): n is a, c, g, or t
  misc_feature (755)..(755): n is a, c, g, or t
  misc_feature (816)..(816): n is a, c, g, or t
  misc_feature (830)..(830): n is a, c, g, or t
  misc_feature (879)..(879): n is a, c, g, or t
  misc_feature (881)..(882): n is a, c, g, or t
  misc_feature (884)..(884): n is a, c, g, or t
  misc_feature (892)..(892): n is a, c, g, or t
cacgccactgacagatagntgctacatcacgctggctcaagctctgggaatgagcatggggggagcccctgctggacctgcaggcacaggcaaaacagaaaccactaaagacatgggacgatgcctcgggaaatacgtcgtggttttcaattgttcagaccagatggatttccgaggacttggacggatttttaagggactggcacagtctggagcctggggctgttttgacgaattcaaccgtattgatctaccagttctctcggttgcagcccagcaaatttccattattctgacatgtaaaaaggagcacaaaaagtcttttatctttactgatggagataatgtgactatgaaccctgaatttgggcttttcttaaccatgaatcctggctatgccggacggcaggaactccctgaaaacttgaagattaatttccgctcagtggccatgatggtgcctgaccgtcagattatcataagggtgaagttggctagttgtggcttcattgacaacgttgttttggccaggaagtttttcacgctctacaaactgtgtgaggagcagctttctaagcaggttcattatgactttggcctgcgtaacattctgtcagttcttcggaccttgggagcagcaaaaagagccaatccaatggatacggagtccacgattgtcatgcgtgtactacgggacatgaatctttctaaactgattgatgaggatgaacccttgtttttgagtttgattgaanatctctttccaaatattcttctggacaaggcaggttaccctgaactggaagcagcaattantagacaggttgaanaagctggtttaatcaaccatcctccttggaaactgaaggtcatccagcnanncnaaacgcanagagtgcgacatgggatgatgactctggggcccagtggggctgggaagaccacctgcatccacaccttgatgagagccatgacagattgtggaaaaccacatcgggaaatgaggatgaatcccaaagcgattactgccccacagatgtttggtcggctggacgttgccacaaatgactggactgatgggatattttctacgctttggaggaaaacattaagagcaaagaaaggggaacatatctggataattcttgatggtccagtagatgccatctggattgaaaatctgaattctgttttggatgataacaaaactctaacccttgccaatggtgatcggattcccatggctccaaactgcaagatcattttcgagcctcataacattgacaatgcttctcctgccaccgtctcaagaaatggaatggttttcatgagctcttctatccttgattggagtcctattcttgagggttttcttaagaaacgctcacctcaagaagcagaaattcttcgtcagctgtacaccgagtctttcccagacttgtatcgcttctgtatccagaacttagaatacaagatggaggtgctggaggcctttgtcatcacacagagcattaacatgcttcaaggcctgattcctctgaag

SEQ ID NO: 87541 - DNA, 417 bp, Homo sapiens
gtcatatgactcctgagcattaaaactatagaagttgcacctacatcctagcagaattcatgccccacccataggcctattcttgtggccttctgttagtcttacatatgtggtttttggttcctaagcaaagaggaggttagttttagagagggactcttatcatccttgcttttaagttaaaccagaaactaaatttgcctccaagttactttggcctacgcccaggaaagaacaagaacagcttggaaatcagaagcaagattaagtgaactatgtcagatttctctgagtgtcataattttgtaaaggtagattcagggccattaacctatgcccctttcaggcagaatggactctctgtgactaactgaggtgctcaaagttaaaatagaatcaggtatccatggctgggtc

SEQ ID NO: 87542 - DNA, 478 bp, Homo sapiens
tggtttttattgttcatattaatatttaatattataactttgaatcatttttacacattgtaatacaaagaaaataagtaattatgttaatgttattaggaaccaagattttcagtataataaataaaagaagtaaacagcaaaaatcctgtaatgtaaatttgaattggaattattgatataagtgttttttaaaaaacatatttcttggccgggcatggtggctgacgcctgtaatcccagcactttgggaggccaaggcaggtggatcacgaggtcaggagtttgagaccagcctggccaacatggtgaaatcccgtctctattaaaaatacaaaaattagctgggcatagtggcaggcgcctgtaatcccagctactcaggaggctgaagcaggagaatcgcttgaacctgggaggtggaggttgcagtgagccaagatcaggtcattgcactccagcctgggcgacaagagca

SEQ ID NO: 87543 - DNA, 139 bp, Homo sapiens
cctgaaaattgtaatgaaatgaccatgaattgatccaggaggcaatgggtttgttttgttgttattgttttgtggttttttctttttgacacggagtctcgctctgtcacccaggctggagtgcagtcacactgacctc

SEQ ID NO: 87544 - DNA, 768 bp, Homo sapiens
atgggattattatttactttatttaattcacacaatgatatggctacatggtctcctttaatcctcacaagaaccatttgagaaaggaaatactattctaaagttgagcacaagataataaaaatatgtctgatgccacagaactgataagagtgatggctctaagctatgttatctactttacattcaaattttgagaatttagcttgtagtgaataactatttctaagaaaagaagaatagtgtattcctttaaaaacaatagctaagcttgacttctttgtcactgggatttagggcatgataaacatgtgatccaagaacaaagtttataccctcagactacatatttggaaacatgacatgccaattcaagtgatttaagtcctggttttccttattaatcatagaaaaaaaatttctacaagtcagaggatttacctgctttgtttgctgctctaagcctggcaccaacaacgatgtcaaacatacaataggagctcaataaatattagttgaatgaatgagtcaagaatgaatctactcataaagcatataatccagtgctttaggtctgatgctgtgagtcaaagttgagttgtgggtgtctcagaaaactacatacaaagcatggcatttatttccactggagtcatagcttttacttatatatttaccatatgagaatttacctactatatttcttcctatctaagaaataattaatggcaagacaaaccatcattgaatgaagtagtgaaagaagaa

SEQ ID NO: 87545 - DNA, 260 bp, Homo sapiens
ctcaaagcaagccataaaacctaagaaggtcactctctgacctcctcccttttgccctgaagaccttcgtgtgacaggtgttctgcccctccctagaggccaaagagaatctgaacaaacaggccttgttaagtttccagtttattaactttaggccatacctcctttttatccaatcccacttcaacacgactgttcatcctttatcccacctaagcactaaaatacagttttccctgggtctttgtgtcttcattttt

SEQ ID NO: 87546 - DNA, 273 bp, Homo sapiens
agtgttagtttttctttaaatatttgttagaattcagctgtgcagcgatcgattcctggctgtttctttgttgggagactttttattattaccttgatcttattacttgttattggtctgttcaagttttctatttcttcctgactcaatcgtggtaggttgcatgtgtccgggaatttattcatttcccccagtctttccagttttttagtgtgtagtcattcataataatctatgatgctcttttgtatttctgtgatatcggttataatg

SEQ ID NO: 87547 - DNA, 428 bp, Homo sapiens
actgattcggtaatacccttttaaaaaattaatttttctccgatgcaggacccagtcttggaaccacgttatttcctgtgtctttattctcctttaatatgggtcctttccgcctttctttaacttttataacattaacgttttttgcagaatctagtcttcttttttaaaaaatgctcatcattttgagcttgccatgtttcctcatgatttgattcatgtaacgcatttctggctgaaatagtatgtgtctggctgaaatagtatgtgtccttctcatggtatcacatttggaggcacacagcacctacctgtacctcattggtgatgttaagtttcatcatccagacaaactgctatccaattttcctactgcttagttactatcttttccctgcaaccaataagcaatatttggacagacactt

SEQ ID NO: 87548 - DNA, 281 bp, Homo sapiens
actcccagcagccgccagccagctgcatcaggagatgttagtcacgcccggaaggctgttctagtccgcctccttggaaaagaagctcaagtaaataattgatggagaatgaccgaacccaggacaaagctttgcaggaaaccagtgcatccgtgttcgagcggttttgggatcctctgccaagtacgggataagagaatagagcaaggagtttgagcgctgctgccaatcttccatctcgggcgtggctctggcctttttgtctctttatcccgccactc

SEQ ID NO: 87549 - DNA, 532 bp, Homo sapiens
ttgagtgctggcaataccctttctacaatactacacagtctttcttttgttaaacgcagtaacaaaaatgtcctcaggtgggtgtcagtcatatagttaagcaaaacaaagtatgtatgtaaaaggtatgtgcaggtcttaccaaattaattggccatctttacacagtgtaaagtctttttctttaaaaagatgtttctttggagaatatctttatgccttcattcttgccaggctttgaggatttgtatctatttaatgaaaggtggttctctttagcacacttacaccaagcatgcaggtgaaaaccatcaccatatagtctcactgtcactagtttgcccctatttccattccattcttcactctgctgactgcctggcctttctaaaatgcacatctgatgatgtttgagtttttttcaatggctttccatgtgctacataaggtaaaatctacacttcttaggctggcattcaggggtctttgaaatgtttagcctgtaccaccccttcagtttcacttctaacac

SEQ ID NO: 87550 - DNA, 454 bp, Homo sapiens
cagagaagtaaactgatttgtttttggaataatggacacattcacgcacctgtatgccccatttctagagcattccgggccatcaaagtctgacagtcactgaacgatgctttgcagacacctttcttaccacctcaagtcgtatcatccaggaggcagcaaaaatagtactcaaaatttaaaaaattaaacaggaaggagaaccaaatcaattcggagggatctgctcagacgttgcaagcacggccgctgtccttctggtactttcacgcaatgcgtttccatttccaaatgtctttcacttacagtctttcataaacatggcatactgattagaatcaaatatttcagtatggagggtgtgcagagagcattcatctgagtcaagattcatttattcccagctctatcactaaaataccttgcggctttaaataatagtgacgttcctcat

SEQ ID NO: 87551 - DNA, 675 bp, Homo sapiens
gttgcctgtgcccctggagtctgtaaaagagatgcttaagtcagtcatgcaggaactcgaagactatagtgaaggaggtcctctctataaaaatggttctttgcgaaatgcagattcagaaataaaacattctacaccatctcctaccaaatattcactatcaccaagtaaaagttacaaggtaaacaggaaagaatggaatcatttcattgtgaaattgtttctaagtgttttaaatgctcttttgttatttttatttttttttttagtattctcccaaaacaccacctcgatgggcagaagatcagaattctttacggaaaatgatttgccaagaagtaaaggccattacgaaactaaatagcagtaagtcagcatcccgtcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggttcttctaatacagaatttaagtcaaccaaagaaggattttccatcgctgtgtctgctgatggatttaaatttggcatttcggaaccaggaaatcaagaaaagaaaa

SEQ ID NO: 87552 - DNA, 219 bp, Homo sapiens
tattactttaacatttttagcaattttttttttaccagtttagtgagcaggactgatatggtttgatgctgtgtcccaaatctcatgtcgaattgtaatccccacatgttagaagagggacctggtgggatgtgattggatcatggggtggatttcccccttgttgttctcgtgatggtgagtgagttctcatgaggtctggttgtttaaaagtgtgta

SEQ ID NO: 87553 - DNA, 389 bp, Homo sapiens
tctaattttttcctttctgaaagaaagtgggtcatataatgagagcttaaagggttcttggttgcttatgttagatcctagtgaaggagcctcactttctctgaggtgctgtggagaattagaatttgctttgtcatgaggctatgaaagaggagaaactctcctccagtagcttcccccacaacaaaaaacctggctaatataaacccaaggacaaagaattgattggcatcagatctgtgagcttgttggggaaaacaagccttccaaatgtgtttttctttctgtcctctgttaacccaggtgataggtgagctcgtctctccagataaccgcatccccccagagcggctagatgaagcagacaggtaggagtctgatatgggggt

SEQ ID NO: 87554 - DNA, 1089 bp, Homo sapiens
cctgtttccaaaacaaagccagaaggaaatatgttagatttttaacagtgattgtcgttagatattgcgctaatccgagatttgtgttttcaatcttacacttttgtaatgtattttctaaaggatgttctttgtattagaaactgtattaaatatgtggagattaactttagcaaaattgaatgtaattaatggtattaattaaacttgtctgcgggtttggaaaaaaaaaaaaaaaaaaaaaaaaaaaaaaaaaaaaaaaaaaaaaaaaaaaaaaaaacaacaaagaacaaaaaaaaagacaaaaaaaaaacaaagaaaacaaaacaacaacaacaaaagaacgacacaggaaaaaaaaagcgacgagagtgaggggggccgcgccacatcgacaccacacgcgctggcgccgcgcaccccgcgcaccaccggccccgacgccgacacaggagggggcagccaaacaccaggacggagagagatagaaaaaacaggagagcaaggcgagacaaaaacacaaagcaacaaagagagtgaggaccagacgacacacgaacagacagcgaggaagacagtaaacaagaaccacccctccacggcggggggagcaaaagcagaacgagagagtagaacaacacgaaaggagaacgacagagagaaaacagcaagcgacacgccggcgcgagcgcggaaaaaacaaccaccgccaatgcgcgaaagacgagaagtgcaggacaacacagatacgacgcataaaggtcacagacccaccggcgcaacaagccgtgggaaagcacgaggaagaaacagagagagaaccgtgggtactgaggggcacgcagcgagaggggcaggagggaacagcgcgaggaggcaccgggaagagcggaggcgaagcacacgaacgcaggacacacagggcgcagagagagaaacacaaaattacacggggcaaaaagcggggccaacagactaaggggcggcacacacgacgaggcgcaagcgcaactcggcagacggcaaggcggcgggagccaaccagagcgaccggcacccggggcggcggccccccaggagtgcggcggg

SEQ ID NO: 87555 - DNA, 372 bp, Homo sapiens
ctcccaaagtgctaggattacaggcatgagccaccttgccaagcctgcgacctacattttattgttactgctaatttacaaacttttattctcaaggacaaagtcaagtctatgttatgccttccatgcatatgtgcttcataaaagggaataaaattatagcttgttatatttcttttatgtaaatttcaacaatttttttttttccttttcctctttttttttttttgagatgaagtcttgttgcactccagcctgggcaacagagtgagactgtctcaaaaaaaaaattcatttttgttttgggatgaatttgtgtttcatgttactagttcctttgtaaatgataaatttgttcaactgctagaagta

SEQ ID NO: 87556 - DNA, 498 bp, Homo sapiens
aaatgataactagattctggtaagcctatgtaaagcctatgtgcatcccaacttacagcccaaatattgtgccaattaggcacaggtacatacagcacacatcctcacttttcttttctttatgtttgttagcactctaactttcccagtgaaaagaatagcaaaacaaaagtggaaaaaacctatgataacaggattcacaaaaattgttgcttagacacctcaaaggagtttaatgtccttcagtgctttagatctttctcttttagggggcattcactacaagaaaagaaaaataaaagaaaatgctttgtccttcagctgtgccaccatgaatttgaattggggagaataagcgtgttcatttcccctcaatttcttccacagagtttaaagtcagactcagatccaaatcctttcaaatccaagctgctttttcatcacaggtaattataaacatttcagagcaaggtgaaatcctttaaactctatcagatt

SEQ ID NO: 87557 - DNA, 168 bp, Homo sapiens
gcaagatccacaaagaacggttggaacttttttctgtcacaccaaggaccatttctccagggttccctttaatattttatgaatctcaagaattctggctgaattcctttttctataaagttgtcatgatttatgttaatctatgaggttcctctccccagtgactgg

SEQ ID NO: 87558 - DNA, 907 bp, Homo sapiens
gtaaaggagtgagaatagagtaattgctttttaaaaagaaagtataaatgggttaatttttttcttccaactttgactttaattcagtaagaaaggcctaggtttcatctcatattcttcataattgattttcaagaagttaatttgtcattcagcctaggaggctataaaacagcagttagttggcattattagactaaaacttgggtggggggaggagactgtttcctcattgctgcaacccatggtctatcctattcctaagccattagaaagaccttgtactttgtatagaaacattagagtgaggttttgatttttaacatagtactctcaaactttgatgtgcatatgaacaagtggattctgattcagtagatctgcattgggccccgtgagtctttttaaacacagtcccaggtgattcatgcagatgcctgtgaactgcgctggtagatgggcctaagaggcttcaggctgtgttttaggttttggtaagccaggcagattcaagtccttttataactgtcaattttgtgaattggggatgcagactggttttgaaggcttaaagttcaaaaattataagaaagttaagaattttgcttaagagccttttaaaaatatggacgatttattttttaagtaggcagactaagaatttcaagttataaagaatcttattgataaggcaaagtagacaaagtattttctcatgagtatttgtgggttatgtttttgttaatataaaagttgatttctaagtattagaatatatttagtctctaaataaatcttgccttctattatggatcatcgttattaataaacatggaaaatcaacactacccctaatattaatctggcagttaaatttagtagtgctataatgaataagtcagtctag

SEQ ID NO: 87559 - DNA, 255 bp, Homo sapiens
gcagtggcacaatcacgtctcactgaagcctcgacttcctttagctcagatgattctcctatctcagcctccagagtagctggccctacaggcacgcaccaccacatgctgagattagaggtgttagctactgcactgggccctttgtatattgtatatcctttatcaaatatgtcatttatttccttctagtctgtggcttttcttttgattctcttgacagcatcccttgcaatttagaaaaaaaacaactgt

SEQ ID NO: 87560 - DNA, 724 bp, Homo sapiens
cactagattttataaattaatttcttttcattgacctaaactccacatttctgctgtgttcatctgaggtcatgtccatatagtcaaatagctgaaggaaaggtgatatttttagtcaaatcaaactccaaacatcatttttatctaaattatctggagaattgaataaatatttttttaaggctgtctgtagaagaaaattatgtcaatttttcatttagctagagaggtcctgaccacagtgtcttctgttgaatttctcctcaaggtaggattccaaaatacctggaaaatgtgaaacagtgttcctcgtatgggtaatgtagcatcttcacaaaaattctgtcatgattcatttgaaaaataataccttctcatgtctaaaatagtttttcatgagaaatacattctataagaaaaaaacaattggcctatcttagaggaaaatgctattaaaaattgtgttatggaaacaggtaacattttctttatctttgtgagttttttcaacataaattttggtcagagaaatcatttcaaaatagaagagagtcagaaataatcagtacagaaatggttttgttgagaactgttaattgaaaaggcaccaagtgaagccctcatctatgtttgcataaaaaactgttttcatccctaagaagcttgtagcgtttggtgtttctagaaagctaccgcagaagtggtgctgtaggggatagtgatt

SEQ ID NO: 87561 - DNA, 582 bp, Homo sapiens
catgaatttaaagcaacaaaaagaagggtctttgttaggtttgaaatgatccccatttacctggtcagtcccttaagagaggaaatggaactgaagacaacactctctgaaatatccctaggcctgtgccaatccaattagtcaattattatttgatgcaaataccctgccccaggtgaccagttggtggttctctgctaaactacatagctaatgccattcaaagatggtatctgcagagactgctaatctacggatgattccaacccagctgttaagtgacatcacagattatgaaaagagtgaattcaatcattcaaagtgaggaaatttattcacaacatacatataacaacaaacaagcattgaaagggggaaaatacagtcgcttgacaaagggaggtttttgaatccaatgggcttttttcctgaatgtggtttgtgtggtcgacatcacctcagtctttttctagatatgtcatgctgcaacattaaggtcatcagagatctgtatgcccatccagcagatagcaggactttcttttctgttgctgctgagttgctgctgatctttcaaacatt

SEQ ID NO: 87562 - DNA, 669 bp, Homo sapiens
ttaatgaattcatttcaaataaaaatccattcagtgcatgcagaaaagccagtccctctgagtgacaaatttgtgtgtgccagggatgagagagcaaatcaaactcgtggagcttgcaaccaaactcctagaggcccaaacacaggactgccaagagcccaggagtgcagagtcattctgctaaaagaagttcccactccaaaaagctctatagagatgctggcctgggtggaaacgtcccctctccctgccctttcacttaaccaaaagggaagaccagcaggagccgtggaaatcaaacccagggcatgtggctagccacctgcgggaggctggggcctggaccaggtgatctctccaggcactttcctgctcttgaatttcatgaatatttcattgtccaggttccaatccatgcagaacagaacctcagaaaacatacaaatatttccccttcttatagagaagtgacctatagtgctagaccaatgactctcatctaagggtgactgtgtcccccaggagacacgtggcaattgctagctgtcacaaccagggagggattgctactggcatctagtgggtagaggccggggatgccgctaaacatcctactacagatacaatgcactccaatgcacccccacttccccaacctccacccttgca

SEQ ID NO: 87563 - DNA, 241 bp, Homo sapiens
taaacaaatatcctgtggccacacccattgtggattgccttatcctctagtgtgaatttgttttagctctgaatgtctgatcaccctaaccagacatctacccttcccaggtaaccagcccagtggttctaaaagtacagtcccaggaccagcagcctcagcaccacctgagaacatgttaggaatgcaaactctcaagccccactccatacccgcagaatcaaaaactcttggggtggga

SEQ ID NO: 87564 - DNA, 2000 bp, Homo sapiens
  misc_feature (1452)..(1452): n is a, c, g, or t
gcgcccagaacgccccggccatgggcatccgaggcatgctgcgagccgcagtgatcctgctgctcatcaggacctggctcgcggagggcaactaccccagtcccatcccgaaattccacttcgagttctcctctgctgtgcccgaagtcgtcctgaacctcttcaactgcaaaaattgtgcaaatgaagctgtggttcaaaagattttggacagggtgctgtcaagatacgatgtccgcctgagaccgaattttggaggtgcccctgtgcctgtgagaatatctatttatgtcacgagcattgaacagatctcagaaatgaatatggactacacgatcacgatgttttttcatcagacttggaaagattcacgcttagcatactatgagaccaccctgaacttgaccctggactatcggatgcatgagaagttgtgggtccctgactgctactttctgaacagcaaggatgctttcgtgcatgatgtgactgtggagaatcgcgtgtttcagcttcacccagatggaacggtgcggtacggcatccgactcaccactacagcagcttgttccctggatctgcataaattccctatggacaagcaggcctgcaacctggtggtagagagctatggttacacggttgaagacatcatattattctgggatgacaatgggaacgccatccacatgactgaggagctgcatatccctcagttcactttcctgggaaggacgattactagcaaggaggtgtatttctacacaggttcctacatacgcctgatactgaagttccaggttcagagggaagttaacagctaccttgtgcaagtctactggcctactgtcctcaccactattacctcttggatatcgttttggatgaactatgattcctctgcagccagggtgacaattggcttaacttcaatgctcatcctgaccaccatcgactcacatctgcgggataagctccccaacatttcctgtatcaaggccattgatatctatatcctcgtgtgcttgttctttgtgttcctgtccttgctggagtatgtctacatcaactatcttttctacagtcgaggacctcggcgccagcctaggcgacacaggagaccccgaagagtcattgcccgctaccgctaccagcaagtggtggtaggaaacgtgcaggatggcctgattaacgtggaagacggagtcagctctctccccatcaccccagcgcaggcccccctggcaagcccggaaagcctcggttctttgacgtccacctccgagcaggcccagctggccacctcggaaagcctcagcccactcacttctctctcaggccaggcccccctggccactggagaaagcctgagcgatctcccctccacctcagagcaggcccggcacagctatggtgttcgctttaatggtttccaggctgatgacagtattnttcctaccgaaatccgcaaccgtgtcgaagcccatggccatggtgttacccatgaccatgaagattccaatgagagcttgagctcggatgagcgccatggccatggccccagtgggaagcccatgcttcaccatggcgagaagggtgtgcaagaagcaggctgggaccttgatgacaacaatgacaagagcgactgccttgccattaaggagcaattcaagtgtgatactaacagtacctggggccttaatgatgatgagctcatggcccatggccaagagaaggacagtagctcagagtctgaggatagttgccccccaagccctgggtgctccttcactgaagggttctccttcgatctctttaatcctgactacgtcccaaaggtcgacaagtggtcccggttcctcttccctctggcctttgggttgttcaacattgtttactgggtataccatatgtattagtcccccagtgctccagaacagcgggagcactgtgctgtgctcctttcagtttcttttgggtttgtttttccctctttcctt

SEQ ID NO: 87565 - DNA, 585 bp, Homo sapiens
gcgcccagaacgccccggccatgggcatccgaggcatgctgcgagccgcagtgatcctgctgctcatcaggacctggctcgcggagggcaactaccccagtcccatcccgaaattccacttcgagttctcctctgctgtgcccgaagtcgtcctgaacctcttcaactgcaaaaattgtgcaaatgaagctgtggttcaaaagattttggacagggtgctgtcaagatacgatgtccgcctgagaccgaattttggagtgtgatactaacagtacctggggccttaatgatgatgagctcatggcccatggccaagagaaggacagtagctcagagtctgaggatagttgccccccaagccctgggtgctccttcactgaagggttctccttcgatctctttaatcctgactacgtcccaaaggtcgacaagtggtcccggttcctcttccctctggcctttgggttgttcaacattgtttactgggtataccatatgtattagtcccccagtgctccagaacagcgggagcactgtgctgtgctcctttcagtttcttttgggtttgtttttccctctttcctt

SEQ ID NO: 87566 - DNA, 83 bp, Homo sapiens
agaacagaagtttaaatattgggcatgaacaagtggacatacatatcccatggatattaaaaggataataaatgaatactatg

SEQ ID NO: 87567 - DNA, 590 bp, Homo sapiens
tgatgtgatctagaggatcccttgggctcattcagggttgtgtcattcagggttggggctcagtcaggaagagatgggaacatctgggccctcaccggcctctcgccacactccccacttccctcctcacggtagccaaagttctcccggggctttccaccaggggtgccttcgtgcagggccggtgcgtgccattccttctgtctagaaggctctttcccccttggcttctcctttctgattcttcctaatttttcaagtctcaccttataagtcacttcctccaggaaggcctgccgggaggaagtgacttataaggtgagacttgaaaaagtaggaagaatcagaaagcagaaccagagaggatccagagcaaggccagggtcagggcagaaccaggaccaggataaggcaaagccaaggccagggtagggcaaggccagggcagggcaagatcagggaagggcaaggccagggtagaaaaggccagggtagggccaggccagggtaggagaaggccatggtagggccaaggccaaggcagggcagggctagggtagcacagggcatggccaaaaacagagcagggc

SEQ ID NO: 87568 - DNA, 306 bp, Homo sapiens
gggactttcttagccaatctggttatgccaacatcttgcctcctaggagcagccttggcttattgtcccccagcaacaaccctgagagagccaacaggaaggactcccttactgagagctgggccatcttaggagcccacatcccactggaggcccgaggattgttttaagtcttgtgaaatcacaggcaactcgcacaaagctcgaggtgttttttttgttttttgttaattgatttcgttgttagttggttttgacagtgtgtttgttttgcaacacaactgacacagaaccctggctgaactc

SEQ ID NO: 87569 - DNA, 371 bp, Homo sapiens
tgctaggattacaggcatgaaccaccgtgcccagcctccaaagcttttttatcatcccaaacggaaactctactggttaagcagtcactccccgtttcccatcccttccgccagccccagctcatctgctttctgtctctatggatttgtctattctagagatttcatacagcgtttggctttttgtctggcttctgtcacttagcacaatgttttcaaagttgacccacgcggtggcacgtgtagggcttggttccttgttaaggctgaataaggtcccatcggataactagaccgcgttgtgtttatccactcatccatcatacacttgggctgtttccatccttctttcaagtctcaggagtgtgttt

SEQ ID NO: 87570 - DNA, 580 bp, Homo sapiens
tccatagagatggggtttcaccatgttgcccaggctggtcttgaactcctggactcaagccatctactcaccttggcctcccgaagtgctgggattatgagcatgtaccaccacacccatcccacagtttctaagagaatctgacctttttcagtttccagagacagtctttgtgattaatgatctatctgtgttagtctaagactccaagaccaatctcccatttccaaagacagaactgggagaaacttccctttcctctaaagaggtgattctgtatgtaagctaagagtaatcaaagcaagttagaatgcaatctccttatatccttgtgagaaggatgggagaggctccccacacatgaaggtaaacaagaggttgcagattttcaccatcgttgacagggtgggtggtgtgctggcagaggggaagcagtagagttattcaggctgaatggacatcactaagggaaccaggttctttcaggtgcacaggggaaatcagcaagtttcagtgaattcatgacaacttgcctcaggctgctatgaaagatggccacaaggtctcctctattagtgag

SEQ ID NO: 87571 - DNA, 854 bp, Homo sapiens
gcagagtctgatggagtctgcctccggcctgccttcctctgggccttcgaagccccctctcaaaaggccaggacgcgctgggcccaagaaagacacccgtcttcacaggccaaccagaactctggccacctgcgggaggacggcactgtcccttgcgacccggcccaggagccgtcctcctccacagcctcctcgaggatagcgagcccgaattccacgcgggcgatgagccccgaagcgcgcggttgcctctgcccctcccgaaccgagaaggaaagaggggagagggaaacaggagtctgatggaggggagagaaatggaattccagaggcagcccacgggcagacacctgcaagaatggctgtgttctggccctgaagttcttaatagtgagggcccaggatagttcccttggggctgtgggaaaagagggaagttcacgctctcagatgttggaggaattggaagccggaggtgtgatttcttggcctccagcagaaacttggttacagtggccacgttctttctctcttctgagaatttggacaagtcactcaatctctctgctcttctgttttctgatatgtgcgatatcatctcaaaaatttcttccagctcctgagatattagtgacaaaatcatcacaagttattttttcagcccttctaaatatagcttcatataatgtaatatattgaagtaaataatctagaaacatgtgaaatgaccaattcctctcacaatgaagatgtgcatcagaaataaaaaacaaagaacatgtttcttttaataagcaaaatagacccattctcagacttatgatcagaaataagactgactcaaagttttcctc

SEQ ID NO: 87572 - DNA, 402 bp, Homo sapiens
ggtgctctttcagttgctcggtcctccctccctccatcccttccttctgcactcctgcacctctttgctttctggcactagaagttgctccaggctcatctcgtgtatttcctgcccaaggcctagaatcagccatttcttcaaggaatcgaggctcttctcttggagaatggtattagaaagcaagacttgggtgctaggtatgcttgttgctattggggtgtcacttgcttggccccctcagatgacagaacatggaaatacctatgtgtatactaacccatgtgtatacacataattataaatatttctgtatgtgacgatctgtatgtatattaagctaagcatgaattgatagcatgaattgatagtgatgtctccagctctgattattaccatgtg

SEQ ID NO: 87573 - DNA, 480 bp, Homo sapiens
ccgaattcggcacgagagaggatacaggtgtaagctctaatagatgtctaattggattgtcacaagcagaagagagaggaaagggtcagagacaacatttgaagtgacaatggcaaaaatctttctggaaatgatgaaaaataacaatcgatgtttcaacaaatccaatgtatcaacatttacctttatattctttctccaaatttctacctctttatctctcttataagaattccagaagttctttggttctattttctagttttctaattttattttcaactgtgtctaatttgttataaaatttatccactgaaatttgttaattaaataattatgtttttacttctcagagtattgtttgatttgtttgcaaatatgcttaggctttaaccatattttaaacttctttgcctcacatttatcagttttactcctcagttactgataagcaacttataatatgtactctctttcctc

SEQ ID NO: 87574 - DNA, 1846 bp, Homo sapiens
ggagctgcgggctgcgtggccgggatgagcgccagcacgggcggtggtggggacagcggcggcagcggcggcagtagcagcagctcacaggcctcctgcgggcccgagtcctcgggctccgaactagccctggccacaccggtgcctcagatgctgcagggccttctgggctccgacgacgaggaacaggaagaccccaaagactactgcaagggcggctaccaccctgtgaagatcggcgacgtgttcaatgggcggtaccacgtggtgcgcaaactgggctggggccacttctccaccgtctggctctgctgggacatccagcgcaagcgctttgtggccctcaaagtggtgaagagtgcggggcattacacggagacagctgtggatgagatcaagctcctgaaatgtgtccgggacagcgaccccagtgaccccaaaagagagaccattgtccagctcattgatgacttcaggatctcaggagtcaatggagtccatgtgtgcatggtgctggaggtgctgggccaccagctcctcaaatggatcatcaagtccaactaccagggcctgcccgtgccctgcgtgaagagcatcgtgaggcaggtgctgcacggcctggactacctccacaccaagtgcaagatcatccacacggacatcaagcccgagaacatcttgctgtgtgtgggggacgcttacatcaggcgcctggctgccgaggccacggagtggcaacaggcaggggcgccgcccccctcccgctccatagtcagcactgccccccaggaggtcttgaccggtaagctgtccaaaaacaagaggaagaagatgaggcgcaaacggaaacagcagaagcggctgctggaggagcggctgcgggacctgcagaggctggaggccatggaggctgccacccaggctgaggactctggcttgagactagacgggggcagcggctccacatcctcttcaggcttctccggctccctcttctctcctgcctcctgctccatcctctccggctcgtccaatcagcgagagaccgggggcctcctgtcgcctagcacaccattcggtgcctcgaacctcctggtgaaccccctggagccccaaaatgcagataagatcaagatcaagatcgcagacctgggcaacgcctgctgggtgcacaagcacttcacggaagacatccagactcggcagtaccgggccgtcgaggtgctgatcggcgccgaatacggccccccggcagacatctggagcacagcctgcatggccttcgagctggccactggtgactacctgttcgagccgcattctggagaagactacagtcgtgatgaggaccacatcgctcacatagtggagcttctgggggacatccccccagccttcgccctctcaggccgctattcccgggagttcttcaaccggagaggagagctgcggcacatccacaatctcaagcactggggcctgtacgaggtactcatggaaaagtacgagtggcccctagagcaggccacacagttcagcgcctttctgctgcccatgatggagtacatccccgaaaagcgggccagtgccgctgactgcctccagcacccctggctcaacccctaggcccggctgtggctccacctccagctctccgtgccttaagggaaaagcgggacagctcccaccaccctgctgggcgccagttctccacaaccacagggcagagagacgctggagccaggcccggctctcagagcgtgttctgcctgagacccccgtgagggctctcggagaaagtgtgtgtattcctttcttaataaagtgtggactgaacatcggtgcc

SEQ ID NO: 87575 - DNA, 1778 bp, Homo sapiens
  misc_feature (706)..(707): n is a, c, g, or t
  misc_feature (709)..(709): n is a, c, g, or t
  misc_feature (712)..(713): n is a, c, g, or t
  misc_feature (715)..(715): n is a, c, g, or t
  misc_feature (719)..(719): n is a, c, g, or t
  misc_feature (722)..(722): n is a, c, g, or t
  misc_feature (726)..(726): n is a, c, g, or t
  misc_feature (729)..(729): n is a, c, g, or t
ggagctgcgggctgcgtggccgggatgagcgccagcacgggcggtggtggggacagcggcggcagcggcggcagtagcagcagatgctgcagggccttctgggctccgacgacgaggaacaggaagaccccaaagactactgcaagggcggctaccaccctgtgaagatcggcgacgtgttcaatgggcggtaccacgtggtgcgcaaactgggctggggccacttctccaccgtctggctctgctgggacatccagcgcaagcgctttgtggccctcaaagtggtgaagagtgcggggcattacacggagacagctgtggatgagatcaagctcctgaaatgtgtccgggacagcgaccccagtgaccccaaaagagagaccattgtccagctcattgatgacttcaggatctcaggagtcaatggagtccatgtgtgcatggtgctggaggtgctgggccaccagctcctcaaatggatcatcaagtccaactaccagggcctgcccgtgccctgcgtgaagagcatcgtgaggcaggtgctgcacggcctggactacctccacaccaagtgcaagatcatccacacggacatcaagcccgagaacatcttgctgtgtgtgggggacgcttacatcaggcgcctggctgccgaggccacggagtggcaacaggcaggggcgccgcccccctcccgctccatagnnancanngncccncangggnctngaccggtaagctgtccaaaaacaagaggaagaagatgaggcgcaaacggaaacagcagaagcggctgctggaggagcggctgcgggacctgcagaggctggaggccatggaggctgccacccaggctgaggactctggcttgagactagacgggggcagcggctccacatcctcttcaggcttctccggctccctcttctctcctgcctcctgctccatcctctccggctcgtccaatcagcgagagaccgggggcctcctgtcgcctagcacaccattcggtgcctcgaacctcctggtgaaccccctggagccccaaaatgcagataagatcaagatcaagatcgcagacctgggcaacgcctgctgggtgcacaagcacttcacggaagacatccagactcggcagtaccgggccgtcgaggtgctgatcggcgccgaatacggccccccggcagacatctggagcacagcctgcatggccttcgagctggccactggtgactacctgttcgagccgcattctggagaagactacagtcgtgatgaggaccacatcgctcacatagtggagcttctgggggacatccccccagccttcgccctctcaggccgctattcccgggagttcttcaaccggagaggagagctgcggcacatccacaatctcaagcactggggcctgtacgaggtactcatggaaaagtacgagtggcccctagagcaggccacacagttcagcgcctttctgctgcccatgatggagtacatccccgaaaagcgggccagtgccgctgactgcctccagcacccctggctcaacccctaggcccggctgtggctccacctccagctctccgtgccttaagggaaaagcgggacagctcccaccaccctgctgggcgccagttctccacaaccacagggcagagagacgctggagccaggcccggctctcagagcgtgttctgcctgagacccccgtgagggctctcggagaaagtgtgtgtattcctttcttaataaagtgtggactgaacatcggtgcc

SEQ ID NO: 87576 - DNA, 722 bp, Homo sapiens
gacagccttggccccagcccgtccccagggctccccttgcttccagcacaagcacttcacggaagacatccagactcggcagtaccgggccgtcgaggtgctgatcggcgccgaatacggccccccggcagacatctggagcacagcctgcatggccttcgagctggccactggtgactacctgttcgagccgcattctggagaagactacagtcgtgatgaggaccacatcgctcacatagtggagcttctgggggacatccccccagccttcgccctctcaggccgctattcccgggagttcttcaaccggagaggagagctgcggcacatccacaatctcaagcactggggcctgtacgaggtactcatggaaaagtacgagtggcccctagagcaggccacacagttcagcgcctttctgctgcccatgatggagtacatccccgaaaagcgggccagtgccgctgactgcctccagcacccctggctcaacccctaggcccggctgtggctccacctccagctctccgtgccttaagggaaaagcgggacagctcccaccaccctgctgggcgccagttctccacaaccacagggcagagagacgctggagccaggcccggctctcagagcgtgttctgcctgagacccccgtgagggctctcggagaaagtgtgtgtattcctttcttaataaagtgtggactgaacatcggtgcc

SEQ ID NO: 87577 - DNA, 302 bp, Homo sapiens
tcccactcctaatggagctgtggggagtggggccacaggcggggaggcagggagagtagtgagtagctggtgccaaggggcgctggcgccacattctggtgtccatgggagccctggggcccggagaggcctcttccctggcggctgtgcagggaaacctccacttcatgctgactggggcgggcgacaggaaccctggggtgaccctggctctgacagcagaccggtaagctgtccaaaaacaagaggaagaagatgaggcgcaaacggaaacagcagaagcggctgctggaggagcggct

SEQ ID NO: 87578 - DNA, 1945 bp, Homo sapiens
ggagctgcgggctgcgtggccgggatgagcgccagcacgggcggtggtggggacagcggcggcagcggcggcagtagcagcagctcacaggcctcctgcgggcccgagtcctcgggctccgaactagccctggccacaccggtgcctcagatgctgcagggccttctgggctccgacgacgaggaacaggaagaccccaaagactactgcaagggcggctaccaccctgtgaagatcggcgacgtgttcaatgggcggtaccacgtggtgcgcaaactgggctggggccacttctccaccgtctggctctgctgggacatccagcgcaagcgctttgtggccctcaaagtggtgaagagtgcggggcattacacggagacagctgtggatgagatcaagctcctgaaatgtgtccgggacagcgaccccagtgaccccaaaagagagaccattgtccagctcattgatgacttcaggatctcaggagtcaatggagtccatgtgtgcatggtgctggaggtgctgggccaccagctcctcaaatggatcatcaagtccaactaccagggcctgcccgtgccctgcgtgaagagcatcgtgaggcaggtgctgcacggcctggactacctccacaccaagtgcaagatcatccacacggacatcaagcccgagaacatcttgctgtgtgtgggggacgcttacatcaggcgcctggctgccgaggccacggagtggcaacaggcaggggcgccgcccccctcccgctccatagtcagcactgccccccaggaggtcttgaccggtaagctgtccaaaaacaagaggaagaagatgaggcgcaaacggaaacagcagaagcggctgctggaggagcggctgcgggacctgcagaggctggaggccatggaggctgccacccaggctgaggactctggcttgagactagacgggggcagcggctccacatcctcttcaggctgtcaccccgggggcgccagagcaggtccctccccagcctcttcctcccccgccccagggggcggccgtagcctcagcgcgggctcacagacctcaggcttctccggctccctcttctctcctgcctcctgctccatcctctccggctcgtccaatcagcgagagaccgggggcctcctgtcgcctagcacaccattcggtgcctcgaacctcctggtgaaccccctggagccccaaaatgcagataagatcaagatcaagatcgcagacctgggcaacgcctgctgggtgcacaagcacttcacggaagacatccagactcggcagtaccgggccgtcgaggtgctgatcggcgccgaatacggccccccggcagacatctggagcacagcctgcatggccttcgagctggccactggtgactacctgttcgagccgcattctggagaagactacagtcgtgatgaggaccacatcgctcacatagtggagcttctgggggacatccccccagccttcgccctctcaggccgctattcccgggagttcttcaaccggagaggagagctgcggcacatccacaatctcaagcactggggcctgtacgaggtactcatggaaaagtacgagtggcccctagagcaggccacacagttcagcgcctttctgctgcccatgatggagtacatccccgaaaagcgggccagtgccgctgactgcctccagcacccctggctcaacccctaggcccggctgtggctccacctccagctctccgtgccttaagggaaaagcgggacagctcccaccaccctgctgggcgccagttctccacaaccacagggcagagagacgctggagccaggcccggctctcagagcgtgttctgcctgagacccccgtgagggctctcggagaaagtgtgtgtattcctttcttaataaagtgtggactgaacatcggtgcc

SEQ ID NO: 87579 - DNA, 1881 bp, Homo sapiens
ggagctgcgggctgcgtggccgggatgagcgccagcacgggcggtggtggggacagcggcggcagcggcggcagtagcagcagctcacaggcctcctgcgggcccgagtcctcgggctccgaactagccctggccacaccggtgcctcagatgctgcagggccttctgggctccgacgacgaggaacaggaagaccccaaagactactgcaagggcggctaccaccctgtgaagatcggcgacgtgttcaatgggcggtaccacgtggtgcgcaaactgggctggggccacttctccaccgtctggctctgctgggacatccagcgcaagcgctttgtggccctcaaagtggtgaagagtgcggggcattacacggagacagctgtggatgagatcaagctcctgaaatgtgtccgggacagcgaccccagtgaccccaaaagagagaccattgtccagctcattgatgacttcaggatctcaggagtcaatggagtccatgtgtgcatggtgctggaggtgctgggccaccagctcctcaaatggatcatcaagtccaactaccagggcctgcccgtgccctgcgtgaagagcatcgtgaggcaggtgctgcacggcctggactacctccacaccaagtgcaagatcatccacacggacatcaagcccgagaacatcttgctgtgtgtgggggacgcttacatcaggcgcctggctgccgaggccacggagtggcaacaggcaggggcgccgcccccctcccgctccatagtcagcactgccccccaggaggtcttgaccggtaagctgtccaaaaacaagaggaagaagatgaggcgcaaacggaaacagcagaagcggctgctggaggagcggctgcgggacctgcagaggctggaggccatggaggctgccacccaggctgaggactctggcttgagactagacgggggcagcggctccacatcctcttcaggctgtcaccccgggggcgccagagcaggtccctccccagcctcttcctcccccgccccagggggcggccgtagcctcagcgcgggctcacagacctcaggcttctccggctccctcttctctcctgcctcctgctccatcctctccggctcgtccaatcagcgagagaccgggggcctcctgtcgcctagcacaccattcggtgcctcgaacctcctggtgaaccccctggagccccaaaatgcagataagatcaagatcaagatcgcagacctgggcaacgcctgctgggtgcacaagcacttcacggaagacatccagactcggcagtaccgggccgtcgaggtgctgatcggcgccgaatacggccccccggcagacatctggagcacagcctgcatggccttcgagctggccactggtgactacctgttcgagccgcattctggagaagactacagtcgtgatgaggaccacatcgctcacatagtggagcttctgggggacatccccccagccttcgccctctcaggccgctattcccgggagttcttcaaccggagaggagagctgcggcacatccacaatctcaagcactggggcctgtacgaggtactcatggaaaagtacgagtggcccctagagcaggccacacagttcagcgcctttctgctgcccatgatggagtacatccccgaaaagcgggccagtgccgctgactgcctccagcacccctggctcaacccctaggcccggtgggcgccagttctccacaaccacagggcagagagacgctggagccaggcccggctctcagagcgtgttctgcctgagacccccgtgagggctctcggagaaagtgtgtgtattcctttcttaataaagtgtggactgaacatcggtgcc

SEQ ID NO: 87580 - DNA, 330 bp, Homo sapiens
gatcaggacctcttcttcctcccaacactgccccaagagcccgttgttaaacgtttaccagcacactactgggctgtttctctaccacttgattgaaatgatccttatggaagcacaaatgacttcactgtcactaaatccaagggacaatttttagtctctatttttcttcaactctccaggatgtttgagagctgatctttccctccctcttgagcctcctctcctgcctggcttttaggggtctctgctgacttttcttcatttctaaacacatgttctcaggggtcctcagcctgcaggccatgcactggtaccagtctgtggcct

SEQ ID NO: 87581 - DNA, 334 bp, Homo sapiens
gcaaaatatgaattctgagctttacccacttacatgtggtattagttttctacagatgccataagaaattaccacaaacaggctgggcaaagtggctcatgcctgtaatcccagcactttgggaggccgaggcaggtggatcacttgaggtcaggagttcgagatttgagaccagcctggccaacacagtgaaaacccatctctactaaaaatacaaaatttagcagggcatggtggcgcgtgcctgtaatcccagccactcaggaggctgaggcaggagaattgcttgaacccgggaggtggaggttgcagtgagatgagatcgtgccactgc

SEQ ID NO: 87582 - DNA, 334 bp, Homo sapiens
tggaattagtagtgataactgcattaacattgtggatatactaaaaaccagtgaacagtatacttaaaaatggttaaaatggttaattttatgatatatgatttttgtctcagtttaataaaaaacaaaagctgctgaacaactgaaaacaggttaaacactatactgagaatacagaaacagtgacaccagtctttccaggttctgttaaacttactatcaaagacatctttcatttaagaagattttcttctcaactgagcttttgagtttgcatttggcaaataaaaatgttaaagttttagttctactcttaacagagagaaaagactgc

SEQ ID NO: 87583 - DNA, 434 bp, Homo sapiens
tgttgcccagactggagtgcaatggggggacctcggctcactgcaacctctgcctcccaggttcaagcaattctcctgcctcagcctcccgagtggctgggattacaggcgcctgccatcacgcccggctaatttttgtgtttttagtaaagacagggtttcactatgttgcccaggctgggctcgaattcctgacctcaactgattcgcccacctcggccatgatgcccagctaatttttgtatttttcataaagacggggtttcaccatgttggccagactggtctcgaactcctgacctcaggtgatccacctgccttggcctcccaaagtgctgagattacagatgtgagcaagcacgcccggcctacttatcattattgatccctgacatatacgaaggggttggatatattaattattttttcaaaag

SEQ ID NO: 87584 - DNA, 290 bp, Homo sapiens
tttacctccctcccctaacttactaaatgcaaatgtactaaatgagatcctggctcaacaaaagcgcaggatctcatctgctttgttcactaccactgtagttccagacctacaatcatctctgttactgcaacattcaaaatatatttttggaatgaattaataataactttgaaatgaagaggaagatggcatgaatcacaaaaactctttggaaattgtgtcagaatttaattgattattttcatatgcattatctattaataataaatacctcatattataaattc

SEQ ID NO: 87585 - DNA, 339 bp, Homo sapiens
cccatttcagccttccaagtagctggacccacaggcatgcaccaccatgctcagctaatttttatactttttttgtagaagcagagttttgctatgttacccatagtggtctcagactcctgagctcaagcaatcagcctgcctcagccttccaaagtgctgggatttcaggtgcgagccactgtgcccagccagcaataaataacaacttctctcaacttaatttagagagctaattcaatagtgattttaaaaatccaatggaaattgatacaaatatcgaaggagttgatacaagtattctgaagttcaatgagataataaagaaaatattcaaaa

SEQ ID NO: 87586 - DNA, 445 bp, Homo sapiens
aatgctatgtgttctattactatgatgctgattattaagtacaggtaacatttattggatgcatactaactacagcttaaagtgctttatatgtttatctcctttaatcatcatggcaagatgatgtggtaaagaatatgactacttttggctgggcacagtggctcacgctggtaattccagtgtgcctccagaccagtatgctccttcctgatagctgcagtgacgttcctcatcctatataaagtcttcagaattatgtaaacagtgatttactgctacctatttgtcttcattgaccttttaaaaacaaattccttgcacaggcaagccttaaaatgtagttttcaacagttgagtcaacaatgcgtaattgtcttaacagttacagactttcacagcaacactaagttaacccattagtaacagagtaagaactttgggt

SEQ ID NO: 87587 - DNA, 224 bp, Homo sapiens
ccgcatccccgtgcccactgcggggctcggacagggggcgccgcgccaggccgcagaccccgcccttccgcgtccccactccggctgcccgtgcggctccggacgaggcttcccgggggctccgggccggggcagccgcggcgccctctccccaggtccaccgcgggcgctgctttcaaacaaaggcaggagacggagcgggagacgctgccgtgactgctccg

SEQ ID NO: 87588 - DNA, 2574 bp, Homo sapiens
ccacgcgtccgcgctcccctcagctcctgcagtgctaattaagggagggagcagcggggagcttgcagtgaccaagagggtgttgaggctaggaggccacgataaacaggatacgataaaagtccttaaccaagacgcagatgggaagaagcgttagagcgagcagcactcacatctcaagaaccagcctttcaaacagtttccagagatggattatcctactttacttttggctcttcttcatgtatacagagctctatgtgaagaggtgctttggcatacatcagttccctttgccgagaacatgtctctagaatgtgtgtatccatcaatgggcatcttaacacaggtggagtggttcaagatcgggacccagcaggattccatagccattttcagccctactcatggcatggtcataaggaagccctatgctgagagggtttactttttgaattcaacgatggcttccaataacatgactcttttctttcggaatgcctctgaagatgatgttggctactattcctgctctctttacacttacccacagggaacttggcagaaggtgatacaggtggttcagtcagatagttttgaggcagctgtgccatcaaatagccacattgtttcggaacctggaaagaatgtcacactcacttgtcagcctcagatgacgtggcctgtgcaggcagtgaggtgggaaaagatccagccccgtcagatcgacctcttaacttactgcaacttggtccatggcagaaatttcacctccaagttcccaagacaaatagtgagcaactgcagccacggaaggtggagcgtcatcgtcatccccgatgtcacagtctcagactcggggctttaccgctgctacttgcaggccagcgcaggagaaaacgaaaccttcgtgatgagattgactgtagccgagggtaaaaccgataaccaatataccctctttgtggctggagggacagttttattgttgttgtttgttatctcaattaccaccatcattgtcattttccttaacagaaggagaaggagagagagaagagatctatttacagagtcctgggatacacagaaggcacccaataactatagaagtcccatctctaccggtcaacctaccaatcaatccatggatgatacaagagaggatatttatgtcaactatccaaccttctctcgcagaccaaagactagagtttaagcttattcttgacatgagtgcattagtaatgactcttatgtactcatgcatggatctttatgcaatttttttccactacccaaggtctaccttagatactagttgtctgaattgagttactttgataggaaaaatacttcattacctaaaatcatttttcatagaactgtttcagaaaacctgactctaactggtttatatacaaaagaaaacttactgtatcatataacagaatgatccaggggagattaagctttgggcaagggctatttaccagggcttaaatgttgtgtctagaattaagtatgggcataaactggcttctgaatccctttccagagtgttggatccatttccctggtcttggcctcactctcatgcaggctttcctcttgtgttggcaagatggctgccaactcttggcaattcatacatccttgtttctgtctggtagagagtttgcttctcaaatggagcaaacaaatttgattattttttcattgttaaataggcaacatgaccagaaaggatggaatggcttaagtaaactaagggttcacttctagagctgagaagcagggtcaaagcacaatactgggcaattcagagcatggttagaagaggaaaggggagtctcaaagctggagagtttaccaacaaatattgactgcagtgattaaccaagacatttttgttaactaaaaagtgaaatatgggatggattctagaaatggggtatctctgtccatacttctagaatccactctatcagcatagtccagaagaatacctggcagtagaagaaatgaatattcaagaggaagataaatgcgagagggcaatcctttactattctcatatttatttatctctcattctgtatagaattcttgccgccatcccaggtctagccttaggagcaaatgtagtagatagtcgaataataaataacttaatgttttggacatattttgtctacttttgagaattatttttaatatgtaaattctctcaaaagggtcaggcacctagttattattttttaatgattatgtgaaagttgaatataatataccactaaaagtgacagttgaaagtggtggcataggatggtagggtagaaatttgggagggaaaaaagaaattgggagggtacaggcaacaggagaaaggaatcaaaccacagaaaaatacaaagggaaacttctgcttcactattcagacaaagacagccctaatgacatcaccaacagtcaaagcaattagagaccatacctaatattgtttaaattctagatgtaggctaacaatgaaaagtatttgccaaactgaataaaactgtcatggttaccttg

SEQ ID NO: 87589 - DNA, 397 bp, Homo sapiens
caagccttctgggcagctaaaattttactgaattttatccaggagaacataatggcttaggctgggtgactaagactccaggaccatttggaagaattaggaaaccagggcaaaagccacatttccttggaacacgatgagctctgtcttaaatacggtgagtgtggaaaattgtaagagacagacatttggaagatgggtagactgggatgagctcagaagaggctcggctagagatacagacttgatatctgcaaaaaagaaaaccatcaaagatgtaagagcttcttcctcagccttagttttgctcttctactccccctactcaatatttcaactgagatcatgagctctggactcacgtcccacaccacaagatgtccagagcacctggcat

SEQ ID NO: 87590 - DNA, 651 bp, Homo sapiens
gagagatagagagagagagagcagatatgcaccagtaaacttggtgggatttgcatggggaattattgcatgagccactgtacctggcctttatgccattatttaatttacagtgttcaagctaggttagcttttacattataaagccagatctcttacattagagtatcaaggtgagccttctgtgtttgagtgtttaatttagatgtgaaatgtttgataggacactatactagaggctctaagaaatagagctctgtggtgaatttcttttctttactattacagatttctaatgatacttttctatgttgtaattttgggtttgtacatgtgggttgtgagaaataaactggaaatcctgtctctgtgggttggaatctggtgtggcttcaaaaggcaaacaaaatattctagcatttacatgccaggtaaattttttaaatggactttccataggttccaaacttctggggccaaataatataaagtaatattgtagttgcagacagacttctgttggcatacatttggtttcttaatttatgatgggacatcaatagctgattaagcaaacaactaaagaaatatctttgtacatccttagtacagcttgttcctgttcatttgtgacaagttgtttgggaaaga

SEQ ID NO: 87591 - DNA, 935 bp, Homo sapiens
accagacctgtcttccagatgttatgtccacagcagtgacttctctaaaatctgaaaggaaagggaaagctattggccatgctttgtaatacacaaatttattttaattacacttgcagaactaaaaggattgctcttcctctggcctccgggtcgccatagtggtggcagaggctgcagtgttggaggaacactttggaatctgtggctgacccgggtagctgaaaacagcagtggcatttcagtaccacttgtcagtttttggctcagtagcagaaggctgcctacagagcacctaaagtgtatgtttcccaaataggagtggcactgcggctggtctggatcatgtacaaaacttcatcctctttccttcaacacaggaacaggaaggattttaatggcttgagtttatgatgctattgaaaaggcactatcaacatttcccagcggctacgactccatatccattcagggaccagcagcccatctgttgatttccaaggcagggctgttaactgcatctgggttacatatgcctggccagttcaatggttgtgtgtgtgtagcaatctttggttgtgcatgactgtaacaacctctcagggtctcagtttcctctttggttcagtaagaatgtcccctgtgcttttgaagtctgttacatgtgctcatgcttgaatgagactgtgttgcatcaattgagctataatgcaagatcattaaattaatgactgatgaaatgacggtaaactctttctccagggtagactggctgagtagaacagggacttcttaaaattatgtcacattaatttggccagaggtttgctgtcctaatgatctcaagattaggatgggcaaccttctgtacacaggctataaccagcgtggctagtggtggtgcatcccaacacatggaggaggagatcctcctc

SEQ ID NO: 87592 - DNA, 466 bp, Homo sapiens
atcccacaggctggtcacttccatctgctgaaatcatgttgttagaagcctaacttcaacacagcctctcagctctgcattcccatgctgaccccaacttaaccccgcaggctggcttcactctcccctcccctcctgctctctctggaaccttctcctgggcctgcctctgaacccacccctcctgctgctgttttggaaagtgtgcggcgtgtcgggcagagggaggtgtgagacgtcagagacagctgtttccagaaatttcactttgaaggggaggggaggcgcaggataggcgctgcagagatcactgggaacaggaaaaggagtttgctttattattagagacagggtcttgctctgtcacccaggctggagtgcagtggcaccgtcacagctcactgcagccttgacctcctgggctcaaacaatcctcccaccttagcctcccaagtagatgggactg

SEQ ID NO: 87593 - DNA, 402 bp, Homo sapiens
ttctttgagctcaacagctattctagctttagtgtattttatgtgtggcccaaggcgattcttcttcttccaatgtggcgcagggaggccaaaatattggacatccctgatatacacgttaacaggtgccatccttggatggcaggattatagagatttctacacgttcatatctgtactacgtcatttttatgaatacgcattttccacttgtaacaaaaaaagtgactgaaaatcatcctgggtcacagtgtctcatgcctgtaatcccaacactgtaagaggctgaggctttaggaggctgaggtgagcagatcacctgaggtcaagagttcaagaccagcctggccaacacagtgaaaccctatctttactaaaaacacaaaaattagccaggggtgg

SEQ ID NO: 87594 - DNA, 95 bp, Homo sapiens
gatcttagagtttgcacagcttaaaaaaatggaaatattggaatctgaatccaaaacagcctgactcaaaacaatgttctttccattatgcaagg

SEQ ID NO: 87595 - DNA, 483 bp, Homo sapiens
ctccaattatgatcagtcttccttctgatttaatgaggtttgatttgtttcagaaaattttcatgcctatacctgccacactttagcagcggccgacacctggcttgccacggtgggtgcatgtatttattgtgtgtatagagagaagggaggatgtcactgtgaaccaaagaaaccccaactaattgcaacacaaagagtgttcccttgctcaggaccccctttttttttcatggccatttctggaaaagatgagctgctccaggcaagatattcttcagaaacatcaatttctgtgaaaacacagtccaaagaaaatgcagaggaaatcagatggctgtgtgccttcctgggccagtgcttgtttttgtttttgtttttaggtgcagtctcgctctgtcgtcaggttggagtgcagtctcgcatcctcggctcactgcaacctctgcttcctgggttcaagtgattctcctgcctcaacct

SEQ ID NO: 87596 - DNA, 472 bp, Homo sapiens
cttgtgcctggcatttcatctgcactaactcagttaatgtccacaggccttagtcaggtgtctggctcttgggaggggtgctgtcaatgagagctattatttttgttgttattgtgtttatgattacaagagaccataagagacaaggaatcaaaagctgtgtttctccattatcagattatcaagggaacatcagtgaagaatatacataagacctcatgtaaggaacaaattaagcatgattgtgtctgtattctagcagtttatcatctacaacatacaattatttgagagaggaggcgtaggaagagggagcgagggagcgagaacatgcatataggtaaatggaccagtatacatgctattctgttctgttttgtaagcatgttttctggaaaatgactgttagacagcagatgtagcactcacatttgtgagttttcatttcagcagtttactgaagtgaaattta

SEQ ID NO: 87597 - DNA, 731 bp, Homo sapiens
tagtttcgccctgaccttgtgatctcaccctgaccttctgccttgtgatcttttattgccctatgaagcatgtgatccctgtgacccacaccctattcgtacactccctcccctttgaaaatcgctaataaaaacttgctggttttgcggctcagggggcatcacggaacctgctgacatgtgtctcccctggacacccagctttaaaatttctctcttttgtactctttccctttatttctcagaccggccgacatttagggaaaatagaaaagaacctacgttgaaatattgggggctggttcccccaacagattatagccaatttttctttctggattggaacaaaaaccattattacttctgttgagctgaagaagttgatttgcattcagggcccttcagtatgaaaaatctttaaaacctagaatcacaatcagccagcaagatagtctcacttagaaacgcacacctaaactgaggctaaaaaaaagtaatagtaaattcatacatcttccacctcattctgaagcatatactctaatataaaaaagaagacaatttataccacataggttgatggttgtttcaatccccaaattttcctgcctggtattcatctttattttctctcctatcagcaccccaactttcctccaaaagccaccctttctccactttaatccttgagtttctactccctccctctttcccccttgggtccccacagg

SEQ ID NO: 87598 - DNA, 629 bp, Homo sapiens
caataaatactggatatagatcatttatactaatttttcaatacctgcaacaaaaggccatgtggaataacattatcatttattatgtaccttccagcattcaaaatattaaactaagtttctttataatattattaagtgcataatcaaaactgactggaaggatgtaggtgataaaatatatttatatttggcattaagtatagtgttagggaagctaacataaacatacagaattaactgaagctatcaaaatgaggttaacaattaaagggactttttcaattatgggcaaggaaagaataaaaatgaaagttaaatcgcttgctagtttagatattatgataaaaagaaaacaaaaccacacaactgtttacattgctactgtctctctttttaaaacatttttcagatggaaatgaactgatgtccaagaaattacacacacacaaatgacaactcctcttttggctctgagaaggaaaagcagtgaaagtgacaccagggtcagctctgagcgttggccaagtacctggccaggtgcctaaggagagtcccaggtgagtggtgagtacagcatctgcgcaaagataggagcagaggcttcaagagatggttcaagtattcac

SEQ ID NO: 87599 - DNA, 959 bp, Homo sapiens
gcttcctttttattacatcttttttgtagcatctgtttatactaatccaaaattcctggacaatataacctattatgtacaacttaagaaaattagtgtaatgccttacccatagtataaagagaaaattaatctatgataatgcataatttcaaaatgttaatgtccaggcatgagttcactgttaagatgaaaatgtttccaagggggggtagtaaagggtatttgatgataattgtctgtatatcccaactctgaaactttgacttttgagctcaaagtctgtatatccaactacaaatgaaacctatgtgcctgaataactcagtttgttatcttcccatccaatctgtttatctttctaaagtttctcttttagtgaatggtaccactcatttattcacccaagttggaatcttggaatcatcttaactcctttcttccttgccttctatatcaaataccaggtcttgttggtttttacctatttaatttctctggaatttgttttccatgccttagtttaggctttaatagtttttagtttgtattattgcaattgtctaatactggttttcctgcctctgccctctttttcttatgttttgctagagtgatttgtcactcttctgcttaaaattaccatttaggggttcattattgctctctggatgtaatattttctgtgagctagaaatcagtttcatttcttggacaaaaatcctttttaatggtgagtggctgcaacatcgcattaaggaagattctgaagtatctgcggggaagaatgcagtgataagggaatgacagcatgagtcctgctttggctagaccacaggatcctttacagtctgaacctgcctacattccagtaataatgaactgcttgtggtgtcctgcaacaggaactgttgttagtttgcttttggatactttttcacatggcgttttcttggtct

SEQ ID NO: 87600 - DNA, 2119 bp, Homo sapiens
tccgcttacacaccaaggaaagttgggctttgaagaattccatccccatggccactggaggaagaatatttctcccgtcttgcttacccatctccccagttttttggaattttctctagctgttactccagaggattatgtttctttcaaagccttctgtgtacatctgtcttttcacctgtgtcctccaactcagccacagctggtcggtgaacaatttcctgatgactggtccaaaggcttacctgatttactccagcagtgtggcagctggtgcccagagtggtattgaagaatgcaagtatcagtttgcctgggaccgctggaactgccctgagagagccctgcagctgtccagccatggtgggcttcgcagtgccaatcgggagacagcatttgtgcatgccatcagttctgctggagtcatgtacaccctgactagaaactgcagccttggagattttgataactgtggctgtgatgactcccgcaacgggcaactggggggacaaggctggctgtggggaggctgcagtgacaatgtgggcttcggagaggcgatttccaagcagtttgtcgatgccctggaaacaggacaggatgcacgggcagccatgaacctgcacaacaacgaggctggccgcaaggcggtgaagggcaccatgaaacgcacgtgtaagtgccatggcgtgtctggcagctgcaccacgcagacctgttggctgcagctgcccgagttccgcgaggtgggcgcgcacctgaaggagaagtaccacgcagcactcaaggtggacctgctgcagggtgctggcaacagcgcggccgcccgcggcgccatcgccgacacctttcgctccatctctacccgggagctggtgcacctggaggactccccggactactgcctggagaacaaaacgctagggctgctgggcaccgaaggccgagagtgcctaaggcgcgggcgggccctgggtcgctgggaactccgcagctgccgccggctctgcggggactgcgggctggcggtggaggagcgccgggccgagaccgtgtccagctgcaactgcaagttccactggtgctgtgcagtccgctgcgagcagtgccgccggagggtcaccaagtacttctgtagccgcgcagagcggccgcgggggggcgctgcgcacaaacccgggagaaaaccctaagggtttcctctgccccctccttttcccactggttcttggcttcctttagagaccccggtaattgtggaacctagggaatggggaacccgctctcccagacctagggatcctgaaagggaaaaactgcaatttctccaaagcttgccactttccagcctgtttccccaattcctctgtgctctcctaaagctctgtctgaatcctcgcagccacacctaggtctgaaaactcaggctttgagttactgatcttccttggattaggaaaacaggtgttcctcctcccctctcctatcagccctaatctctgacctagcctatcaacccttaggcgctggaaaaaccttctcatacacgcaggacccaggttaactcaaagctttgcccttttgcccactgtctgctaccaggggctcaccctctgctgcacctctcttctgcacagctcctcccctgctactgctgaccaaattcccaggaatcttgaatgctttctctcctcttctccctttcctttcccaaaaaaaactgaggaaactggccccggaaaagcatgtctttggggttggttcctagaggcagaggttgaagatggaagagggagctctggagtgctaacttgaacaccaagggtgctactcatccctatggtatcatatcatgaatggactttactagtggggcaatgactttcctagacaataacccgagggactccagatacataccccgaaggtctaggaaatacgttaagggcagattacagtcatttcctaccctttaaaggtaacttctcccttctcctgacctacttcctcctagcaaccaactttacctcttcttctccaaaggatctttgttcctctgagccaagactgaggtaaataaagccactttcctcttcagatcctggtctgcacctctaga

SEQ ID NO: 87601 - DNA, 347 bp, Homo sapiens
ctaggtctgagaactcaggctttgagttacggatcctgaaagggaaaaactgcaatttctccaaagcttgccactttccagcctgtttccccaattcctctgtgctctcctaaagctctgtctgaatctcgcctattgtaggtctggattggatgcttccactcattcatttccttttaattaacccgcattcctggaggagaaatatttatgttggctcccatagaggcaatcctcagactggaaagaagggggaagaaagcctgtcttagcaaaacaatatctctaaagagctcaagaagagaaaataggagaacaaaatgccattaaaatagccttctaccccc

SEQ ID NO: 87602 - DNA, 1721 bp, Homo sapiens
tcgatgatcagagtatagggaggacgtgggcccattcattgcaggagaagggctccaccttcctgcagctgggctcttccaccgagcaacagcttcaggtcatctttgaggtgctggaggagtatgactggacgtcctttgtagccgtgaccactcgtgcccctggccaccgggccttcctgtcctacattgaggtgctgactgacggtagtctggtgggctgggagcaccgcggagcgctgacgctggaccctggggcgggcgaggccgtgctcagtgcccagctccgcagtgtcagcgcgcagatccgcctgctcttctgcgcccgagaggaggccgagcccgtgttccgcgcagctgaggaggctggcctcactggatctggctacgtctggttcatggtggggccccagctggctggaggcgggggctctggggcccctggtgagccccctcttctgccaggaggcgcccccctgcctgccgggctgtttgcagtgcgctcggctggctggcgggatgacctggctcggcgagtggcagctggcgtggccgtagtggccagaggtgcccaggccctgctgcgtgattatggtttccttcctgagctcggccacgactgtcgcgcccagaaccgcacccaccgcggcgagagtctgcataggtacttcatgaacatcacgtgggataaccgggattactccttcaatgaggacggcttcctagtgaacccctccctggtggtcatctccctcaccagagacaggacgtgggaggtggtgggcagctgggagcagcagacgctccgcctcaagtacccgctgtggtcccgctatggtcgcttcctgcagccagtggacgacacgcagcacctcacggtggccacgctggaggaaaggccgtttgtcatcgtggagcctgcagaccctatcagcggcacctgcatccgagactccgtcccctgccggagccagctcaaccgaacccacagccctccaccggatgccccccgcccggaaaagcgctgctgcaagggtttctgcatcgacattctgaagcggctggcgcataccatcggcttcagctacgacctctacctggtcaccaatggcaagcacggaaagaagatcgatggcgtctggaacggcatgatcggggaggtgttctaccagcgcgcagacatggccatcggctccctcaccatcaacgaggagcgctccgagatcgtggacttctccgtccccttcgtggagaccggcatcagcgtcatggtggcgcgcagcaatggcacggtgtccccctcggccttcctcgagccctacagccccgccgtgtgggtgatgatgttcgtcatgtgcctcactgtggtcgccgtcactgttttcatcttcgagtacctcagtcctgttggttacaaccgcagcctggccacgggcaagcgccctggcggttcaaccttcaccattgggaaatccatctggctgctctgggccctggtgttcaataattcggtgcccgtggagaacccccggggaaccaccagcaaaatcatggtgctggtgtgggccttcttcgccgtcatcttcctcgccagctacacagccaacctggccctccggccattcgacgcctccgtccattctacgcctccggccattcacagcctccggccattcacgcctccggccattcaacgcctccggccattcaacgcctccgca

SEQ ID NO: 87603 - DNA, 4299 bp, Homo sapiens
ggacgccgggttccggtcctggcccccccgccatccccccaacagaacagggtcatgaaaagaggccgcccggcggggcccgcaggcgatgcgcggcgccggtggcccccgcggccctcggggccccgctaagatgctgctgctgctggcgctggcctgcgccagcccgttcccggaggaggcgccggggccgggcggggccggtgggcccggcggcggcctcggcggggcgcggccgctcaacgtggcgctcgtgttctcggggcccgcgtacgcggccgaggcggcacgcctgggcccggccgtggcggcggcggtgcgcagcccgggcctagacgtgcggcccgtggcgctggtgctcaacggctcggacccgcgcagcctcgtgctgcagctctgcgacctgctgtcggggttgcgcgtgcacggcgtggtcttcgaagacgactcgcgcgcgcccgccgtcgcgcccatcctcgacttcctgtcggcgcagacctcgctgcccatcgtggccgtgcacggcggcgccgcgctcgtgctcacgcccaaggagaagggctccaccttcctgcagctgggctcttccaccgagcaacagcttcaggtcatctttgaggtgctggaggagtatgactggacgtcctttgtagccgtgaccactcgtgcccctggccaccgggccttcctgtcctacattgaggtgctgactgacggtagtctggtgggctgggagcaccgcggagcgctgacgctggaccctggggcgggcgaggccgtgctcagtgcccagctccgcagtgtcagcgcgcagatccgcctgctcttctgcgcccgagaggaggccgagcccgtgttccgcgcagctgaggaggctggcctcactggatctggctacgtctggttcatggtggggccccagctggctggaggcgggggctctggggcccctggtgagccccctcttctgccaggaggcgcccccctgcctgccgggctgtttgcagtgcgctcggctggctggcgggatgacctggctcggcgagtggcagctggcgtggccgtagtggccagaggtgcccaggccctgctgcgtgattatggtttccttcctgagctcggccacgactgtcgcgcccagaaccgcacccaccgcggcgagagtctgcataggtacttcatgaacatcacgtgggataaccgggattactccttcaatgaggacggcttcctagtgaacccctccctggtggtcatctccctcaccagagacaggacgtgggaggtggtgggcagctgggagcagcagacgctccgcctcaagtacccgctgtggtcccgctatggtcgcttcctgcagccagtggacgacacgcagcacctcacggtggccacgctggaggaaaggccgtttgtcatcgtggagcctgcagaccctatcagcggcacctgcatccgagactccgtcccctgccggagccagctcaaccgaacccacagccctccaccggatgccccccgcccggaaaagcgctgctgcaagggtttctgcatcgacattctgaagcggctggcgcataccatcggcttcagctacgacctctacctggtcaccaatggcaagcacggaaagaagatcgatggcgtctggaacggcatgatcggggaggtgttctaccagcgcgcagacatggccatcggctccctcaccatcaacgaggagcgctccgagatcgtggacttctccgtccccttcgtggagaccggcatcagcgtcatggtggcgcgcagcaatggcacggtgtccccctcggccttcctcgagccctacagccccgccgtgtgggtgatgatgttcgtcatgtgcctcactgtggtcgccgtcactgttttcatcttcgagtacctcagtcctgttggttacaaccgcagcctggccacgggcaagcgccctggcggttcaaccttcaccattgggaaatccatctggctgctctgggccctggtgttcaataattcggtgcccgtggagaacccccggggaaccaccagcaaaatcatggtgctggtgtgggccttcttcgccgtcatcttcctcgccagctacacagccaacctggccgccttcatgatccaggaggagtacgtggatactgtgtctgggctcagtgaccgcaagttccagaggccccaggagcagtacccgcccctgaagtttgggaccgtgcccaacggctccacggagaagaacatccgcagcaactatcccgacatgcacagctacatggtgcgctacaaccagccccgcgtagaggaagcgctcactcagctcaaggcagggaagctggacgccttcatctacgatgctgcagtgctcaattacatggcccgcaaggacgagggctgcaagcttgtcaccatcggctccggcaaggtcttcgccacgacaggctatggcatcgccctgcacaagggctcccgctggaagcggcccatcgacctggcgttgctgcagttcctgggggatgatgagatcgagatgctggagcggctgtggctctctgggatctgccacaatgacaaaatcgaggtgatgagcagcaagctggacatcgacaacatggcgggcgtcttctacatgctcctggtggccatgggcctgtccctgctggtcttcgcctgggagcacctggtgtactggcgcctgcggcactgcctggggcccacccaccgcatggacttcctgctggccttctccaggggcatgtacagctgctgcagcgctgaggccgccccaccgcccgccaagcccccgccgccgccacagcccctgcccagccccgcgtaccccgcgccggggccggctcccgggcccgcacctttcgtgccccgcgagcgcgcctcagtggaccgctggcgccggaccaagggcgcggggccgccggggggcgcgggcctggccgacggcttccaccgctactacggccccatcgagccgcagggcctaggcctcggcctgggcgaagcgcgcgcggcaccgcggggcgcagccgggcgcccgctgtccccgccggccgctcagcccccgcagaagccgccggcctcctatttcgccatcgtacgcgacaaggagccagccgagccccccgccggcgccttccccggcttcccgtcgccgcccgcgccccccgccgccgcggccaccgccgtcgggccgccactctgccgcttggccttcgaggacgagagcccgccggcgcccgcgcggtggccgcgctcggaccccgagagccaacccctgctggggccaggcgcgggcggcgcggggggcacggggggcgcaggcggaggagccccggccgctccgcccccgtgctgcgccgcgccgcccccgtgcccttacctcgatctcgagccgtcgccgtcggactcggaggactcggagagcctgggcggcgcgtcgctgggcggcctggatccctggtggttcgccgacttcccttacccgtatgccgagcgcctcgggccgccgcccggccgctactggtcggtcgacaagctcgggggctggcgcgccgggagctgggactacctgcccccgcgcagcggtccggccgcctggcactgtcggcactgcgccagcctggagctgctgccgccgccgcgccatctcagctgctcgcacgatggcctggacggcggctggtgggcgccaccgcctccaccctgggccgccgggcccctgccccgacgccgggcccgctgcgggtgcccgcggtcgcacccgcaccgcccgcgggcctcgcaccgcacgcccgccgctgccgcgccccaccaccacaggcaccggcgcgccgctgggggctgggacctcccgccgcccgcgcccacctcgcgctcgctcgaggacctcagctcgtgccctcgcgccgcccctgcgcgcaggcttaccgggccctcccgccacgctcgcaggtgtccgcacgccgcgcactgggggccgccgctgcccacagcttcccaccggagacaccggggcggggacctgggcacccgcaggggctcggcgcacttctctagcctcgagtccgaggtatgacgcggccccgggggccccaccgcccccttggtcagcgcaggccacggcccgagggggcgcccgcagtggacaggacccgcgtgggttgggaaggaaagcagtggaactggccggaccccgcctggagcagcgtcctgcgccccctggttctggaggaaccgcaagccggagaggatttggtccctcaactatcacccagg

SEQ ID NO: 87604 - DNA, 238 bp, Homo sapiens
gtccctgcgtctcccgtctgtgcctccctctcctccccgtctctcccggcccgggcgctcagaggccgcccggcggggcccgcaggcgatgcgcggcgccggtggcccccgcggccctcggggccccgctaagatgctgctgctgctggcgctggcctgcgccagcccgttcccggaggaggcgccggggccgggcggggccggtgggcccggcggcggcctcggcggggcgcggccg

SEQ ID NO: 87605 - DNA, 1341 bp, Homo sapiens
agcggggggttagctgaactgagctgaaatcctaaaggccgcggagtcggcggtgttgtaggtagcggtaccttgagtggcaacagaattcgattaaattacaatgggaaacatttttgaaaagctctttaaaagtctacttgggaaaaaaaagatgcggattcttatattgagtttggatacagctggaaaaaccaccatcttgtataaattgaagctgggggagactgtgcctgccgtccctacagtaggtttctgtgtggagacagtagaatataaaaataacaccttcgctgtctgggatgttggcagccacttcaaaatcagacctctgtggcagcattttttccagaacacaaaaggtgccagaagcccaggaagcacacatcaaggctcacttgccagcggggtgctgccaataaaatgtagtcacgtggaatttggaatgtggaaaggaggtagaagtcatcctttcctcccccatagcagcaggtgtgcaggctctggtggtcagctggactccatactcccccaccagtcaccagcctggggaccgtggggctgcaaggacctcagcagcggtttcccaagtttcctgacttcttccatcctctggaaatcagctgtggttcgtgagccacacatctccccacaccaagctcctccatacaagacctcggactgcatcacgtaaatgctttttcaggggcaaaatctagagaatctgaaatgagctatcagcttcccagtttgcacaattcatcaagaaattatgcggggtcactggcacaaatgatgaggcatctcctggaagcttaacttcttatccatcccatctcttggacagatgatgccagttaattactttgaatgttctatattggctgtgatctttgtactaactgctattatggagaatgtgttggcatcgcagaaaaggaggctaagaaaatggatgtgtacatctgtaatgattgtaaatgggcacaagagggcagcagtgaggaattgtactgtatctgcagaacacctgcagtcacagtgagttctaataagagcatcacatttaataatttaggaagccaaattgctctgactggttacttatttactttaaaataaaaagcagattttttctacatttgttatacacttacattacaaattccttttcatttttttttctctttttccctttttacctacccttcaaaatttatcttgcttcatagtgaatgtttgagacacattggggaaaatgtggtttaatggtagatttgattcttcaatatgtaacatagaaattaatgagattaaactagcttgacttgtttggacttt

SEQ ID NO: 87606 - DNA, 1886 bp, Homo sapiens
agcggggggttagctgaactgagctgaaatcctaaaggccgcggagtcggcggtgttgtaggtagcggtaccttgagtggcaacagaattcgattaaattacaatgggaaacatttttgaaaagctctttaaaagtctacttgggaaaaaaaagatgcggattcttatattgagtttggatacagctggaaaaaccaccatcttgtataaattgaagctgggggagactgtgcctgccgtccctacagtaggtttctgtgtggagacagtagaatataaaaataacaccttcgctgtctgggatgttggcagccacttcaaaatcagacctctgtggcagcattttttccagaacacaaaagagctatcagcttcccagtttgcacaattcatcaagaaattatgcggggtcactggcacaaatgatgaggcatctcctggaagcttaacttcttatccatcccatctcttggacagatgatgccagttaattactttgaatgtctcacaacaacaaactgcagtctacagcttcctaaagttcagcatgttaacctaacataaaacacagcaagaatcttgttgcctgaactattttaaattaaggagccagatctttttagtgaggctatcctgacaagacttgacctaaactttgtttttattggtcataacagtccaattatattattggccaattttgtccaatggacaagaaaaaagcaaagttgccaggtgcggttgtcacgcctgtaatcccagcactttgggaggccaaggcgggcggatcatctgaggtcgggagttcgagaccagcctgaccaatatggagaaaccccgtctctaccaaaaatacaaaattagctgtgcatggtggcctatgcctgtaatcccagctacttgggaggctgaggcaggagaatcgctggaacccgggaggcagaggttgtattgagccgagattgagccattgcactccagcctgggtgacaagaacaaaactccgtttcaaaaacaaaaaaaggaagaaaagaaaaagaaaaaagaaaagtcaacgacaccattatcttgtcaagatcaaatggttttattattgtggcagaagcgagaaaattttgtttattaaaaaaaaaaaagaaaaagaaagcaagaaacaatgatactgtggggtcaagtataactccatggaaatgccacgtctgctcttcagtgaagaagctggtttagagtctcacagaaaacttttgactgtatttatttattgttgcaaaaaagacgcttttttattgctgccctcatttgtcagctaagtattttttcttataaaatccagccccggttacatataatcatctgtatcttatcatgattcctgtaggtaaaagtacaagacgacctctagatgtcttttctttctatgaaaggagctgctatgtacacatgtgcacacacacacaactgggaatcaacaatgagtttattgttcatggtagattaaaattaagcttgcataaaggttgggctaagtggtcctggactacagactctgttgccttgaatataacagtacaatttgtcaattactctgcaccaggctaaagtgagtaaaatctatttgaaggtatcttgtttgtaaacatttgtcagattctaatttttttcttttgtattaaaattcaactatggatgtatatgaaacaaaataaatggagataatttttctcccacagacagaggtgtctttgaatgtgtgctaatgattatctgtaagcctctgtggggagggagggctgcaaggtcatgaaaggcaaaagaatctaattgtacctggaattctcctggacagcagtggcccctcgttttatcattcccagtcaattgtcatc

SEQ ID NO: 87607 - DNA, 1096 bp, Homo sapiens
aggtgctcaattgttccctttttctatactctgtaggtctcacaacaacaaactgcagtctacagcttcctaaagttcagcatgttaacctaacataaaacacagcaagaatcttgttgcctgaactattttaaattaaggagccagatctttttagtgaggctatcctgacaagacttgacctaaactttgtttttattggtcataacagtccaattatattattggccaattttgtccaatggacaagaaaaaagcaaatcaacgacaccattatcttgtcaagatcaaatggttttattattgtggcagaagcgagaaaattttgtttattaaaaaaaaaaaagaaaaagaaagcaagaaacaatgatactgtggggtcaagtataactccatggaaatgccacgtctgctcttcagtgaagaagctggtttagagtctcacagaaaacttttgactgtatttatttattgttgcaaaaaagacgcttttttattgctgccctcatttgtcagctaagtattttttcttataaaatccagccccggttacatataatcatctgtatcttatcatgattcctgtaggtaaaagtacaagacgacctctagatgtcttttctttctatgaaaggagctgctatgtacacatgtgcacacacacacaactgggaatcaacaatgagtttattgttcatggtagattaaaattaagcttgcataaaggttgggctaagtggtcctggactacagactctgttgccttgaatataacagtacaatttgtcaattactctgcaccaggctaaagtgagtaaaatctatttgaaggtatcttgtttgtaaacatttgtcagattctaatttttttcttttgtattaaaattcaactatggatgtatatgaaacaaaataaatggagataatttttctcccacagacagaggtgtctttgaatgtgtgctaatgattatctgtaagcctctgtggggagggagggctgcaaggtcatgaaaggcaaaagaatctaattgtacctggaattctcctggacagcagtggcccctcgttttatcattcccagtcaattgtcatc

SEQ ID NO: 87608 - DNA, 1192 bp, Homo sapiens
cagagaaggatgatgaggagttgaagagggtgctccgttccttacaggcccataagatggcccagcctttccttgaaccagtagaccctaatgatgcaccagattattatggtgttattaaggaacctatgggtctcacaacaacaaactgcagtctacagcttcctaaagttcagcatgttaacctaacataaaacacagcaagaatcttgttgcctgaactattttaaattaaggagccagatctttttagtgaggctatcctgacaagacttgacctaaactttgtttttattggtcataacagtccaattatattattggccaattttgtccaatggacaagaaaaaagcaaatcaacgacaccattatcttgtcaagatcaaatggttttattattgtggcagaagcgagaaaattttgtttattaaaaaaaaaaaagaaaaagaaagcaagaaacaatgatactgtggggtcaagtataactccatggaaatgccacgtctgctcttcagtgaagaagctggtttagagtctcacagaaaacttttgactgtatttatttattgttgcaaaaaagacgcttttttattgctgccctcatttgtcagctaagtattttttcttataaaatccagccccggttacatataatcatctgtatcttatcatgattcctgtaggtaaaagtacaagacgacctctagatgtcttttctttctatgaaaggagctgctatgtacacatgtgcacacacacacaactgggaatcaacaatgagtttattgttcatggtagattaaaattaagcttgcataaaggttgggctaagtggtcctggactacagactctgttgccttgaatataacagtacaatttgtcaattactctgcaccaggctaaagtgagtaaaatctatttgaaggtatcttgtttgtaaacatttgtcagattctaatttttttcttttgtattaaaattcaactatggatgtatatgaaacaaaataaatggagataatttttctcccacagacagaggtgtctttgaatgtgtgctaatgattatctgtaagcctctgtggggagggagggctgcaaggtcatgaaaggcaaaagaatctaattgtacctggaattctcctggacagcagtggcccctcgttttatcattcccagtcaattgtcatc

SEQ ID NO: 87609 - DNA, 1832 bp, Homo sapiens
agcggggggttagctgaactgagctgaaatcctaaaggccgcggagtcggcggtgttgtaggtagcggtaccttgagtggcaacagaattcgattaaattacaatgggaaacatttttgaaaagctctttaaaagtctacttgggaaaaaaaagatgcggattcttatattgagtttggatacagctggaaaaaccaccatcttgtataaattgaagctgggggagactgtgcctgccgtccctacagtaggtttctgtgtggagacagtagaatataaaaataacaccttcgctgtctgggatgttggcagccacttcaaaatcagacctctgtggcagcattttttccagaacacaaaagagctatcagcttcccagtttgcacaattcatcaagaaattatgcggggtcactggcacaaatgatgaggcatctcctggaagcttaacttcttatccatcccatctcttggacagatgatgccagttaattactttgaatgtctcacaacaacaaactgcagtctacagcttcctaaagttcagcatgttaacctaacataaaacacagcaagaatcttgttgcctgaactattttaaattaaggagccagatctttttagtgaggctatcctgacaagacttgacctaaactttgtttttattggtcataacagtccaattatattattggccaattttgtccaatggacaagaaaaaagcaaagttgccaggtgcggttgtcacgcctgtaatcccagcactttgggaggccaaggcgggcggatcatctgaggtcgggagttcgagaccagcctgaccaatatggagaaaccccgtctctaccaaaaatacaaaattagctgtgcatggtggcctatgcctgtaatcccagctacttgggaggctgaggcaggagaatcgctggaacccgggaggcagaggttgtattgagccgagattgagccattgcactccagcctgggtgacaagaacaaaactccgtttcaaaaacaaaaaaaggaagaaaagaaaaagaaaaaagaaaagtcaacgacaccattatcttgtcaagatcaaatggttttattattgtggcagaagcgagaaaattttgtttattaaaaaaaaaaaagaaaaagaaagcaagaaacaatgatactgtggggtcaagtataactccatggaaatgccacgtctgctcttcagtgaagaagctggtttagagtctcacagaaaacttttgactgtatttatttattgttgcaaaaaagacgcttttttattgctgccctcatttgtcagctaagtattttttcttataaaatccagccccggttacatataatcatctgtatcttatcatgattcctgtagatgtacacatgtgcacacacacacaactgggaatcaacaatgagtttattgttcatggtagattaaaattaagcttgcataaaggttgggctaagtggtcctggactacagactctgttgccttgaatataacagtacaatttgtcaattactctgcaccaggctaaagtgagtaaaatctatttgaaggtatcttgtttgtaaacatttgtcagattctaatttttttcttttgtattaaaattcaactatggatgtatatgaaacaaaataaatggagataatttttctcccacagacagaggtgtctttgaatgtgtgctaatgattatctgtaagcctctgtggggagggagggctgcaaggtcatgaaaggcaaaagaatctaattgtacctggaattctcctggacagcagtggcccctcgttttatcattcccagtcaattgtcatc

SEQ ID NO: 87610 - DNA, 396 bp, Homo sapiens
gtaagtattttatctaaaagcacttatgtgtctaaacagacttctacaaatcagtaccaaaatggtaaataattccacagaaatatgggcaaaagcttatcattatcaacaaatgagaagaaagaaaccctatgccaggtaacaccaaagctttggcccagtgccctctgttgaaacatcctaggctttttctttccactcctattacaactgatctgatttggccccttcacacttcactcctagattttgctagacctttctattttgtctccctgaattaagcttttccttttggacactttacatatggattctaaaacaatcctctgcatgtctacacttgcacataatgcaaaaaacaaaataaaataatcttcctgttttgatcatgta

SEQ ID NO: 87611 - DNA, 324 bp, Homo sapiens
tgacaataagaatgcctactttttcattataggcccataagatggcccagcctttccttgaaccagtagaccctaatgatgcaccagattattatggtgttattaaggaacctatgggtacacatgagttgaatttgaagttttttcagaagtctcagtgtatattttattaaccataaaattaatatcttagaatacttttagcaaggctggtgggggtataaattggtatggtcactttggagggtaaattgatagtatctattacagttgaattgtgcatactcggttattttattttatttttttgagatggagtctcac

SEQ ID NO: 87612 - DNA, 1562 bp, Homo sapiens
agcggggggttagctgaactgagctgaaatcctaaaggccgcggagtcggcggtgttgtaggtagcggtaccttgagtggcaacagaattcgattaaattacaatgggaaacatttttgaaaagctctttaaaagtctacttgggaaaaaaaagatgcggattcttatattgagtttggatacagctggaaaaaccaccatcttgtataaattgaagctgggggagactgtgcctgccgtccctacagtaggtttctgtgtggagacagtagaatataaaaataacaccttcgctgtctgggatgttggcagccacttcaaaatcagacctctgtggcagcattttttccagaacacaaaagagctatcagcttcccagtttgcacaattcatcaagaaattatgcggggtcactggcacaaatgatgaggcatctcctggaagcttaacttcttatccatcccatctcttggacagatgatgccagttaattactttgaatgtctcacaacaacaaactgcagtctacagcttcctaaagttcagcatgttaacctaacataaaacacagcaagaatcttgttgcctgaactattttaaattaaggagccagatctttttagtgaggctatcctgacaagacttgacctaaactttgtttttattggtcataacagtccaattatattattggccaattttgtccaatggacaagaaaaaagcaaatcaacgacaccattatcttgtcaagatcaaatggttttattattgtggcagaagcgagaaaattttgtttattaaaaaaaaaaaagaaaaagaaagcaagaaacaatgatactgtggggtcaagtataactccatggaaatgccacgtctgctcttcagtgaagaagctggtttagagtctcacagaaaacttttgactgtatttatttattgttgcaaaaaagacgcttttttattgctgccctcatttgtcagctaagtattttttcttataaaatccagccccggttacatataatcatctgtatcttatcatgattcctgtaggtaaaagtacaagacgacctctagatgtcttttctttctatgaaaggagctgctatgtacacatgtgcacacacacacaactgggaatcaacaatgagtttattgttcatggtagattaaaattaagcttgcataaaggttgggctaagtggtcctggactacagactctgttgccttgaatataacagtacaatttgtcaattactctgcaccaggctaaagtgagtaaaatctatttgaaggtatcttgtttgtaaacatttgtcagattctaatttttttcttttgtattaaaattcaactatggatgtatatgaaacaaaataaatggagataatttttctcccacagacagaggtgtctttgaatgtgtgctaatgattatctgtaagcctctgtggggagggagggctgcaaggtcatgaaaggcaaaagaatctaattgtacctggaattctcctggacagcagtggcccctcgttttatcattcccagtcaattgtcatc

SEQ ID NO: 87613 - DNA, 169 bp, Homo sapiens
tcgaggataccttcgctattcatcggcacctgctaagagagagaaacccactaactccagcatccgagccccggttttatgaaatcctcaaagtcatgcaggaagctgcggacagacacacccagaccctgccagaggtgccgatgaatagcgaggtgccgatgaatag

SEQ ID NO: 87614 - DNA, 6315 bp, Homo sapiens
acattatctgcccaagcacagtgctgttggccaagcctccagcagctgacgggacccagctgtagtgaggttgcagtgattgagtaggattggcctgcttcaaagcagaggtttctcatgggaatatgcttattaaactcccactggtgcagaaaccatgaacagaggatgaacaagtgaagttgcaatctcctccatcacagctcagttccccaacaacaggatcacaagctggagatgcctttaaggaagatgaagatccctttcctcctactgttctttctgtgggaagccgagagccacgcagcatcaaggccgaacatcatcctggtgatggctgacgacctcggcattggagatcctgggtgctatgggaacaaaactatcaggactcccaatatcgaccggttggccagtgggggagtgaaactcactcagcacctggcagcatcaccgctgtgcacaccaagcagggcagccttcatgactggccggtaccctgtccgatcaggaatggcatcttggtcccgcactggagttttcctcttcacagcctcttcgggaggacttcccaccgatgagattacctttgctaagcttctgaaggatcaaggttattcaacagcactgatagggaaatggcaccttgggatgagctgtcacagcaagactgacttctgtcaccaccctttacatcacggcttcaattatttctatgggatctctttgaccaatctgagagactgcaagcccggagagggcagtgtcttcaccacgggcttcaagaggctggtcttcctccccctgcagatcgtcggggtcaccctccttacccttgctgcactcaattgtctggggctactccacgtgcctctaggcgtttttttcagccttctcttcctagcagccctaatcctgacccttttcttgggcttccttcattacttccggcccctgaactgcttcatgatgaggaactacgagatcattcagcagcccatgtcctatgacaatctcacccagaggctaacggtggaggcggcccagttcatacagcggaacactgagactccgttcctgcttgtcttgtcctacctccacgtgcacacagccctgttctccagcaaagactttgctggcaaaagtcaacacggagtctacggggatgctgttgaggaaatggactggagtgtggggcagatcttgaaccttctggatgagctgagattggctaatgataccctcatctacttcacatcggaccagggagcacatgtagaagaagtgtcttccaaaggagaaattcatggcggaagtaatgggatctataaaggaggaaaagcaaacaactgggaaggaggtatccgggttccaggcatccttcgttggcccagggtgatacaggctggccagaagattgatgagcccactagcaacatggacatatttcctacagtagccaagctggctggagctcccttgcctgaggacaggatcattgatggacgtgatctgatgcccctgcttgaaggaaaaagccaacgctccgatcatgagtttctcttccattactgcaacgcctacttaaatgctgtgcgctggcaccctcagaacagcacatccatctggaaggcctttttcttcacccccaacttcaaccccgtgggttccaacggatgctttgccacacacgtgtgcttctgtttcgggagttatgtcacccatcacgacccacctttactctttgatatttccaaagatcccagagagagaaacccactaactccagcatccgagccccggttttatgaaatcctcaaagtcatgcaggaagctgcggacagacacacccagaccctgccagaggtgcccgatcagttttcatggaacaactttctttggaagccctggcttcagctgtgctgtccttccaccggcctgtcttgccagtgtgatagagaaaaacaggataagagactgagccgctagcagcgcctggggaccagacagacgcatgtggcaaagctcaccatcttcactacaaacacgcctgagagtggcactggggaaacataactccatctacaccttggatttggactgattctccattttatcacctgaaggcttgggccagagctcaacagctactcaactggaggggtgagggggataaggtctgtagtatacagacaggaagatggtaggtttatgccttctgtggccagagtcttggactcatggaaatagaatgaatagaggggcattcacaaggcacaccagtgcaagcagatgacaaaaaggtgcagaaggcaatcttaaaacagaaaggtgcaggaggtaccttaactcacccctcagcaaatacctatgtcaacagtataagttaccatttactctataatctgcagtgatgcaataaccagcataataaaaaggcaatcacataaaaaagagtttagtcgtctaaacataagtaactttaaggtgaatgaaagatcttctttaggaataatagatgatggtaagttccactttggttattggaaggcaagtcattattactggtattagttaaaacacatatcaaatgcttgctcttcatcatatatatagttatgcatacatacacacacacacatacagtatattctttcctcaaaagggttaagatgtctaaaatagggacctagaagcttaacactatttaagtaaatacagtagaagctcacaaatagatttctttgcacaatgattttttgcaaaattttacagtaataataatcccaaggcaaatctctcctgaactgctttccattccataatttgtagtataattcttggattccactgttttctttggggaatggaagttctgaattaaaagcccactgtggagatgctgtggttcatggaatctcttccagtgtaattcagaatcattggcctagaaagtctctgatatttggaggggaacaaaaatcactcacaagcaatccatgatctatacacataagcataatttcctttagttctagttagtcatcagagaacagtcatgtatgcaagttttgtgactgagaaatttctgtgcttccaatccacaatgagatgcatgattttgttttcatcccatttcccccaagcccctgtaaatcagggaaaatgcgcaactgatcgcctaggagagggcctcgtagtggcacagctggagatagtttcaaagtctaaaccaccagcccatcctgaggaaagcctcctatggaatgtaaagtgcaatcatttcttcagatataagactttccccaacaatgtgattggattcctttatggcaaaatcgagagaagctgccatccacctgcttatgcatttatctcttttgtggacttgtctgaccaccttctatttgcccagagtttgctcaattccaagacagtgcccatgaatgggacacctgtaatgtaacccacacagcggtttgcagagaatgttagccatgacttgggctttctgaaagttggctataatttctctatccctacccacaaccctgggaagttggagcaagaggggcatactattgggctgggaggatttgacagcatttccccagttgccctttaagttcttctatttcaaacgttaattttgcttctctttctaaaaaaaaaaaaaaaaaagaaagagaagaaagaagtgattcctaccccctacctccagagttgttgaaagctgaaaagcatacaagattcttccttttaacttggatttctcgttccagaaattgtgggataatctgtattcttgctttagaaaacattcttagagagggtactagcttactgatgatgtgttaggattgctactgatgctgtcatgtggaaactatttaaaggcactattataaatttatcctataagatgacaatgtttactcaaagtctaacatattcaatgcaagtaagactttctgaaaacacttgatgatgtggaaatgctgcaggattaaataacttgaagagcctttatagattatatgaatgcctatttgtgtctagaaccagttatttaacctgtaaaatgtcaatagcaaatgaaggatgaagtatatctctagatgcaaatacattgagtttaaaagtgcctcaaaataattgagatcacatttcaggacatttggaaatcaggtcgatttgtggtaactgtagtcatcttaaatttcaaaccatttaccatctgaaagttttgatttgaatgtaaaacaggaaattggaattcctttgtccaggagaaacctcacaaaccttctttaaggcatagttttgttgtttgtttgcttgtttgttgcaggctgtaaggcatggctgcttgtttacaaagcatctcattcatattacctgtggagttgcatatccaaaccttagtgagttttgaagctttaagcaaattcttttaaaaaattcttgtatttctagcattactagatattaaaagttaagcaaatagattaatgacgtatacataggcatcatttcacaaggtcagtaatgctgcaggaaaagcaaaattgcaatctacgtatctatggtactaaggaagtcctgtttttcaaaaatggaagcccacttctcagatttttctgaagggcatacaatgaaaagtgaaggggaaacacacacacgcaaaaaaacaagtatttggcttgtcacaggaatctgattgcattaagtgaaaggattatttagaatatgttaatgcaaagctaaaataaaattttccttggcaattaaaaatgctgtgcgctaataccctgctttctatcgtgactcaattcaacaatgtggggaatgtttactacatttccaacttgatgtcaagcaatggggaatacaagttccagttctgcaaagattcgtcaactttcttagctcaagagagaggctgagaaatgcagagaagaataagacataaaatagctccgacctccatgatccgagagtgggaaaaggcccgattattacccataaggcacactctctaaggccttttaaggggcctacaaaaatgttttattttataatcagaagaaaaggaaatgaacattggggattgaaaatcatattggtatttgcaccaacatagtcataaaatagtatgttaatatgtttttactttatatatttatatattaaaatatatttaatatgttttgcctttgtggcccatgaaagtcttactgggccctggggaaggtatcctaccctggtgaagcagctgctttgctctacaaatacctggggcagaaatttgatttgaaaagtattattctctcttctctttgtttcaactggattcctttggaaaaccaaactagtatcagaacaaaccccgaaacagtaagaaattggagtgagaagggcatggtattgggactaggatcggctctcattcgatcgagctattctcttaaaatgacaaaaagtgtccataaagaggctgctggagagtgcgtggccatagggagccgacatgcccgggaggaaaggtgttgattacatggatacttctaaaagctaaagccttgttgccttctctttaatgcctagagaatgggatgtgtgatgcaaatgctcaaaacctcttaaatcatagctgtctgacctctacggacctcacatccatctgaggcttcatggacaaagattctccacttggccaaactttagccaagctcctcaaccttctcccaggcccaatctgggcacttccttccccccatatctgttcaacctcagtatctgatcaggctcctcagcctccaccatcccccaggtgatgtctggtcaactggcctaccttcagctagaatcctgttaggtcggtttagatgaatgctccctgatatttcctcttggtaatcttccatccactgcccctgaccctgttccctgtctataaatccccagttttccatggtgtattcagagctgagtccagtctctctcccctactacaagtccccattgctgtggtccccgtacctgtcatgatggtcctaaataaagtcttactgtgctttaataggtagcattgaaaaatttttttctttgacatcattcatgacaacatgaaacctattgggacagcatgactgtgcagggtctttagagctcagctttctgaggccctgagcattcttggttttccgacatcgtgaacctgttctgtgttgcaagatatcactcaagccagtgttgcttaataccatctctttgtgtaatagatctgaataaagtaattgtaatacaccaata

SEQ ID NO: 87615 - DNA, 4790 bp, Homo sapiens
acattatctgcccaagcacagtgctgttggccaagcctccagcagctgacgggacccagctgtagtgaggttgcagtgattgagtaggattggcctgcttcaaagcagaggtttctcatgggaatatgcttattaaactcccactggtgcagaaaccatgaacagaggatgaacaagtgaagttgcaatctcctccatcacagctcagttccccaacaacaggatcacaagctggagatgcctttaaggaagatgaagatccctttcctcctactgttctttctgtgggaagccgagagccacgcagcatcaaggccgaacatcatcctggtgatggctgacgacctcggcattggagatcctgggtgctatgggaacaaaactatcaggactcccaatatcgaccggttggccagtgggggagtgaaactcactcagcacctggcagcatcaccgctgtgcacaccaagcagggcagccttcatgactggccggtaccctgtccgatcaggaatggcatcttggtcccgcactggagttttcctcttcacagcctcttcgggaggacttcccaccgatgagattacctttgctaagcttctgaaggatcaaggttattcaacagcactgatagggaaatggcaccttgggatgagctgtcacagcaagactgacttctgtcaccaccctttacatcacggcttcaattatttctatgggatctctttgaccaatctgagagactgcaagcccggagagggcagtgtcttcaccacgggcttcaagaggctggtcttcctccccctgcagatcgtcggggtcaccctccttacccttgctgcactcaattgtctggggctactccacgtgcctctaggcgtttttttcagccttctcttcctagcagccctaatcctgacccttttcttgggcttccttcattacttccggcccctgaactgcttcatgatgaggaactacgagatcattcagcagcccatgtcctatgacaatctcacccagaggctaacggtggaggcggcccagttcatacagcggaacactgagactccgttcctgcttgtcttgtcctacctccacgtgcacacagccctgttctccagcaaagactttgctggcaaaagtcaacacggagtctacggggatgctgttgaggaaatggactggagtgtggggcagatcttgaaccttctggatgagctgagattggctaatgataccctcatctacttcacatcggaccagggagcacatgtagaagaagtgtcttccaaaggagaaattcatggcggaagtaatgggatctataaaggaggaaaagcaaacaactgggaaggaggtatccgggttccaggcatccttcgttggcccagggtgatacaggctggccagaagattgatgagcccactagcaacatggacatatttcctacagtagccaagctggctggagctcccttgcctgaggacaggatcattgatggacgtgatctgatgcccctgcttgaaggaaaaagccaacgctccgatcatgagtttctcttccattactgcaacgcctacttaaatgctgtgcgctggcaccctcagaacagcacatccatctggaaggcctttttcttcacccccaacttcaaccccgtgggttccaacggatgctttgccacacacgtgtgcttctgtttcgggagttatgtcacccatcacgacccacctttactctttgatatttccaaagatcccagagagagaaacccactaactccagcatccgagccccggttttatgaaatcctcaaagtcatgcaggaagctgcggacagacacacccagaccctgccagaggtgcccgatcagttttcatggaacaactttctttggaagccctggcttcagctgtgctgtccttccaccggcctgtcttgccagtgtgatagagaaaaacaggataagagactgagccgctagcagcgcctggggaccagacagacgcatgtggcaaagctcaccatcttcactacaaacacgcctgagagtggcactggggaaacataactccatctacaccttggatttggactgattctccattttatcacctgaaggcttgggccagagctcaacagctactcaactggaggggtgagggggataaggtctgtagtatacagacaggaagatggtaggtttatgccttctgtggccagagtcttggactcatggaaatagaatgaatagaggggcattcacaaggcacaccagtgcaagcagatgacaaaaaggtgcagaaggcaatcttaaaacagaaaggtgcaggaggtaccttaactcacccctcagcaaatacctatgtcaacagtataagttaccatttactctataatctgcagtgatgcaataaccagcataataaaaaggcaatcacataaaaaagagtttagtcgtctaaacataagtaactttaaggtgaatgaaagatcttctttaggaataatagatgatggtaagttccactttggttattggaaggcaagtcattattactggtattagttaaaacacatatcaaatgcttgctcttcatcatatatatagttatgcatacatacacacacacacatacagtatattctttcctcaaaagggttaagatgtctaaaatagggacctagaagcttaacactatttaagtaaatacagtagaagctcacaaatagatttctttgcacaatgattttttgcaaaattttacagtaataataatcccaaggcaaatctctcctgaactgctttccattccataatttgtagtataattcttggattccactgttttctttggggaatggaagttctgaattaaaagcccactgtggagatgctgtggttcatggaatctcttccagtgtaattcagaatcattggcctagaaagtctctgatatttggaggggaacaaaaatcactcacaagcaatccatgatctatacacataagcataatttcctttagttctagttagtcatcagagaacagtcatgtatgcaagttttgtgactgagaaatttctgtgcttccaatccacaatgagatgcatgattttgttttcatcccatttcccccaagcccctgtaaatcagggaaaatgcgcaactgatcgcctaggagagggcctcgtagtggcacagctggagatagtttcaaagtctaaaccaccagcccatcctgaggaaagcctcctatggaatgtaaagtgcaatcatttcttcagatataagactttccccaacaatgtgattggattcctttatggcaaaatcgagagaagctgccatccacctgcttatgcatttatctcttttgtggacttgtctgaccaccttctatttgcccagagtttgctcaattccaagacagtgcccatgaatgggacacctgtaatgtaacccacacagcggtttgcagagaatgttagccatgacttgggctttctgaaagttggctataatttctctatccctacccacaaccctgggaagttggagcaagaggggcatactattgggctgggaggatttgacagcatttccccagttgccctttaagttcttctatttcaaacgttaattttgcttctctttctaaaaaaaaaaaaaaaaaagaaagagaagaaagaagtgattcctaccccctacctccagagttgttgaaagctgaaaagcatacaagattcttccttttaacttggatttctcgttccagaaattgtgggataatctgtattcttgctttagaaaacattcttagagagggtactagcttactgatgatgtgttaggattgctactgatgctgtcatgtggaaactatttaaaggcactattataaatttatcctataagatgacaatgtttactcaaagtctaacatattcaatgcaagtaagactttctgaaaacacttgatgatgtggaaatgctgcaggattaaataacttgaagagcctttatagattatatgaatgcctatttgtgtctagaaccagttatttaacctgtaaaatgtcaatagcaaatgaaggatgaagtatatctctagatgcaaatacattgagtttaaaagtgcctcaaaataattgagatcacatttcaggacatttggaaatcaggtcgatttgtggtaactgtagtcatcttaaatttcaaaccatttaccatctgaaagttttgatttgaatgtaaaacaggaaattggaattcctttgtccaggagaaacctcacaaaccttctttaaggcatagttttgttgtttgtttgcttgtttgttgcaggctgtaaggcatggctgcttgtttacaaagcatctcattcatattacctgtggagttgcatatccaaaccttagtgagttttgaagctttaagcaaattcttttaaaaaattcttgtatttctagcattactagatattaaaagttaagcaaatagattaatgacgtatacataggcatcatttcacaaggtcagtaatgctgcaggaaaagcaaaattgcaatctacgtatctatggtactaaggaagtcctgtttttcaaaaatggaagcccacttctcagatttttctgaagggcatacaatgaaaagtgaaggggaaacacacacacgcaaaaaaacaagtatttggcttgtcacaggaatctgattgcattaagtgaaaggattatttagaatatgttaatgcaaagctaaaataaaattttccttggcaatta

SEQ ID NO: 87616 - DNA, 1131 bp, Homo sapiens
ccccccatgcctctgcacccttgtcgaccactgtctcacatgatctgcagcttccattgtgtcctggctcatatacctcctctctggcatcttcagctttgtcctcctcatcagcctcctcttcagatagttcagcctctcctttctcaatagcctcatgcgagtccagaattgccctcggggcaatactggactaggatcggctctcattcgatcgagctattctcttaaaatgacaaaaagtgtccataaagaggctgctggagagtgcgtggccatagggagccgacatgcccgggaggaaaggtgttgattacatggatacttctaaaagctaaagccttgttgccttctctttaatgcctagagaatgggatgtgtgatgcaaatgctcaaaacctcttaaatcatagctgtctgacctctacggacctcacatccatctgaggcttcatggacaaagattctccacttggccaaactttagccaagctcctcaaccttctcccaggcccaatctgggcacttccttgtaaaatctagttttggcaagaagtctattaggtcagtttagcaagaacacctaacccccccatatctgttcaacctcagtatctgatcaggctcctcagcctccaccatcccccaggtgatgtctggtcaactggcctaccttcagctagaatcctgttaggtcggtttagatgaatgctccctgatatttcctcttggtaatcttccatccactgcccctgaccctgttccctgtctataaatccccagttttccatggtgtattcagagctgagtccagtctctctcccctactacaagtccccattgctgtggtccccgtacctgtcatgatggtcctaaataaagtcttactgtgctttaataggtagcattgaaaaatttttttctttgacatcattcatgacaacatgaaacctattgggacagcatgactgtgcagggtctttagagctcagctttctgaggccctgagcattcttggttttccgacatcgtgaacctgttctgtgttgcaagatatcactcaagccagtgttgcttaataccatctctttgtgtaatagatctgaataaagtaattgtaatacaccaata

SEQ ID NO: 87617 - DNA, 6538 bp, Homo sapiens
acattatctgcccaagcacagtgctgttggccaagcctccagcagctgacgggacccagctgtagtgaggttgcagtgattgagtaggattggcctgcttcaaagcagaggtttctcatgggaatatgcttattaaactcccactggtgcagaaaccatgaacagaggatgaacaagtgaagttgcaatctcctccatcacagctcagttccccaacaacaggatcacaagctggagatgcctttaaggaagatgaagatccctttcctcctactgttctttctgtgggaagccgagagccacgcagcatcaaggccgaacatcatcctggtgatggctgacgacctcggcattggagatcctgggtgctatgggaacaaaactatcaggactcccaatatcgaccggttggccagtgggggagtgaaactcactcagcacctggcagcatcaccgctgtgcacaccaagcagggcagccttcatgactggccggtaccctgtccgatcaggaatggcatcttggtcccgcactggagttttcctcttcacagcctcttcgggaggacttcccaccgatgagattacctttgctaagcttctgaaggatcaaggttattcaacagcactgatagggaaatggcaccttgggatgagctgtcacagcaagactgacttctgtcaccaccctttacatcacggcttcaattatttctatgggatctctttgaccaatctgagagactgcaagcccggagagggcagtgtcttcaccacgggcttcaagaggctggtcttcctccccctgcagatcgtcggggtcaccctccttacccttgctgcactcaattgtctggggctactccacgtgcctctaggcgtttttttcagccttctcttcctagcagccctaatcctgacccttttcttgggcttccttcattacttccggcccctgaactgcttcatgatgaggaactacgagatcattcagcagcccatgtcctatgacaatctcacccagaggctaacggtggaggcggcccagttcatacagcggaacactgagactccgttcctgcttgtcttgtcctacctccacgtgcacacagccctgttctccagcaaagactttgctggcaaaagtcaacacggagtctacggggatgctgttgaggaaatggactggagtgtggggcagatcttgaaccttctggatgagctgagattggctaatgataccctcatctacttcacatcggaccagggagcacatgtagaagaagtgtcttccaaaggagaaattcatggcggaagtaatgggatctataaaggaggaaaagcaaacaactgggaaggaggtatccgggttccaggcatccttcgttggcccagggtgatacaggctggccagaagattgatgagcccactagcaacatggacatatttcctacagtagccaagctggctggagctcccttgcctgaggacaggatcattgatggacgtgatctgatgcccctgcttgaaggaaaaagccaacgctccgatcatgagtttctcttccattactgcaacgcctacttaaatgctgtgcgctggcaccctcagaacagcacatccatctggaaggcctttttcttcacccccaacttcaaccccgtgggttccaacggatgctttgccacacacgtgtgcttctgtttcgggagttatgtcacccatcacgacccacctttactctttgatatttccaaagatcccagagagagaaacccactaactccagcatccgagccccggttttatgaaatcctcaaagtcatgcaggaagctgcggacagacacacccagaccctgccagaggtgcccgatcagttttcatggaacaactttctttggaagccctggcttcagctgtgctgtccttccaccggcctgtcttgccagtgtgatagagaaaaacaggataagagactgagccgctagcagcgcctggggaccagacagacgcatgtggcaaagctcaccatcttcactacaaacacgcctgagagtggcactggggaaacataactccatctacaccttggatttggactgattctccattttatcacctgaaggcttgggccagagctcaacagctactcaactggaggggtgagggggataaggtctgtagtatacagacaggaagatggtaggtttatgccttctgtggccagagtcttggactcatggaaatagaatgaatagaggggcattcacaaggcacaccagtgcaagcagatgacaaaaaggtgcagaaggcaatcttaaaacagaaaggtgcaggaggtaccttaactcacccctcagcaaatacctatgtcaacagtataagttaccatttactctataatctgcagtgatgcaataaccagcataataaaaaggcaatcacataaaaaagagtttagtcgtctaaacataagtaactttaaggtgaatgaaagatcttctttaggaataatagatgatggtaagttccactttggttattggaaggcaagtcattattactggtattagttaaaacacatatcaaatgcttgctcttcatcatatatatagttatgcatacatacacacacacacatacagtatattctttcctcaaaagggttaagatgtctaaaatagggacctagaagcttaacactatttaagtaaatacagtagaagctcacaaatagatttctttgcacaatgattttttgcaaaattttacagtaataataatcccaaggcaaatctctcctgaactgctttccattccataatttgtagtataattcttggattccactgttttctttggggaatggaagttctgaattaaaagcccactgtggagatgctgtggttcatggaatctcttccagtgtaattcagaatcattggcctagaaagtctctgatatttggaggggaacaaaaatcactcacaagcaatccatgatctatacacataagcataatttcctttagttctagttagtcatcagagaacagtcatgtatgcaagttttgtgactgagaaatttctgtgcttccaatccacaatgagatgcatgattttgttttcatcccatttcccccaagcccctgtaaatcagggaaaatgcgcaactgatcgcctaggagagggcctcgtagtggcacagctggagatagtttcaaagtctaaaccaccagcccatcctgaggaaagcctcctatggaatgtaaagtgcaatcatttcttcagatataagactttccccaacaatgtgattggattcctttatggcaaaatcgagagaagctgccatccacctgcttatgcatttatctcttttgtggacttgtctgaccaccttctatttgcccagagtttgctcaattccaagacagtgcccatgaatgggacacctgtaatgtaacccacacagcggtttgcagagaatgttagccatgacttgggctttctgaaagttggctataatttctctatccctacccacaaccctgggaagttggagcaagaggggcatactattgggctgggaggatttgacagcatttccccagttgccctttaagttcttctatttcaaacgttaattttgcttctctttctaaaaaaaaaaaaaaaaaagaaagagaagaaagaagtgattcctaccccctacctccagagttgttgaaagctgaaaagcatacaagattcttccttttaacttggatttctcgttccagaaattgtgggataatctgtattcttgctttagaaaacattcttagagagggtactagcttactgatgatgtgttaggattgctactgatgctgtcatgtggaaactatttaaaggcactattataaatttatcctataagatgacaatgtttactcaaagtctaacatattcaatgcaagtaagactttctgaaaacacttgatgatgtggaaatgctgcaggattaaataacttgaagagcctttatagattatatgaatgcctatttgtgtctagaaccagttatttaacctgtaaaatgtcaatagcaaatgaaggatgaagtatatctctagatgcaaatacattgagtttaaaagtgcctcaaaataattgagatcacatttcaggacatttggaaatcaggtcgatttgtggtaactgtagtcatcttaaatttcaaaccatttaccatctgaaagttttgatttgaatgtaaaacaggaaattggaattcctttgtccaggagaaacctcacaaaccttctttaaggcatagttttgttgtttgtttgcttgtttgttgcaggctgtaaggcatggctgcttgtttacaaagcatctcattcatattacctgtggagttgcatatccaaaccttagtgagttttgaagctttaagcaaattcttttaaaaaattcttgtatttctagcattactagatattaaaagttaagcaaatagattaatgacgtatacataggcatcatttcacaaggtcagtaatgctgcaggaaaagcaaaattgcaatctacgtatctatggtactaaggaagtcctgtttttcaaaaatggaagcccacttctcagatttttctgaagggcatacaatgaaaagtgaaggggaaacacacacacgcaaaaaaacaagtatttggcttgtcacaggaatctgattgcattaagtgaaaggattatttagaatatgttaatgcaaagctaaaataaaattttccttggcaattaaaaatgctgtgcgctaataccctgctttctatcgtgactcaattcaacaatgtggggaatgtttactacatttccaacttgatgtcaagcaatggggaatacaagttccagttctgcaaagattcgtcaactttcttagctcaagagagaggctgagaaatgcagagaagaataagacataaaatagctccgacctccatgatccgagagtgggaaaaggcccgattattacccataaggcacactctctaaggccttttaaggggcctacaaaaatgttttattttataatcagaagaaaaggaaatgaacattggggattgaaaatcatattggtatttgcaccaacatagtcataaaatagtatgttaatatgtttttactttatatatttatatattaaaatatatttaatatgttttgcctttgtggcccatgaaagtcttactgggccctggggaaggtatcctaccctggtgaagcagctgctttgctctacaaatacctggggcagaaatttgatttgaaaagtattattctctcttctctttgtttcaactggattcctttggaaaaccaaactagtatcagaacaaaccccgaaacagtaagaaattggagtgagaagggcatggtattgggactaggatcggctctcattcgatcgagctattctcttaaaatgacaaaaagtgtccataaagaggctgctggagagtgcgtggccatagggagccgacatgcccgggaggaaaggtgttgattacatggatacttctaaaagctaaagccttgttgccttctctttaatgcctagagaatgggatgtgtgatgcaaatgctcaaaacctcttaaatcatagctgtctgacctctacggacctcacatccatctgaggcttcatggacaaagattctccacttggccaaactttagccaagctcctcaaccttctcccaggcccaatctgggcacttccttgtaaaatctagttttggcaagaagtctattaggtcagtttagcaagaacacctaacccccccatatctgttcaacctcagtatctgatcaggctcctcagcctccaccatcccccaggtgatgtctggtcaactggcctaccttcagctagaatcctgttaggtcggtttagatgaatgctccctgatatttcctcttggtaatcttccatccactgcccctgaccctgttccctgtctataaatccccagttttccatggtgtattcagagctgagtccagtctctctcccctactacaagtccccattgctgtggtccccgtacctgtcatgatggtcctaaataaagtcttactgtgctttaataggtagcattgaaaaatttttttctttgacatcattcatgacaacatgaaacctattgggacagcatgactgtgcagggtctttagagctcagctttctgaggccctgagcattcttggttttccgacatcgtgaacctgttctgtgttgcaagatatcactcaagccagtgttgcttaataccatctctttgtgtaatagatctgaataaagtaattgtaatacaccaatattttactttgttgagtattattttaatgggagcctttccaatgaaggaaacatcagctttccttgttagaatgcaagcagcttaaaaactacccatgtctttctggaaaggaaacattgccatgtaactatgtatcagttttctaagaacttcatgggccttccata

SEQ ID NO: 87618 - DNA, 6371 bp, Homo sapiens
acattatctgcccaagcacagtgctgttggccaagcctccagcagctgacgggacccagctgtagtgaggttgcagtgattgagtaggattggcctgcttcaaagcagaggtttctcatgggaatatgcttattaaactcccactggtgcagaaaccatgaacagaggatgaacaagtgaagttgcaatctcctccatcacagctcagttccccaacaacaggatcacaagctggagatgcctttaaggaagatgaagatccctttcctcctactgttctttctgtgggaagccgagagccacgcagcatcaaggccgaacatcatcctggtgatggctgacgacctcggcattggagatcctgggtgctatgggaacaaaactatcaggactcccaatatcgaccggttggccagtgggggagtgaaactcactcagcacctggcagcatcaccgctgtgcacaccaagcagggcagccttcatgactggccggtaccctgtccgatcaggaatggcatcttggtcccgcactggagttttcctcttcacagcctcttcgggaggacttcccaccgatgagattacctttgctaagcttctgaaggatcaaggttattcaacagcactgatagggaaatggcaccttgggatgagctgtcacagcaagactgacttctgtcaccaccctttacatcacggcttcaattatttctatgggatctctttgaccaatctgagagactgcaagcccggagagggcagtgtcttcaccacgggcttcaagaggctggtcttcctccccctgcagatcgtcggggtcaccctccttacccttgctgcactcaattgtctggggctactccacgtgcctctaggcgtttttttcagccttctcttcctagcagccctaatcctgacccttttcttgggcttccttcattacttccggcccctgaactgcttcatgatgaggaactacgagatcattcagcagcccatgtcctatgacaatctcacccagaggctaacggtggaggcggcccagttcatacagcggaacactgagactccgttcctgcttgtcttgtcctacctccacgtgcacacagccctgttctccagcaaagactttgctggcaaaagtcaacacggagtctacggggatgctgttgaggaaatggactggagtgtggggcagatcttgaaccttctggatgagctgagattggctaatgataccctcatctacttcacatcggaccagggagcacatgtagaagaagtgtcttccaaaggagaaattcatggcggaagtaatgggatctataaaggaggaaaagcaaacaactgggaaggaggtatccgggttccaggcatccttcgttggcccagggtgatacaggctggccagaagattgatgagcccactagcaacatggacatatttcctacagtagccaagctggctggagctcccttgcctgaggacaggatcattgatggacgtgatctgatgcccctgcttgaaggaaaaagccaacgctccgatcatgagtttctcttccattactgcaacgcctacttaaatgctgtgcgctggcaccctcagaacagcacatccatctggaaggcctttttcttcacccccaacttcaaccccgtgggttccaacggatgctttgccacacacgtgtgcttctgtttcgggagttatgtcacccatcacgacccacctttactctttgatatttccaaagatcccagagagagaaacccactaactccagcatccgagccccggttttatgaaatcctcaaagtcatgcaggaagctgcggacagacacacccagaccctgccagaggtgcccgatcagttttcatggaacaactttctttggaagccctggcttcagctgtgctgtccttccaccggcctgtcttgccagtgtgatagagaaaaacaggataagagactgagccgctagcagcgcctggggaccagacagacgcatgtggcaaagctcaccatcttcactacaaacacgcctgagagtggcactggggaaacataactccatctacaccttggatttggactgattctccattttatcacctgaaggcttgggccagagctcaacagctactcaactggaggggtgagggggataaggtctgtagtatacagacaggaagatggtaggtttatgccttctgtggccagagtcttggactcatggaaatagaatgaatagaggggcattcacaaggcacaccagtgcaagcagatgacaaaaaggtgcagaaggcaatcttaaaacagaaaggtgcaggaggtaccttaactcacccctcagcaaatacctatgtcaacagtataagttaccatttactctataatctgcagtgatgcaataaccagcataataaaaaggcaatcacataaaaaagagtttagtcgtctaaacataagtaactttaaggtgaatgaaagatcttctttaggaataatagatgatggtaagttccactttggttattggaaggcaagtcattattactggtattagttaaaacacatatcaaatgcttgctcttcatcatatatatagttatgcatacatacacacacacacatacagtatattctttcctcaaaagggttaagatgtctaaaatagggacctagaagcttaacactatttaagtaaatacagtagaagctcacaaatagatttctttgcacaatgattttttgcaaaattttacagtaataataatcccaaggcaaatctctcctgaactgctttccattccataatttgtagtataattcttggattccactgttttctttggggaatggaagttctgaattaaaagcccactgtggagatgctgtggttcatggaatctcttccagtgtaattcagaatcattggcctagaaagtctctgatatttggaggggaacaaaaatcactcacaagcaatccatgatctatacacataagcataatttcctttagttctagttagtcatcagagaacagtcatgtatgcaagttttgtgactgagaaatttctgtgcttccaatccacaatgagatgcatgattttgttttcatcccatttcccccaagcccctgtaaatcagggaaaatgcgcaactgatcgcctaggagagggcctcgtagtggcacagctggagatagtttcaaagtctaaaccaccagcccatcctgaggaaagcctcctatggaatgtaaagtgcaatcatttcttcagatataagactttccccaacaatgtgattggattcctttatggcaaaatcgagagaagctgccatccacctgcttatgcatttatctcttttgtggacttgtctgaccaccttctatttgcccagagtttgctcaattccaagacagtgcccatgaatgggacacctgtaatgtaacccacacagcggtttgcagagaatgttagccatgacttgggctttctgaaagttggctataatttctctatccctacccacaaccctgggaagttggagcaagaggggcatactattgggctgggaggatttgacagcatttccccagttgccctttaagttcttctatttcaaacgttaattttgcttctctttctaaaaaaaaaaaaaaaaaagaaagagaagaaagaagtgattcctaccccctacctccagagttgttgaaagctgaaaagcatacaagattcttccttttaacttggatttctcgttccagaaattgtgggataatctgtattcttgctttagaaaacattcttagagagggtactagcttactgatgatgtgttaggattgctactgatgctgtcatgtggaaactatttaaaggcactattataaatttatcctataagatgacaatgtttactcaaagtctaacatattcaatgcaagtaagactttctgaaaacacttgatgatgtggaaatgctgcaggattaaataacttgaagagcctttatagattatatgaatgcctatttgtgtctagaaccagttatttaacctgtaaaatgtcaatagcaaatgaaggatgaagtatatctctagatgcaaatacattgagtttaaaagtgcctcaaaataattgagatcacatttcaggacatttggaaatcaggtcgatttgtggtaactgtagtcatcttaaatttcaaaccatttaccatctgaaagttttgatttgaatgtaaaacaggaaattggaattcctttgtccaggagaaacctcacaaaccttctttaaggcatagttttgttgtttgtttgcttgtttgttgcaggctgtaaggcatggctgcttgtttacaaagcatctcattcatattacctgtggagttgcatatccaaaccttagtgagttttgaagctttaagcaaattcttttaaaaaattcttgtatttctagcattactagatattaaaagttaagcaaatagattaatgacgtatacataggcatcatttcacaaggtcagtaatgctgcaggaaaagcaaaattgcaatctacgtatctatggtactaaggaagtcctgtttttcaaaaatggaagcccacttctcagatttttctgaagggcatacaatgaaaagtgaaggggaaacacacacacgcaaaaaaacaagtatttggcttgtcacaggaatctgattgcattaagtgaaaggattatttagaatatgttaatgcaaagctaaaataaaattttccttggcaattaaaaatgctgtgcgctaataccctgctttctatcgtgactcaattcaacaatgtggggaatgtttactacatttccaacttgatgtcaagcaatggggaatacaagttccagttctgcaaagattcgtcaactttcttagctcaagagagaggctgagaaatgcagagaagaataagacataaaatagctccgacctccatgatccgagagtgggaaaaggcccgattattacccataaggcacactctctaaggccttttaaggggcctacaaaaatgttttattttataatcagaagaaaaggaaatgaacattggggattgaaaatcatattggtatttgcaccaacatagtcataaaatagtatgttaatatgtttttactttatatatttatatattaaaatatatttaatatgttttgcctttgtggcccatgaaagtcttactgggccctggggaaggtatcctaccctggtgaagcagctgctttgctctacaaatacctggggcagaaatttgatttgaaaagtattattctctcttctctttgtttcaactggattcctttggaaaaccaaactagtatcagaacaaaccccgaaacagtaagaaattggagtgagaagggcatggtattgggactaggatcggctctcattcgatcgagctattctcttaaaatgacaaaaagtgtccataaagaggctgctggagagtgcgtggccatagggagccgacatgcccgggaggaaaggtgttgattacatggatacttctaaaagctaaagccttgttgccttctctttaatgcctagagaatgggatgtgtgatgcaaatgctcaaaacctcttaaatcatagctgtctgacctctacggacctcacatccatctgaggcttcatggacaaagattctccacttggccaaactttagccaagctcctcaaccttctcccaggcccaatctgggcacttccttgtaaaatctagttttggcaagaagtctattaggtcagtttagcaagaacacctaacccccccatatctgttcaacctcagtatctgatcaggctcctcagcctccaccatcccccaggtgatgtctggtcaactggcctaccttcagctagaatcctgttaggtcggtttagatgaatgctccctgatatttcctcttggtaatcttccatccactgcccctgaccctgttccctgtctataaatccccagttttccatggtgtattcagagctgagtccagtctctctcccctactacaagtccccattgctgtggtccccgtacctgtcatgatggtcctaaataaagtcttactgtgctttaataggtagcattgaaaaatttttttctttgacatcattcatgacaacatgaaacctattgggacagcatgactgtgcagggtctttagagctcagctttctgaggccctgagcattcttggttttccgacatcgtgaacctgttctgtgttgcaagatatcactcaagccagtgttgcttaataccatctctttgtgtaatagatctgaataaagtaattgtaatacaccaata

SEQ ID NO: 87619 - DNA, 6137 bp, Homo sapiens
acattatctgcccaagcacagtgctgttggccaagcctccagcagctgacgggacccagctgtagtgaggttgcagtgattgagtaggattggcctgcttcaaagcagaggtttctcatgggaatatgcttattaaactcccactggtgcagaaaccatgaacagaggatgaacaagtgaagttgcaatctcctccatcacagctcagttccccaacaacaggatcacaagctggagatgcctttaaggaagatgaagatccctttcctcctactgttctttctgtgggaagccgagagccacgcagcatcaaggccgaacatcatcctggtgatggctgacgacctcggcattggagatcctgggtgctatgggaacaaaactatcaggactcccaatatcgaccggttggccagtgggggagtgaaactcactcagcacctggcagcatcaccgctgtgcacaccaagcagggcagccttcatgactggccggtaccctgtccgatcaggaatggcatcttggtcccgcactggagttttcctcttcacagcctcttcgggaggacttcccaccgatgagattacctttgctaagcttctgaaggatcaaggttattcaacagcactgatagggaaatggcaccttgggatgagctgtcacagcaagactgacttctgtcaccaccctttacatcacggcttcaattatttctatgggatctctttgaccaatctgagagactgcaagcccggagagggcagtgtcttcaccacgggcttcaagaggctggtcttcctccccctgcagatcgtcggggtcaccctccttacccttgctgcactcaattgtctggggctactccacgtgcctctaggcgtttttttcagccttctcttcctagcagccctaatcctgacccttttcttgggcttccttcattacttccggcccctgaactgcttcatgatgaggaactacgagatcattcagcagcccatgtcctatgacaatctcacccagaggctaacggtggaggcggcccagttcatacagcggaacactgagactccgttcctgcttgtcttgtcctacctccacgtgcacacagccctgttctccagcaaagactttgctggcaaaagtcaacacggagtctacggggatgctgttgaggaaatggactggagtgtggggcagatcttgaaccttctggatgagctgagattggctaatgataccctcatctacttcacatcggaccagggagcacatgtagaagaagtgtcttccaaaggagaaattcatggcggaagtaatgggatctataaaggaggaaaagcaaacaactgggaaggaggtatccgggttccaggcatccttcgttggcccagggtgatacaggctggccagaagattgatgagcccactagcaacatggacatatttcctacagtagccaagctggctggagctcccttgcctgaggacaggatcattgatggacgtgatctgatgcccctgcttgaaggaaaaagccaacgctccgatcatgagtttctcttccattactgcaacgcctacttaaatgctgtgcgctggcaccctcagaacagcacatccatctggaaggcctttttcttcacccccaacttcaaccccgtgggttccaacggatgctttgccacacacgtgtgcttctgtttcgggagttatgtcacccatcacgacccacctttactctttgatatttccaaagatcccagagagagaaacccactaactccagcatccgagccccggttttatgaaatcctcaaagtcatgcaggaagctgcggacagacacacccagaccctgccagaggtgcccgatcagttttcatggaacaactttctttggaagccctggcttcagctgtgctgtccttccaccggcctgtcttgccagtgtgatagagaaaaacaggataagagactgagccgctagcagcgcctggggaccagacagacgcatgtggcaaagctcaccatcttcactacaaacacgcctgagagtggcactggggaaacataactccatctacaccttggatttggactgattctccattttatcacctgaaggcttgggccagagctcaacatataagttaccatttactctataatctgcagtgatgcaataaccagcataataaaaaggcaatcacataaaaaagagtttagtcgtctaaacataagtaactttaaggtgaatgaaagatcttctttaggaataatagatgatggtaagttccactttggttattggaaggcaagtcattattactggtattagttaaaacacatatcaaatgcttgctcttcatcatatatatagttatgcatacatacacacacacacatacagtatattctttcctcaaaagggttaagatgtctaaaatagggacctagaagcttaacactatttaagtaaatacagtagaagctcacaaatagatttctttgcacaatgattttttgcaaaattttacagtaataataatcccaaggcaaatctctcctgaactgctttccattccataatttgtagtataattcttggattccactgttttctttggggaatggaagttctgaattaaaagcccactgtggagatgctgtggttcatggaatctcttccagtgtaattcagaatcattggcctagaaagtctctgatatttggaggggaacaaaaatcactcacaagcaatccatgatctatacacataagcataatttcctttagttctagttagtcatcagagaacagtcatgtatgcaagttttgtgactgagaaatttctgtgcttccaatccacaatgagatgcatgattttgttttcatcccatttcccccaagcccctgtaaatcagggaaaatgcgcaactgatcgcctaggagagggcctcgtagtggcacagctggagatagtttcaaagtctaaaccaccagcccatcctgaggaaagcctcctatggaatgtaaagtgcaatcatttcttcagatataagactttccccaacaatgtgattggattcctttatggcaaaatcgagagaagctgccatccacctgcttatgcatttatctcttttgtggacttgtctgaccaccttctatttgcccagagtttgctcaattccaagacagtgcccatgaatgggacacctgtaatgtaacccacacagcggtttgcagagaatgttagccatgacttgggctttctgaaagttggctataatttctctatccctacccacaaccctgggaagttggagcaagaggggcatactattgggctgggaggatttgacagcatttccccagttgccctttaagttcttctatttcaaacgttaattttgcttctctttctaaaaaaaaaaaaaaaaaagaaagagaagaaagaagtgattcctaccccctacctccagagttgttgaaagctgaaaagcatacaagattcttccttttaacttggatttctcgttccagaaattgtgggataatctgtattcttgctttagaaaacattcttagagagggtactagcttactgatgatgtgttaggattgctactgatgctgtcatgtggaaactatttaaaggcactattataaatttatcctataagatgacaatgtttactcaaagtctaacatattcaatgcaagtaagactttctgaaaacacttgatgatgtggaaatgctgcaggattaaataacttgaagagcctttatagattatatgaatgcctatttgtgtctagaaccagttatttaacctgtaaaatgtcaatagcaaatgaaggatgaagtatatctctagatgcaaatacattgagtttaaaagtgcctcaaaataattgagatcacatttcaggacatttggaaatcaggtcgatttgtggtaactgtagtcatcttaaatttcaaaccatttaccatctgaaagttttgatttgaatgtaaaacaggaaattggaattcctttgtccaggagaaacctcacaaaccttctttaaggcatagttttgttgtttgtttgcttgtttgttgcaggctgtaaggcatggctgcttgtttacaaagcatctcattcatattacctgtggagttgcatatccaaaccttagtgagttttgaagctttaagcaaattcttttaaaaaattcttgtatttctagcattactagatattaaaagttaagcaaatagattaatgacgtatacataggcatcatttcacaaggtcagtaatgctgcaggaaaagcaaaattgcaatctacgtatctatggtactaaggaagtcctgtttttcaaaaatggaagcccacttctcagatttttctgaagggcatacaatgaaaagtgaaggggaaacacacacacgcaaaaaaacaagtatttggcttgtcacaggaatctgattgcattaagtgaaaggattatttagaatatgttaatgcaaagctaaaataaaattttccttggcaattaaaaatgctgtgcgctaataccctgctttctatcgtgactcaattcaacaatgtggggaatgtttactacatttccaacttgatgtcaagcaatggggaatacaagttccagttctgcaaagattcgtcaactttcttagctcaagagagaggctgagaaatgcagagaagaataagacataaaatagctccgacctccatgatccgagagtgggaaaaggcccgattattacccataaggcacactctctaaggccttttaaggggcctacaaaaatgttttattttataatcagaagaaaaggaaatgaacattggggattgaaaatcatattggtatttgcaccaacatagtcataaaatagtatgttaatatgtttttactttatatatttatatattaaaatatatttaatatgttttgcctttgtggcccatgaaagtcttactgggccctggggaaggtatcctaccctggtgaagcagctgctttgctctacaaatacctggggcagaaatttgatttgaaaagtattattctctcttctctttgtttcaactggattcctttggaaaaccaaactagtatcagaacaaaccccgaaacagtaagaaattggagtgagaagggcatggtattgggactaggatcggctctcattcgatcgagctattctcttaaaatgacaaaaagtgtccataaagaggctgctggagagtgcgtggccatagggagccgacatgcccgggaggaaaggtgttgattacatggatacttctaaaagctaaagccttgttgccttctctttaatgcctagagaatgggatgtgtgatgcaaatgctcaaaacctcttaaatcatagctgtctgacctctacggacctcacatccatctgaggcttcatggacaaagattctccacttggccaaactttagccaagctcctcaaccttctcccaggcccaatctgggcacttccttgtaaaatctagttttggcaagaagtctattaggtcagtttagcaagaacacctaacccccccatatctgttcaacctcagtatctgatcaggctcctcagcctccaccatcccccaggtgatgtctggtcaactggcctaccttcagctagaatcctgttaggtcggtttagatgaatgctccctgatatttcctcttggtaatcttccatccactgcccctgaccctgttccctgtctataaatccccagttttccatggtgtattcagagctgagtccagtctctctcccctactacaagtccccattgctgtggtccccgtacctgtcatgatggtcctaaataaagtcttactgtgctttaataggtagcattgaaaaatttttttctttgacatcattcatgacaacatgaaacctattgggacagcatgactgtgcagggtctttagagctcagctttctgaggccctgagcattcttggttttccgacatcgtgaacctgttctgtgttgcaagatatcactcaagccagtgttgcttaataccatctctttgtgtaatagatctgaataaagtaattgtaatacaccaata

SEQ ID NO: 87620 - DNA, 688 bp, Homo sapiens
accattcatccgctcggccctccgggacagctctgcggcctcaggcgcactgccctctatagaacgcaccgcggctacccgccgcacctcggatgaaatccagactccttcccagagcctgcaagctcccgcatgatcctgctgccgtccgcctctccaaaccccccattccacccctctccctcgtctgctgcagccagactggcttgctgacagtttctcgaaaaccccacgctcattactctctcaagcacttaacttgttccctctgcttggggtgctttgcttccagcgtttcccgggctgcctctttctcatccttcaggtcttagctcaaatgtcacctcctcagagaggccttccctgaccaccatagctaaagttaccattcttaattccattcccttttattctctatcctgattattttcttcatggccccatcacagtttgtaataatgttattaatttgtttctttgcttagtgtctgcttcctccactaaacagaaagctcgatgagggcagggactgtgtctgttttgttccctgctgtatccccagcacctaaggcagtgcctcctaggaagagtattcaataaatatttatcctacgatggaatcaatgaatttaacaatgagtctttggtcacctagccaagggaatggatcgaaccctgccccttatgc

SEQ ID NO: 87621 - DNA, 350 bp, Homo sapiens
ggtctcttgtgagccctgtaaagaattaaacaaaaagtgatgaaggttttaattccaccatgggtctgcttgccatcactatatttctagatctcattgtacacattcatacattgatacaccattcattcccagcatttcccacatgcttacttttaatggtgtgataatctgattaatggctttctagaccattagaaaacccattgaaactcttttggtaaagagctaaaattaaatattttaggctttgtgcaccaaaagttatttgatgtaactactcaagttggacattataacatgaaaaacatcataggcaatatgtaaaagaataaggatggctatgttat

SEQ ID NO: 87622 - DNA, 394 bp, Homo sapiens
gacaatgaaataaacccaactcaaagaaagtaaaatgaaggtattattaaagacaaagcatatcctgaaatagaaaaaataataacaacaaaagtattccacattagcaaaatcaaaagctgtttttttgtccaaaaaaatagacaaacctgcagcaagcttcaacaagaaataaagaagagcgatgatgccaaaaaaacaacactagaaatactttttaaagaagtaccatacttatatgaagatttaaaatttataacatcttttgaactgggcatggttgctcatgcctgtaatcccaggactttaggaggctaaggcaagaagatccttgagcctaggagttcaagaccagcccagacaaggaagtaagaccttgtctccacaaaaaata

SEQ ID NO: 87623 - DNA, 413 bp, Homo sapiens
gggagaaaatgaagcacaatcaatgaaatttggaaattcagagaatgctgctaaatcatagcagattggccacaccagaaaagggctggaagaatgaaagaaaaatggcaggaaatatgaaagaaataagtgaaagtgagaaggttggacctacttttaatcagtctcagaaggtgtaaagagagaataatagatcaaagatgatatttgctgagaattttcgagaattggtgtggcaccaatccactgactcaagaagcccaaattccaggaaggataaataaaaagaattctgtgtaagtcataatgaaattaaaaaaaaaagacttaaaaatagactgaggaaaacctgacaagcacagcactgaggctgccaggtgactcttggcagtagcagcagagcccagcaggca

SEQ ID NO: 87624 - DNA, 444 bp, Homo sapiens
caatcttggtgcaatcttggattttttttttcatgtgaatgtccagttgtcccagcatgatttattgtaaagactattttttctccattgtattgccttttcatctttgtcaaagatgattttactgtatttgtgtgagtctatttctgagctttctattctgctctattgactattatttttgtcaataccacagtgtttggagtacgatacctttattgagtcttaaaattgatagtgtcagtcttccaacattgtttttctccttccatattaaattggttattcttggtcttttgcctctccatataaactttaaaattagtccatcaatatccacaaaataatttgcctagattttgattggggttgcattgaatctatagataagtttgagaagagcctacattttgacaatattgagtcttcctatccatgaatatg

SEQ ID NO: 87625 - DNA, 406 bp, Homo sapiens
gatccaaaaacctccaccatagagactgataaattgtagctattgaagctgtacttctttgtacataggtgctttgggagactcactctgattattgtaaatttgctcactagctacccaacattaaattcaaataacagagaatttctattgtacagccttgcaactttgctttaagtttaaacttttctttaaaataaaattttaagtggcaaaaataattattagaagagaaaatgtgtgctcatttttgaatattcttggcatcaaatataaatttgtatgtttactttattggcattcatactgccatttcaaaggactgcagcattcaaaaggggaaacaatattttgactgtgtattctgatttttataatgtaactctccatttcttcttttaaaagt

SEQ ID NO: 87626 - DNA, 5613 bp, Homo sapiens
  misc_feature (1)..(2): n is a, c, g, or t
  misc_feature (36)..(36): n is a, c, g, or t
  misc_feature (889)..(889): n is a, c, g, or t
  misc_feature (3773)..(3774): n is a, c, g, or t
nngcaactgtctatgcagctgaatctaagtatggtnttttgtcatattgcctctagattttcttctgtgcttctctctatctgctctggaatggatgagtgaatgtgttctgggtgttttagggaacatattgatagaaatgaccaccttgcagacaaaatctctctctctctttttgtttttatagaaaagaagtgatagtagttaattggcatcgatttttcagatattgcactaccttataatggttgtttttgatacctgaaaattgtgcaaatgccaaatattaattgtaagtcatatctgagaaatcattcttggctgtctttctaggtattccatagaatcaacacattttaaggctgaaagatactgtcgaaatcacccagtcccaaccccccaatttaaaattgattctagtaaaattaggtccagtaacacctgtatatatgtatatatttaataaagagtacttgtacaaaaaagcttatcataaattatttcatgaatgtgaatagatttctggccttgaggacgatgtttggaaatatggttggaagcacaattcattcgctactagttattcagagcgtactttgttccaggaactatgctggaaactgatagttcactattctgatgaaaaggctggttttgttgttgttgttgttgttgttgttgttgtttttggtgaggaactcttactctttgctaatctattggcctatcttaagaaataattatttggttattcattggcttcctttaaaaaaaagtgttcttctacaaatcttacagagtgtaaagagataaaaagaaatgattttttttcttacctttacatatgaaggtttaaaaatacatcatgtggccaaagaatgagaaaggncagaattaaccaaggattcttaattgttaatttgaagaacacattaaccagaaagcttaaacattattattaaaataaattatttcatttgcacacaatgataataatgatgataataataataataataataataataataataataataatatgttgtttgctttccttaactgaatttcatcaaattcattcagtgatttttattttggtcattatttctatcttcccaataacccagaggtacatcaagtaaaaacacttttgcaaagagccagtcacttttccctcttagaaaatctcagaagaatgattaggggcacccaaagttctggttatctatgaataataatgaataattttggctgagaatggtacctttatataactcttttaaagatgaaattcagaataattttattcaggacctagtatctgcagtccatgttggccactaactgctacataattactttcaatttcctccaggcatgactaggtataaacatatatttacatgattaatccacattttaaaatgacttgcacttgtgcatatacatagtactttgaataatgtatattttaaattggacctcacaaatcttgtattaaagtaggtagagagtagagtcacactttttttgatgaaatgagtcacagagaagttacatgacaaagataaaatcacagggttggaaagaactttgaaaggtcatttttcaataatctcaccttaaaagtgaccccttttcaaacaaagcataaacaatttatttgtggcttattttacccatgagctggccaatacttcctggcctagaaaaatatctccactctccccattcctgttcttaatggtcttctcttctcaatttgtaaatattctccagtaaaagacaccaggtgtggagatgggtcacttaatttcaagttctgagtgtcttgtggttttaaacaagtctcttaacctctctaagactgattcctcatttataacagggaggaggtggattatgtaatatctaagagcttttcagttttaatactctctgattctcatagtaaatacaagcatactcttgtaagaaaaacactgaatactttgaaccacaaataagtgtttatggacaaaaatttagttctactgcttgattactttaagttcattgcttgcttcaaactaaggtttccctaccttcaaaaatatatataacatctctccatttagataaagtatattcttccccagggaagactgtattctttaaagacagtagaatattggctatttctcttttctgggatttcctgggcttttattcactaaatgggctcctgcccagtttgggtactgtgctgatttttagatatacagagataaaaatagcccctttccttgcaggtagtcacagtccggaagagatgatagatgcatagacaaaaaattatgggatgtaactaatgcttcagtagaatacagcagggccaaaactagagtgatactcatctcaggcacaaatatatatggggacatcaaaacttcaataatcaagatacctaatatttaagtgaatatttttaaaactcaaaattaatgcaaaagatttatgatgaacagaatatacaaattttaaataaattaatagaatcagtagtaataatattttcttctgcctcaggctccaaaattgctcagcatagcactgatctagatagaggtggataaaagatccacataacttaattacattgttgaaggagaggaacaagagtgatagcagagaaggtttcacagatataatcttaagctaaattttatagaatgatttggagttcttatagcctccattcccacttccacaaacaaacaaaaaaatgaaagcgcaattttatcagcacctgaggcaggagaagagatgaggatgtggaaagtcaaggggaactcttactacaaattcttagttctgtgtttggaggtaagggtgaatgcagggaagtgagagttgttgatgttggaaagacctaaagagcctggattaggaagagttttgtgtaaattactgaaggaatggaatttgatcaggattagtggcaatttattaaaaatcttgaagaataatacgatgaaaactaacatccttatttttctgttttagagaaagcacctgattattgtgtgaactatggtttggagggccacaaatctagaggtagtggaacagttgagatctcttattttttctttcctgtcttaaactttgccttctattccttttttctttttttgaccgcaatgacttcattgtcatttgtaaaagtgatacatgactgttaaagatagacattgtagaaacttaaaaacaatctcaaaattctaccacccagaaatcagaaatattttgtatttggatatgtttgtctagaagagtagattgcttgattaaaagacagagttttataaatgtagaagccaatatgacatacatgctgccattaaataataaaaaattaaattgacttttatctcaagataagattaaaattggagggtaaaactgaagaaattgttgaaatttggatggtgcttctttaaagcaagagatttagagagtcagagctttttatcccaggtttcaatctttatttcaggaaaattttctgcaattttgtctaagttaattttttttttttaagaaatgccaattatgtcaaatcccttttgtctctatacaatagtccccaactgttttggcaacaggcacgggtgagggtgggggaatggttttcagatgaaattgttccatctcagatcatcaggcattagtcgattctcataaggagcggacaaccttgcatgccctcctatgagaatctaatgccnncgctaatctgacaggaggcagagctcaggcgataatgctcaatgggtgccactcacctcctgttgtgctgcccaattcctaacaggtcatggataagtactggtcagtggcccaggggttggggaccactgctctgtaactatttacagtattctttgtaactactttggtatctttaaaattttctttaacttttgtcaaccataaccctagtgagttttcagttgtgattattctattttgtaacttccaatgtacttttcaacttcataatggttaattttgttttccattgctttcttggtcactgtcatttcatttttcttctctttctctatttttaccattgctttattgaaatatcttctttgagcttctcatgtttctctattaatgagatcatgtctataatattttttgagactacagagacctatttatataaactcttcctctatttcttgaaaaagtttttatctggcgtgagcttcatctgctttttcattgaggttttatctcccttgcctatttttggggctggtttctttctattaatcactgagcagagccagctatttactgaactacagtgtgggaagtggtgggagggtgagtcagatcagcccacagaagctatttaaatttcaggtttcaagcccacctccccaaaaccgttttatgtgttttttcttctgcccaggcaccatatttttatatctatttttgacatttgggcggcctatgtagttcacagtgtaaaactctctgttttactttctttatgttattgctagtgattattgcttgtagtcccacccccttccccacattagccttagtattctatattattcagcaagcttgttcacaactctcaaatatagtctatcagaatttttatctttacctctacattccactattcggaagtatatagtaaaatcgtatgaagacagattttgtctttttcttgcctgtttacactctatcttacagaggtttcaaacaaaccatctttgtttgaaacatcgcaggataatgatacttattgaaatctacatcctgcccaagatatatgccagtcaatttcctttctcctattagtgcaaatggctacctacttaaaagctgctgactatagtttgtcatcaattacttgttaattacagatatggttttcatttttttttctcaatttttcattatgttatttttggagactgtcttaggtggggagtgaattataaatatttttatttcaccacctttaactgagtcaccatatgttatttgcacttccaatagaccagggattgaccagagtatcttttactgatatgaccaccagagctacatggcttttaccttctgtatatcagatgtcactggaatcaagcattaaacctagattaaatctggattaaaccagctgtatggcaccttagaaaattgagaaggactaggaagctgatagaaagaactcctgtataaaaaataaattctttttacattttccttggtagtatttctgcaagcttctttagtttctataggggaatcccagagttttcctctgagattgcttccctttcctttgtattttcatttttccctcttgggctttacttttcagtcgtgtatttctatcccaatgttaatttattacactgtttatattttcctgtccttcaattcatcagtagattagtgaagtacttattcctttaattataagtataaacgtttttaatttctttttggataacgatacatttaatggaaaatttttaaatgctatggtttcttaatagcttttctctaccactaattacttccgtt

SEQ ID NO: 87627 - DNA, 705 bp, Homo sapiens
cttgcaagaagcaagtgggaatcactaggccttagtacttgtaggtgggcgatgaagccacaaacacagtctgccctcagctaggaccaagcaggcagcaggcagctgacctgtgagaaaacagccacagcctggacaacagaccgcaggcagaaggcccagcaccatcgcgccagctccctccacagccccagccttcaaaggagcattgtcatgggaggcaagataccagttctgtgttaaaccctggacaccactgaagggaaaggcattgaaggagttaacactttttagttaagggttttgtattcattcagataggaggtttggctttgctgctgggacagtcctagagtaagagaagttttcccagttctctccagaggataggacactgcacacctcattttgttttgactacaaaaagccagtgcaattgcatgcagaaatcagtcaacaggatgaccaagcagaggcaaaaggagagaacacccagcccagcgctagttggaagctggcagtcagcacatggggctcgcaccccagtcagcagcttcttagctgtttaaacaaagagtctttttttttagaaatgaacaaacaaaaacccctccctatttgaaggcaagagtaagctcagttgaagttgaataaagccagtgtccaggttccccatgatcctggtggcaggttacctgaattacc

SEQ ID NO: 87628 - DNA, 463 bp, Homo sapiens
  misc_feature (350)..(350): n is a, c, g, or t
  misc_feature (445)..(445): n is a, c, g, or t
aacttagaatccctggctaccatttcaaaattgtaattgtaaatttggtacaagagggttttctaaaaagattaatgcatacagattttttttgttctacttcctgtggttacattcctaagaaaaactgctagaatatttgccagtgacttggacctgggttttatgacctggcagaatgtcctttaaggggccctaagcaatgctgtcaggactgagctgagtaagcccctggggttagggatgctgaggacccctggggtgccctggcttggctggcacaggaaggcaggagagggagtgggtttcagggaggatgggctcctggcctgtgcatctttgcaagggtnagatttgctaatcttacatcacagatgcctctccatgtgtgagtctatgttagctgtactctcaagcaatgagataaactgccccctccctggangcccggtgactgtcagca

SEQ ID NO: 87629 - DNA, 388 bp, Homo sapiens
cctaagatgcctggcacaatcaaagacctttggtggcttccagcatttataaggcagagtccaaacacacacttaagaatgacttactcctctggcggaccccaccattccctcaccccgctttggctctgtcctctcgtggagctgcccctgcccctaaacactgcctcctctctaccaacccggaccatatttcccctcctcccctcaccaggtccagcagtacccaccacgtttgtggacatctccccaaggagctctcacgtatcagaagcaaggagttagccttcagccccacctcttgtgcttaggtctacagtgagtgtccagtgatgcttcctaccgactgctggggtgcacaagagtgaggccagcagatcccagcgaa

SEQ ID NO: 87630 - DNA, 1098 bp, Homo sapiens
catggtggcgggtgtctgtaatcccagctacttgggaggctgagacagaagaatcggctgaacccgggaggcagaggttgcagtgagctgagattgcgccattgcgccccagcctgagcgacaagagcaaaactccgtctccaaaaaaaaaagggaattattacccttaatcaagtatttattacctgaactaccaaaacgtgcagtgtaaatatacagagaacatgatttaaggttgaaaatgaggtgctcaaatagaaatgtttaaaaggtctttcacaaaaggctggtaaaatacctattcgttaccttttttatcttaaaattgtaatctaaaaagtattggtagttttaattttaaaatttctgagtattttgaaaactatttttaaagagtacataagactgtaaaattgtgattcagttaaacatttgagggcattcttgtctaggaatatggtagagataccatttgcctttgtgagagcagtgtgtttatacttgtttatgaaaaaattctacagaagttttagtgttgaaagagtccctttctgaaacccaagtgtcattagatagtttagttcatttgtatatgggcacattaactggtctgtgatgatcttaacactccttaaatagaccatctcagattaatcacatctgaaattaaggataagattaatatgcagggttttggtttacagttttgtacacttaacctttctgagtaattgttaaagtgcctcatcctaagtattgctgaccttttcctatttatacttgatagtttgaaaacccagtgaaacaaatttcgtatttgtaaaggattggacatcagatttatattgtctatgtgactcttctataacaattagttgcagtatgcaagtattacataattcaaattgtaaatagtgaaaaatgaacgtttataggtaactataacgtttcacttaatgggaaatcttactattataaatgtgcataattggcatttaaaatatcaaactgaaatgctgttttctcctaaaacagtatatatatatacacacatatgtatatgtaacatttatatataacactgaattttccagatga

SEQ ID NO: 87631 - DNA, 317 bp, Homo sapiens
aaactacctcaacatataaaaggcattagtgaaaaattaacaacaaacatcatctccattggagaatgacaaagcttttcatctaagatcaggaacaaggcatgaatgcccacttcgacaattcttttcaacacagtactgtaagttctagccagagcaattaggcaaaaaaagaaatgaaaggcccccaaactggaaacaaacaagtaaaattatctctgttcacagatggtaagatattttatgtagactattccaccaaaaaaaaacctactagagctaacaaatgaattctgccaacaggaggacacaaagtc

SEQ ID NO: 87632 - DNA, 299 bp, Homo sapiens
ggatggaggagaggatcccggtcgcgagcaccgatgtgaagcgagatgcatgagtcgtaaaataccaaagataatgaaaataaatggacagaaccttgagatcaggagaaaatccccctaaaaattactccagaaaaccatccccctgtgtgccccgccatcctctgtagcatttcccctggggtcttgtgtgctggtcagccttctaaaggggacctgctcacagacaatgtcctgaccccatttcacagtatttcagtgtataacacctatcatttattgagtctctattatattcc

SEQ ID NO: 87633 - DNA, 165 bp, Homo sapiens
tctgtccaggattattaccagctaaaccaagtaatggaggtctatgcctgatgaagaacacctgtaaaagctggaaaatgtggctgtcttctcaaatgggcagataccagcacaaagatacaaggattgtaaagactcagaatcatgatacttccagaagaaact

SEQ ID NO: 87634 - DNA, 421 bp, Homo sapiens
gcgtgagaaataggagtatctcctggattcgagtagtctgcgtgcaagtgatgggaagtggccgtcgtaaatcaaggtcggtgacagcactgataatttaaacattgcaggcattccaaaatgctgtgatttgcaacaccagttttaattaatgcctgcaacctggctgtgaaaattgggacctgtaatttgtgagttacaataactgctagtgtttattaacctagcaggtcaaattctggtttcatggtcgcatatatacatatatatcatcacctattaaacttcaagttgaaagccaactggagagggaaattatcacccacaggtaatgcatcatcattgaaaacagaggtgagagcagaatggaaggttttctccttcccctccatcctgcctcacttggttaaccccttcctct

SEQ ID NO: 87635 - DNA, 341 bp, Homo sapiens
atcatacacagttcttttctttttaaagcacaacattaaaacctttaaaaggcatttaagggtttggtcaagtgaatatgataaaacatacttgtctgtataaagagaaaatgaaattgtagtcactgttatgtactgacattagttacaacctagttttaattcttaaaacaattttgattagcaaagctaaaaaaaatggatgtttcagttaaatgttttaaagaggtacagatttttacaaggacataatataagttattgttctgtagaaatatcctattaaatattgtatgtccctccctctgtacactttgtaaagaaagtaaatacataaaaag

SEQ ID NO: 87636 - DNA, 766 bp, Homo sapiens
cattttcagtgctctgcctcagtggggagcaggggtggggcaacacaaagacccaaataggctgctgggtaatcctagggaatgtacaaggatgtacaaggccccagagctgagtctaccctacacagccatgaggcaaaaagtgaattaggaacaagtatgctctatagcccaggtactctggaagttttatagcacaggtgaccttggcccctgtcaagtataggcccagggcacctggagaacacttaagtctgagggtgagtggtccctcctgcttctctgtggttattgtttcatgtagccagcttttctatgtgtatgggtagcatgaccattcatctagcctccctccatctctatcatccgtgccacccgaaacaggtattgctactcccagggacagaggtcctcagaggggcagcctgggacgtttggcctacattccttttccgaaggctggggagtttggatgtgggaattggactcttgctcaaataacgggtaccagtgtaaatagatgtctctcaccctctgttttgttactttttattatggaaaattttaacatacaaatgagaggagagtgtaatgacttacacatacaatatatgttcatttcatggttcatcttgtttcgtctatatcccctttcctcccccttcttctcccagaatgttttgaagcaaatctcagacatcttatcaccttattatttcatccaaaagtattttagtatccctgaaagatacagctcttcaaaaaa

SEQ ID NO: 87637 - DNA, 629 bp, Homo sapiens
aatgtacatgaaaatgaaaacaattgaaaaacctgtgagtggcagtaaaagttgtattggaagttttataacctaatatttgtgcatatattgtaatactaggaagaaaaaatatagaacccaaggaactaaaacaagctgaaatgaattgtgggaggaaggaggtagtattattttaaaaggcagaaataattgaaagaaaaaaactggatctgaatccaaaattgatatttgatggaagagaaaaaaaatgagacaaagtttagtgattccagaggtgaaataaggatgacaaataaacaatattgtatatgagaaattgaaatggctatatatgtaaacttaaaagaactgtgtcatttggggtaatgaaaatgtggcatgggtaaaggttgtacaattttgtttatatactacaggtcactcaactatacactttaaaagggtgaatattatgctgtgtgaatttgatctcaatttaaaaacttaaggctgggtgcagtggctcatgcctgtaattccagcactttgggaggctgaggtaggagaatggcttgaggccaggagttcaagaccagtctaggtaacataatgagatccccctcccctcatctctacagaaaaaaaaa

SEQ ID NO: 87638 - DNA, 490 bp, Homo sapiens
  misc_feature (9)..(9): n is a, c, g, or t
  misc_feature (18)..(18): n is a, c, g, or t
tgaaaatcnggaaaaagnctgtgatttttaataagttgacgacatcagaattaactggaggtgtaaaatcttaatagacctccctccagaataaacttatttaaaaaaataagactggccaggccatgtgtgtcacgcctgtaatcaggtgatccacctgcctcagcctcccaaagtgctgggattacaggcatgagcgattgcacctggctttattttttgttgagacggagtttcgctcttgttgcctaggctggaattgcaccactgcacactccagactgggtgacagagcgagactctgtcttacaaaataaaaaataaacggttaccaatctgaaaccctgaaaatatgatgagtagtagaaagcacagctgtcaaaaaagcaggaagagattataaaattttttctaatatttccccccaaaatgcagaaaacatactggcaacattatttgaccagaggaagcagtacaataggataaccat

SEQ ID NO: 87639 - DNA, 419 bp, Homo sapiens
  misc_feature (9)..(9): n is a, c, g, or t
  misc_feature (18)..(18): n is a, c, g, or t
tgaaaatcnggaaaaagnctgtgatttttaataagttgacgacatcagaattaactggaggtgtaaaatcttaatagacctccctccagaataaacttatttaaaaaaataagactggccaggccatgtgtgtcacgcctgtaatcaggtgatccacctgcctcagcctcccaaagtgctgggattacaggcatgagcgattgcacctggctttattttttgttgagactctgtcttacaaaataaaaaataaacggttaccaatctgaaaccctgaaaatatgatgagtagtagaaagcacagctgtcaaaaaagcaggaagagattataaaattttttctaatatttccccccaaaatgcagaaaacatactggcaacattatttgaccagaggaagcagtacaataggataaccat

SEQ ID NO: 87640 - DNA, 494 bp, Homo sapiens
ggattgcttgaacctgggagttggaggttatagtgagctgagattgcaccactgcacactccagactgggtgacagagcgagactctgtcttacaaaataaaaaataaacggttaccaatctgaaaccctgaaaatatgatgagtagtagaaagcacagctgtcaaaaaagcaggaagagattataaaattttttctaatatttccccccaaaatgcagaaaacatactggcaacattatttgaccagaggaagcagtacaataggataaccatcaaatatctgattattaattcaatattccctcttaattaacatgggttaaggaataaatccctaatatatacattatttaaatgtacatgaaaatgaaaacaattgaaaaacctgtgagtggcagtaaaagttgtattggaagttttataacctaatatttgtgcatatattgtaatactaggaagaaaaaatatagaacccaaggaactaaaacaagct

SEQ ID NO: 87641 - DNA, 393 bp, Homo sapiens
ctgtcacccaggcatgatctcggctcactggaacctccatcttccaggctcaagtaatcctcctgcctcagcctcctgagtagctgggatcaaacgtgcacaccaccatgcctgtgtaatttttatatttttggtagagacagggtttcaccatgttgcccaggctggtcttgaattcctgggttcaaatgatccacccacctcggcctcccaaagtgctgggattacaagcgtgagccactgtgcctggccaaacactttcaagttgttccaaacaaaaaccaaggctacatttcatgctgcaattacacaaccatctttgaaaacaggcaggatagcagggaaatcattgattgagaattactcaatttcctagactctcaggcaagtttg

SEQ ID NO: 87642 - DNA, 193 bp, Homo sapiens
gctcctgtcctcctgttcacctctggatttggtagttcctttagacttggtcctgatcctttttctcttctcgtgctacttttttttccatggctttgaatatatacttatgactccatatttagcaccaactcaatcctctcttctcaacctcagatccaaatacccaaatgctttcaaggcattcttactt

SEQ ID NO: 87643 - DNA, 486 bp, Homo sapiens
gacaggagcccgcctcccctcctgaggtgctgtagctggaaattgcttgtgcaacccgatgacaacttttctatatttagcagaaaaagtggtggcaaggatctgtccagctcaattttttttacagtttcaatgttcgaaatctctcagacaatctcctgaaaggcacattggccttgacagtatctgagcggaaggaaattttccccatctcacagggctgtccactggaagccgggacgtggagatccactgtagagcagagacttgacatgccaaacgctcctcccacaccttgctctacaccccacgaaacggggagacactggtcccgttgaagcttcgatggcttttaagtgttattctaagaagggaaaataagcatgaaagattcaagggggaaatggactatctcttaattgtttatgcctttaattgacatgtatggcgcttggtttttatttcttttcaatgtggcatgcaaaa

SEQ ID NO: 87644 - DNA, 284 bp, Homo sapiens
gagaaaggaaccaagaattgagacttaaccctctacaatttaacgaaaaggttaggaagaaaaggagaaccagcaaaagagaaagagaaggaccaatcagtgaagtaggaggaaacccaaaagaatgggtagtatgggccacaaataaagagtgtgcatcaatgagaataaagcgactggttgtgtcaagtgtttctgatgggtaataaaaggggaactgagaattgaccattgcattcaacaccatggagaccactggtggtgttgacaagcatagtttcagt

SEQ ID NO: 87645 - DNA, 149 bp, Homo sapiens
gggatagccatcaccttaaatatttatcttttctttatgctaggaacattctaattattctagcaaatgtttacttaatgtgttctcattacttctctcaggtagatttctggaataatggggatctaggtttaggttgggcttaagtt

SEQ ID NO: 87646 - DNA, 605 bp, Homo sapiens
acattgcaatgctacccaaaccttagtgacttaggaaaaaataaaacttgaaagtaagattcctgttaaggctttaaactgatgattatcattcatgtatttttttttcctctctccttacttccctggctatttattcaagacattctattctacactaaacatttaatttgaaacatgtggttcttggaaaatatgccgtcttccatgtttataattaatgctgacataattaatgacctcaaaattcaagaaagccttttacttttgagcatatccatgccatctttaaatacgcacactgtactctctggtatactatgctgctcaaatgtttttatccggtcagtaattagtttaatttggctttacaaaaaaattcacctttgaagtcatatattaacattaaaaaccatactacttcaaatgtacaatgcctatcatttttgcatcacacatgtgaaatacatgaactgacctcacctattcctttttcaaaataaccaccacttcaactgtgtaacactcagttgaaacaacagcaattcaaataatcaagaacatttcttgggaaagggagagttggggcacagatcttatgaaag

SEQ ID NO: 87647 - DNA, 687 bp, Homo sapiens
gtggtccagtaaaagaatgcattctcctcagctatctggagaagttcaagattgtctttgataaaagaatatttaccaggtgtctgaaaataccaagctggagaattagtctatggtgattaaaaactctcaaagcatgtcttaccaactggagaatttttcctatgtcaaccaaagggacctcccagtgccaagtgtataagtgtgtctggaattggtgggttcttggtctcactgacttcaagaatgaagctgcagaccctcctggcggaattctccacgagttttgagcagcctcggttttcccaccacctccaaatcatggaagacacagggcagagcccccggagccatggccagcccttcccgcagctccgaagccactggcaagccccgaggcagggatggccggcccaggagggaggaggacgacgtccctcccgaagagaagaggctgcggctcttgctggaggggggaagcgcacagccccaggacggcgaggacggggaggacgcgccgcggccgggcagggtggagaccggcacccagacaggtggcgacggcagaggatgatgttttgttctggggtgcatcacaagagacaaggttcctggccgggcatggtggctcaagccaataatcccagcactttgagaggccgaagggggacgatcgcttgagcccag

SEQ ID NO: 87648 - DNA, 847 bp, Homo sapiens
tccattcgaatcatcttattacttggcagttctgcatggcctacactccacagcaagctcaggaaaaggtgagatcagtcccattgaagacctcaagttctctgcataaaaaggagaggggccaagaaagtgggtgagagtagataccttttaccacaggtaggaatatcagtagaaaaggtaaggcagtactggagaaaatagctgtatattctgtcttccctcagctccaccccttgctttgctggtctttatatgtgctaatgtttgaaatttgcctataagtaataataatacttataaagtccctttaagaactatatccagagatatctgatgtctttcttctcaaggtggtcatcctcagtctcaaccctggctacacgttagaatgatccgcaaagcttttaaaagcatggatgcagggtctcatcacaagtcaattaacttagagctgagcagacagcgggcagccatcactactgttctcaagagtccccaggtcattctatttttgcagtcagtgcctttaagagcagttgtgatgtcccacattctctggtgttccccaaaaaggcactgctcttccccacaagtgctgggaagcatgaaatgtgagggggagactatttttcatgggtaggaacaagtttttctgtctcagattctatcttgttgacatgtgtgatgctgagataaggagaccactctttctggtggacgcccttaatgccttcgggagtttacatctcattcttcaaaatgtaccactcggcctataaggaaagccaggattgtaaatgcatttgctcacgtggaaataacctacctagcccatttgcagatt

SEQ ID NO: 87649 - DNA, 317 bp, Homo sapiens
aaaggaaatgagaaaggcaggagtcatggagcaaatgggtggcaggtggaaggatgatggagaaaagcaacagggaaggagagctatgtctgattcttggctaagatctaaatatgccatatgaatataactgccaggctctcaaaaggcacatatggattgcttttgagaatgaaagtccagcatgtggtttggagccttctgaaccaaattaacatggttgaggcataacttcagggacccttcatcatgactgagattagagctgaggacttggtgtgttcttaaatctagctgctgcccctttctctctccct

SEQ ID NO: 87650 - DNA, 349 bp, Homo sapiens
ggaccttcctctctgcattcttgctatttgttggtgtggcaagtcagtcagtgtgcgctgaggggtccttctcagcttcccacgttgcgtctttgtgcctgttgctggtacctcaggacagactcccagtcccggtccgtcatgatttccattctgcattttgatgtagtcatgtctcatgtctcagttggctagagtatattttgaagtaattcttttttggagaacagtagatggtggtacatttttctgagtcttccatacctgagaatagcctgctgtttccttgacacataagaaagctcctttgcctggtaggtgaagatggaggtgcgggaggagggggtga

SEQ ID NO: 87651 - DNA, 543 bp, Homo sapiens
cctccctctgggagcccccactgagtgcctctgaggacctcattccttggaccctggtgtctagggcaccccaagccccagcagagctcctggtactcctacaggctccttgcgccaacctccacatagcttcctttctcaggggctgcctgacaaagtatgtacttaactcttctgtttattccttgccctccttccgtccataacctctttagaatgtcagctctggccaggcgcagtggctcacgcccgtaatcccagcactttgggaggctgagatgggcagatcacctgaggtctcctaggagtttgagaccagcctgcgccaatgtggtgaaaccgtgtctctactaaaaattaaaaaaaattagcctggcttggtggcgcacgcctgtagtcccagctactcgggaggttgaggcaggggaattactggaacccaggagggggaggttgcaatgagccaagaccacaccactgcactccagcctgggtgacagggcaagactctgtctcaaaaacaaacaaacaaacaaacaaaaa

SEQ ID NO: 87652 - DNA, 404 bp, Homo sapiens
gtgtgtgccttgtcttttcacatagattgtaagccccttgatgataaggattctatatcttttccctatagttccaggcatgttattgaattgagtaacagtttgcctgaaatgtattaacctgggatggataaaatgggctagttttgagaaatataattgtcaaaaacattttgatttgacagatgaagcagaagtgatgtcttgggttttgaacttttgggagaatggtggtgcccgtgcgttttctagaaattagctgttcatgcacataggtttggatccccaaacaggagaattggatttcaccgttacatttaatatgatgttttagcttttcctaaaactgccttattgattatcttatagtaatcttgaagataatgtatttttaactatgagca

SEQ ID NO: 87653 - DNA, 437 bp, Homo sapiens
tctgtatcaaaagtagaggctgtgaattggttatggtactcttgcctgagtgtggcctcagaatccaacccatataccacactctagcagcagcaaaatccatcagagatgcctgcaagcgaaactaccggccatgtgtgggccctggagaaacccctatccacatcctatttagagctggcagagtggagctataaccaagcctggaggcaggataggaaaagaaaagtgaattcagggaaaatcacttatttacaaatccatctgcttaatcaacagtattgactctatgacatgccaggctcaagcctgatgcagatgtacatggtgatcataaaaagacctctgcccatgcctggctacaggttaccaacatacaattacaataccaccagctccctcttctatgacactagaaggctctggggggccacaaa

SEQ ID NO: 87654 - DNA, 535 bp, Homo sapiens
aaagtgcaggataaatgtttcaccaataggactagcctataccaagggcagtgcccagacaaagtgacataaactaagcccagaaagatgaagaggacttagggggaagaagggttgtccagtcaagggaatttaaaattgttctaagtgcaaagttaagccatcggaaggttgtacactggggaaggacatcagcccagctgcaatatggggatggatgagaagggacagtagccaataaggaatgaccagtgtccagatgggagaaaaaggagtacttggactagggcctactttttattttatctttttaatctcatgacagatgacaaggcctgctttttaaatgccagcattccccagaaagacagcccagttctgttagtagtggcgttcactagtatccaggtctttgccatgaatgtctcatccagcagtcttaagccaggcctctgcaagaagatgaggtcttccctctcatcgggttagaaatagaaatccttagcaggaacacatttcagatactaaattacac

SEQ ID NO: 87655 - DNA, 322 bp, Homo sapiens
ccttagctttgcaaagtggctgcagtaaaacctgccatgcttggattggcacggctcaaagctaactgtatttgaaacttcacatttcaaatctcgaagaagacttctgtattaaatttagagttttttatcctcaaaggagttgtacattttatttgtgtcaaaatttacagagcactgtcttaggcgctttctagcagttgctttaaagggttgtcagctccaggcatttcctctgcccacatacaggtgttgtcacatgttcccaggtgaggagttagcaagggtttgctgtagctcttggtttaaatgttggcaaaaa

SEQ ID NO: 87656 - DNA, 296 bp, Homo sapiens
ctttacgtatactttctggttatactgcaacataaatattttctagttgctgggccacaccgttgacattatttcctcatttttggacactccggagcagacttgtacattttcagaaaactgtcaataacattttttgccactttgcaccattaagtgttatctttgaatcaggtgttggccaaatcgtgtagactgttccgttttgttcatggttactatggaaactgtgcagtcataatgttttgaggagactagcaggaaatttaagagtgtacaataaaagttaacttatt

SEQ ID NO: 87657 - DNA, 488 bp, Homo sapiens
aaggactgccaacacgcatctccatttctgcgaagtgactttaaaaccacaagatttaaaagaccagggcattacataatggtaagggttccattcaacaagatctaactattctaaatatatatatatccccaacaggaacaccccagattcataaagcacagttcttagagaccctaatagaaacttaagactcccacacaataatagtgggagactttaacaaccccactgacaatattagatcattgagaccgaaaattaacaaagatactcaggaactgaactcagcactggatcaaatatatacacaacactggatcacagaatatacattcttctcattgccagattgcggtgtttgaagcacctgaaatcttgctactccaaatggagaaggggtgtaagtataaaatacaaaccatatcttgaagactcaacaccaaataaatgcagatcatctcattatttttgtattagttatatag

SEQ ID NO: 87658 - DNA, 164 bp, Homo sapiens
gatctgaaccaggacacgtttgaagtgaaggaggtgtgattagtagttaagctgggacaacacgtctaaaatggaccattctgtgcaaatcaggacatatctgtatgtaatgatttccaccatcaacctgtatacagcaagtaaaagaaactgctgtttaaaac

SEQ ID NO: 87659 - DNA, 406 bp, Homo sapiens
tcggcttccctacttctgaggttttgggacttggactgatccaccattggcttccgtgcttctcaacctgcagacagcctattgtgggactttaccttgtgatcgtgtgactcaattctccttaataaactccctttcacatatacatatatcctattagttctgtccctctagagaaccccgactaatacaggtatcttttgactctatggcaaaaaaataagctcaaaactaccaataataggaaaaaaatccggggggggggggtctcttttagagaatgtaatgtttcccatcacagtggtttcttaaaaggatgttctccacactcacggggtgtcttttggcataattgttatacatttggcatggacagcacacaggctggtgtcttcaaaaaggacaa

SEQ ID NO: 87660 - DNA, 244 bp, Homo sapiens
gtcatctcagaccaaagtggaataaaaccgtaaattaactccaaaaggaaccctcaaacctatataaatatatgaaaattaaataaactgctgttgaatgatccttgagtcaacagtgaaatcaagatggaaatttaaaaattatttgcacagaacagtaatagtgacacaacttaccaaaacctctgggatacagcaaaaacgttgctaagaagaaaggccatagcattaaatgcctacatca

SEQ ID NO: 87661 - DNA, 1055 bp, Homo sapiens
  misc_feature (69)..(69): n is a, c, g, or t
aggcgcgcagcggagggaggagtaataatacagacagtgtcggagcgcgtggagcttgtgatcaaagangcaggcgccgaaccacggggaaaaatatgttcaacaaaactaattcctgtagaccaaaataaggagcaaacgcagagtccatcaacatcccgcccgcaatccatttccaaggtgagagtgttaccccgtcataggaatgtgtcatcatttgtttaaccaaataactattgttggatagttaggggatttccagctttctgttgcatttttgaaagtttataaggttattaaaatgagaataatgcaaagaatatccttgtagatatctttttggcacatctctgaatatttctagaaagagaacaagatgaaggttaggaatgttgcctcctttagaaagggtgtggaattatccttaaaaataaaccaacatgcaaaccaatagataactttatcagtttggcaaaacaacattggtcatgcaaaatggttttctcatcgttttgatttgaattcatctcatcacgaataagattgagtatcttccacttttcaaccttctgtagatgttcttggtatgtgaaggcgattagtccttttcaatcatgttagttgcatgttatcttcctagtacatggccttctttataattttgtttttaacacaaagaagttttttgtttgcttgtaggcaaatctccttttcccgtataatttcttttgcttttatgcttcgagacttcttccttatcctgtgataggttaaatatccacattaattttcttctaatttttacttaacttttttttttttttccccttgagacagagtctcactctgtcacccaggctggagtaccatggcgcaatcttggttcactgcaacctccaccgcctaggttcaagcgattcttctgcctcagctactcaggaggttgagacaggagaatcccttgaacctgggaggtggagtttgcagtgagctgagatcgcgccactgcactccagcctgggcaatagagcaagcctctgtctcaaaccaacaac

SEQ ID NO: 87662 - DNA, 555 bp, Homo sapiens
caggtccctccgcagcgggttctcagttgctcgctgggcagacccaggtcgcgctcccactgccgagcccgcgagatgctccccagagctgcctggagcttggtgctgaggaaaggtggaggtggaagacgagggatgcacagctcagaaggcaccacccgtggtggggggaagatgtccccctacaccaactgctatgcccagcgctactaccccatgccagaagagcccttctgcacagaactcaacgctgaggagcaggccctgaaggagaaggagaagggaagctggacccagctgacccacgccgaaaaggtggccttatttcctccaaagccgatcaccttgacggacgagcggaaagcccagcagctgcagcgcatgctggacatgaaggtgaatcctgtgcagggcctggcctcccgctgggactatgagaagaagcagtggaagaagtgacttgcatccccagctgtctccctgaggctccgccctggctgggagcctctggcggcccctcccctcccctgcccttaaccccagtaaagctccaaa

SEQ ID NO: 87663 - DNA, 687 bp, Homo sapiens
caggtccctccgcagcgggttctcagttgctcgctgggcagacccaggtcgcgctcccactgccgagcccgcgagatgctccccagagctgcctggagcttggtgctgaggaaaggtggaggtggaagacgagggatgcacagctcagaaggcaccacccgtggtggggggaagatgtccccctacaccaactgctatgcccagcgctactaccccatgccagaagagcccttctgcacagaactcaacgctgaggagcaggccctgaaggagaaggagaagggaagctggacccagctgacccacgccgaaaaggtggccttgtaccggctccagttcaatgagacctttgcggagatgaaccgtcgctccaatgagtggaagacagtgatgggttgtgtcttcttcttcattggattcgcagctctggtgatttggtggcagcgggtctacgtatttcctccaaagccgatcaccttgacggacgagcggaaagcccagcagctgcagcgcatgctggacatgaaggtgaatcctgtgcagggcctggcctcccgctgggactatgagaagaagcagtggaagaagtgacttgcatccccagctgtctccctgaggctccgccctggctgggagcctctggcggcccctcccctcccctgcccttaaccccagtaaagctccaaa

SEQ ID NO: 87664 - DNA, 592 bp, Homo sapiens
  misc_feature (33)..(33): n is a, c, g, or t
cgactgtggagggccctggaattgagtgatgtnggggagatggcacagctcagaaggcaccacccgtggtggggggaagatgtccccctacaccaactgctatgcccagcgctactaccccatgccagaagagcccttctgcacagaactcaacgctgaggagcaggccctgaaggagaaggagaagggaagctggacccagctgacccacgccgaaaaggtggccttgtaccggctccagttcaatgagacctttgcggagatgaaccgtcgctccaatgagtggaagacagtgatgggttgtgtcttcttcttcattggattcgcagctctggtgatttggtggcagcgggtctacgtatttcctccaaagccgatcaccttgacggacgagcggaaagcccagcagctgcagcgcatgctggacatgaaggtgaatcctgtgcagggcctggcctcccgctgggactatgagaagaagcagtggaagaagtgacttgcatccccagctgtctccctgaggctccgccctggctgggagcctctggcggcccctcccctcccctgcccttaaccccagtaaagctccaaa

SEQ ID NO: 87665 - DNA, 572 bp, Homo sapiens
ttttactgctaagttatgtgttctcttactgttaagtttactggtaagttctttgttaacccaaaagccttattgtttttctaacccctcgttttgctttctaatatgaatatattatgaaccattaggctgaacaatctgtatttttgtaattcagtttttaaaggcatctttatttttgtctcccactcttaagtttatgaatctgtctctattgtttcaaaattaatttgggtcttcatcatttctcacctatgctatttcactatctttccagctgttctttctactttataataccctccatacaaaacccactgtgccatcggaaggatcttttaaaatatagctctagccacgtcactctccctgctttaaatccttcagtgacttctcattgctataggattaaattcgcagtcacctcaacctatgttttcagccagcctgctttcttcactccttcaaaacatattatgtagactttttcctccttcgggctagtcaaaggactggaaggaacaaatttgtctcacccaaattggaaaagaaatttaaaagtaaaaaaaaaa

SEQ ID NO: 87666 - DNA, 5491 bp, Homo sapiens
  misc_feature (435)..(435): n is a, c, g, or t
  misc_feature (509)..(509): n is a, c, g, or t
  misc_feature (1126)..(1126): n is a, c, g, or t
  misc_feature (1224)..(1224): n is a, c, g, or t
  misc_feature (1879)..(1879): n is a, c, g, or t
  misc_feature (1938)..(1938): n is a, c, g, or t
  misc_feature (1951)..(1951): n is a, c, g, or t
  misc_feature (2819)..(2819): n is a, c, g, or t
  misc_feature (4120)..(4120): n is a, c, g, or t
  misc_feature (4179)..(4179): n is a, c, g, or t
gcacagccatctgtggtgactaggaggtccccaagccgaggacacccatcaaggacctttagagtggcctcagaccaaggtcaccaatcaatggctaactgggggtcccaaaacctagcccagccatctatggacagtggggagccctcaagcctagcccagccatctcaagcccctggggtaacctcaaatctggcccagccatctcaagcctttggggtgtctccaagtccagactacccatctcagtctgttggggagtacccaatgctggctcagccatttcagcccactgaggtgtccccaagtccaacctacccatctcaggccattagggagtacccaaccctggcacagccatttcagcccactgaggtatctccaagcccagcccacccatatcagctcactgaggtgtccccaagtgcagcctantcatatcagcccactgaggtgtccccaaacccaggctacctatctatggccattgagatgtccccaagcccagnatacccatctgtggccactgaggtgtccccaagcccaacctacccatatcagcccactgagatatccccaagctcaggctacctatctgtggccactgaggtgtccccaagcccaggctacccatctcagctcactgaggtgtccccaagctcaggctacctatctgtggccactgaagtgtccccaagcccagactactcatctcagcctactgagatgtccccaagctcaggctacctatctatggccactgaggtgtccccaagcccaggctacccatttcagcccactgaggtgtccccaagcccagactatccatgtgtggccactggggagtcccctagccttgcccagccatctcagcccactgaggtgtccccaagctcagcctacccatctgtggtcactggggagtctccaagcctggcccagtcatatcagcgcactgaggtgttcccaagcccagcctacccatttatggccactgaggtgtccccaagcccaggcgacccatctgtggtcactggggagtccccaagcccagcctacccatctcagcccactggggagtctccaagcctgacccagccatctctgaccatcagagtgtccccangcctagccatgtcatctcagactattggagtgtccccaagcctagccatgccatctcagaccattggagtgtccccaagcctagccatgccatttcanaccattggagtgtccccaaccctagctcacccatctatggccattcgggagtctccaagcctggcccagcctcctcagtccactggggaatccccaagcttgacctggccatctcaggccactggggtgtccccaagtgtagcccaccaatctgtggccagtagggtttcctcaagcctagcccagccatctcaagccagtgggatgtcccctagacaagattacccaccagtggcctccagggtgtccccaaaccaagctcacgcatctataaccagcaggatgtcccctagcagagctcatgcatctatgacctgtatggtgtccccaagccaggttcatcgatctatgcccagtgaggtgtccccaagccttgcccagctatctcaggccaccactgcagtgcccttaagaccagctcatcaacctatggcctgtggtgtatccccaagcctagcccagccgtctcaagccacagggatgtcttcaaggctagcccaccaacctatgacctgtgtggtgtccttaagcccagcccagccatctcaagccattggtgtgtccccaagcctagcccacccatcaggaccccatgggttgtctccaagtctagctcacccatatgtggccagtggggcgggctccagcctagccnacccatctcagaccactgcagtatccccaaggcaagcccaaccatctgtggcctccagnccaggcaagacanattcatcctgtaccctagcctccagcctagccgagccagctatagcccccagcctattcccaccatctgtggcccacacggaagccctaagcctggctcagtcacccccggacactaggttggccccaagccgatcccagccatctgtggtcagtggtacatgtcatggcctcaatgagccatgctggggctctaggctggattcaaatctgcagtgttcaagggtggactcagtagccccgtgtctgtgtcacccatcagcgtttgtttcagttagcctgggtggaccatatccctctgtggctggaaatatggaccagggtctgaaccagccatccctgggtactggggtgaacctatgtgaagaacctctgatggttagtgagatggtatccagccccccggacttcaagttcaacgacgtgtcccttgggttccatcatccacccagggttggtgggaggcatgtgtgtccaccctctgtggttagtgtttcaacaccaaatctctctcatgctgatgaggaggcctgttgtgtaggccagtgaatcacgcctctgttcaggggtgtggctgtaagccatccccaggagcctttggctgatgctatgttccccagtgggtctcaggggaccacatctcctggcctagctgggaatctcccctggagaaccatagcaactggcatgggccaaagtcaatgtcaggtggccaatggcatggcttcccttgcatcccaggtcttagaggcaggtggccctttgacacatccctctggaaccacagggatggcccccagcccctctctggcttcagtgcccaacagactggccgtgactcagtctaatctttccctgaacagcatggnccccagcagctcccagatcagtgtggttattccaaaaaacatagactgctggcacccttctgaggcatccatggtcccacccagttaccagcagagagatgtgattccgcaggactctctgaagagcagggctggtcgtggtgcggcaggaggttttgtagccagtagaatgagcacgggcgcagtcccaggcactctgcctggtggcataacctccagccttcccccgggctccaccatccgaggcatgggtcacagccttcccgcaggctctgtgtccagttgggtggctcccagtctgatggcagacagaaagaagccaagtctatctgtaagaccctccgctagcttagctgctccaaacttgctcccaggttcagtagtgagtcgggtgagcccagttgtccccctggttctgtgccaatgatgggggcctctagtgtggctcagagctgctccaaggggcccatggtgattgacatcactgcccctccttacctcaaagcctggctggggagaggtctttagcccccttgcagatgccccacaccaccagtctggctccaggtcactcctcagccccggcagctagtggcacagtgaggagtctacaccgagtgcccacggttctatcaagagccttacaattgagccaagatgctaggataatgccatctggggtcacaggggaccaagccaagctaggagaattggatgaggctgtgttccaagtgtcaggatcaagtggatccaatgacctattcagcaaagccagggtcactggtgcaacccagtggatgtactccagtcctctgggagctgatgggggccatgatcataggtccctgtctgagaaagggtctcttccccaagggaggtggctcccagccatgctagtggcatggtccctgtccctttccaggccccgggtttagccactaagtccccctcagtttatcaacaggggtctgtcgttcacgtcataccccaaaatcactctcagggtacagtggcttctaatgtagtctcaggatcaccccagctggcccgtggcagtactgaggctttcagattgctttcagtgtctgtgggcaggatggggaatcctagtcttcttcagaggtcagggaccaccagcatggtctcacatgtgccactatatccgtcctcggctagaagggcattgtccagtcccttccagacagaagctgtccccaatccactccagaaaacagtgtctggaaacatggctccgagcagccgctgggacgccatgggccctaaaaattcctacagatccntgcatggtaggattgttccagaactgctagaaagttctgtggccagggttaggcccttncagtatgtgcaaagacaaccatcccaggcctcagcccgaagtggtgcaaaccccacccacaggccctctgcagaggtaaggcccgtcatccgcactggggagatgacacactcctcggtcattcctccgctggccccgggagttcggagggtgtctctaggctatgagtcttccccaagtggttccctgccacccctttttaaccaggagtcaccgtggagacggcaggactcctatagcccccagaatcctgccgttagtcacaaggcatccctgaactccactatactccagggccccgcggacgctggtgtggttggtggccaatcgtggaaccgcgcatgggagccagccaggggtgctgcgtcctgggacacctggcgcaacaaggcggtggtgcctcccaggcggtccggggagccaatggtgtccatgcaggctgcagaggagatccgcatcctcgcagtgatcactatccaggcgggcgtccgtggctacctggcgcgtcgcaggatccggctgtggcaccggggggccatggtcatccaagctacttggcgcggctaccgtgtgcggcggaacctggcacacctctgcagagccaccacgaccatccagtctgcctggcgcggctacagcacccgccgggaccaagcccggcactggcagatgctccaccccgtcacgtgggtggagctgggcagccgggccggggtcatgtctgaccgaagctggttccaggatggcagagccaggacagtatctgaccatcgctgcttccagtcctgccaggcacacgcttgcagcgtctgccactccctgagctccaggatcgggagcccgcccagcgtggtgatgctagtgggctccagccctcgcacctgtcatacctgtggacgcacacagcccacccgtgtggtgcagggcatgggccagggcactgagggccccggggcagtgtcttgggcctccgcctaccagctggctgccctgagtcccaggcagccgcatcgccaggacaaagcggccacagccatccagtccgcctggaggggctttaagatccgccagcagatgaggcagcagcaaatggcagcgaagatagttcaagccacctggcgaggccaccatacccggagctgtctgaagaacacagaggcgctcttgggaccagcagacccctcggccagctcacggcacatgcattggcctggcatctaggaccctggctccctgcagtggggacttcgtgggaggcactcatggctctctgggtctaatgaataaagtcctccacagcctaaaaaaaaaa

SEQ ID NO: 87667 - DNA, 3823 bp, Homo sapiens
  misc_feature (946)..(946): n is a, c, g, or t
ggctttgagtcacaaagctgctgcggcaccagggctccaagactggccgttcagactgctaggtttagcttcaggggcagcccagggcagtgttgctgcatattgcatggatgaaaggctgaaggctgcctcctcttgcaggctggcttctgagattgcaccttcttctcctgctactcctccaaatctatgacccttcaaggcagagctgacctgtccggtaatcaaggcaatgcagccggccgcctagctacagttcacgagccagttgtcacccagtgggcggtgcatcctccagcccccgctcaccccagtctcctggacaaaatggagaaagcgcctccacagccccagcacgagggcctcaagtccaaggagcatcttccgcaacagcctgccgaaggcaagacggcgtcccgccgcgtcccacgcctccgggctgtggtcgagagccaggccttcaagaacatcctggtagacgagatggacatgatgcacgcccgtgcagccacgctcatccaagccaactggaggggctattggctccggcagaagctgatttcccagatgatggcggccaaggccatccaggaggcctggcggcgcttcaacaagagacacatccttcactccagcaagtcgttggtaaagaaaacgagggcggaggagggggacataccttatcacgccccacagcaggtgcgcttccagcatccggaagagaaccgccttctgtccccgcccatcatggtgaacaaggagacccagttcccttcctgtgacaatctggtcctctgcagaccccagtcgtcccccctcctgcagcccccagcagctcagggtaccccagagccctgtgtgcagggtcctcatgctgccagagtccgggggctggccttcctgccacaccagacggtcaccatcagatttccctgcccagtgagtntggacgcaaaatgccagccatgcctgctgaccagaaccatcagaagcacctgcctcgtccacatagagggtgactcagtgaagaccaaacgtgtaagtgcccggaccaacaaagccagggctccggagacaccattgtccagaaggtatgaccaggcagttacgagaccatccagagcccaaacccagggccctgtgaaagcagagacccccaaagcccccttccagatatgtccagggcccatgatcaccaagactctactccagacatatccagtggtctccgtgaccctgccacagacatatccagcgtccacgatgaccaccaccccacccaagactagcccagttcccaaagtaacaataatcaagaccccagcccagatgtatccggggcccacagtgaccaaaactgcacctcacacatgccccatgcccacaatgaccaagatccaggtacaccccacagcctccagaactggcaccccacggcagacatgccctgcgaccatcacggcaaagaaccgacctcaggtttcccttctggcttccatcatgaagagcctgccccaggtatgcccggggcctgcgatggcaaagaccccaccccagatgcacccggtcaccaccccagccaaaaacccattgcaaacatgtctgtcagccacaatgtccaagacttcatcccagaggagcccagttggggtgaccaagccctcaccccagacccgcctgccagccatgataaccaagaccccagcccagttacgctcggtggccaccatcctcaagactctgtgtctggcctctccaacagtggcaaatgtcaaggctccaccccaagtggcggtagcagccggaactcccaacacctcaggctccatccatgagaacccacccaaggccaaggccaccgtgaatgtgaagcaggctgcaaaggtggtgaaagcctcatccccctcctatttggctgaggggaagatcaggtgcctggctcaaccacatccgggaactggggtccccagggctgcagctgagcttcctttggaagccgagaaaatcaagactggcacccagaaacaggcgaaaacagacatggcatttaagaccagtgtggcagtggaaatggctggggctccatcctggacaaaagttgctgaggaaggggacaagccacctcacgtgtatgtgcctgtagacatggctgtcaccctgccccggggacagctggctgccccactgaccaatgcctcatcccagagacatccaccctgcctgtcccagagaccactggccgccccgctgaccaaggcctcatctcagggacatctgcccactgagctgaccaagaccccatccctggcccatctggacacctgtctgagcaagatgcattcccagacacatctggccacaggtgccgtgaaggtccagtcccaagcgcctctagccacctgtctgaccaagacgcagtcccgggggcagccgatcacagacataaccacgtgcctcatcccagcgcaccaggctgctgatctcagcagcaacacccactcccaggtgctcctaacagggtccaaggtgtccaaccacgcctgccagcgcctcggtggcctcagcgccccaccctgggccaagccagaggacagacagacccagccacagccccacggacacgtgccggggaagaccactcaggggggaccatgcccggcagcctgtgaggtccagggtatgctggtgccgccgatggcacccaccggccattccacatgcaacgttgagtcctggggagacaacggagccacacgtgcccagccatcaatgcccggccaggcggtgccctgccaggaggacacgggccccgcggacgctggtgtggttggtggccaatcgtggaaccgcgcatgggagccagccaggggtgctgcgtcctgggacacctggcgcaacaaggcggtggtgcctcccaggcggtccggggagccaatggtgtccatgcaggctgcagaggagatccgcatcctcgcagtgatcactatccaggcgggcgtccgtggctacctggcgcgtcgcaggatccggctgtggcaccggggggccatggtcatccaagctacttggcgcggctaccgtgtgcggcggaacctggcacacctctgcagagccaccacgaccatccagtctgcctggcgcggctacagcacccgccgggaccaagcccggcactggcagatgctccaccccgtcacgtgggtggagctgggcagccgggccggggtcatgtctgaccgaagctggttccaggatggcagagccaggacagtatctgaccatcgctgcttccagtcctgccaggcacacgcttgcagcgtctgccactccctgagctccaggatcgggagcccgcccagcgtggtgatgctagtgggctccagccctcgcacctgtcatacctgtggacgcacacagcccacccgtgtggtgcagggcatgggccagggcactgagggccccggggcagtgtcttgggcctccgcctaccagctggctgccctgagtcccaggcagccgcatcgccaggacaaagcggccacagccatccagtccgcctggaggggctttaagatccgccagcagatgaggcagcagcaaatggcagcgaagatagttcaagccacctggcgaggccaccatacccggagctgtctgaagaacacagaggcgctcttgggaccagcagacccctcggccagctcacggcacatgcattggcctggcatctaggaccctggctccctgcagtggggacttcgtgggaggcactcatggctctctgggtctaatgaataaagtcctccacagcctaaaaaaaaaa

SEQ ID NO: 87668 - DNA, 2676 bp, Homo sapiens
  misc_feature (946)..(946): n is a, c, g, or t
ggctttgagtcacaaagctgctgcggcaccagggctccaagactggccgttcagactgctaggtttagcttcaggggcagcccagggcagtgttgctgcatattgcatggatgaaaggctgaaggctgcctcctcttgcaggctggcttctgagattgcaccttcttctcctgctactcctccaaatctatgacccttcaaggcagagctgacctgtccggtaatcaaggcaatgcagccggccgcctagctacagttcacgagccagttgtcacccagtgggcggtgcatcctccagcccccgctcaccccagtctcctggacaaaatggagaaagcgcctccacagccccagcacgagggcctcaagtccaaggagcatcttccgcaacagcctgccgaaggcaagacggcgtcccgccgcgtcccacgcctccgggctgtggtcgagagccaggccttcaagaacatcctggtagacgagatggacatgatgcacgcccgtgcagccacgctcatccaagccaactggaggggctattggctccggcagaagctgatttcccagatgatggcggccaaggccatccaggaggcctggcggcgcttcaacaagagacacatccttcactccagcaagtcgttggtaaagaaaacgagggcggaggagggggacataccttatcacgccccacagcaggtgcgcttccagcatccggaagagaaccgccttctgtccccgcccatcatggtgaacaaggagacccagttcccttcctgtgacaatctggtcctctgcagaccccagtcgtcccccctcctgcagcccccagcagctcagggtaccccagagccctgtgtgcagggtcctcatgctgccagagtccgggggctggccttcctgccacaccagacggtcaccatcagatttccctgcccagtgagtntggacgcaaaatgccagccatgcctgctgaccagaaccatcagaagcacctgcctcgtccacatagagggtgactcagtgaagaccaaacgtgtaagtgcccggaccaacaaagccagggctccggagacaccattgtccagaaggtatgaccaggcagttacgagaccatccagagcccaaacccagggccctgtgaaagcagagacccccaaagcccccttccagatatgtccagggcccatgatcaccaagactctactccagacatatccagtggtctccgtgaccctgccacagacatatccagcgtccacgatgaccaccaccccacccaagactagcccagttcccaaagtaacaataatcaagaccccagcccagatgtatccggggcccacagtgaccaaaactgcacctcacacatgccccatgcccacaatgaccaagatccaggtacaccccacagcctccagaactggcaccccacggcagacatgccctgcgaccatcacggcaaagaaccgacctcaggtttcccttctggcttccatcatgaagagcctgccccaggtatgcccggggcctgcgatggcaaagaccccaccccagatgcacccggtcaccaccccagccaaaaacccattgcaaacatgtctgtcagccacaatgtccaagacttcatcccagaggagcccagttggggtgaccaagccctcaccccagacccgcctgccagccatgataaccaagaccccagcccagttacgctcggtggccaccatcctcaagactctgtgtctggcctctccaacagtggcaaatgtcaaggctccaccccaagtggcggtagcagccggaactcccaacacctcaggctccatccatgagaacccacccaaggccaaggccaccgtgaatgtgaagcaggctgcaaaggtggtgaaagcctcatccccctcctatttggctgaggggaagatcaggtgcctggctcaaccacatccgggaactggggtccccagggctgcagctgagcttcctttggaagccgagaaaatcaagactggcacccagaaacaggcgaaaacagacatggcatttaagaccagtgtggcagtggaaatggctggggctccatcctggacaaaagttgctgaggaaggggacaagccacctcacgtgtatgtgcctgtagacatggctgtcaccctgccccggggacagctggctgccccactgaccaatgcctcatcccagagacatccaccctgcctgtcccagagaccactggccgccccgctgaccaaggcctcatctcagggacatctgcccactgagctgaccaagaccccatccctggcccatctggacacctgtctgagcaagatgcattcccagacacatctggccacaggtgccgtgaaggtccagtcccaagcgcctctagccacctgtctgaccaagacgcagtcccgggggcagccgatcacagacataaccacgtgcctcatcccagcgcaccaggctgctgatctcagcagcaacacccactcccaggtgctcctaacagggtccaaggtgtccaaccacgcctgccagcgcctcggtggcctcagcgccccaccctgggccaagccagaggacagacagacccatggggacttcgtgggaggcactcatggctctctgggtctaatgaataaagtcctccacagcctaaaaaaaaaa

SEQ ID NO: 87669 - DNA, 506 bp, Homo sapiens
ggctttgagtcacaaagctgctgcggcaccagggctccaagactggccgttcagactgctaggtttagcttcaggggcagcccagggcagtgttgctgcatattgcatggatgaaaggctgaaggctgcctcctcttgcaggctggcttctgagattgcaccttcttctcctgctactcctccaaatctatgacccttcaaggtaagaagatggtctatgggcaaggggtctggctagtccaacctgaagagaggggcttctgccaaacaagtgtgctgtgctccaggctatgcatcagggtggcttgacagtgtcccagctctctctgcatcctagttacttctgaaagccacagtcaccactttttcttccttctttccatccttccatatgccatttacctacccatcccctaatccacccacccacccatccacccatcagtctacctcctgttgggttatctcttcaccagtctttccagctctctttaatttccctccct

SEQ ID NO: 87670 - DNA, 5036 bp, Homo sapiens
  misc_feature (435)..(435): n is a, c, g, or t
  misc_feature (509)..(509): n is a, c, g, or t
  misc_feature (1126)..(1126): n is a, c, g, or t
  misc_feature (1224)..(1224): n is a, c, g, or t
  misc_feature (1879)..(1879): n is a, c, g, or t
  misc_feature (1938)..(1938): n is a, c, g, or t
  misc_feature (1951)..(1951): n is a, c, g, or t
  misc_feature (2819)..(2819): n is a, c, g, or t
  misc_feature (4120)..(4120): n is a, c, g, or t
  misc_feature (4179)..(4179): n is a, c, g, or t
gcacagccatctgtggtgactaggaggtccccaagccgaggacacccatcaaggacctttagagtggcctcagaccaaggtcaccaatcaatggctaactgggggtcccaaaacctagcccagccatctatggacagtggggagccctcaagcctagcccagccatctcaagcccctggggtaacctcaaatctggcccagccatctcaagcctttggggtgtctccaagtccagactacccatctcagtctgttggggagtacccaatgctggctcagccatttcagcccactgaggtgtccccaagtccaacctacccatctcaggccattagggagtacccaaccctggcacagccatttcagcccactgaggtatctccaagcccagcccacccatatcagctcactgaggtgtccccaagtgcagcctantcatatcagcccactgaggtgtccccaaacccaggctacctatctatggccattgagatgtccccaagcccagnatacccatctgtggccactgaggtgtccccaagcccaacctacccatatcagcccactgagatatccccaagctcaggctacctatctgtggccactgaggtgtccccaagcccaggctacccatctcagctcactgaggtgtccccaagctcaggctacctatctgtggccactgaagtgtccccaagcccagactactcatctcagcctactgagatgtccccaagctcaggctacctatctatggccactgaggtgtccccaagcccaggctacccatttcagcccactgaggtgtccccaagcccagactatccatgtgtggccactggggagtcccctagccttgcccagccatctcagcccactgaggtgtccccaagctcagcctacccatctgtggtcactggggagtctccaagcctggcccagtcatatcagcgcactgaggtgttcccaagcccagcctacccatttatggccactgaggtgtccccaagcccaggcgacccatctgtggtcactggggagtccccaagcccagcctacccatctcagcccactggggagtctccaagcctgacccagccatctctgaccatcagagtgtccccangcctagccatgtcatctcagactattggagtgtccccaagcctagccatgccatctcagaccattggagtgtccccaagcctagccatgccatttcanaccattggagtgtccccaaccctagctcacccatctatggccattcgggagtctccaagcctggcccagcctcctcagtccactggggaatccccaagcttgacctggccatctcaggccactggggtgtccccaagtgtagcccaccaatctgtggccagtagggtttcctcaagcctagcccagccatctcaagccagtgggatgtcccctagacaagattacccaccagtggcctccagggtgtccccaaaccaagctcacgcatctataaccagcaggatgtcccctagcagagctcatgcatctatgacctgtatggtgtccccaagccaggttcatcgatctatgcccagtgaggtgtccccaagccttgcccagctatctcaggccaccactgcagtgcccttaagaccagctcatcaacctatggcctgtggtgtatccccaagcctagcccagccgtctcaagccacagggatgtcttcaaggctagcccaccaacctatgacctgtgtggtgtccttaagcccagcccagccatctcaagccattggtgtgtccccaagcctagcccacccatcaggaccccatgggttgtctccaagtctagctcacccatatgtggccagtggggcgggctccagcctagccnacccatctcagaccactgcagtatccccaaggcaagcccaaccatctgtggcctccagnccaggcaagacanattcatcctgtaccctagcctccagcctagccgagccagctatagcccccagcctattcccaccatctgtggcccacacggaagccctaagcctggctcagtcacccccggacactaggttggccccaagccgatcccagccatctgtggtcagtggtacatgtcatggcctcaatgagccatgctggggctctaggctggattcaaatctgcagtgttcaagggtggactcagtagccccgtgtctgtgtcacccatcagcgtttgtttcagttagcctgggtggaccatatccctctgtggctggaaatatggaccagggtctgaaccagccatccctgggtactggggtgaacctatgtgaagaacctctgatggttagtgagatggtatccagccccccggacttcaagttcaacgacgtgtcccttgggttccatcatccacccagggttggtgggaggcatgtgtgtccaccctctgtggttagtgtttcaacaccaaatctctctcatgctgatgaggaggcctgttgtgtaggccagtgaatcacgcctctgttcaggggtgtggctgtaagccatccccaggagcctttggctgatgctatgttccccagtgggtctcaggggaccacatctcctggcctagctgggaatctcccctggagaaccatagcaactggcatgggccaaagtcaatgtcaggtggccaatggcatggcttcccttgcatcccaggtcttagaggcaggtggccctttgacacatccctctggaaccacagggatggcccccagcccctctctggcttcagtgcccaacagactggccgtgactcagtctaatctttccctgaacagcatggnccccagcagctcccagatcagtgtggttattccaaaaaacatagactgctggcacccttctgaggcatccatggtcccacccagttaccagcagagagatgtgattccgcaggactctctgaagagcagggctggtcgtggtgcggcaggaggttttgtagccagtagaatgagcacgggcgcagtcccaggcactctgcctggtggcataacctccagccttcccccgggctccaccatccgaggcatgggtcacagccttcccgcaggctctgtgtccagttgggtggctcccagtctgatggcagacagaaagaagccaagtctatctgtaagaccctccgctagcttagctgctccaaacttgctcccaggttcagtagtgagtcgggtgagcccagttgtccccctggttctgtgccaatgatgggggcctctagtgtggctcagagctgctccaaggggcccatggtgattgacatcactgcccctccttacctcaaagcctggctggggagaggtctttagcccccttgcagatgccccacaccaccagtctggctccaggtcactcctcagccccggcagctagtggcacagtgaggagtctacaccgagtgcccacggttctatcaagagccttacaattgagccaagatgctaggataatgccatctggggtcacaggggaccaagccaagctaggagaattggatgaggctgtgttccaagtgtcaggatcaagtggatccaatgacctattcagcaaagccagggtcactggtgcaacccagtggatgtactccagtcctctgggagctgatgggggccatgatcataggtccctgtctgagaaagggtctcttccccaagggaggtggctcccagccatgctagtggcatggtccctgtccctttccaggccccgggtttagccactaagtccccctcagtttatcaacaggggtctgtcgttcacgtcataccccaaaatcactctcagggtacagtggcttctaatgtagtctcaggatcaccccagctggcccgtggcagtactgaggctttcagattgctttcagtgtctgtgggcaggatggggaatcctagtcttcttcagaggtcagggaccaccagcatggtctcacatgtgccactatatccgtcctcggctagaagggcattgtccagtcccttccagacagaagctgtccccaatccactccagaaaacagtgtctggaaacatggctccgagcagccgctgggacgccatgggccctaaaaattcctacagatccntgcatggtaggattgttccagaactgctagaaagttctgtggccagggttaggcccttncagtatgtgcaaagacaaccatcccaggcctcagcccgaagtggtgcaaaccccacccacaggccctctgcagaggtaaggcccgtcatccgcactggggagatgacacactcctcggtcattcctccgctggccccgggagttcggagggtgtctctaggctatgagtcttccccaagtggttccctgccacccctttttaaccaggagtcaccgtggagacggcaggactcctatagcccccagaatcctgccgttagtcacaaggcatccctgaactccactatactccagggccccgcggacgctggtgtggttggtggccaatcgtggaaccgcgcatgggagccagccaggggtgctgcgtcctgggacacctggcgcaacaaggcggtggtgcctcccaggcggtccggggagccaatggtgtccatgcaggctgcagaggagatccgcatcctcgcagtgatcactatccaggcgggcgtccgtggctacctggcgcgtcgcaggatccggctaccagctggctgccctgagtcccaggcagccgcatcgccaggacaaagcggccacagccatccagtccgcctggaggggctttaagatccgccagcagatgaggcagcagcaaatggcagcgaagatagttcaagccacctggcgaggccaccatacccggagctgtctgaagaacacagaggcgctcttgggaccagcagacccctcggccagctcacggcacatgcattggcctggcatctaggaccctggctccctgcagtggggacttcgtgggaggcactcatggctctctgggtctaatgaataaagtcctccacagcctaaaaaaaaaa

SEQ ID NO: 87671 - DNA, 1675 bp, Homo sapiens
  misc_feature (116)..(116): n is a, c, g, or t
  misc_feature (1567)..(1567): n is a, c, g, or t
  misc_feature (1570)..(1570): n is a, c, g, or t
  misc_feature (1572)..(1572): n is a, c, g, or t
  misc_feature (1612)..(1612): n is a, c, g, or t
  misc_feature (1631)..(1631): n is a, c, g, or t
gcttactcactatagggctcgagcggccgcccgggcaggtcagaggtccacagacatccaggaagatgcagccagcagacaaagaatggcagccacccaagtgctgaggggagccntcccggccatttctgtcccagctccaagggtctctccacgatggcctgcaacagcacgtcccttgaggcttacacatacctgctgctgaacaccagcaacgcctcagactcggggtccacccagttgcccgcacccctcaggatctccttggccatagtgatgctgctgatgaccgtggtggggttcctgggcaacactgtggtctgcatcatcgtgtaccagaggccggctatgcgctcggccatcaacctgctgctggccaccctggccttctccgacatcatgctgtccctctgctgcatgcccttcaccgccgtcaccctcatcaccgtgcgctggcactttggggaccacttctgccgcctctcagccacgctctactggttttttgtcctggagggcgtggccatcctgctcatcatcagcgtggaccgcttcctcatcatcgtccagcgccaggacaagctgaacccgcgcagggccaaggtgatcatcgcggtctcctgggtgctgtccttctgcatcgcggggccctcgctcacgggctggacgctggtggaggtgccggcgcgggccccacagtgcgtgctgggctacacggagctccccgctgaccgcgcctacgtggtcaccttggtggtggccgtgttcttcgcgccctttggcgtcatgctgtgcgcctacatgtgcatcctcaacacggtccgcaagaacgccgtgcgcgtgcacaaccagtcggacagcctggacctgcggcagctcaccagggcgggcctgcggcgcctgcagcggcagcaacaggtcagcgtggacttgagcttcaagaccaaggccttcaccaccatcctgatcctcttcgtgggcttctccctctgctggctgccccactccgtctacagcctcctgtctgtgtttagccagcgcttttactgcggttcctccttctacgccaccagcacctgcgtcctgtggctcagttacctcaagtccgtcttcaaccccatcgtctactgctggagaatcaaaaaattccgcgaggcctgcatagagttgctgccccagaccttccaaatcctccccaaagtgcctgagcggatccgaaggagaatccagccaagcacagtctacgtgtgcaatgaaaaccagtctgcggtttagggggtcagggggccacagagaaggggcagctgagccccagtcccagggtggatctgtcctgctctgttccctggcatgttggtcatagtctgcactttgtggtggcaatttaagcacaaaggtactcatttgtaatcagatgagctgcagctcccaaatttcaaattttggcacgatgaattatttttgtttctctttgcagagagccaaatatggggctgatgggaactgcaacgtcattaagtcaaaaatggagtgggctggggagtgcagaagttgggcagaaagggangangngggcaacagggaatgaagctggttgagtgtggggcaggangactggtcagtcacaagancttcaacctgccctgcgagccctctctgcacctgctcaagaaaa

SEQ ID NO: 87672 - DNA, 383 bp, Homo sapiens
ggacaaaacagccttacagagttgtcagggggactcctcattaaataagcatttatttgaagattattagatggcagaacatgtgattatcctgaacgacttaagacctgacattagtcatactgttctgtgcaatacacttatgagaacaagcattctctgcattgatattattgaagtcaaaataggaaatcttattacaaatataaccagattaaaggctgtgtctttccattgttaaacctaactctggtgattttgtttcagcaaaacaatgttatctgtcacgttgaataatgttcatttgcggttttctgattttgttactttgattatttagcttacactagggttgtattaaagtacttaaacatgaggactta

SEQ ID NO: 87673 - DNA, 377 bp, Homo sapiens
gcattctaaggaaattgtggagaaggttgctgttgtaatcactctactttccagaattacctgtcttatggatttcagaagatcagaaagggttagccacctaaatctatttacttattaatttcctatgggaacagtgcctacaaagttggcactttttttcctcattcacatcagtagggaatcttcaactttcacaatttaactaatctttttctttaacaccctttcttagaaaaaaaaaaatttcggccgggcgcagtggctcacacctgtaatcccagcactttgggaggccgaggcgggtggctcacttgaggtcggcggtttgagaccagcctggtcaacatggtgaaaccttgtctctactaaaaata

SEQ ID NO: 87674 - DNA, 348 bp, Homo sapiens
agtgccttgcccatagtaacaacttattttaactgaatgaacaagtgaatgtagcctattgtctaccattttctgcattgattccacaagtattatttgagctctgctgatgaaatggaagagttccctgatccccctcacaggacctgtgacagtggtttggctcaccactgctcaaacccctgacaggagggggagcatgcagacaggcaggagcaggagctagggtgagtgctttgggctctggccccatagtagtatctaggggtgggtgcctgcagcctcagtgttacagtgttcttttaaccttgccatccacagatggtttaagtgttaaccagctcagtg

SEQ ID NO: 87675 - DNA, 387 bp, Homo sapiens
ggtctcgctgttacccagtctggtctccagctcctaggcttaagcaatcctcctgcctcagcctcccaagtagccggggctagaggcatgagccagcacgtgtagcttctgatctttttgtcctcaattctcttttacctaattgctttctctagaggtaaggttatgaagtggagatggtcaggacccctcaaataaaatttgggaatacaggaaacaaagactgggtcaatacacgtattctttttgtttgtttgtttttgtattttgttttcagatggagtctcgctctgtggtccaggatggagtgcagtggcacgatttcagctcactgcaaactccgcctcctgggttcacgccattcttctgcctcagcctcccaagtag

SEQ ID NO: 87676 - DNA, 435 bp, Homo sapiens
tagattatgttttgtaagaacacaaagctcctgtttcttgttagtctttgactgaacttgacactagttaacagtctggggaccagtgaaaggttaatatgtactgtaaaattcaattctcagatattcattgtcatgcttctaattacacttctttttcgccaccaggccaaattcaattgtaacagtacatggaggttcacaatatgtattcacactggagacgtcggcattgtttctattgatgctaatattctaggttgtaatagtgcactacttttgacagctcaatgaactagccaaatatctattttgggcagttgaagatacaaagcagtatagtcattgacatagttcggatgtttgcccttgtccaaatctcatgttgaaatgtaatccccagtgttgaacgtggggcctggtaagaggtgattg

SEQ ID NO: 87677 - DNA, 459 bp, Homo sapiens
atgacaggatttcatgctttttaatgacaaaatattattccattatgtgtatatactgcattttctttatccactcatgtgttgatggacacttaggatgattctgtgtcttggctattacaaataatgctgcagtcaacatgggagtgcatatttccctttgacatattcattttctttggatacatacccagcagtgagatttctgggtcatatgccacttctacttttaattttttgaggcatctccatactgttttccataatggctagattcgtgtatatacccacctagagtgtataagggctccatttctccatatctacaccacaatttgttattttttctctttaaaaacatttttagattgaggtgtacacgtgtaggtttgttacatgggagttaaaacataatcctttctttttctttttcataaattgagacaggatgttgctatg

SEQ ID NO: 87678 - DNA, 839 bp, Homo sapiens
cattttacaaagaataaaatatgaagaaggaaaaaacaagattggtctgaatcgtttgcttaccaatggctcctatgaagctgcgtttcccctgcatgagggaagttatagaagtaaaaactccattcgaacccatggagcagaaaaccaccgacatctactctatgagtgctgggcctcctggggcgtgtggtataaataccaacctttggatcttgtaaggcggtactttggagagaagattgggttatattttgcctggttgggctggtacaccggcatgctcttcccagctgccttcattggattgtttgtctttttgtatggcgtcaccactctggatcacagccaagtcagtaaagaagtctgccaagctacagatatcatcatgtgtcctgtgtgtgataaatactgtccattcatgaggctgtcagacagctgtgtatatgccaaggtaacccacctttttgacaatggagccactgtcttctttgctgttttcatggcagtctgggcaacagttttcctggagttttggaaaagacggcgagcagtaattgcttatgactgggatttgatagactgggaagaagaggaggaagaaatacgaccccagtttgaagccaagtattccaagaaagagcggatgaatccaatttctggaaagccagaaccttatcaagcatttacagataaatgcagcagacttatcgtttctgcatctggaatattttttatgatctgcgtggtgattgctgccgtgttcgggatcgtcatttaccgggtggtgactgtcagcactttcgctgcctttaagtgggcgttaatcaggaataact

SEQ ID NO: 87679 - DNA, 457 bp, Homo sapiens
ttggctggtgggatggggtggtggctcagccagctcagcctctgatgtgctagccctgccctcttctgcctggatcagaagcctggccatccttccccagggtctagtctatactggggtcctttacttgtaatttatctttctgcttgaagtcaagtggtcacgcctgggacaagtgggaacaaagagggtgctcttgccctgatctccctgagatgagattgtcccaaactgctggtgaggatagcctagcatagaggcctccacagtgtaatggcatgatctcggctcactgcaaccttcacctcctgggttcaagcgattctcatgcctcagcctcctgagtagctaggactataggtgtgcgtcaccacactcagctaatttttgtatttttagtagagacgaggtttcgccatgttgaccaggctggtcttgagctcctggcctcaggtga

SEQ ID NO: 87680 - DNA, 312 bp, Homo sapiens
ttcccagcatttgcgattctgtgagaacaaagcaagaggtgtgagtttttccacttttctcctctttcttgggttcccccaggccagctgctggctgctgtgagaggtgcaggctcccaggtatgctcaggtacacccaggtccttccagggcattgacctggcccagtcacttggggtatgctactatggcattctccctgatactctgcccagtgaaagctcctttagctctatgggtaaacttgttttttcctatgagattttatttggcgggagctcccacactgaagttgccttcaacacagtgact

SEQ ID NO: 87681 - DNA, 256 bp, Homo sapiens
tctaatctttcaattatcttacttgctgttatgggggaaaatgctttaaccataggaatgtctaaagaaataacttagaattcattgaagaattcatacaagaattaagaataatatgcaaaaagtaaaaatataaattagaagtgaaaatgttcattagattaatttgatgattcttatgttgagaatctataagttattttctgcattgccctcatttttaaagtctcaaactggtcaattatgtgtgtatagc

SEQ ID NO: 87682 - DNA, 754 bp, Homo sapiens
agtccctccatgcctccagcacatgctgttctgcctgtctgaaatgtccttggtctcttctgaccctgacagactcctactcatcctttaataccctattcaagtggctcctgttctggagagccttcctgggtacccctagctaatcatactctctctcccctgctagacggtgagcctcaaggccagggactatgtcttattcaactctgtgcctagtgcctgacacagagctgggcacaaagtgatcattgagaaacagcttgttgagtttttatggagtaagtctatcctcaaatcaagggcaggccctcatggaaccacacacacgatctcaaatcctcagtgtccaggagggcttagatttggaggtaggagccaagtgagattaagaagagaactcatacttcttagggatccagactagggaattttccaggacaagtaggcctccagaactctgctgtgtgcccgtgactgctgctgagagaattcatacctgggacctcaccccgatccactccagcaccactcagagatagtggaaaacaagctggaggcctgagatggcctgtccactatcgctcggtggacctccttaaaatgtggagcccaaaactagccctgcctgagctaccaggaggatgctggctgtcactctacttctactcttacagcctacaatcacattggctttttcagcagcttttggcttgtggtcaactcaaacccccaggtctttttcactggggtg

SEQ ID NO: 87683 - DNA, 390 bp, Homo sapiens
ctcaaaaaaagaaaaaaagtaaagttctgagtagtaatttcattactctgtggggatttattttttttctaattattgtttaaatatttctcatggtgatatggtttggctctgtgtccccactcaaatctcatgttggattgtaatccaaccagggacctgctggatagtgactggaccatggtggtggatttcccccttgctgttctcatgatagtgagtgagttctcatgaggtctggtcgtttgaaagtgtagcacctccctctttgctctctctctctctcctgctctggccatgtgaagaccatgcctccttcccctttgacttctgcaatgattgtaagttttctgaggcctgcccagaagcagaagcctgtacagcccacag

SEQ ID NO: 87684 - DNA, 845 bp, Homo sapiens
cagtgtcaccagtttctcaaggaggcaatatggttacctctagtagcaagagtcatgaaacttcttcagagttataacatccaaagcccattctcctagcaactgtattttccctggcaggagaaactccacctaaccacaatagatcaagcctggctttctgtgggatgtcagtaggagagctggccatctgcaaactttctcaagcttaacaccatcggtcaatgactccgtttggctttcaggttgatctttgtccccgcccccacgctcattctaattcaaagtccacatggaatgttttatgccacagctgagcgtctaagaggaatacatgccttctggggcagatcatcctaacactgattttatgcaattctccccttccatcaccccaccctaccttgcttcatttgccccactagtaatgatcaaaaagagaaagaataaaatgttcaccaaatctgtgacttagaaaaacatgtggagggttctgccatcttctgaattctgatcctcactgagtcctcattgaaatgttatttggggaagaatgtttacctggggcctccttcccagaaactttttttcagatgaatttctagtcaaagactaagacttgcctttggaaatgcctggataaatctggatgctaaatgacttgaggacacctaataaaggaatggggtactattggggaattgtctgtcattgcattacaaatgctgctcagtctccctgctatttgcagacatcatcaccagagagtttcactaggctcgttgggattgggtctcagcaaggtcccatgtgactcaataagagcccacctttgctgctaaatt

SEQ ID NO: 87685 - DNA, 412 bp, Homo sapiens
tttcttagaacatatccctgtcgttaagcaacacagaactacatacacaaagcagtgctaagccctgtggtgctcaatcctgcaagggtggtgagcacatcactcggaaggtcagctctcccaccaaggggcagggcacactgggaatctggcttacaacaatcaactgcactggggcatgcacagaaaaaaatatgaatagcatcttcaacacggttgtctttaggaggtgggttcgttcaacttcactgtagatttccataaagcgtgaattgaggataattaatgtaaattatttctaagatcagaaaaatactacttaaaaagtaaaagaaaaaaagcttagtattaaagaacaaaaatattaatggagaaatgtaaacacatcatgcatctacaatcagagtataat

SEQ ID NO: 87686 - DNA, 484 bp, Homo sapiens
ctggagccgggggtggctgagggagccttcccttgtgagccctgcctgggaacagtccctgaggcccaggtcagggtgctgggtgcagagtcaggccaggaatggccaatgctagaaactcaggtatctggtaaacagatacagagtgggtatttcataaatattccctaagtgaatcaatgggctttggaatcatcaactggctgtgcatccctgtacacggcacacagcctttctgattctcattttcacctctaaaaaggtgatgataatgtcttcctgttggggttgttgcaaagttaaaatgcagtaagtaaaatacctggcacacagtaagtgttcaataaatggtagccattgaattacactgtgaactaggagcaggaaccagaaaataaatgagtcataactgaagggaaataactctacttaggtgtgtaacctcaggcaagtcattttcctttattaaagtctcagttgcctc

SEQ ID NO: 87687 - DNA, 417 bp, Homo sapiens
tcaaatgttgaaataaattaaaattttaaaataaaataaatattatcagtagattaattaaaggtttctgttttttgttttctctttgaaataagacagaaacacatgaggtccagcaataacttatttccttcaaagtttcattaaataatgattaaatctagccctatctagagattagaaatgttggcacgttacattataaccactcagagaaatataaggcattatcttcccttacaaatcattaacaaaaacatctgatcatacagaccacaacagaaatagaaatgctatcagtgatcacactgtttggtggtaagacaggatgaatggagatttaagtctgtttttcctccccatctttagtcagaaccagatgttaaatattgagactgggggtaggggaagtaaact

SEQ ID NO: 87688 - DNA, 110 bp, Homo sapiens
gatctgcttgccttggcctcccaaaatattgggattacagacatgagccactgcgcccagccagagggtgtttttttaatgtggcatttgaaaataaaaagttggaatat

SEQ ID NO: 87689 - DNA, 883 bp, Homo sapiens
gatccaaattgtgaagccgttggtcaggtgcctggctacacacaaaatggtggaggcttagcctaaacagtttcttcatttcacattaaaatcctaatttctggctcctctcaaaatgagttctagaagcactggatgtagattcccatgtggacacagccttcaggaggtgagcagcagctccctgcagccagctggagcctgccagttttccctagtgcccagcactcctgagcttctgccctccgagggattcccgcagctctctctaatgggatagtggagcgcctgtcggctgccttggcttgccttgctcaggtccactgacttaaatcaaccagccccatcctaggccctcacagtcacttaagaaggctgctgcaggggatgtggggcttgcatttccccggtggaaagttcaggtgtgaaagggagcgggtaagcagggaatggagaagacaggaagttctgccgccatggagagtgtggagaatagaaaccagcacttgaagattctaaacaattcacacctcagctgtgaagtcgggattttgaattaaattgttatttccatatgttttttactttcagttattttctagttaatgtattatcataggaccctccccaggagtccggcagatcacttcatcagttatatataaagaagtaattagattcaacactcagatcactacttagtttagattacattaagattgttttgtttttgaatgggggatagaaaaccattttccttttattttatttacttatttttgagacagagtctcgctctgtcccccaggctggagttgcagtgagccgagactgagccattgcattccagcctgggtgaaagagcaagactccatccatcttt

SEQ ID NO: 87690 - DNA, 460 bp, Homo sapiens
tcagtgccctttatttctgcatttaaattctagttacttgccagcatcctttcatttcagtctgaagagctttctttagtgtttcttgtatgacaagttcggtagtaatgaattctttgtttcctccttcatttttaaaggatagttttgctggatttaaattttttaattaaaagtctttttaaaaatttcctctgtcttctatgctttctgatgagaaatcagctgataatattattcagaatcccttgtttgtgataagccacttctatcttgctgctttcaagactatctgtgtctttggctttagagagttttattataatgtaccttggcatagatatctacaaattatagtacttgggtttattgagcctctgggatgtgtagactagtggtttttgttttgttttatcaaaattgtgaagttttcagccattatttctttgcatattctttc

SEQ ID NO: 87691 - DNA, 456 bp, Homo sapiens
ggtaggtttttggtagtgagagaaaagggaagagtgcttttggcagggataaaatctgggtaaaatcactaaggtgaggcttaaacaacatactcaagaattaaaagcctgcctgactctttattatgaggacaagatgatcaggaagaaatggtgcaagttcaggaaggtcttctgtactagtgtctcatatgtcagcatatacttattggtcacctgtgtgccaggcactcttctcattgcacagatactttagagaacaaagcatgaaagttttctgctttcttggagcttacattctaggagagggccacacataattaacggaataggttacaagttaattatttaatatgttacaaaagtagtaagtgctgtgaaaaaaaaaaggaaaagcagaggtgaggctggggagggtgcaggcttgcgggggagcaaggcacaagaaggctacag

SEQ ID NO: 87692 - DNA, 851 bp, Homo sapiens
tccaattcggcatacagactacagagctgatgtgtattttttaagtaggttttaaaaataagtaagtcacagtgtcatatgccctcacatgccatccatatacaaagaatacataaccacctacgtacttccatttcacaaacaccaagtgggttgagcttctccccataactcccccaaaaaacgcttatgatacttgaaaactcaccatttaggtcaattcctttatttatggtataaatcccctatttaatataaatagccctggtaggcataatagttaagaattgttagtctcttttcccttggtataaatatggttatcaataccttatctaagagcaattttaatttggaaaacagcgtgaagaagaaagaaatggaaaaaggtggaccctggagattcaaaagacaagatttttttagtcaaaattttgaacagagtaagacatgacagaaaaattcaggcaacattatgtccatctgcttaatgtaaatataacatattcataggataaagctcaatgccagacacttccaccattgcatggccccagccagctttgcatgggaactcactgctacccctaccaatcagggggtagtagttggctttctttggtagtcctcaccaacctattcttgtacttccagctctattctgtcctcttagaggtgtcagtggcattccaggatgaagtggtggggatctcagctctgggagttcatatgctactggtgctgattgccaacctgcaacagccattagagtccaagggataatgagagtaaggagacttctatcaagttcagccagctgaaaccatgcatctaaaatgctatgggaagaa

SEQ ID NO: 87693 - DNA, 830 bp, Homo sapiens
tgtccttaacattcatcttattggggttcaagcagagaaaactagggggagacggtgtgtgcacatgcatccaatgtattctgaagaatgggcataggtgattgtgggggctggctgggactcagggctcaggttgaagctgctgttcccagtgggtacttggagggagcctcagccctgtgcttaagacttacagctgattggatcgggccttctgggattacccaggataatctcccctaaagttacctgatgagggtctttaatttcatctgcaaaatggttccacatcactacccaaatgtgtttgaataacttgaagatttgacacaagggaaaagcagccatggctgatgaagtgccacaggcctataaccccagctactgggaggccgaggcaggaggatggcttgagcccaggagttaaagtgtagcctgggcaacatagtgaggcctcatctcaaaaaaatgagaagggccatagtgtggctatgttagctgttcaggggacactagcacgtgtgtggcaaaagtaaacctttaatgtcagcagctacgtgtgtggctagtggctgctctgttggacagcagaactctagggggttagccaatgtgaaaaggacgaatgcccagccgatgccagcaggagtgagggatgtgggaggacaaagactttcctgcttccaagtaccctccagggctggccctcattgtccaggatctttctgcagtcctctgcccacctgcaggggcctggggccctgtgacctcagaatcccccataccatgggccacttgttacctgttcagtcttcccccactaggctggg

SEQ ID NO: 87694 - DNA, 895 bp, Homo sapiens
tgttttgaactggggcacatttttaacctaagaagggaatacaggttgtctcgtgaggtggttgtgcagttcaaatgagattacaaacgtgaaagcttgtgaagctcaatgatgtacattcatggagtcctcattgtacaaactggcccttcttggtaacctttagagttccctcccaggctgtaagctgcaagagggcagggaccaggtctgattgtattcatcatgtatcacaatgtttagcagaagggttcatgtgggtgttcaataaagttttgctgagtaggtaaataaatgaattaatgaatcctgttatgctctgaacagttcctattatttgttccttaagcagttccttcaatagtggtcttattgtatggctggctcagtgaaaaacactctaactcaacctcctgtgacttactagtgtgccaggagactgggagaattctggatggtactgtcagaggcattcaaaccagagaaactccattttgaatgagggctaggaaaatgagactgagactggctgggctgcattctcgggaagttaggctttcttagcctctagatgtttacagctaagggaacaaattaatagtgtttactaaacaaacccagacttgggagtgtccagatatcccgatatctggagaacaaaggcattcctaattttgctttaaagataatattgattcttgcaaaatatagtaatttatttatttatcacaaactcttgtagcagagcacatctccctatatatacgagcgatgtacctagcatggaatcgttcctcctcttactttcggcaacatcctactttgtctatggagtaggtgtcctttcaccactttactttcttaataaactggcttttactttacactgcggact

SEQ ID NO: 87695 - DNA, 2257 bp, Homo sapiens
gagatgaggagttctccagaactcgggtggcggggcgctcccgggctctggcgcggggaaatggggctttggcagtgggggcggggcttaagggtggggagaggccggggagcctggaggcggagcttggggagctcgccccacgcggggcggggctccggcggcagcgggatctgcagttcggactccgcgcgccacagtcgctgcagttcgctccactctggtggccccgccgccctgcggggatcccgggggtcggcgggctgctcggacttggcgcggggccggcccggcctctctcttcctcggtggggcctagacggtcggggcaccgggaacatggagccctctccagccgctgggggcttggagaccactcgcctggtgagcccccgggaccgcggtggcgccggaggcagcctgcgtttgaagagtctcttcacagagccctcagagcccctccctgaggagtccaaacctgtggagatgcccttccaccactgccacagggacccccttccgccgccgggccttacccctgagaggctgcatgcacggaggcagctatatgctgcctgtgccgtttgctttgtcttcatggctggggaggtggtcggcgggtatctggcacacagcctggccatcatgaccgatgcagcccacttgctggcggatgtgggcagcatgatgggcagcctcttctccctctggctctccacccgtccagccacccgcaccatgacctttggctggcaccgttcagagactctgggggctttggcctctgtggtctccctctggatggtcactggcatcctcctgtacctggccttcgtccgcctgctgcacagcgactaccacatcgaggggggtgccatgctgctgaccgccagcatcgcagtctgtgccaacctgttaatggcctttgtgctgcaccaggctgggcccccccacagccacgggtctaggggagcagagtatgcaccgctggaggaggggcctgaacagcccctgcccctggggaacaccagcgtccgggcggcatttgtgcacgtgctgggggacctcctgcagagctttggggtactggctgcctccatcctcatctacttcaagcctcaatacaaggcagccgaccccatcagcaccttcctcttctccatctgtgcccttggatccaccgctcccaccctccgagacgttcttcgaatcctcatggaaggtaccccccgcaatgtggggttcgaacctgtgcgggatacgctgttgtcggtgccaggagtccgggcaacccatgagctgcacctgtgggcccttacgctcacttaccatgttgcctctgcacacctggccatcgactccaccgctgaccctgaagccgtcctggctgaagcctcatcccggctctactcccggtttggattctccagctgcaccctgcaggtcgagcagtatcagccggagatggcccagtgcctgcgctgccaggaacccccccaagcctgagccatggccctgccctcaccccactgccaggccgaggctcagccccagactctcagcatctgctgccctgatcacagagacgggaccgagccaggtccataccccttccctctctcccctccctaccacctgccagtttccccagcctcagccccagccccagccccagtgggcaagaccaaagtgtggcggggagtggggtgggagtcaggggaatagatgtgactagttcaggggcggggactcccaggcctcagtgtggcagggtgtgttgaaggcctgtggtgccatctccccatggttcatgtggagccacgaacatcctttccctgcagtccatttgtctgtgtggcaggctggctggctgggggcatctgcctgtctatgtgctgttggtgtgcctatgcctgggggaggtcagtaggggccccctccccacatggccctcgctctgtctatgcaggggccccaaagcccgcactttgtccgtgtgtcttagccctgtggttttgtctgtgtgtgtgtgtgtgtgtgtgtgtgtgtgtgtgtgtgttcttggtgctgtggcctgtgtgtctctgtgcctatgtggctgtgctatggtttctatgagtctgctccatccatgtgtctgtttgggggtctatctctccatccctctgttggtgctgtgcccttggctatccctgaaagagggaggactccgctgcagctccaccaataaacttgtgtctcactgcaaaaaaaaaaa

SEQ ID NO: 87696 - DNA, 1933 bp, Homo sapiens
ggcctggggaaggagatggtctgatgaggccagcactggggactaaggacgtggagtgagcaggccagcctgtgggccaggcccaggttgaaccatgttgcttgcctcagtctcttcacagagccctcagagcccctccctgaggagtccaaacctgtggagatgcccttccaccactgccacagggacccccttccgccgccgggccttacccctgagaggctgcatgcacggaggcagctatatgctgcctgtgccgtttgctttgtcttcatggctggggaggtggtcggcgggtatctggcacacagcctggccatcatgaccgatgcagcccacttgctggcggatgtgggcagcatgatgggcagcctcttctccctctggctctccacccgtccagccacccgcaccatgacctttggctggcaccgttcagagactctgggggctttggcctctgtggtctccctctggatggtcactggcatcctcctgtacctggccttcgtccgcctgctgcacagcgactaccacatcgaggggggtgccatgctgctgaccgccagcatcgcagtctgtgccaacctgttaatggcctttgtgctgcaccaggctgggcccccccacagccacgggtctaggggagcagagtatgcaccgctggaggaggggcctgaacagcccctgcccctggggaacaccagcgtccgggcggcatttgtgcacgtgctgggggacctcctgcagagctttggggtactggctgcctccatcctcatctacttcaagcctcaatacaaggcagccgaccccatcagcaccttcctcttctccatctgtgcccttggatccaccgctcccaccctccgagacgttcttcgaatcctcatggaaggtaccccccgcaatgtggggttcgaacctgtgcgggatacgctgttgtcggtgccaggagtccgggcaacccatgagctgcacctgtgggcccttacgctcacttaccatgttgcctctgcacacctggccatcgactccaccgctgaccctgaagccgtcctggctgaagcctcatcccggctctactcccggtttggattctccagctgcaccctgcaggtcgagcagtatcagccggagatggcccagtgcctgcgctgccaggaacccccccaagcctgagccatggccctgccctcaccccactgccaggccgaggctcagccccagactctcagcatctgctgccctgatcacagagacgggaccgagccaggtccataccccttccctctctcccctccctaccacctgccagtttccccagcctcagccccagccccagccccagtgggcaagaccaaagtgtggcggggagtggggtgggagtcaggggaatagatgtgactagttcaggggcggggactcccaggcctcagtgtggcagggtgtgttgaaggcctgtggtgccatctccccatggttcatgtggagccacgaacatcctttccctgcagtccatttgtctgtgtggcaggctggctggctgggggcatctgcctgtctatgtgctgttggtgtgcctatgcctgggggaggtcagtaggggccccctccccacatggccctcgctctgtctatgcaggggccccaaagcccgcactttgtccgtgtgtcttagccctgtggttttgtctgtgtgtgtgtgtgtgtgtgtgtgtgtgtgtgtgtgtgttcttggtgctgtggcctgtgtgtctctgtgcctatgtggctgtgctatggtttctatgagtctgctccatccatgtgtctgtttgggggtctatctctccatccctctgttggtgctgtgcccttggctatccctgaaagagggaggactccgctgcagctccaccaataaacttgtgtctcactgcaaaaaaaaaaa

SEQ ID NO: 87697 - DNA, 2103 bp, Homo sapiens
gagatgaggagttctccagaactcgggtggcggggcgctcccgggctctggcgcggggaaatggggctttggcagtgggggcggggcttaagggtggggagaggccggggagcctggaggcggagcttggggagctcgccccacgcggggcggggctccggcggcagcgggatctgcagttcggactccgcgcgccacagtcgctgcagttcgctccactctggtggccccgccgccctgcggggatcccgggggtcggcgggctgctcggacttggcgcggggccggcccggcctctctcttcctcggtggggcctagacggtcggggcaccgggaacatggagccctctccagccgctgggggcttggagaccactcgcctggtgagcccccgggaccgcggtggcgccggaggcagcctgcgtttgaagagtctcttcacagagccctcagagcccctccctgaggagtccaaacctgtggagatgcccttccaccactgccacagggacccccttccgccgccgggccttacccctgagaggctgcatgcacggaggcagctatatgctgcctgtgccgtttgctttgtcttcatggctggggaggtggtcggcgggtatctggcacacagcctggccatcatgaccgatgcagcccacttgctggcggatgtgggcagcatgatgggcagcctcttctccctctggctctccacccgtccagccacccgcaccatgacctttggctggcaccgttcagaatggcctttgtgctgcaccaggctgggcccccccacagccacgggtctaggggagcagagtatgcaccgctggaggaggggcctgaacagcccctgcccctggggaacaccagcgtccgggcggcatttgtgcacgtgctgggggacctcctgcagagctttggggtactggctgcctccatcctcatctacttcaagcctcaatacaaggcagccgaccccatcagcaccttcctcttctccatctgtgcccttggatccaccgctcccaccctccgagacgttcttcgaatcctcatggaaggtaccccccgcaatgtggggttcgaacctgtgcgggatacgctgttgtcggtgccaggagtccgggcaacccatgagctgcacctgtgggcccttacgctcacttaccatgttgcctctgcacacctggccatcgactccaccgctgaccctgaagccgtcctggctgaagcctcatcccggctctactcccggtttggattctccagctgcaccctgcaggtcgagcagtatcagccggagatggcccagtgcctgcgctgccaggaacccccccaagcctgagccatggccctgccctcaccccactgccaggccgaggctcagccccagactctcagcatctgctgccctgatcacagagacgggaccgagccaggtccataccccttccctctctcccctccctaccacctgccagtttccccagcctcagccccagccccagccccagtgggcaagaccaaagtgtggcggggagtggggtgggagtcaggggaatagatgtgactagttcaggggcggggactcccaggcctcagtgtggcagggtgtgttgaaggcctgtggtgccatctccccatggttcatgtggagccacgaacatcctttccctgcagtccatttgtctgtgtggcaggctggctggctgggggcatctgcctgtctatgtgctgttggtgtgcctatgcctgggggaggtcagtaggggccccctccccacatggccctcgctctgtctatgcaggggccccaaagcccgcactttgtccgtgtgtcttagccctgtggttttgtctgtgtgtgtgtgtgtgtgtgtgtgtgtgtgtgtgtgtgttcttggtgctgtggcctgtgtgtctctgtgcctatgtggctgtgctatggtttctatgagtctgctccatccatgtgtctgtttgggggtctatctctccatccctctgttggtgctgtgcccttggctatccctgaaagagggaggactccgctgcagctccaccaataaacttgtgtctcactgcaaaaaaaaaaa

SEQ ID NO: 87698 - DNA, 381 bp, Homo sapiens
gttttctttctcacctgggtatccccagagcttagcacaggatttggcactttgtagtcactctgtaaatatttgttgaccaactgctaatatttggtatatgtgatcagaaatctgaggtttgagggagtatgaaaaactgaaaccaaggatgactagtttaaaatagcaaattgagattaggggagaaggagtaaaagagaagggaagaaagaaaatgggaatagagaaagaatcaagttagataagaggatatgggcaagacttcagaatgtgcaaggggattggctcaataggatgtattatgctaagatggaactctctagttatattattatatttcataatattctgtttaatactgtagttagcaatgggcag

SEQ ID NO: 87699 - DNA, 413 bp, Homo sapiens
tgtaacattgcacaagtgacatagtattgccaagcctcattttcctaccaagaatgggagagattacctctaatccatagagttgtgatgagaataagaaggaaataatttactcttactgcttagtatagtttttggtacattatttgttctcaaaaaaataccagctgttatgattcaatttaatacttttatttatgctctggttttgtgaggtgtattgggacagcatcctgacaaggctttataatgtgcagtgaacatttcaaattcagaagtggaaaattgagatgggatttatcaggttgcctatgcagttgggacaatgttttaaattgtatattagacagagttagtgactttctgaatggagaatagggggattatgtaagaaagtagggattgtcacacat

SEQ ID NO: 87700 - DNA, 142 bp, Homo sapiens
tgctgggattacaggcatgagccaccgcacctggccgacgaattattaatgtctctgaaatagctttggaggccactctctttctagaagggttccggggcaggggaggatgtggcttcctgaggagctctcagtccttctc

SEQ ID NO: 87701 - DNA, 574 bp, Homo sapiens
gcaccatgcctagggccgccactttccagtgctgcagccagagggaaaggcgtccaccaaaggctgctcgggaagggtcaacacacttgagcagccttagctagactgaccagggagaaagagagaagactcagaagccagaatggtgaaagaacgagggcactttgctaagcagacgccacggacgactgcacagcagcacgccagataactcagaagaagcaagcacgcggctgtgcacgcttccgaaatgcactccagaagaaaatctcagtacatctataggaagtgaagaggctgagttagtcccttagaaacgtcccagtggccgggccgggtgtggtggctcacgcctgtaatcccaacacttcaggtggccgaggtgggcggatctgagtccaggagtttgagaccagcctgggcaacatagcaagaccccatctatataaaacattaaaaagggccaggcgcggtggctcacgcctgtaatcccagcactttgggaggccgaggcgggcagatcacttgaggtcaggagttcgagaccagcctggccaacacaatgaaaccccga

SEQ ID NO: 87702 - DNA, 354 bp, Homo sapiens
ccccgggattgtggggaagggcctcacgctctgggacccccaggattgtggggaagagcctcacgctctgggacccccgggattgtggggaagagcctcacgctctgggacccccgggattgtggggaagggcctcacgctctggacccccctggggtttacgtggtctgtgccgcccacacttagtgagtccagcccattcttggaacaaagtacaatatatcttacagaagaaaatattttatctttttctgaaaatataatgattgagtcctaattaaacttcaagcatggttgaccagaaattgaatgttttaaagaaaacctaggccttatagagaaggattgctttcc

SEQ ID NO: 87703 - DNA, 587 bp, Homo sapiens
gcctcccaaagtactgagattacaggcatgagctaccatgccctgatgagaaacatttcttaatgaaatggacagccgtatagtgaataggggatgaagagcaagaatttctgtcactccagtcctcagctttttttttttttttttttttttttaaattcaagagtttttggggaaacaggtgttgttgggtcacatggaaaatttcttaagagggggattcccgaaatttgggggcccccttcccccggagcagggttacaactttaatacccagattgttgtatgtctttattactccctaaccccaccatcacaacactttttccccaaagtgtgtggaaaaggctcaatgtggataccacactactttcttgcccttatggagaatcccacaagatatcgtggtaggaactgggataacataacaacagatgtaggtatactgatcactgcagcaagtcatcaaccactcctatcactggggaacggcaagtgtcgaggtccaccgcgacgcggccccccggggtggaaaacatctgtgaaaaacgacttaagtggggcaggaggcgcaggtaaccaagacg

SEQ ID NO: 87704 - DNA, 672 bp, Homo sapiens
ctgatatttagatgaactttatagaatgcaaattataaaactgaatctgacccaagttttatagatccttttaattcaaaggagagaagcatcttttcttcattcgtgcagtaaacctttatgaagcccttgcaatgggtaggaattattctgagagctgtaggggatggatggccaaggcatagtgcctagtacataataggagtgaaacagatatttcaataaataaatcaatgaatgatgggacaactttggcgaccaaaaaagttttagacattgggtttggtggtaatgcatagaaaaaaaaaaatagaaatctattttacttgaaagcatctccctgtcattccatacagttttacttctcacatgtttacctctattcaaaggggtagtggagtggaaggttgcagggagtagggagaaaattgctcagatagaaaacaaaagagcagccgggcgcagtggctcacgcctgtaatcccagcactttgtgccgctgaggtgggcagatcacctaaggtcaggagttcgagaccagcctggccaatatggcgaaaccccatctctactaaaagtaaaaaaaaaaaaaaaaaaaatagccggtcatggtgttgtgtgcctataatcccagctactcgggacgctgaattaggagaatcgcttgaatcc

SEQ ID NO: 87705 - DNA, 403 bp, Homo sapiens
tggggtgcagtggtgcaatcacagatcactgcagcctcaacttcccaggctccagtgatcctcccacctcagcctcccaagtagctgggactataggtatgtgtcaccacacccagctaattttttaattttttatagagatggggtttcgccacattgtctaagctggtcttggactcttgggctcaagcaatccacctacctcggcctcccaaagtactgggattataggcatgagtcactgtgcccagcctgatttttttctattttatgtttgtttatttatttatttactgagacaagagtttcactcttgtcacccaggctggagtgcagtggcgcgatctcagatcactgcaacctctgtctcctgggttcaagtgattctcctgcctcagcctcc

SEQ ID NO: 87706 - DNA, 149 bp, Homo sapiens
  misc_feature (3)..(3): n is a, c, g, or t
  misc_feature (148)..(148): n is a, c, g, or t
acngccagtctgggatagttgtagaaatacaggcaggtagaggcctggcattgctcgctagctacagggcccaggccatgtggccctgtgggcagaccatggcagtgtttgagctgagcatcagagcacactgcacacagaggccgcnt

SEQ ID NO: 87707 - DNA, 385 bp, Homo sapiens
gtggtttcgtgtttgggagcttgaactagactttagaaggcctaggacccccttccatgtgtgcctgagcagtatattggcagaccattcacattttccatctcattatctcacatcgagaaagcagacttaaatcactcttcacacactcattacagactgagggactatacttacttgagcaggctgctttgggattttctttagtgacttttggttatatgcttttgtaatcaactgagcgtctttctttaaggctatttttcaatacgaaattctttaaaatgaaatctcttaaaatctgagggaaaggtatagacataaaaacaattcctatcatatacagataaataagaacttaataaaaatttattgctattgtttc

SEQ ID NO: 87708 - DNA, 434 bp, Homo sapiens
tttgaggcatttttatcaattaaaatgtactcatcagattacttgataaatatatattgagcatcagcaagtgccagtgcttgtgtggcctctgaagatgggattctgcctcatgaagtctagagggaaggcactaatatgtgtaaaattacaatgttgataagagctgttagaggtataatggtgctataaaattttaaaataggaggattttgacttattcagggaggaagggaaggcttctctgaagaatcgatgattctgttgagtgtgatatctgaaaggaagaatgaaagtagacaatgaaagagaccagccatggggtgaggaaaggagagcatccgggatcagattgcttcagaagcccaggcaaaatatgatggtgtttagagtaatggatttgtagtagagatgaaaagaagagagcttaagtt

SEQ ID NO: 87709 - DNA, 200 bp, Homo sapiens
atccgcccaccttagccttgttgttgttgctgtgattacaggtatgagccaccacgcctgggctgaagcagtggttttcaaggcactgattatcaggcagtagagttatctatgagtgatgggaaataaacaaggtgaaccaatcaacttctgccttgagcgtttccaggccatggagcagggaagaagaaccgaggcag

SEQ ID NO: 87710 - DNA, 315 bp, Homo sapiens
gatcttcattccaaattttactgcatggaaatgactaataatgtgcataaaaagttaactataaggatgctcactgcagggtggcttatattaacacaaattcacaaacaactccactgttccagcacagcagtgtttggtaaatcatgacatgtttctatgctcaattactatccaacttttcaaaattaggttggagatatgtaattaccaatatgaaaataaatttcctatatactatttagtaaaaataattcataaattttcattttttcaaacacttcatgaatttattccaaaatacaaatgttatct

SEQ ID NO: 87711 - DNA, 569 bp, Homo sapiens
tggtttagacaaaggttcttggaggtctcactcccatgccctctcatgggccgagggtccctggacatttaggagctagccagagctctgagcagtggggtccttgtcttgagggcggggccaggcactaatgctgatttcctggctgtggcagggagatggcagaggcaggagcatgtctcctctgagcaagggagtgaagtcattgtaggctgaagggccggataaatgagctaggggcttggtccaagacccagaaagcaagagagtgaagggatatccccaggaggaggcagctgagcactcccagattttggggggtcttccagatcagcttcccccttccccctagtcattagaagggagagccccaatgaagactagcttggttgtcacatctgtccaccctcctgccaagggcatatgtggttccacatgagtcaccaggagcccctcacgggtgtcctaccaaagagctcaagaaaggtgaggttaaactggccctggccacagaggctggagggccggggtgcctggaccccagggttggccagcaggggtcgggggag

SEQ ID NO: 87712 - DNA, 136 bp, Homo sapiens
gacagggtcagctgtggccagctgacctctcagagggagtttctttcaagacttgtaagcctggtgtgcccagagcccttgctctgctggggtggcccctggtgtgttgagatcagttctaatccatcccagatgc

SEQ ID NO: 87713 - DNA, 446 bp, Homo sapiens
ttcaaatcagttccaagcacttcctcagcaagtggcccggcagcaattaccctgctgctgaagacacttcgcatcacaggcctcagtttttgagacaagcaagcaaggctgtaagaaatgataacatatgtttcagcctccattcaccagcgatttatacccccataagaagggtgaatcaattttcatgcaaattcaacaggcatattcaacaacgttgctctcttctctaattcacacaaactcagcattcatcggctgcattacttgcctcaaatgggcactcacagttgctaaatgattcgggcgggggtggagttgctctgtgtcaaaaaggggcaaagaacaaggaaaggacatgaatccatcagggcaatgagagctgaactgattcactgagacaaaatagtgaggttttgaaaagccagtgcaaaaggagatggctt

SEQ ID NO: 87714 - DNA, 477 bp, Homo sapiens
ctgatactttctttctcttataattgtgactgacagttgattaacaacttgaaaaaaaagaaaagcacaagatttttacctcataccatataccaaagtagagtctagatgtagtaaataataaaataataattcaatgagaaaaaaatttggtgaaaaacttagatttaagaattatacaagaggccgggtgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaa

SEQ ID NO: 87715 - DNA, 1615 bp, Homo sapiens
ggctggcatggagcgggtgccccctgagcctggagagaagcgtgtggcctgttcccggctgccgtgctcctccccagctctgtctgccacgtacagggcccttgaggcacttagagggtgactctggcaggcatggtctgtctgggagccccaggtgagcccgggacggggaggcaggtgtgagtgcctcctgggcttccccagcaggctccgccccctccgtggccacccatgtaatccgctgaccgcctgtctctggttcagcttccaggccgagcggcccgcgttaaacgtcgtcatcttccctctgctccacgagggcctgaccgacgtcatccgggacgtccccctggtgcacctggatgagatcaccttatttaagagcagagtggccgaggaaccgccgaacctgtggtggtgagaggcggagccgccgcccatcggtctcagtcacctcgagaagctgcaggagcctgggacgccagggacccttggtttgtcacaagaggaagggggcctctctcccggccagccacgccccacctggctcctggggctcccggcgtctccacggctctctcatggggactgttgctctgtgaagtttgggtcgaggggatgcgttctgggtgacatgagggggctcgggggacggtcgatgtggggggctggctgaaccaggctgacccttggggcctggctggggggtttgtatactgagccgcaatccctgggggccctgtccacgggcctggagggcccgaaccccctgccacttccgaccgggaagcgtgtcccttggctgttgtgtttgtggtcacctgccaccggggccccgtggatgggcggccacatgctgtccccctgaagtccagtcggccgggctggtcaccgtgtatctgagtgtccccttgcatggtcaagtgtgacatggggaagggcctgccagtttagtggctgcagacttgggactctccatcccattaggacacacttgagcccactcatgtctctggggcttttctagccagatgatgcctgtggccccagagaggtcccctgaggttgggactgctggttggagcctctcctgtgacttttcagcccaaccagcagggcccgtttctaacgagagaggcctcctccccctcccacccaccccacggccttcagcttccctgggaaggtccatgcgcgttcctggggaaatcgatacacattcggctttgttagaataacgcgaaacattaaaacccagaaaggattcttaaggctggagtagcaatcacatgaccccatttcaaatgacttcatttaagactttaaaaatactcagctgggcgcgatggctcacgcctgtaatcccggcactttgggaggctgaggtgggtggatcacgaggtcaggagttcaagaccagcctggccaacatggtgaaaccccatctctactaaaaatacaaaaattagctgggcgtggtggcgggcgcctgtaatcctagctactcaggaggctgaggcaggagaatcgtttgaacctgggaggcggaggttgcagtgagccgagatcacaccattgcactccagcctggacaacagggtgagactccgcctca

SEQ ID NO: 87716 - DNA, 617 bp, Homo sapiens
ggttgagcggtggacgcgccggcttcgagcatccctagccgggcaggtgggaggcacggggttgcggatcccgcggccgcggttcggacccgccggcgacatggccagctccggagaggtactgtccgcgactgtctccgctctgcttctgcctcggcggcctcggtctccctgggttcttccatcccgacccgggttcccttgcatcctttctatcccgacccctaccccgccccgtccttcccatcctgaccctggccttgcccctgctcccgtccttcccgcatcctgtccccaagactcctaccctgtctcggaaggcacaagctgtctcccccttcgctcgtgcattcctgatcgccagagttgtccccgtctctccgtcccctgagggtccaggctcctccgagacccctttctcagtgccccggttccttggctgggcccctgcagccctgggacattccccctccgtgcccacgtcccactccatcttctatctctggatgctcagtttcagccccagcccacttctccctggagcctgcttgctgaatgacgtggggggtgggtgatggaggaaaagccatttcacctgagggacttacgacgtaccc

SEQ ID NO: 87717 - DNA, 3268 bp, Homo sapiens
ggttgagcggtggacgcgccggcttcgagcatccctagccgggcaggtgggaggcacggggttgcggatcccgcggccgcggttcggacccgccggcgacatggccagctccggagaggacatatccaatgatgatgatgacatgcaccctgcagcagccgggatggcagacggggtccacctcctagggttctctgatgagatcctccttcacatcctgagtcacgtccccagcacagatctgattctgaacgtccggcgtacctgtcggaagcttgcagccctgtgccttgacaagagcctcatccacaccgtgttgctgcaaaaggactatcaggcgagcgaggacaaagtgaggcagctggtgaaggagatcggccgggagatccagcagctgagcatggctggctgctactggctgcctggctccaccgtggaacacgtggcccgctgccgcagcctggtgaaggtgaacctctcgggctgccacctcacttccctgcgcctctccaagatgctctcggccctgcagcacctgcgctcgctggccatcgacgtgagccccggcttcgacgccagccagctgagcagcgagtgcaaggccaccctgagccgcgtgcgggagctcaagcagacgctgttcactccctcctacggcgtggtgccctgctgcaccagcctagagaagctgctgctctacttcgagattctggaccgcacgcgcgagggcgccatcctctcgggccagcttatggtgggccagagcaacgtgccgcactaccagaacctgcgggtcttctatgcgcgcctggcccccggctacatcaaccaggaggtggtgcggctctacctggctgtgcttagcgaccgcactcctcagaacctccacgccttcctcatctccgtccctggcagcttcgcggagagcggcgccaccaagaacctcctggactccatggcgcgcaatgtcgtgctggatgccctgcagctgcccaagtcctggctgaacggctcttccctcctgcagcacatgaaattcaacaacccgttctacttcagtttcagccgctgtaccctgtcaggcggccatctgatccagcaggtcatcaacggcgggaaggacctgcggagcctggccagcttgaacctcagcggctgcgtccactgcctgtccccagactcgctgtctgtcgctgactccgcgccgcgcgccgaccgcgcgcccgcccagccggccatgcacgcagtgccgcgcggctttggcaagaaagtgcgtgtgggcgtgcagtcctgtcccagccccttctcgggccaggcgtgcccccagccctcctccgtgttctggtctctgctgaagaacctgcccttcctggaacacctcgagctgattgggtccaacttctcctccgccatgccccgcaacgagcccgccatccgcaactcgctcccaccctgcagccgcgcacagagtgtcggggactcggaggtggccgccatcggccagctggccttcctgcggcacctgacgctcgcacagctgcccagcgtccttacgggctccgggctggtcaatatcggcctgcagtgccagcagttgcggtccctgtcgctggccaacctgggcatgatggggaaggtggtgtacatgcccgcgctctcagacatgttgaagcactgcaagcggctgagggacctcaggctggagcagccctacttcagcgccaacgcccagttcttccaggcgctgagccagtgcccctcgctgcagcgcctgtgcctggtctctcgcagcggcaccctccagcccgatgccgtgctggccttcatggctcgctgcctgcaggttgtcatgtgccacctgttcaccggggagtccctcgccacctgcaagagcctgcagcagtcgcttctccgcagcttccaggccgagcggcccgcgttaaacgtcgtcatcttccctctgctccacgagggcctgaccgacgtcatccgggacgtccccctggtgcacctggatgagatcaccttatttaagagcagagtggccgaggaaccgccgaacctgtggtggtgagaggcggagccgccgcccatcggtctcagtcacctcgagaagctgcaggagcctgggacgccagggacccttggtttgtcacaagaggaagggggcctctctcccggccagccacgccccacctggctcctggggctcccggcgtctccacggctctctcatggggactgttgctctgtgaagtttgggtcgaggggatgcgttctgggtgacatgagggggctcgggggacggtcgatgtggggggctggctgaaccaggctgacccttggggcctggctggggggtttgtatactgagccgcaatccctgggggccctgtccacgggcctggagggcccgaaccccctgccacttccgaccgggaagcgtgtcccttggctgttgtgtttgtggtcacctgccaccggggccccgtggatgggcggccacatgctgtccccctgaagtccagtcggccgggctggtcaccgtgtatctgagtgtccccttgcatggtcaagtgtgacatggggaagggcctgccagtttagtggctgcagacttgggactctccatcccattaggacacacttgagcccactcatgtctctggggcttttctagccagatgatgcctgtggccccagagaggtcccctgaggttgggactgctggttggagcctctcctgtgacttttcagcccaaccagcagggcccgtttctaacgagagaggcctcctccccctcccacccaccccacggccttcagcttccctgggaaggtccatgcgcgttcctggggaaatcgatacacattcggctttgttagaataacgcgaaacattaaaacccagaaaggattcttaaggctggagtagcaatcacatgaccccatttcaaatgacttcatttaagactttaaaaatactcagctgggcgcgatggctcacgcctgtaatcccggcactttgggaggctgaggtgggtggatcacgaggtcaggagttcaagaccagcctggccaacatggtgaaaccccatctctactaaaaatacaaaaattagctgggcgtggtggcgggcgcctgtaatcctagctactcaggaggctgaggcaggagaatcgtttgaacctgggaggcggaggttgcagtgagccgagatcacaccattgcactccagcctggacaacagggtgagactccgcctca

SEQ ID NO: 87718 - DNA, 2990 bp, Homo sapiens
ggttgagcggtggacgcgccggcttcgagcatccctagccgggcaggtgggaggcacggggttgcggatcccgcggccgcggttcggacccgccggcgacatggccagctccggagaggacatatccaatgatgatgatgacatgcaccctgcagcagccgggatggcagacggggtccacctcctagggttctctgatgagatcctccttcacatcctgagtcacgtccccagcacagatctgattctgaacgtccggcgtacctgtcggaagcttgcagccctgtgccttgacaagagcctcatccacaccgtgttgctgcaaaaggactatcaggcgagcgaggacaaagtgaggcagctggtgaaggagatcggccgggagatccagcagctgagcatggctggctgctactggctgcctggctccaccgtggaacacgtggcccgctgccgcagcctggtgaaggtgaacctctcgggctgccacctcacttccctgcgcctctccaagatgctctcggccctgcagcacctgcgctcgctggccatcgacgtgagccccggcttcgacgccagccagctgagcagcgagtgcaaggccaccctgagccgcgtgcgggagctcaagcagacgctgttcactccctcctacggcgtggtgccctgctgcaccagcctagagaagctgctgctctacttcgagattctggaccgcacgcgcgagggcgccatcctctcgggccagcttatggtgggccagagcaacgtgccgcactaccagaacctgcgggtcttctatgcgcgcctggcccccggctacatcaaccaggaggtggtgcggctctacctggctgtgcttagcgaccgcactcctcagaacctccacgccttcctcatctccgtccctggcagcttcgcggagagcggcgccaccaagaacctcctggactccatggcgcgcaatgtcgtgctggatgccctgcagctgcccaagtcctggctgaacggctcttccctcctgcagcacatgaaattcaacaacccgttctacttcagtttcagccgctgtaccctgtcaggcggccatctgatccagcaggtcatcaacggcgggaaggacctgcggagcctggccagcttgaacctcagcggctgcgtccactgcctgtccccagactcgctgtctgtcgctgactccgcgccgcgcgccgaccgcgcgcccgcccagccggccatgcacgcagtgccgcgcggctttggcaagaaagtgcgtgtgggcgtgcagtcctgtcccagccccttctcgggccaggcgtgcccccagccctcctccgtgttctggtctctgctgaagaacctgcccttcctggaacacctcgagctgattgggtccaacttctcctccgccatgccccgcaacgagcccgccatccgcaactcgctcccaccctgcagccgcgcacagagtgtcggggactcggaggtggccgccatcggccagctggccttcctgcggcacctgacgctcgcacagctgcccagcgtccttacgggctccgggctggtcaatatcggcctgcagtgccagcagttgcggtccctgtcgctggccaacctgggcatgatggggaaggtggtgtacatgcccgcgctctcagacatgttgaagcactgcaagcggctgagggacctcaggctggagcagccctacttcagcgccaacgcccagttcttccaggcgctgagccagtgcccctcgctgcagcgcctgtgcctggtctctcgcagcggcaccctccagcccgatgccgtgctggccttcatggctcgctgcctgcaggttgtcatgtgccacctgttcaccggggagtccctcgccacctgcaagagcctgcagcagtcgcttctccgcagcttccaggccgagcggcccgcgttaaacgtcgtcatcttccctctgctccacgagggcctgaccgacgtcatccgggacgtccccctggtgcacctggatgagatcaccttatttaagagcagagtggccgaggaaccgccgaacctgtggtggtgagaggcggagccgccgcccatcggtctcagtcacctcgagaagctgcaggagcctgggacgccagggacccttggtttgtcacaagaggaagggggcctctctcccggccagccacgccccacctggctcctggggctcccggcgtctccacggctctctcatggggactgttgctctgtgaagtttgggtcgaggggatgcgttctgggtgacatgagggggctcgggggacggtcgatgtggggggctggctgaaccaggctgacccttggggcctggctggggggtttgtatactgagccgcaatccctgggggccctgtccacgggcctggagggcccgaaccccctgccacttccgaccgggaagcgtgtcccttggctgttgtgtttgtggtcacctgccaccggggccccgtggatgggcggccacatgctgtccccctgaagtccagtcggccgggctggtcaccgtgtatctgagtgtccccttgcatggtcaagtgtgacatggggaagggcctgccagtttagtggctgcagacttgggactctccatcccattaggacacacttgagcccactcatgtctctggggcttttctagccagatgatgcctgtggccccagagaggtcccctgaggttgggactgctggttggagcctctcctgtgacttttcagcccaaccagcagggcccgtttctaacgagagaggcctcctccccctcccacccaccccacggccttcagcttccctgggaaggtccatgcgcgttcctggggaaatcgatacacattcggctttgttagaataacgcgaaacattaaaacccagaaaggattcttaaggctggccttgaactcctgacctcaagtgattctcctgcctcggcctcccaaagtgctaggataac

SEQ ID NO: 87719 - DNA, 1152 bp, Homo sapiens
gcgattctcctgccttggcttcctgagtagctgggattacaggcctgcgccaccagcatgtattttgtattttagtaaagatagggtttcaccatgttggtcaggctggtctcgaactcccgacctcaggtgatccgcctgcctcggcctcccaaagtgctgggattacaggcatgagccaccgcacccagcctgcaaccatctttaactctggatttttcacatctctgcccgttgtttggatctagaagcagtgcttacttgggcagttgtgggtaaaggcggtagattgaacagagaacctttccttctccctctccctcgccacctgctgtcaggccctttctggaaggcccacatagtctggcccctcttcccttagctagctagcatctccgcttcccctcgtgacagggcatcctggagtttgatgctctgctgctgcgcaggaagtcaggtgagcacctagaattgaacacaaattaggaggaggcgattcctggagagagctggagcttggtaggcgatgtggggagtgacgcatttcaagacctctcaggaggacgggctgactgctggagtgatcagggctcctgagagaggcgtgcgcccggccaagggggcagcaggacatgaacgccctgagtgttcgtgtccctgcaggtggggagaggtgacaggaaggaggccccagctgttcacagagttgcgagaagagccatcagccaggacgtctcgagccactgggcgccgacaaccctgcttgccagactctggggtagtctgttgtccttgcggtcggccgctggctgtctcaggaataatcctggttggggtttccccctctctggttgtaaaaacaacttgtgtttatagagtactttttaaaaatttagactatgcatcaatcttttttcttgtttgtttgtttgagacagagtctcactctgtcgtccaggctggagtgcagtggcgggatctcagctcactgcaacctctgctttctgggttgcaacctcagcctcctgagcagctggagaatgaactggagatagggttctcatattgttttgtaatctgatttttaaaaatgtaacactacaccgtggagtcctcttgtgtcagtaaataaagccctaagtgattattctc

SEQ ID NO: 87720 - DNA, 1806 bp, Homo sapiens
ggttgagcggtggacgcgccggcttcgagcatccctagccgggcaggtgggaggcacggggttgcggatcccgcggccgcggttcggacccgccggcgacatggccagctccggagaggacatatccaatgatgatgatgacatgcaccctgcagcagccgggatggcagacggggtccacctcctagggttctctgatgagatcctccttcacatcctgagtcacgtccccagcacagatctgattctgaacgtccggcgtacctgtcggaagcttgcagccctgtgccttgacaagagcctcatccacaccgtgttgctgcaaaaggactatcaggcgagcgaggacaaagtgaggcagctggtgaaggagatcggccgggagatccagcagctgagcatggctggctgctactggctgcctggctccaccgtggaacacgtggcccgctgccgcagcctggtgaaggtgaacctctcgggctgccacctcacttccctgcgcctctccaagatgctctcggccctgcagcacctgcgctcgctggccatcgacgtgagccccggcttcgacgccagccagctgagcagcgagtgcaaggccaccctgagccgcgtgcgggagctcaagcagacgctgttcactccctcctacggcgtggtgccctgctgcaccagcctagagaagctgctgctctacttcgagattctggaccgcacgcgcgagggcgccatcctctcgggccagcttatggtgggccagagcaacgtgccgcactaccagaacctgcgggtcttctatgcgcgcctggcccccggctacatcaaccaggaggtggtgcggctctacctggctgtgcttagcgaccgcactcctcagaacctccacgccttcctcatctccgtccctggcagcttcgcggagagcggcgccaccaagaacctcctggactccatggcgcgcaatgtcgtgctggatgccctgcagctgcccaagtcctggctgaacggctcttccctcctgcagcacatgaaattcaacaacccgttctacttcagtttcagccgctgtaccctgtcaggcggccatctgatccagcaggtcatcaacggcgggaaggacctgcggagcctggccagcttgaacctcagcggctgcgtccactgcctgtccccagactcgctgtctgtcgctgactccgcgccgcgcgccgaccgcgcgcccgcccagccggccatgcacgcagtgccgcgcggctttggcaagaaagtgcgtgtgggcgtgcagtcctgtcccagccccttctcgggccaggcgtgcccccagccctcctccgtgttctggtctctgctgaagaacctgccttccctgggaaggtccatgcgcgttcctggggaaatcgatacacattcggctttgttagaataacgcgaaacattaaaacccagaaaggattcttaaggctggagtagcaatcacatgaccccatttcaaatgacttcatttaagactttaaaaatactcagctgggcgcgatggctcacgcctgtaatcccggcactttgggaggctgaggtgggtggatcacgaggtcaggagttcaagaccagcctggccaacatggtgaaaccccatctctactaaaaatacaaaaattagctgggcgtggtggcgggcgcctgtaatcctagctactcaggaggctgaggcaggagaatcgtttgaacctgggaggcggaggttgcagtgagccgagatcacaccattgcactccagcctggacaacagggtgagactccgcctca

SEQ ID NO: 87721 - DNA, 2406 bp, Homo sapiens
ggttgagcggtggacgcgccggcttcgagcatccctagccgggcaggtgggaggcacggggttgcggatcccgcggccgcggttcggacccgccggcgacatggccagctccggagaggacatatccaatgatgatgatgacatgcaccctgcagcagccgggatggcagacggggtccacctcctagggttctctgatgagatcctccttcacatcctgagtcacgtccccagcacagatctgattctgaacgtccggcgtacctgtcggaagcttgcagccctgtgccttgacaagagcctcatccacaccgtgttgctgcaaaaggactatcaggcgagcgaggacaaagtgaggcagctggtgaaggagatcggccgggagatccagcagctgagcatggctggctgctactggctgcctggctccaccgtggaacacgtggcccgctgccgcagcctggtgaaggtgaacctctcgggctgccacctcacttccctgcgcctctccaagatgctctcggccctgcagcacctgcgctcgctggccatcgacgtgagccccggcttcgacgccagccagctgagcagcgagtgcaaggccaccctgagccgcgtgcgggagctcaagcagacgctgttcactccctcctacggcgtggtgccctgctgcaccagcctagagaagctgctgctctacttcgagattctggaccgcacgcgcgagggcgccatcctctcgggccagcttatggtgggccagagcaacgtgccgcactaccagaacctgcgggtcttctatgcgcgcctggcccccggctacatcaaccaggaggtggtgcggctctacctggctgtgcttagcgaccgcactcctcagaacctccacgccttcctcatctccgtccctggcagcttcgcggagagcggcgccaccaagaacctcctggactccatggcgcgcaatgtcgtgctggatgccctgcagctgcccaagtcctggctgaacggctcttccctcctgcagcacatgaaattcaacaacccgttctacttcagtttcagccgctgtaccctgtcaggcggccatctgatccagcaggtcatcaacggcgggaaggacctgcggagcctggccagcttgaacctcagcggctgcgtccactgcctgtccccagactcgctgtctgtcgctgactccgcgccgcgcgccgaccgcgcgcccgcccagccggccatgcacgcagtgccgcgcggctttggcaagaaagtgcgtgtgggcgtgcagtcctgtcccagccccttctcgggccaggcgtgcccccagccctcctccgtgttctggtctctgctgaagaacctgcccttcctggaacacctcgagctgattgggtccaacttctcctccgccatgccccgcaacgagcccgccatccgcaactcgctcccaccctgcagccgcgcacagagtgtcggggactcggaggtggccgccatcggccagctggccttcctgcggcacctgacgctcgcacagctgcccagcgtccttacgggctccgggctggtcaatatcggcctgcagtgccagcagttgcggtccctgtcgctggccaacctgggcatgatggggaaggtggtgtacatgcccgcgctctcagacatgttgaagcactgcaagcggctgagggacctcaggctggagcagccctacttcagcgccaacgcccagttcttccaggcgctgagccagtgcccctcgctgcagcgcctgtgcctggtctctcgcagcggcaccctccagcccgatgccgtgctggccttcatggctcgctgcctgcaggttgtcatgtgccacctgttcaccggggagtccctcgccacctgcaagagcctgcagcagtcgcttctccgcaggtggggagaggtgacaggaaggaggccccagctgttcacagagttgcgagaagagccatcagccaggacgtctcgagccactgggcgccgacaaccctgcttgccagactctggggtagtctgttgtccttgcggtcggccgctggctgtctcaggaataatcctggttggggtttccccctctctggttgtaaaaacaacttgtgtttatagagtactttttaaaaatttagactatgcatcaatcttttttcttgtttgtttgtttgagacagagtctcactctgtcgtccaggctggagtgcagtggcgggatctcagctcactgcaacctctgctttctgggttgcaacctcagcctcctgagcagctggagaatgaactggagatagggttctcatattgttttgtaatctgatttttaaaaatgtaacactacaccgtggagtcctcttgtgtcagtaaataaagccctaagtgattattctc

SEQ ID NO: 87722 - DNA, 2180 bp, Homo sapiens
ggttgagcggtggacgcgccggcttcgagcatccctagccgggcaggtgggaggcacggggttgcggatcccgcggccgcggttcggacccgccggcgacatggccagctccggagaggacatatccaatgatgatgatgacatgcaccctgcagcagccgggatggcagacggggtccacctcctagggttctctgatgagatcctccttcacatcctgagtcacgtccccagcacagatctgattctgaacgtccggcgtacctgtcggaagcttgcagccctgtgccttgacaagagcctcatccacaccgtgttgctgcaaaaggactatcaggcgagcgaggacaaagtgaggcagctggtgaaggagatcggccgggagatccagcagctgagcatggctggctgctactggctgcctggctccaccgtggaacacgtggcccgctgccgcagcctggtgaaggtgaacctctcgggctgccacctcacttccctgcgcctctccaagatgctctcggccctgcagcacctgcgctcgctggccatcgacgtgagccccggcttcgacgccagccagctgagcagcgagtgcaaggccaccctgagccgcgtgcgggagctcaagcagacgctgttcactccctcctacggcgtggtgccctgctgcaccagcctagagaagctgctgctctacttcgagattctggaccgcacgcgcgagggcgccatcctctcgggccagcttatggtgggccagagcaacgtgccgcactaccagaacctgcgggtcttctatgcgcgcctggcccccggctacatcaaccaggaggtggtgcggctctacctggctgtgcttagcgaccgcactcctcagaacctccacgccttcctcatctccgtccctggcagcttcgcggagagcggcgccaccaagaacctcctggactccatggcgcgcaatgtcgtgctggatgccctgcagctgcccaagtcctggctgaacggctcttccctcctgcagcacatgaaattcaacaacccgttctacttcagtttcagccgctgtaccctgtcaggcggccatctgatccagcaggtcatcaacggcgggaaggacctgcggagcctggccagcttgaacctcagcggctgcgtccactgcctgtccccagactcgctgtctgtcgctgactccgcgccgcgcgccgaccgcgcgcccgcccagccggccatgcacgcagtgccgcgcggctttggcaagaaagtgcgtgtgggcgtgcagtcctgtcccagccccttctcgggccaggcgtgcccccagccctcctccgtgttctggtctctgctgaagaacctgcccttcctggaacacctcgagctgattgggtccaacttctcctccgccatgccccgcaacgagcccgccatccgcaactcgctcccaccctgcagccgcgcacagagtgtcggggactcggaggtggccgccatcggccagctggccttcctgcggcacctgacgctcgcacagctgcccagcgtccttacgggctccgggctggtcaatatcggcctgcagtgccagcagttgcggtccctgtcgctggccaacctgggcatgatggggaaggtggtgtacatgcccgcgctctcagacatgttgaagcactgcaagcggctgagggacctcaggctggagcagccctacttcagcgccaacgcccagttcttccaggcgctgagccagtgcccctcgctgcagcgcctgtgcctggtctctcgcagcggcaccctccagcccgatgccgtgctggccttcatggctcgctgcctgcaggttgtcatgtgccacctgttcaccggggagtccctcgccacctgcaagagcctgcagcagtcgcttctccgcaggtgagtgatgtgggttgcgtacagcttcaggggccgcagaaatcaccagcatcccgtgacctggtccccagccttcaccgagtgcctaccagtggtttcttggaattgacgagcaccaggcagtgacagggtgaaagcaaggggtttggtctcccacggcccagcctctgctccttgagcattccctagccacatggtaaattttctagatagttcaagctctcctctcccacaagtacaacctgccggtgggtaccgactaa

SEQ ID NO: 87723 - DNA, 815 bp, Homo sapiens
gggagctcaagcagacgctgttcactccctcctacggcgtggtgccctgctgcaccagcctagagaagctgctgctctacttcgagattctggaccgcacgcgcgagggcgccatcctctcgggccagcttatggtgggccagagcaacgtgccgcactaccagaacctgcgggtcttctatgcgcgcctggcccccggctacatcaaccaggaggtggtgcggctctacctggctgtgcttagcgaccgcactcctcagaacctccacgccttcctcatctccgtccctggcagcttcgcggagagcggcgccaccaagaacctcctggactccatggcgcgcaatgtcgtgctggatgccctgcagctgcccaagtcctggctgaacggctcttccctcctgcagcacatgaaattcaacaacccgttctacttcagtttcagccgctgtaccctgtcaggcggccatctgatccagcaggtcatcaacggcgggaaggacctgcggagcctggccagcttgaacctcagcggctgcgtccactgcctgtccccagactcgctgctccgcaaggcggaggacgacatcgacagcagcatcctggagactctggtggcgtcctgctgcaacctgcgccacctgaacctctcggccgcccaccaccacagctcggagggcctgggccgccacctctgccagctcctggcccggctgcgtcacctgcgctccctctccctgcctgtctgctctgtcgctgactccgcgccgcgcgccgaccgcgcgcccgcccagccggccatgcacgcagtgccg

SEQ ID NO: 87724 - DNA, 2648 bp, Homo sapiens
tcgcggccccgcgcgccggatcggcgtgcgtgcggctggagccttaagcgtttcccccgcccggcttcatccctgctggcggcccagcgtcgttctcctcctgcgcgaggcggccaaggcctgctggcccggagccgcgcctccacccgcgcgaggtatcgtccttggagaagatggaagcggagaggcggccggcgccgggctcgccctccgagggcctgtttgcggacgggcacctgatcttgtggacgctgtgctcggtcctgctgccggtgttcatcaccttctggtgtagcctccagcggtcgcgccggcagctgcaccgcagggacatcttccgcaagagcaagcacgggtggcgcgacacggacctgttcagccagcccacctactgctgcgtgtgcgcgcagcacattctgcagggcgccttctgcgactgctgcgggctccgcgtggacgagggctgcctcaggaaggccgacaagcgcttccagtgcaaggagattatgctcaagaatgacaccaaggtcctggacgccatgccccaccactggatccggggcaacgtgcccctgtgcagttactgtatggtttgcaagcagcagtgtggctgtcaacccaagctttgcgattacaggtgcatttggtgccagaaaacagtacatgatgagtgcatgaaaaatagtttaaagaatgaaaaatgtgattttggagaattcaaaaacctaatcattccaccaagttatttaacatccattaatcagatgcgtaaagacaaaaaaacagattatgaagtgctagcctctaagcttggaaagcagtggaccccattaataatcctggccaactctcgtagtggaactaatatgggagaaggactgttgggagaatttaggatcttgttgaatccagtccaggtttttgatgtaactaaaactcctcctatcaaagccctacaactctgtactcttctcccatattattcagctcgagtacttgtttgtggaggggatgggactgtagggtgggtcctggatgcagttgatgacatgaagattaagggacaagaaaagtacattccacaagttgcagttttgcctctgggaacaggcaacgatctatccaatacattgggttggggtacaggttatgctggagaaattccagttgcgcaggttttgcgaaatgtaatggaagcagatggaattaaactagatcgatggaaagttcaagtaacaaataaaggatactacaacttaagaaaacccaaggaattcacaatgaacaactatttttctgttggacctgatgctctcatggctctcaattttcatgctcatcgtgagaaggcaccatctctgttttctagcagaattcttaataaggcggtttacttattctatggaaccaaagattgtttagtgcaagaatgtaaagatttgaataaaaaagttgagctagaactggatggtgagcgagtagcactgcccagcttggaaggtattatagttctgaacatcggatactggggcggtggctgcagactatgggaagggatgggggacgagacttaccctctagccaggcatgacgatggtctgctggaagtcgttggagtatatgggtctttccactgtgctcagattcaagtaaaactggctaatccttttcgaataggacaggcacatacagtgaggctgattttgaagtgctccatgatgccaatgcaggtggatggggagccttgggcccaagggccctgcactgtcaccataactcacaagacacatgcaatgatgttatatttctctggagaacaaacagatgatgacatctctagtacttcggatcaagaagatataaaggcgactgaatagatggatgagggagtgaaaactttgcatagaatcctcacgcaagtagatacatgttcatccaaaagtattaatagaaattctctatcagctattcagtcttaatttcactagtagtataatgggtatacatttttgtaaatagcatccccaaaccagccagccttcagttatttacaaatgtttgtccttttttcagcaaaatacttcaaatgaatagtattaacttacaaaaagtcacgaaaaacttacatgagagtgaaaatttgttatgactgttttgagagtgggactcactctgaagtatgtgctgtctcatgtcttatttttgaaccatgcatatgatggacacacaatggatggacacattatatctccaacaaggtgtgggtggaaagatcaaattaacctgcttttttgaaaggaaatgattactgtcaaaccagcatggttaattgtgagcatcctctgcagcatgccccttaagattttctacaacccaaaccaagtgtatgtattgatttctaggaacccccaaaaggagaatagtaaaaaaagatcatacttaaaatttgtattacaatttttattttaggaacttattcagacacgtaaatgttgtttaattctgtaggtaaccatttgagctgcaattcaggatcttttttataacaccagtgtagccaaaagagaaacagataagtgaattggtaagaaataagattcagagcacttgggattgtaagttataggttctgagctgaactgtttatc

SEQ ID NO: 87725 - DNA, 1734 bp, Homo sapiens
tcgcggccccgcgcgccggatcggcgtgcgtgcggctggagccttaagcgtttcccccgcccggcttcatccctgctggcggcccagcgtcgttctcctcctgcgcgaggcggccaaggcctgctggcccggagccgcgcctccacccgcgcgaggtatcgtccttggagaagatggaagcggagaggcggccggcgccgggctcgccctccgagggcctgtttgcggacgggcacctgatcttgtggacgctgtgctcggtcctgctgccggtgttcatcaccttctggtgtagcctccagcggtcgcgccggcagctgcaccgcagggacatcttccgcaagagcaagcacgggtggcgcgacacggacctgttcagccagcccacctactgctgcgtgtgcgcgcagcacattctgcagggcgccttctgcgactgctgcgggctccgcgtggacgagggctgcctcaggaaggccgacaagcgcttccagtgcaaggagattatgctcaagaatgacaccaaggtcctggacgccatgccccaccactggatccggggcaacgtgcccctgtgcagttactgtatggtttgcaagcagcagtgtggctgtcaacccaagctttgcgattacaggtatggtcttcgtggacactcactgtcccagaatgcgccgtgggaatcaggatttcatagagtggtgtagaggcctgctttaatctctgctgatgacctaaactcattttgaggaaacaagctaataaataaacatccctgagtttgtgcaagcgtggcagctttgcagtagtcatttgctgagacgatgcatccagcctccactcctcagccagcctgcccttttgggtaataaaacttggctcctaacgttaatacagaggtttctaagtggtgcctgcttcatggccactgtatattttagcttttgttcctatcgattatctccttattttaaataaggaaaaatgaaatatggacaaattaacttttcccttcagccgcaaaactgatgggtcacaggtttgtactatgaatgtgcagtgaaaacaagtgtcattccaaggcagcacttttatgtcttttgctaatatagctgttggtaccatagcgaaatatactcaaaaagaacactgaaaggaatattccttttgacgcttggtctttcaggacatgtagaatcttagataagtgaccttgattaagccaagaatattttaatgtcttttatatacacactggacaacacatttttgtccttaaatattgtttgaaaataggtgaagatgtcctttgctgatgttggaaatgtggtaaaggagaatgctgctttgcaaatgatctattctaactcagttcacagttgagaaaattaaagcccgttaggtccactctggtaaaataggactggcctccaggatttccagctctggactaacacttagcctcctttgagccttaagtctggacatcttcattgtaatgggttttatttctgacaagtagaaaggcgcataaacatgcttaagaaatgaaataggcagtaaataggaagctgctttttaatttttgtaattttttttgcagaaattctttcattagcatgaacgctattataatgtcaatacctgtttttaagtcttattttaaataattttacacattatcaaagaggcttaagaataaatgttcaaaataatgtattctagacaactaca

SEQ ID NO: 87726 - DNA, 488 bp, Homo sapiens
aataatttgatgtagcagtgtaatgggctgcattactagtgagttccttatgtgagtgtgcgagcatatgctggatgacttatctagaataatgtagaagagaattaaacattgaatgggagcttaaattagttaatttctgaggttcccttccattcttagaattctttgatttttatattgaattgagagaactagtatagtttttatttcagcaaattatagcaccattgttctcaaggcatggaaaatgtgcttttcatctttaagatactaaaccttttcactcatggcaattttttttagctagcctctaagcttggaaagcagtggaccccattaataatcctggccaactctcgtagtggaactaatatgggagaaggactgttgggagaatttaggatcttgttgaatccagtccagggcgacagagtgagactccatctcaaaaaaaaaaaagggaaacctcttacccttttagcagt

SEQ ID NO: 87727 - DNA, 489 bp, Homo sapiens
gccaataacttaggatttagctgttttcattaactaaacaatattaaatgccttatttatgaaattttacatagagataattttcctttgggctgcattcattgttttataaccctcatgccaaattttggcatctagcagagataaatatgaaaccactgttccaataaatttaaacaatagtgtatgttgacaattctgaagccattctaattctaattttatttcatgactactttcaaaaccagcttatttattaaagatatacttaagtcacatgaacttgaaaagacatttggcttaaaatctctattttctctgatacagtatttgatttaaagcccctttttttctttaagccaattaattagagcacttttacatgtttctagtagtgaaacatcatatacatgacacataaatacatagatgtattatacatgcagatagaagtagagcttatcatttcacaagacctctttttttcct

SEQ ID NO: 87728 - DNA, 1596 bp, Homo sapiens
ttcattctacttatctttattttctgaactttctacaatgaacatgttttatttttacttttgttaaaataaataacatttaatttgacggaaaattctaaaaatcaacatttggtaacttaaatattcattggcacatgattctgtgcctgtttctgggggtcattcccatgagaagagcaggtagaacttatgagaatagagcagtcgaaatattataggtttcatattttacggctttattgaaaacattgatatattgaatattcataaattttaatttaactttcttttataatccttaatgtgaggctaaggtataaggagaaaggagattggtaaggaagtgtgatacatattgaatcaggtgtcaaggtaccatttgtgcctggatctgaccaatagaccaaggtaaaaatctcaaagaatgagacttgtaatgagaatgccacaaacttgaataccttatgcacaaaacacaaacattgttatgcataatgtacatgaaccctgaaacaaagataatgatttggaccacccaactgaagtggcatgttatgtttttggcatgaacaaaagaaacaagagagaaaaaaatcaaaataattaaaataaattgttagagaaaagttactttaaaaatagctataacgctttgcaatttcagtaacagttctgcctctgatgcaatgtaaaacatgtattagacattcaggctccacaataaattttaatgagcactacaaatttagaatatataaaaatatcagtaacctatgaattcatcaacataactcacttttcagttaagttaggctgagttgaaattctactaagttttcccatattcttgataaaggctaaatttgaaataatttatttagatgactaattggcaatttgatagtagttacattttatgtaacacttgatataataacccaaattaattagctcaatattatcttctgtggtttattgatccaaaagtacatatttgttatgtaaacttatactatgtaaacttgaattagttttttgcttccttgaattaataaagcccattaatgcaaatctaagccttcatagacttttccaatccttagttaaatattaaaaactgagtattgtagttatttgctaggtataaaaggtgactcagagtagagagtaagatgtcagcaaatagacaataagatgtcagcaaaagtgcctcaaattttaactgcgtcaagttaagggcattgtaaatactgtagttttatgtagcttgcaacttctactgaaatgagtttaatcatgtctttcacatagctgaagtttgtgtcaagatttaagctgattttctcattcttatcaaagtctcacctgggggtagggaggggtaggcctacctcccacctctatactatcattttaggaacagacaggcataaatctgttcatatggtagaacacatgatgttagagtatattttgttgaatgctatggaatattaatataattaattctaaaatatcacctaaaatatgtcaactgaagatctgactgtactaaatatgaaaaataaagcagcacatactttctctactgtt

SEQ ID NO: 87729 - DNA, 153 bp, Homo sapiens
aatactatctgatacacagtaagcactcaataaatatttactgggtaaatgaacccataagcaaacccatctagtcccttctcctccagaagccctaaggatttgctttattttgttctcctctagagtgggggcccctgaggaagatgtaca

SEQ ID NO: 87730 - DNA, 870 bp, Homo sapiens
ggtggtacggcctgggagttaaggcatgtggcagtcaggtggcgaccactatctagcccaacgttgctggagttgttgcagctctgccgggcccacatatcagcgttcgtgcatgacgcctcctgtggatgggtcacaaaatgactgtgcagcagccgaaggcccctggaacccagacagatgtgctactggctgaccttcagcactgcaggtacctgtgccagcccccagccccgcctcctgttggccctcccacggaagacaagggtgtgtggccgtagtcatggccagaatcttcacttctgggccagcacccggcatggagcccttctgctggggcgatccccccactggaaagtgggtgggtaccagttgtgtgtgcaatgccctgtaggcctgagaggaggtgggggtgtggaaggcaccaggatgaggtaggcggtgggtgctggccctcccactgctgggctgcgtgacctgggatcagtctttcctctgtctgatggcaggtgcagattgcctgccctggcacgtggtgggcagtctgggcccaggagcatctcccaccctgtgtggctggggcctgctcgtgagtggcctgctgtcctcctgcccagcaagctgcaccaccctggcctgttgctgctgatggcactgagtccctctgcagatctgtcggggctgtgccttctctttgagcctgtgtggctgggctccctgcagggggtgctgcacccaccgagaccaagtgaggaggcacctgggactgtgctgggcctgccgccccggccccctgctgcagcaggtgctaaaggccctgctgttcctgcaggcccactggcgagctcacagtggcttcagctctcacac

SEQ ID NO: 87731 - DNA, 372 bp, Homo sapiens
gggcgccggtgatcttggggtcccccgacgacgtgctcgagttcctgaaggtgtatgagaagcactctgcccagtgagcacctgccctgcctgcatccggagaattgcctctacctggaccttttgtctcacacagcagtaccctgacctgctgtgcaccttacattcctagagagcagaaataaaaagcatgactatttccaccatcaaatgctgtagaatgcttggcactccctaaccaaatgctgtctccataatgccactggtgttaagatatattttgagtggatggaggagaaataaacttattcctccttaaaaaaaagtctcccttgctttgtgtcaaataataatgatgatgacaataataac

SEQ ID NO: 87732 - DNA, 404 bp, Homo sapiens
ttactggtatataggaaagcaattaattgacttttgtatattaagaaatcctgtatcctgcaaccatgctataatcacatattagttccagtggattttgtgtgttatttagaagtgtgttgtttaatcttcacatactctgagatttttcagctagctttctgttgttgagttctaattccattgtgatctgaaagcatactttatatgatacctattatttcaaatttaaggttttatgacccagaatgttgtctaacttggttaatagtccatgagaacctgagaataatatataaagttcaaaacaggtttcactggacccaaatcagaatgtctgcagggctgcgtttactttggaggctctagggagaatatattcccttgcgtttcccagtttctag

SEQ ID NO: 87733 - DNA, 1146 bp, Homo sapiens
cagctgagagcaggcccagggcagaagggaggcaggggcattaagagctcaggcctccagctgagggactgcagatgttgggaagcctctgattagggcccggaaccaacttccttttcgcatctgcagactcatggaggcaaccactcaaggccactctgagaagggttgaacgtgctttaaattaaaaggactgaggatcatgtgtgttggtgtgtcctggactctgctctaagagctgcacgggggcttggatcaatgcctgaatccagtgttcctgagtgcagagcatctttgctctgggtgagctttgaccatcctggagaagaaggctgctgcgggggtgggacaaagccaagaccaatgcccagcggccaaggccagccagatggctctgtgctggcagccagtgtacacggattttacctgaaggaaaatgtcacattttccacagacaactgaagaaaaagagctctttggattaccctaattgtgatttactcattggaaccactgttttggattgtccaaaattaagtctcaaagcttaaatatgaggcttcagggagttatcctgaaatcagtgcttggtatcttcttgttttttgcttgttttttaaaaccttaattctcatatttttctgtcatatttctcagtgcctggtacattatcaccattaatccatgccagttatgtacagttttgcatgtttgttttttattttactcttttctctccttcattccctattcctgttcccccataggtgcccagtctaatgtatttgatatctgtccttagagcctccgtatctgtgaagactagagtcatgcacttcatcacatttcagtaacgatgggccgcatgtaccacagtcccatgagatgatagaggtgcagaaaaattcctgtcatctagtgacatcgtagccatcataacatcacaacacgactctcatttgtggtgaccctggtgtacacaaacctactgtactgccagttgtataaaagtctagcacatccagctacgcacagtacatacttgaaaattataataaatgaccatgttactggtttatgtaattactatattatactttttaatcattattttagagtgtacaacttctacttgtaaaaaaaaaa

SEQ ID NO: 87734 - DNA, 426 bp, Homo sapiens
ggcccagccctaggagggggcagtcccacagcaggctcacaccctgcccttcagagttgcagcagctaatgctgatgccaggaccttgtcctgccaggaagcctctgattagggctgtgaaccaacttccttttcacatctgcaaggactctgctctaagctcaaattttgcagtttctgctgtcatcacagctgggaatgagaaagggaaggggctccagttggtctccctctgcctctggagcacacgtggaggacatgaggcttccgcaggaacagctctgaaagctgagttctcgggtccctgtgaaggagggaagcttgcctgccttggagcgtgaaaaagtcttgctggacagaagtctcacggtttaaaactgggaagggagaggattgagatcacactagaatgcacagaaaattctt

SEQ ID NO: 87735 - DNA, 1266 bp, Homo sapiens
ggcccagccctaggagggggcagtcccacagcaggctcacaccctgcccttcagagttgcagcagctaatgctgatgccaggaccttgtcctgccaggaagcctctgattagggctgtgaaccaacttccttttcacatctgcaaggaccttggaggcaactgcccaaggccactctgaggagggttgaatgttctttattaaaaggactgaggatcatgtgtgttggtgggccttggactctgctctaagactcatggaggcaaccactcaaggtcactctgagaagggttgaacgtgctttattaaaaggactgaggatcatgtgtgttggtgtgtcccggagtctgctctaagagctgcacgggggcttggatcaatgcctgaatccagtgttcctgagtgcagagcatctttgctctgggtgagctttgaccatcctggagaagaaggctgctgcgggggtgggacaaagccaagaccaatgcccagcggccaaggccagccagatggctctgtgctggcagccagtgtacacggattttacctgaaggaaaatgtcacattttccacagacaactgaagaaaaagagctctttggattaccctaattgtgatttactcattggaaccactgttttggattgtccaaaattaagtctcaaagcttaaatatgaggcttcagggagttatcctgaaatcagtgcttggtatcttcttgttttttgcttgttttttaaaaccttaattctcatatttttctgtcatatttctcagtgcctggtacattatcaccattaatccatgccagttatgtacagttttgcatgtttgttttttattttactcttttctctccttcattccctattcctgttcccccataggtgcccagtctaatgtatttgatatctgtccttagagcctccgtatctgtgaagactagagtcatgcacttcatcacatttcagtaacgatgggccgcatgtaccacagtcccatgagatgatagaggtgcagaaaaattcctgtcatctagtgacatcgtagccatcataacatcacaacacgactctcatttgtggtgaccctggtgtacacaaacctactgtactgccagttgtataaaagtctagcacatccagctacgcacagtacatacttgaaaattataataaatgaccatgttactggtttatgtaattactatattatactttttaatcattattttagagtgtacaacttctacttgtaaaaaaaaaa

SEQ ID NO: 87736 - DNA, 367 bp, Homo sapiens
ttatcaataatccttgtacctaatgtgccttgactctgaaggacatggtaactgcctgtggtttagaaaatgttttggctaaaagacaagttctcctccctcctctcatttttatatcacagagctgcacgggggcttggatcaatgcctgaatccagtgttcctgagtgcagagcatctttgctctgggtgagctttgaccatcctggagaagaaggctgctgcgggggtgggacaaagccaagaccaatgcccagcggccaaggccagccagatggctctgtgctggcagccagtgtacacggattttacctgaaggaaaatgtcacattttccacagacaactgaagaaaaagagctctttgga

SEQ ID NO: 87737 - DNA, 406 bp, Homo sapiens
attttactcttttctctccttcattccctattcctgttcccccataggtgcccagtctaatgtatttgatatctgtccttagagcctccgtatctgtgaagactagagtcatgcacttcatcacatttcagtaacgatgggccgcatgtaccacagtcccatgagatgatagaggtgcagaaaaattcctgtcatctagtgacatcgtagccatcataacatcacaacacgactctcatttgtggtgaccctggtgtacacaaacctactgtactgccagttgtataaaagtctagcacatccagctacgcacagtacatacttgaaaattataataaatgaccatgttactggtttatgtaattactatattatactttttaatcattattttagagtgtacaac

SEQ ID NO: 87738 - DNA, 179 bp, Homo sapiens
tcaatttggcatagagttgcttataatattcccttatcatattttacaatgtgtactaaaaatcattgatatagtatcctacaagcacgatgggtctgatggaaggggaaaatgtagagttgcatgttgaatgctgtcttgcaattgtgagtgcatttctgagactgtactagctattt

SEQ ID NO: 87739 - DNA, 1214 bp, Homo sapiens
tgtcgtgtctatgttagcaccttgaaatctgtgcatagaaagctgaaaatgatggctactctgaaacattgcccaagatacaaccttcttgattagctcctcaatatgcccaagacagagccatactgacttatttcgtggctcttagctggtgcctaatgcagtgaaaaccccttttaaacagcactgactaggtatggctgggagagtttctaggagggaaacacgctcagacatctccaagttttctcgtaatttgggaaaatataaccattaggaagtgttctcttaagcgtctggagaccttgcacaagttacccccaaaagcacaataaaatctaggtgaaagaatagaagaaatcaaaagctatcacaaaatagaggcctaagcacctctttaaaaagcaggaacagctagaaaagtagatttagcatttggacattcagggtttaccagacctatttgcaatactaattagtcttaagttggccctcctttgcagtcctttagctggtaaactgctagaaaacatggattacaccttgttattaatatagaaaagccctggtgcaggtggcagagccatgagcaacctgaatgccatgattagggtcatgacgagagcaattccagtatctgaaactcacacagaagcaagcctcacaggcaaatacccagatgatagaggccctatatccaatgccaagagtcagatgctacagcgcagaagcaacaaattcttccaaaagaaatgattcatacaaattaattgttttctaatgtcctttaattataattaaagagtttgagcatcgactttggttttttaattaagcccaactttagcttatttttctatattctgaaatttagacattcaattcatgtatgttctattaaaagacatgtcaacttatatcagaatataaattaatattaacacatataaatgatatatactgaataaaagaacattttaaaataaaagctactcaaatgtgtataatatgaaacaatgaagaattcaccacaaaaagtaatttattggagccaggtgcagtggtacatgcctgtagtcccagctacttgggaggctgaggcaggaggattgcttgagcccaggagttcaagattgcagtggcatgatcagtgcttacccaactcttgaactcaagcagtcctcccacctctgcctctcaagtacacagacaca

SEQ ID NO: 87740 - DNA, 779 bp, Homo sapiens
caaaaagaagcgcttggcactacagggttacaaccctatgccaatatattattcttagtgggctccctgccagccctaatgggtaatggctaaaacatggattacaccttgttattaatatagaaaagccctggtgcaggtggcagagccatgagcaacctgaatgccatgattagggtcatgacgagagcaattccagtatctgaaactcacacagaagcaagcctcacaggcaaatacccagatgatagaggccctatatccaatgccaagagtcagatgctacagcgcagaagcaacaaattcttccaaaagaaatgattcatacaaattaattgttttctaatgtcctttaattataattaaagagtttgagcatcgactttggttttttaattaagcccaactttagcttatttttctatattctgaaatttagacattcaattcatgtatgttctattaaaagacatgtcaacttatatcagaatataaattaatattaacacatataaatgatatatactgaataaaagaacattttaaaataaaagctactcaaatgtgtataatatgaaacaatgaagaattcaccacaaaaagtaatttattggagccaggtgcagtggtacatgcctgtagtcccagctacttgggaggctgaggcaggaggattgcttgagcccaggagttcaagattgcagtggcatgatcagtgcttacccaactcttgaactcaagcagtcctcccacctctgcctctcaagtacacagacaca

SEQ ID NO: 87741 - DNA, 395 bp, Homo sapiens
tctcagattaattataatttaatgtcaatggtatacaaaaactttgcgcatatatagctctgttcccctcctcctcctctgtgctatcactgtcatataatttaaatgtttacacatcatttgactaccagcacagatgtctaatcatcactctctgcagttgtcttttaaatcaggtaggagaaaaaagagctacacacataaactatttatttttacactgccctttgaaaatgttttccccaattttttattgtaataaaatacacataacaggccaggcacagcaacacacgcctataatcccagcactttgggaggccaaggctagtggatctcctgaggtcaggaatttaagacaagcctggccaacacgatgaaacaccgtctctact

SEQ ID NO: 87742 - DNA, 337 bp, Homo sapiens
gccttccattacccacagtaacgagccttctgatttctaagtccattcttccctcgggtccttttttatatggttttattgcatctctctatgtttctaaaatgccctttttattatagaaaattttaaaggtacacaaaaacagaaaaagtatgaattcctgtgtacttaccatccagcactttgggaggccgaggcgggcggatcacctgagatcaggagtttgagaccaacctgggcagcgtagtcaaactctgtctctactaaacatagaaaaaaaattagccgggtgtggtggtgcatgcccatagccccagttaacttgggcgtacgggga

SEQ ID NO: 87743 - DNA, 335 bp, Homo sapiens
ttacaggcgtgagccactgcgcccaaccaatgttttaatatatttttaaggagaggacagagaaagcacacaggctaccttatatttggatatgctgacattattttggtcatagatatcaaaaagcaaacaaatctcccacattccttttcttattaaattacataaaaccatttaatcagtacaaatttcttctctgaaccctataaaagggattatattctattacttgaatagtcgatagaaatttttatttagtgccagatactgtgctttacacaatttttaaaattttatttttaattgacacataataattgtgcagatttgtggtt

SEQ ID NO: 87744 - DNA, 401 bp, Homo sapiens
gttactcatagtattagatgtcaagatactagagaagacaagtgacaaaagcatgaatatttcttaagtatctcaacaacatgtcaaagctgcatgtgtaggatgtatgctgtttgtacaaactatttcagaatattttgtaagctataacatatttattgtgcattaaaattaaatactttttccccaaaggcatgcagtcatgagaattacagaaaatttgcaacatataaagtagtttgatctaagaggattcaacacctttgttttgttgctcagtgtgtaatgactgagatttgtaaatctttgtgaacattctgtactggttcccaagagctattcattccctgctacctgatttcagcacaataaatatacttctgctgtgggaaaaataaaat

SEQ ID NO: 87745 - DNA, 2973 bp, Homo sapiens
tcctcgtctttctcccgggaaccttgacgacgccttccgcttggccctgccttctgccgcatccccgccgccgcggcgccttgaggagcaggagaagacgcagccgggccgccgccgttagaggggttcccggccgccgctcgccccgtcggccgccaccgcctccggggtcagccctctctctgggtctccgctttctcctgccgccagcgcccgctcatcgccgcgatggggctcctggactcggagccgggtagtgtcctaaacgtagtgtccacggcactcaacgacacggtagagttctaccgctggacctggtccatcgcagataagcgtgtggaaaattggcctctgatgcagtctccttggcctacactaagtataagcactctttatctcctgtttgtgtggctgggtccaaaatggatgaaggaccgagaaccttttcagatgcgtctagtgctcattatctataattttgggatggttttgcttaacctctttatcttcagagagttattcatgggatcatataatgcgggatatagctatatttgccagagtgtggattattctaataatgttcatgaagtcaggatagctgctgctctgtggtggtactttgtatctaaaggagttgagtatttggacacagtgttttttattctgagaaagaaaaacaaccaagtttctttccttcatgtgtatcatcactgtacgatgtttaccttgtggtggattggaattaagtgggttgcaggaggacaagcattttttggagcccagttgaattcctttatccatgtgattatgtactcatactatgggttaactgcatttggcccatggattcagaaatatctttggtggaaacgatacctgactatgttgcaactgattcaattccatgtgaccattgggcacacggcactgtctctttacactgactgccccttccccaaatggatgcactgggctctaattgcctatgcaatcagcttcatatttctctttcttaacttctacattcggacatacaaagagcctaagaaaccaaaagctggaaaaacagccatgaatggtatttcagcaaatggtgtgagcaaatcagaaaaacaactcatgatagaaaatggaaaaaagcagaaaaatggaaaagcaaaaggagattaaattgaactgggccttaactgttgttgacagtgaggaaaaactcccatatcatataaaatttcagggaaaacagaagcaaaggagagcttgggggtggggagaaaagacaaatgtgctctatgtcctagtaactcttagactgagtaaagtgttaataccatacccagatgttttatttatgaagtttttattttaaacattttttttaaaaattagccttgatattctccagaccaaagcaatcattaagtgactttggggattctccccctgttcacatccagttgtctaaaggatgagatttttcatgtatcttatagtcactcattcttcggtctgaattttagacgatcacagaaacggtctttatgaattattttgataaattactaattatcttatctactgactgaaatcagtggtgttacattttcttgtccaaagctgaaaatgtgtatacacttaaacttgcacatttgaattcatttgctgaccggaatggtcaaatctctccacctctagtcagagtataattttggttgtaattaaatttttaaaatctgctgatctctgtagaatcttagaggcttgatgatgatggtgttggtgaaaataagaaagaattgcagtaaagtcttgtctggtgacccagagatcaccatgacttgaggcacaaatcactgtggggaaacaattttttgtgatgaaaaggcagcatttgaatactcctgttagtagcagaaatatattatgaaaattaagattattgtctgattgaaacatgaaacaactcatgtctttattagtaacatcataagatagttacatttatgtgctgttagaatatgttgatttttatcaggctttccttgttttgatttatggctgttcctgatttttcatatgtggaaatatacctacctcttccgttggaaagaacatttaaaattaaataaattttaattaaaaaatcaaggagtcttctaatgtaaattttaatgttaactttcaaatccactagtattttttttgcttttatgacaaatagcatacaccaaacatttctgtgaaactatccttctctttcaatgtgtttaattttggagtaacgttttccttgtgactaagttgcaagatcttatttattaactaggtatgaagtataaacccattttggtgcaatattcttgactccttggtgctaaagattgttaaattcaatgcttgatgttacaaggtgttgttaaaacacaaaatgaataaaagtgagagtagtcagaactataacattcaatttgctatttacaaatgaagtatttcatgtaatataagtgaacaactggaaataaagtaggaaagaatttgtatcatgttttactacataggttaattttttaagggatgttgcaaagggattactagagaaagacaaaatgtgaccaaaaaaaagcatgaatatttcttaagtatctcaacaacatgtcaaagctgcatgtgtaggatgtatgctgtttgtacaaactatttcagaatattttgtaagctataacatatttattgtgcattaaaattaaatactttttccccaaaggcatgcagtcatgagaattacagaaaatttgcaacatataaagtagtttgatctaagaggattcaacacctttgttttgttgctcagtgtgtaatgactgagatttgtaaatctttgtgaacattctgtactggttcccaagagctattcattccctgctacctgatttcagcacaataaatatacttctgctgtgggaaaaataaaat

SEQ ID NO: 87746 - DNA, 368 bp, Homo sapiens
attttttaatggctccctggtgccaagtgcagccagggttgggaatcactgggtaggagggcaaggaccatgtctgctgcttatccatgacttcatcccccgtgctgagcactcagcagtgtctgcacagagtaggcactcgataaatggcaactgtacttatgattgttgtttttgttatggttgatagggttatgattacaaagatcattaagccatatgactttttttttcacatttttggcctctgtgattctttgctacagaactctaaaaaataataataataaaactgtagtagccaaatcatctttttaaaattcaatgagtttctattttcctgtcaacatagagcttcaattaaggat

SEQ ID NO: 87747 - DNA, 719 bp, Homo sapiens
gacatggaagatagaacagaacttacccgacatatagccaagagagctaaagatatggaaaatatgaaatagaacttaaagagacatggaagatagactgagaaggtctgtgatatggtttggctgtgtcttcactcaaatctcatcttgaattatagctcccataattcccacatgctgtgggagggacctggtgggagataattgaattatgggggtggtttccctcatactgttcttgtggtagtgaataggtctcacgagatctgatggttttataaggggaaaccccctttgcttgcgtctcattcgcttgcttctcattcgtttgcttctcattcgctttttgcctgctgccatgtaagacgtgcctttgccttccaccatggattgtgaggcctccccagccatgtgggaactgtgagtccattaaacctcttttcctttataaattacccagtttcgggtatgtctttatcagcagcatatagtctaatgaaggattactttctataaatgacaaagggtcctaatccacaggttcgagaagccaaaaaactttcgactataataaataaaaagaaatgtgcacccagaataatcatagtgaagacacataacatagtatactaaatattaaaatattaaataatatatggtattttatagcatattggaaactgagtatatgtaacttccaaactgttagagaaaagaga

SEQ ID NO: 87748 - DNA, 709 bp, Homo sapiens
tgaagatattcactacagacttatgatagtaataactatctacagacaatgtttaaatactttatttcaattaatgcaggttaatcctcacaacaatctatggtgctagtgaacattactatcctcattgtacagatgagaaaactgaaacattgagaagtcaagtaacttgctcaagattatatagctagtgcatagaggggcaaagatttgaaccagattgcctggttccacatgcactttaacctgctttatttaggcttttgaaagcaacctaaatagctaacattgactaaataagtgcagtatacctggtctgtgtgacattttgcaggtattaaaaagtgaacattctgaacccttttagcaatatggcaaatacttctgatgtgatgtatgcatataaatatgatcgaaagcaaatatcccaaaaggttgatggcagttatgtcaggttagtagcacaatagtttcttttctcattttctcacatttttagtaatgtgtgttgcctatattaaaaaacaaatattaaaaagtagtagcatgtattagatcagagcatgggctcagactgcctgtgtcatctcttattagatgtatgaccagggacaagttattgaccttttgtttctaagtctctaagtttatcctgtaaaatgaagataattgtagtaactacctaataacatgattgtaaggattaaat

SEQ ID NO: 87749 - DNA, 303 bp, Homo sapiens
ggggctgggaagagaatgatgtcattgcttttctctgaatcttttccctgtagctggattctttgggccttctatagaggcctgacccagggcagggggtagaaagctgttctactttgagaatcctgaatgttccagcctagaaggaatcatctcttacagcatagtctcttatgttttatgtttgaggaaaccgaaacataagagagggcaagtgacttgctagagtcacacagccagctcagtgcagagttaggagcggaagcctgccctgctaactccctgcctgccattcttcccacc

SEQ ID NO: 87750 - DNA, 355 bp, Homo sapiens
tacccaaaagccctccaggagcaggttgtttaactcttatgtaattttacgattttgatagatcttggtgttgtttctacttttattgcactgtgctttgagactgtggttagtatgatttcatttttttttttaatttgttaaggtgtgctttatggacgactgtgtgttcagtcttagagtatgtgtcatgtgttgatgagaagtgtgtatattctgttgtcgttgggtggagttttccatagatgtctcttacatccaattagtcaaatgtctagtttatgtccataatttctttgttagttttctgcctcaataatctgtctaatgctgtcagtggggtgttgaagtcttg

SEQ ID NO: 87751 - DNA, 657 bp, Homo sapiens
gaggggtcaggcccagtgcctggaacctggtaggaagaaagaccaagttgtagcagctgccacgtgttgggcgctgtgctgagtgctgtctttgtgtggtctcatctcttccctactctcaccctgtgaagtcagtatcaccctcttcactttcacggaagaagctgatcgaaatcacccagctgatattcaattgaccgaggattcaaaaccaagatggggctgggcgcggtggctcatgcctgtaatcccagcactttgggaggctgaggcaggcagatcatgaggtcgggagttagagaccagcctggccaatatgatgaaaccccatctctactaaaaatacaaaaattagctgggtgttgtggcacgtgcctgtaatcccagctactcaagaggctgagacaggagaatcacttgaacccaggaggtggaggttccagtgagccaagatcacaccactgcactccagcctgggtgacagagtgaaactccatctcaaaaaaacaaaccaagatggcccgaattttgaaactttatactcctcactactctgcaaaaatatctgtgaccactcttctgttcggtgcccagatggtacacaatgaagtattgagcaaatgcttttagcgttggttttggcatccagcccctttt

SEQ ID NO: 87752 - DNA, 499 bp, Homo sapiens
cagtggaaggacagacagaaaggtgggtggatgcatgtttgcatgcacaagttaatggatgcttagattgatgcatggatgggtggtggatggatggatagaaaggtgggtggatgcgtgtacgcatgcacaggtgaatggatggatgcatggatgggtgtgtggatggatgggatggagaaggggtgaatggacaggtggatggttgctcagaacataagcagagggactgtgtactgtgcagaggagcaagaggtacacagaggcagggtctgagcctggagccaagacgggaggcctaaggacaacaagcccagagaagcaagacatgcgccaagcagagccaagagccaggagtaattaagcctgcgtgcacagccctggagccccagcagccctgtcttcattaagatgctgaccagggaaatctcatcagagatagaaattctggcttgagctgcttccagccctggccctgtcaccttccccataaagtgtc

SEQ ID NO: 87753 - DNA, 434 bp, Homo sapiens
gccatgccttggggtgaattcttccccactagctctctcacccagcctacaagtccttctctcatagatcccagagcaatgggcaccgtccaggaggtacaggagaggactttatgatgcaggaaagaaggaagaagtgggtcccttgcaagtggccagacagggaatgatggtttgactccagaaatcaggaatcaggttcaggtttggataacttctctttaaaatatctccacattgagactcttattttaacaaaatccaaacaaaattaactcagggcttgtgacctaacctttgtaagaaggtgatcaaagagatcctacattaataagcactgcctgtagcaccagctttgtctttttgtcttttgttgtttctttcctgaaccaccctgtacatcatagccaggtctaccccaaatagagcagcag

SEQ ID NO: 87754 - DNA, 363 bp, Homo sapiens
gagtcattgatgctgagagattgtgaagaatatactgacagcatccttgtagctgcatcacagtaaatcggacttctgaatcaagcagcccagcctagcagctgataagagtgaatgtaggtgagaagcattaccttattcctgtaacaagagaactgttttgtgataagtgaaactaggaatgtagaagaagaaatatcctatggctattataaaagaagaaggacttgcctgaatgacttggtggtgcaccagaaaataactttcagaagaatgctttctgttaagctgctgcattgttcctggaggaaatgttatttctaatgcatgttatttcttcaaaagataggataacaaagaatg

SEQ ID NO: 87755 - DNA, 730 bp, Homo sapiens
gacaatatttttgagatgatgggctgtgaagggaagatgagtaataaggtgatatctagagagggattcagagatcttattataagtcatatattacagttttgaaatcctcgtgtgttttatgtagaagaactatgatacaatatgctctttacatctcattatttgagaaatgtcctctttaaccccaattataggatgggtatagtttctgtatatccttcattactttgtgtgttcagaagatacccttttgatcctttattaaagacttgaaacaactagtatgcgaatgctttattttgaattttaatgctgtgttttttaatagttttatttttcttacggcagttctgttgagtggaaatgttaaataatctatttctaaagagaaatgatattgaattggtcttgattttttaatatgcatgtaatgcttattgtgtgccaaagtacaagtgccttatatacatcacttttttgatcatcacacaaacatgtgagatagatactctattctctacattttacagataaggaaactaaggtaaactaacacaggaatagaaaaccaaacaccacatgttctcactcgtaagtgagagttgaacagtgagaacacatggacacagggagggaaacatcacatacctgggcctgtcgggggatggggggaaggggagggagagcaatagggcaaatacccaatgcatacggggcttaaaaccta

SEQ ID NO: 87756 - DNA, 545 bp, Homo sapiens
aatcttgtttctttgcagtagtgggggtaccttgagatattttgcacttgacacctacatataaaaacaaagtctgccaatgagggctatgttccttattatgcctctgccttgcatttgtattttgggcttgcatccctaaataaatgagcaactaatcttcacaaaacttgggtcttctgccaagtatagatattatacgtaagtatagatgttatacttaaagagtcattgcatgctactacaatgtttatgaagcctttacattctctggttgtggtttctaaatgcctctagttaaagtgctgaaatttcaagcaaattggaaattgttacttccatataggtctcttgggctccattcattaagtaaacacctgctatgtgccaggcacaattcaaagcattaagaatacaatgagaaggccgggcgcggtggctcacacctgcaatcctagctactcaggagtctgaggcaggagaatcccttgaacccaggcggcggaggttgcggtgcctgcgcaacaagagtgaaactctgtctt

SEQ ID NO: 87757 - DNA, 416 bp, Homo sapiens
taaagaaacccattgatgtttaagggctacctgagagagataaaagtcacattcgcatcaaagttctactggaaatgaaagaaatgctgcttcgtgcgtcattctactgaaggaagagtagaattactctgtcttttaaactgattacctggacaattctattttgcccccaaaaagcatctctgactttagaaattatcatttttagaaagaaattttgaccctagggactatatgtggaagtaaatgaagagagatgaacgatttcacagcattgccagaatgctaactttaccaagtcaaaattgtctaattcactgtttttaacacaaatgtgaaagaatctatgcttctttgagtaaaagaacttccagatgctttccagttccatgattttctataacctcacaaagtct

SEQ ID NO: 87758 - DNA, 449 bp, Homo sapiens
attacatttgctcaccttgcttccttacccccaccatgtgaacatgcccaagcccgcctgctggagggacatgagaaacacagaatgaagggtaagtcaccgcagttacactggtggaggttgtcctcagccagccaccatgccaacttgctgctttaatcacaggagagagcccagccaacatcagcagacctgctcagccaacccataaacagactgaggagcagcaagaaagtatcatttttcagacactgagtttcaggagttatttgttatgaagcatttatttgtagcaattgctgatggatacaacaaccaaagtatggtcaacattctgcattggactgcaacaatttggaatgtaaaaagaaagaattttgatctcaatttcttctgagatatcaggataataaattctgtactacttgaataaagttttttcctgatag

SEQ ID NO: 87759 - DNA, 2175 bp, Homo sapiens
aggatgacagacagccaggcctgatttggccaaatcatcatgcaaatattattctgggctgacaggcccaagttgcagtcagcagaggcaacacgggcttataatttgccatttgtgaatgtcctgaggactggagaatcagctaggaagcaaatcttccttctgctgcataagacagccaaaagcacctctgaggataggcatctcagggatttcagagcaggtaacgccttttggttgttttgaatatgctgacagaagaaccaaagctttcaggaaaacaaagcccaaccccttaatgaaacaggaaaggaaaaacagtttcaaatgcttgcttgctttccttgttttctgagaagaaagatgccttgcctgttgaaggtggcagatgcaggttgctctgtgggcctcgggaaggttcactgcagctgtcacctgcccaacccacgtgtcctgaggcactgtgacatcttgacaggtgtcctgactcttggccttgacatgtcctgtcacgcctgcctgtcagctgggactgggcttggggaagagcttgtgggcctggggcctggtagtacttgcttagtaaacatctgtggctgctatttccctgtcacaggctggcaagtcagaactactcagattcacttgcacagcaatgtccttcagtcttctgattatgtggctctgcaacagggagagggagatattcatgagcaagtgtgcaaaatgcatttaatgcctgctaatggtgtacagccatccattgctttggtctgcccagtgtctgtctccctatcttttgataccaggggccaagtttctctggggaattcctttcagtttttgcagttctgggacagttacccttcacccagcactatgtcaatatgggcacatgactcaagccagccaatcagagttcactttccctagacttggtcactcagagggagctatcccttaggccacagtgattggttcagaaatgggcacataatcaaactagaccaatgagtctcagttctgaaattttgagttaagattgcttggaaaaagaactgtttactctatggaaatagaagctggagtgatgaaatttggggtaccgggagcgacagggccatagtgagaagagaaccctacctgaaaatgaagtcagaaggaaaaggaaagtagacaagtttgatggagagagaggcagagacagatccctgaagacatcatttaagatcccgaattcacctgtgcccaaagccagactagtcctgaatgatttagttacaagaactaataaatgcctttttccataagtcagtttgaggccagatgaatagaaattgcatcccttattgagtcctggctcaagtcaatttagcaagcatttgttaagatccacggtgggagctatacctcagagctccagggagcacaggaggtgtgctacaatcacagccattgccagtattgttattattccatttattagacatttcagacactcctcagcactttacacacattatttcatttcaccctttgagcacatcctttaattaaaaattgttatctacactttacagggaaagaaacctagaccagagaagttaagaaatacatccaggggtgggtgcggtggcttacacctgtaatcccaacactttgcgaggccaaggtgggaggattgcttgagcctaggagttgaaggccagcctgggaaacatggcaaaatcctctctctattttcaaaaaatacaaaaattagccgggcatggtggtgtgtgcttgtagtcccagctacttaggaggctgaggtgggagaattacctgagcccaggaagcagagattccagtgagttgagatcatgcccctgcattccagcctaggcgacagagtgagaccctgtctcaaaaaagaaagaaaaaaagaaatatgtctaatatagtaataatagtgacagaggatgtgagttatcgtctacacactggcaggcaaaagaggttacttcctcccatctcaaggacttggaagtaagggaaataagactgtacacccaagaaagcaaaatggaatagatcggagtagagatctgccaagttgccttacagagccaggacagcttccagccagccaggctagatctagctgcctgaatgtattgacagcaaaaaaaaaaa

SEQ ID NO: 87760 - DNA, 139 bp, Homo sapiens
ccaggctgtctcttggacatctcctctgggaacaacccgtaggtccctcaaatattgaacatccaatacaccttttgttactattaaaggcatcagcaaacttcttagttttttgttttttgggtttttgttttgtttt

SEQ ID NO: 87761 - DNA, 618 bp, Homo sapiens
ctcagctgtatctcagagaaaccatgtcagcttcaccaaactctcaacttgtcatacacagaatgaatcttactatcttctcccaagagccaagctcactgataattttgctttaggtaaatctctccctatgcacaaaatgcataaaatgacatgaaaaaatcaggctcaaaagcatgtacaaatgatgtactacaggacgatcactttgtctggacagatttaagttagtgccttggcctcctttggaccttaagccttccaccagcctttcagggcttgtgttccagctagctcagctgacttccccaggctctgtgagaaatgttaccctcagcctctctcttctgctctgcaggtctcatttcctacttggatccaagaaacacctgccatttcctcttcctgggaaggttgctgactatatgcagccacatccctgtatatcagatatgtaccctcttccccttgctctgtccctggcttatttatactataccttttttttcctatctttggtctcctatgaatgtatgcctaggtgttaccctaccagaacctagtttaatatatcctgttattatgctttctccattcaagaatttacaaaacacatcc

SEQ ID NO: 87762 - DNA, 129 bp, Homo sapiens
aagatcacgcctctgcactccagtctgggcgacagagcaagactccgtctccaaataaataaataaataaataaataaataaatagtttggtaggctgggcgtggtggtttgtccctgtaatcctagca

SEQ ID NO: 87763 - DNA, 384 bp, Homo sapiens
  misc_feature (366)..(366): n is a, c, g, or t
tgattgctgctggtgaatttttgctggtttttattatttttgattcttttctgtagttaactgggggaggagagattctgttgaggcagtaatggtgcaatggttagatacctggattcgaatgccggctgtaccgcttagtatctgtatgactttgagcaagttacctaacttcatggggcttcactgtcctcatcaaggaagtggggatgatgacagtagtaccttccttggagggttgtgagaattaaatgagttaacacttgtaaagcatttacaatagagatacacaaagcagtaagtaaatgttagctgtcatttatgtattgtttttgagatggagtttcactcttgtcaccaaggttnggagtgcaatggcgtgat

SEQ ID NO: 87764 - DNA, 420 bp, Homo sapiens
  misc_feature (393)..(393): n is a, c, g, or t
tgattgctgctggtgaatttttgctggtttttattatttttgattcttttctgtagttaactgggggaggagagattctgttgaggcagtaatggtgcaatggttagatacctggattcgaatgccggctgtaccgcttagtatctgtatgactttgagcaagttacctaacttcatggggcttcactgtcctcatcaaggaagtggggatgatgacagtagtaccttccttggagggttgtgagaattaaatgagttaacacttgtaaagcatttacaatagagatacacaaagcagtaagtaaatgttagctgtcatttatgtattgtttttgagaattgcttgagcccgggaggcagaggttgcagtgagccgagatcacgccattgcanctccatcctggatgatagagcaagact

SEQ ID NO: 87765 - DNA, 616 bp, Homo sapiens
gcatgttcagacctttatttgctacatttggtaggaaagattttttttttcccctcttaactacaagaagccagagttttctgtgcaaacgaaacaggcgttgcaagaatcagattcactttggacgactcttcacattccaagtcatcattgcgttaggcagcacaattccatctctggttgatgggcagaaaaagtgggcagcttgccaggtagacgtttccatgactcccagcccccaaaggtgatgcgtttttcagctaattcaatgaagagtgggctgaactttgggtctaaacgagacaatagctgccttcgcagtatcagcagaatggttgatgggagtgcactctacatttggcagagaatcatgtgaccttacgactgagattttgtgatggtgccaacggagacttggaaagcagcaaccgtcctgacttttttcttcttttctaacatggctcagaaaatggtggatcttaatacttgactttagccagactcagcaagcgactgagctttgaagcacaacttcgcctttattctgggtttttggcaggccaccaggaggctgtccctttcacgcctgataaattctgctgcttatctctaaata

SEQ ID NO: 87766 - DNA, 518 bp, Homo sapiens
tgctgggaatacaggcgtgaacgaccgtgcccggctagaacatgggtttttgaagtaacccaattagagaccagaggagaaaaatcaggggtcagaattgaggaaattgttcttcctttatagctcacccctactgtgagccgtctctggggaacactcagttaagaaaggaaaacttattatgattatgttctgtttcagaatgttgggaccctttttttcttggaacctttaggtcctaaagcaggaatgcctttgaacagaccacaggtgtctctagagagggagacttgggggtactctgggaggttgaactgagacctcccaggttcagggacggagcgctgctgagcccattacatgagttggcagcgagcctgggccaccgaatgtccactttggcagttcaagcatgaagccaacaaagatagatgcaactggtttcgagaggacagaacccacctcccttgttttctgccatccattatattttgtggccatttatgaaagttgcagtg

SEQ ID NO: 87767 - DNA, 576 bp, Homo sapiens
tgaaagtttgcaggtcgtgaagaccaattagttgctatggtgtcaataagtgcaaattgctgtaggttgttggtgaatagggaaatctccactgggtcagtgcccagggcaatgaggtactaaaggcacggcaggtggtttgaaggcagacaccttaaaaaaaaaaaaaagccacaactgtgctggactttggtgttccacccataaacagtgatacgttccagctcctttctcagtctctgcatgtatatcaaggtgctgatctcagctggtacatcactgtgtggtctgaattaattttattctaaggattatattctctttagacatggtacagcaattgagattagaccaaattgcttattctgtggaactctggattatcagtaaaacatcaagatttgactaattaatgatccttccaaacagtcttcattttaaaggattccattttagagttaacagaaaagaaaagagataatctctgagtggaaatgtggaaaccaaatgttcagccttttttaaaacccaattcagaactcaacctagacatgccattatgttacagtaacagtg

SEQ ID NO: 87768 - DNA, 234 bp, Homo sapiens
tgacaaaacacttgtgtactatgtgatgtgaaatgggggcaaaatcaggttataaaaaagagggccaactcttttttatattttaaatgtaaaatatacacacactctccctcattttatctggacagatatttaccaaaatgcaaacagtatatagctcagcatggtggggatttatggtattttccttttgcttatttgtattttctaattttctctataataagtgagtca

SEQ ID NO: 87769 - DNA, 431 bp, Homo sapiens
tctttaattccccaagcagcaaatttgatggagcactacatccaaggcatttctggatgtgaaaggggtccctcaccttcaaggaatgtgcgccaggttgaggagttcagcacatactcctgaaaagatgagtggtgcagacaatgatttcccgagtggttgagaggaaagagagaaggttggagactggacctgatgacagctttcatggaggaagtgaggactgagctgagccttgaaaattgggagttgctgtcttcccatctcagtaaatggcggcaccattcacccaggtatttaatcccaaaacctagaaatcatacttgcttcctctttccctcacccccaaatccaaactctcagcaactcctacctattctgcctccaaaatagatcctgagtctgcacactcccaccatctccatttctgt

SEQ ID NO: 87770 - DNA, 459 bp, Homo sapiens
ccttgagatccatttaccctatgcctaggaatgggcaggccagcagttgcagagatactggagtctattgagaccatatctacggggaggagccgaggctcaggtaatctgaagcaagttaacaggtttcaagtcagggtcagagacttaagaaatcagatgtgggtgttaagatcagacaaaagcaaattatagggaacaggagaaaattaaacgagcagttgtcataaacgccagtttgtctttgaatcatgtctttctaggtggttggcttggttcaaattttgttatttattatcctgctatgaattgtggtttcataaatattttatttatagtagtagtattttttagatgtttagatgtggaaacataataacgttatattttctgctggtaaaattgttccttgcttgtataatgttatgctggaattaaatacatcagtaaatcatggtg

SEQ ID NO: 87771 - DNA, 407 bp, Homo sapiens
cctaaggtattgaggttcagacacttctggatcttaggccaaactgtgccacaggatgtcatagttattgtcatgaaacaaagcattttttaaaaagctaacatggggccgggcgaggtggctcactcctgtaaatcctagcactttgggaggctgaggcaggtggatcacttgaggtcagaagtttgagaccagcctggccaacatggtgaaaccctgtctgtactaaaaatacaaaaattagccgggtatgatgacacacgcctgtaatcccagctactagggaggctgaggcacaagaatcacttgaacctgggaggcagaaattgcagtgagctgagatcacgccactgtactccagcctgggcaacagagtgagactctttctcaaaaaacaaaacaaaaca

SEQ ID NO: 87772 - DNA, 439 bp, Homo sapiens
tccatctcaaaaaaaaaaagaaaaaagaaaacaacgggcttatttacagcaggagctgtggtgcccttgggggatgtgtgagctccagggatgacagcaaccaccatctgttcatctcagcacttgggagacaagccctgtaggattcattcagtaaaaataaaatcctacgaagtgaatttgtaggcttggggaagtgtggacaatgcagtttgggcatcacctacgtacaagcagaattcgcaggaacagctcctgggcattgggatgaaacatggcccctgccatctgcttcttggtgtcaggccggcctcctgcttcccgcctttgttgccagcgtggaggaagcagaggtcagggaggcagtcactgcttgtccctgacacgggactcagtctccagacaaggcggctgctctcagtgtcctgtctcatgactc

SEQ ID NO: 87773 - DNA, 961 bp, Homo sapiens
agaattcttgccatgtggatgaactcattcaaacacaatgactgctttatgagacaatagatagatttctacctcttctcacatgtacagagaaaatatttccaaagtctccggaatatttacatgtattactatttaatataaacttgcaagtctttttaaatgtgtttaaaactatcacagtactaaacatgaactagatgcataataaatgctgaaagtaaaaagcctgaattatttaagtgaaaagagaaaaagatttagatcccaaataaatgtatgcgtttgtgtgtttgtgtgtgtgcgcgcatgtttgctgggcatgtacttgtaaaaagtaaaataatagaaaagtattattcttggtacccagcattctaggaataatgtcttccacaagattattagaaaactctgctactttgtaggaggagctttggataactatgaataagtccctttacagacttaactttaaaaaaccatctgatttttctttattttctttatttttattgtaaattgacatattttacttgcatacatttatgaggtatcaggtgttgttatgatttatgactactatgtggaataattaaatgaaactaattaacgtattcaaatgataataaatataacagataacaggtaacaaatatttttttatggtgagaatatttgaaagttactttttcagcaattttgtaatgtacaatacactattattaaccatattcacaatgctgttcaatagatctcagaaaagcagaacaaaacttattcctcttgtctaactgaggttctgtaaactttcaccatcatctccccatttttctccacccaaacacggaagtatgtaaaaattctcagtgcttacaaagtttcatataccaatttttgtaatgatacttccccagaactcaatttgacagactgaagtatgtagataagacaaaaaaaa

SEQ ID NO: 87774 - DNA, 507 bp, Homo sapiens
ataacatacaccctgtctagggacactcttcaaataattggaacatataaaaacaaaataaagtactgaaacgatactgagcatagtcaaatgagacaattggatctttgatggtttcccgagccctttcattattacaaatgtgttatttcatgcactaccatttaatcaaatgtaccattgactttaataaatggtataacactaattttcagaacatcagtaaaaatgtaggtcattgtattataattattgttcagattttaaaactcaggacccattacgtctgtttaatatcagtatttttgtgaaaatcatcctgagagtgcacttatgttcttttgtattatctttgctttattattttatctttggtttcccaactttgaaagaagatgttacaatttacaatcagattgttattccagggggagatataacaattctggttttattttttggcattctctcctgtaacttcatttcatcatctaagaaaacacattt

SEQ ID NO: 87775 - DNA, 460 bp, Homo sapiens
agctaatttttttacatagtgagaaaaacagttgttcaagtctctaatttttgacttaatacaaaatagctttattctcattatcagcatctgccttcagtctattgcaatatgttgtttcagttgaacaatatgaaggaaatgcagccaggcacaaacatgcagttggaaagagtgttttaatagtcttttcagatatgtgtagctattttttgatattacactaaaactaggtaagtagtagtttcttgaacgtttgtagcaatgtgagatctgaaaccctaacaatgaacttttcattactttgttaacattaaaatgcattggtcaggctgggtgtggtagctcacacctgtaatcccagcactttgggagatcgaggtgggcagtcacctgaggtcaggagtttgagaccagcctggccaacatggtgaaaccctgtctctactaaaaaaaaaaa

SEQ ID NO: 87776 - DNA, 251 bp, Homo sapiens
aaatgatagtctaaaaaattaaattacatgaaaaaaagcacgaagagaggaacagagaagcaaaaaatagatgagataaacagaaaacaagtagtgaaaatggaaatcctaaatttaatcatcttagtagttacattaattataagtgaattaaacacttaaaaagcaaaaattttcagaatatataaaattgaaaacacaacaaaaccagtcctcactgatttctatatattaatggtttataatatata

SEQ ID NO: 87777 - DNA, 526 bp, Homo sapiens
ccttatttctcagttgccctgatgcattccatccatcatataaaataaataatttaaatgaaaagttaattgaacgcttagagcactaaaagtcattctaagttcttctttcagagaattaaagatgcaaaaggaaaaactaatttcaacattatgcattcaaagaaatctaaattgtaacaaattatttatgtatatatttagtctctatttcctgttcaaatacttcaaatacatttataaccatttggaactgttattaccaatattttaagatgttacacgatccaataggaaatattaactgttttattgttaaagagtcatattaaaataatgccatgacatatgtgttatcaattaggcaatgagctaccagtcaatatgttttgccttataaagaattttagccaagataaagcttgtttgtttgacttagaaagccaaagttgaacctgtgtgataactctttgatcacatgtaataactgaagcataagaaaattggtttttagtataatcaccaa

SEQ ID NO: 87778 - DNA, 323 bp, Homo sapiens
tgaattctttttcctcagcgggcaccaagagtgagaaaacagcacataccgaaaggttttgaggtggagaagagggcagttatagttctgctgagaagaagagaaatagaagtggggttgagaagttggatggtctttggagactgtagaaaggagacaaccaaaagcattgtgcagtagtagtaacaacctgaatcattagcaggtacaggccttgaatctagcaccaaagtgtccaaaaatggctcccagaacctgtggctcagcaaagtgagactgcagagaatctggcatttttaaaagatttaaggagaagaggtatc

SEQ ID NO: 87779 - DNA, 407 bp, Homo sapiens
gtttccccaatgggcgtattactatctgggattacaggcaggaaccatggtccaaagtgactttaaacaagtgccccagggtaagggtggtatggatatgtcactgaagtcctctactcgagtcttcctgggcctgatcacttttgcatacaccacaaagcttagactgctcagagctagttttcttctcacattatatagcactgagttcatacatttgcccttaggtgaaaatagctttgtttcttaacacttttcttcctagccaacctggttcctccctcctcccctttctaccccacaaataacggaaatttgactgtggccaaatctctttcctcgttgctgtgcctcttttttcataataactcacatacattggctaattcagctgctgaggcctggcc

SEQ ID NO: 87780 - DNA, 268 bp, Homo sapiens
atccctggagcctccccttccctacagcagtgtgcacacaccccatccactccccttgagcactaagctccctaatttatggtgctggcagacctgagacagtaaagcaggggatactgccaagaccacagatgggccagaaaacaggtcagtacaagtgggacagtcaggaaagcagctgctgacagcaggccctggacgtggtgcaggtaacacgtgtttctgggtaggcccatgggaagagagtaaactgctgatcacagatcag

SEQ ID NO: 87781 - DNA, 310 bp, Homo sapiens
tgggacactatccacaaaataaggaagcatagaaatcactgtccctaaaaggcatatttaacatggtgaccaacaactcattctgacctgcctctccaagcagtccaacccaggttttatcaagtggtgccagtgctaacgtcttgtgggtggaactggcactgaatgtaaagaaaatcatagccaggcatggtggctcatgcctataatcccaacactttgggaggctgaggcgggaagctcacttgagctcaggagttcgagaccagcctgggcaacatcaacaccgtccttacaaaaaatgtaaaaa

SEQ ID NO: 87782 - DNA, 385 bp, Homo sapiens
ttaaaataaatccaactacgtagagtgaagcaacaggtgtatcaggatctgagagactccaaatttcgtgggcaagacactacaccactgtcctctaaatactacgaggtatttgcacaccagtggaaagaaatctttttaaatggagagctaagccaagggaaaaaataaatggagactaaatttttttaatattgtattttaaaattaggaaatgcaataacacatctgtggttaaatgttgtttattattttctcattattaaagagtctctctgtttttttgaaaaaaaaatttggttaaaacttcaaaaattgtgtaaccggcaaatgttacagtctctgaatataatactgctatagtgagcaaattttgttcttgaat

SEQ ID NO: 87783 - DNA, 794 bp, Homo sapiens
caaaacacagtggctttactcagatcttttaaacagctacaaaagtgaaaaagctgaggatggagtggaaaaagagaaaggatactttgttttagggacctgttttatttatttatttttttgtatccattgatcacaggacatcagtggctgcttcagggacttgggttagtagtctccagggtttactttactctgtatctagggcaaacctgacagtctggagtagagcaagaaaaatatgtaatacagtcaactagattatttaaaaagccacctttctgttattcttatggggttgaggaaattgtttctctatatgagtataaaatttatcaccaatgttcaaggctttaaagcagagttgaaggcaacctgagaatcactcagtattctttcttcccttacgttttatatctgctactgaattattagtgatggctcactgtgcttccagtgagggcagagggtgttgggctcctcctaaacagggagaaaaaagaacaacaaggatatatatttgtttcatgctgcctactggttttgaatgttttaggctatttaattggaagaagaaggaattgttaaagttactttaaaactctacaattgcttgattaacaaggaggagaaaaactattggataaaacatacagttatttaaataaggtttagcaattcagcaacatctatcaaaatctttattattttcatgtttaaaaaatactttaggctgggcgtagtggctcaggcctgtaatcccagaactttgggaggccgaggcgggtggatcc

SEQ ID NO: 87784 - DNA, 1088 bp, Homo sapiens
tatataaataagtaaacatagtatttgtacttcaggatcatttttaaaaaccttgccataaatatttgaggcatttttttttctctgtgtgatgcatagaaaatatccagatattttctatgtcagtttgttggtaagtatagttattatggcctaatgttttgcgttgatatgaaatcacctacttatataaagtaaacctgagtaaaatcctcttaaatgagatgttagagtcaccattggaacaaatagtgttgaaaattgtcttaacactagattaactgttatttggtatattgttttttaaaatgtgagtaatttttatgattaatacattgtgactggtagataagtgtttagtctaacatttttaagtgtagccatgtttgatgcccccctcaccatttgtgtatattttatttcaaaagcttgtactttcatagaaaactttaagatttagaagaggctgttgtggcctggtgtgatggctcatgcctgtaatcccagcactatgggaggctgaggagggaggatcgcttgagcccagaactttgagaccagcctgggaaacatagtgcgataccatctctgttaaaaaaaaatttaaaaaagaggttgttgatcattaagatggcatagtgatataggtaaagggtttttttgtttgcttagcaaaatattttcttagttttatttcttagggaggctgaggtaagaatctgaatgtggaaaattgaagaaaaggtttaaatattggtagaatttagggcctaaataattcgagaaagaattatatattagaacattaacattgaatggagtagagctacacatttatagggaataacaccttctgcttataagcaaattcattgctgacgtgtataaatggcattaggttggttgtactgttcacattattttatataggagatgaaataaaaattccctaaaataaaactagggttttcttaggaaagaggaagtggggaatggatcttagtgggtcatgaacgagtgtcctcttctgcagtgggaccctgtctctgcagaaaagaaaagcagtagttgggcatggttggtgttcg

SEQ ID NO: 87785 - DNA, 502 bp, Homo sapiens
ttaaaatattcaggaaaccatgctgcacacacatatgtggtcatccagacttcagtgttccatttatagagcagaggcagagtagatttagcataattcttaagggctctggcttttttggaatagtaaatgagcactggcttcaatttaaagtcactaggtacattatctcctaacaagagagtcaacctgccctttgaggctttgaaacagtgaagccaggcattcacttcccctctccagccttgagtcctagatggcatcttctcccaacagaaggctattttgtctacactgacaatctgttgtttggtgtagccaccttcattaattatcttagctagatcttctggataacttggtgcaccttctacatcagcacctgctgcttcaccttgcacttttatgtttcggagatctttcctcaagcttcatgaatgaacttctactaactttccaacttttcttctgcagcttcctcacctctctccaccttcataga

SEQ ID NO: 87786 - DNA, 424 bp, Homo sapiens
cgagaccccattttccaccaaaagggaaaaaaaaattctcatctaagaaaggcagatactagtttactcacctaaggtggctggaataagaaatgtacatttcatgcctggcacatagtaaggactgaattaaggtcaaatggtaaggactgaatcaaggtcaattgccttctgctctcttccctaatgcgctcagacaaactgatgctctgcttcctcaaagtggtaaggtgggattttctctgcatttccctgagttgaactggacaagacccatcatcctatgctttgacgttagaccagactggcgggcagacaggggacgggtgatgtagtacggagggggaaacagtgaacggcaactaaacaaacttgcgtgactgtgtcaacaccttcctgtggctcattgccccattccctatca

SEQ ID NO: 87787 - DNA, 386 bp, Homo sapiens
ccacctcagcctccagagtagctgggactacagatgtatgccaccacatccggctagttttgcattttgttggtagagatgtagtttcaccatgatgcccaggctggtctcaaactcttgggctcaggccatcctctcaccttgtcttcccaaagtactgggattacaagcgtagccattgtacctggctgccctacctgcttgttgaagcccaacatctagacctttccagctttccatacttaattctctccattctttaactcaaattctcttttccagtcaggcctgtttcttttatgccagtcatcacatgtccattcccatctcgtgccttgattttccacattcagttttcttcgcatttcctttaccagttgtattag

SEQ ID NO: 87788 - DNA, 529 bp, Homo sapiens
atcagcaatcctgcttccctctgcatttaccgtgtcatggcacagcagatacgtctgcagcatctgcaacgttgtgtgaatcataacaaacttcccaaatgcaacctgaccccaggcccctcactgtgcttcccgttaacttttacttcacctccgaaagaccttcctgggaaatgtggttttaaaggtgttggaagaatttgtcatcggggacctctttagtttcagaacccaagtgaagtaaccaaggcaggaaatacatctgttccacagcactgggttgccccactgggtacacagccctccaactccaggggaactttcacacaccagcatcctatatcatagccatctgccccaataaatccgacacctatcactagttaaaacccatgatatccaggaatgcaatgcttgattcatttgctactgatgaggctaggaatcagaagacctgccttctgttttccacttcattacattcaagagcaattaagaaaagtgattttgtcatcatgctcttggcaat

SEQ ID NO: 87789 - DNA, 393 bp, Homo sapiens
tcagtttcatctgcaaataagaatatggcaaataaaacaagaaacttcataaatagattgggtgttaggactaatggtggaatcctaattagggaaaaggagtcaggctggtgggagcaggggagcataaaaagaaaaaacagataaactgtaagtctgcctttcttcacagtccaggacacatagccctcctgtgcaaaaatctcacagtcctcctgtgcaaaaaactcacagtcttcctatacgcaacttatcaccagaccctctgctaatagaaaagtgcaggttagctcactgcaaccttggcgttaccagtactgcacatagccctctccagcacaagaacgatcctataaaatccccaccaagccttagtctcttttcagtcagctc

SEQ ID NO: 87790 - DNA, 419 bp, Homo sapiens
ttaaaccttgtagaatctgtaagcattcacaatccccttgacttgtagtgcctgattgtaaaaagaacagttgaatgagctcattgttttctggtttttttctttaatgtattttacaaacactctggtgacaggcctgacatgctgatttctatgtactggcacttcagtttgggattacagcattaataacagagttccatgcatcatgccatttttaagcatgatcgttatgataaagggcatatacttaattacaggcctgcttaataacagctctgttgaagctcgtttgtttaggagaatgctaattgcgccacagagccagcggcacatccttgctttcatctgctggaggtagctcgatgctgtggatcagcattttgttaaaactgccaccaaaaataaaaaaaaaattt

SEQ ID NO: 87791 - DNA, 1288 bp, Homo sapiens
cggctggccgagctcaatcagttccatctccgtgggcatgtaacccatagtcctcatgagattccccagatccttacaagagatgaacccatctcggtccttatcgaactcaagaaatgcttcccgcagctcttcaatctcatcttgtcccagtggtctttcccgctgtttctcagcaatgcctttcctcaagaagatgcaggcggggcccatggggaactgcatggaggggtggggtggagctcgcagggcaccagtctcaagatggcccctcctccctgctccctgtcggagctcagcctccttatcttctccagcactcctttgccacctcttcctgcctctcttggcttctccttcggtcccggtgtcttagagctgtgacagctgggctggaaatccgcatgaacttgggtggccgtgtagactttgatgactttgtggagctgatgacccccaaattgcttgcagaaacagctgggatgatcggtgtccaggagatgcgggatgccttcaaggagtttgacacgaatggagatggggagatcaccctggtggagctacagcaggccatgcagagactcctgggggagcggctcaccccccgggagatctctgaggttgtccgggaggctgatgttaatggagacggcacagttgactttgaagagtttgtgaagatgatgtctcgctgaggaggtcctggaagctccagaccctctccacctggtcaacatggagcaagcgcttgtggagaaccaaagcccaaaagccccagatccccttaaagcagagagggagggcaggcgggagggagggcattggcatgcggcgctgtgcatggggtgagacccagagcggtatctttgccaggatgggggcgtctgcagaactaggttaagaaggaagagtctgtggatggaaataggaagcgtgggagggtccagttgccacccccaaaaattccaatgattcttgacatcttttcacttcacgtagtcctaagtccctgtgacctgccagagtctcttccccagcttccccttgggtgaaaatagtctcttctcctgttgggtatcaaaaggttcagaacgtagtctctactcttcccctgcctgcatcaactgttgcaaatcccgtttctctctcccggtaaggggacaaattatactttattcaggtgatggttacatgaacagcccagacttcaccactacgcaatatatccatgtaacaaaaccgcacttgtactccctaaatctatagaaatacaaaatgaaataaaacg

SEQ ID NO: 87792 - DNA, 344 bp, Homo sapiens
gaggtagctctattaaacatgccaacttgacagatgagaaactgaggcacagggttaagtaacttgccacagagatctgattcccatttcatagatggagaaatggaagcatagagggattaagtaatttcccagggatcaccagcagtgcctgccacataggaagggctcaaaaaataatgttgggggcttttacaacgagatgccttactggggattttttttttctttgcagagtttgtgaagatgatgtctcgctgaggaggtcctggaagctccagaccctctccacctggtcaacatggagcaagcgcttgtggagaaccaaagcccaaaagccccag

SEQ ID NO: 87793 - DNA, 343 bp, Homo sapiens
aaattccaatgattcttgacatcttttcacttcacgtagtcctaagtccctgtgacctgccagagtctcttccccagcttccccttgggtgaaaatagtctcttctcctgttgggtatcaaaaggttcagaacgtagtctctactcttcccctgcctgcatcaactgttgcaaatcccgtttctctctcccggtaaggggacaaattatactttattcaggtgatggttacatgaacagcccagacttcaccactacgcaatatatccatgtaacaaaaccgcacttgtactccctaaatctatagaaatacaaaatgaaataaaacggatgcaaatcagtca

SEQ ID NO: 87794 - DNA, 1247 bp, Homo sapiens
ggagaagccaagagaggcaggaagaggtggcaaaggagtgctggagaagataaggaggctgagctccgacagggagcagggaggaggggccatcttgagactggtgccctgcgagctccaccccacccctccatgcagttccccatgggccccgcctgcatcttcttgaggaaaggcattgctgagaaacagcgggaaagaccactgggacaagatgagattgaagagctgcgggaagcatttcttgagttcgataaggaccgagatgggttcatctcttgtaaggatctggggaatctcatgaggacgatgggttacatgcccacggagatggaactgattgagctcggccagcaaatccgcatgaacttgggtggccgtgtagactttgatgactttgtggagctgatgacccccaaattgcttgcagaaacagctgggatgatcggtgtccaggagatgcgggatgccttcaaggagtttgacacgaatggagatggggagatcaccctggtggagctacagcaggccatgcagagactcctgggggagcggctcaccccccgggagatctctgaggttgtccgggaggctgatgttaatggagacggcacagttgactttgaagagtttgtgaagatgatgtctcgctgaggaggtcctggaagctccagaccctctccacctggtcaacatggagcaagcgcttgtggagaaccaaagcccaaaagccccagatccccttaaagcagagagggagggcaggcgggagggagggcattggcatgcggcgctgtgcatggggtgagacccagagcggtatctttgccaggatgggggcgtctgcagaactaggttaagaaggaagagtctgtggatggaaataggaagcgtgggagggtccagttgccacccccaaaaattccaatgattcttgacatcttttcacttcacgtagtcctaagtccctgtgacctgccagagtctcttccccagcttccccttgggtgaaaatagtctcttctcctgttgggtatcaaaaggttcagaacgtagtctctactcttcccctgcctgcatcaactgttgcaaatcccgtttctctctcccggtaaggggacaaattatactttattcaggtgatggttacatgaacagcccagacttcaccactacgcaatatatccatgtaacaaaaccgcacttgtactccctaaatctatagaaatacaaaatgaaataaaacg

SEQ ID NO: 87795 - DNA, 690 bp, Homo sapiens
caataatactgttaattttttagatagcatgtcaaatttagggcaaatgatgctaaaaatatgttaaaatagtccctagtctctgctcttataaaaaaatgatcatagcagttctttcttaccatcaaagcagatggctctaatgatttttcaagccatagttaattcatttgcaaacaacagagatcagttggcaaatgtgtactgagagtgagacattactgttcataaatgctcccaaagtttgttttgtcctgtcattactggaaaatggtgtttacctaagttaaattatttgtgtgaaccattcctgagacagtgctgcagttataataaattacctgtaaagtaagtgaacatcacttggttaatgtggtcgtggtggtgcaattgacctcatggagtaagtgagtgcatctgtgttctttaaattaaaattttataaaagaaacatcatgtctttttctattttggaaatatatttacttggatatgtttagtgtctcctccaagacacagaaagtagtatatgtattatcaataattttgaattagaaatgttatcatataattaataaaagttatttaatagtacaaatatcaaataagagattattgaaaacttctagcacatgtcattcaggataaagccaaataagctaattcattaaaggttttgaaacatactaa

SEQ ID NO: 87796 - DNA, 395 bp, Homo sapiens
gaccatctaccccattgagccctggggcattccagtatttaaaggacagaaagataagaagttttcagcaaagagaatgtgaaattgtggccaacaaagtaagagaaggataagctctgagcactttagccttcaccttactctatttcctatatgtagaattattatatattccccctgttgcttttctaggcagaccagagcaatgctaaaaggtctgtctatggggaggagaagggaggatgaagagaagtgggttaaagggtacaaacattgtaagatgcaaggaataaattcaatatttgataccagagtggggtaactatgcttaacaaaaatactctggtgaccaacaccctaaatatcctggcttgatcactacacattatatacat

SEQ ID NO: 87797 - DNA, 204 bp, Homo sapiens
ggtggaccaagaaatagtgtgttttagaagccaacagaaagagcggccttcagaagtagtcagtcaatttgtggtcccatggccaactggaggaaacataaaataggcaatggactcgataggtcattggtgagtttgagagaacagtgttgtcagcatggggtgaggtggtccactggaagttcaaaagaattgtggcatacg

SEQ ID NO: 87798 - DNA, 338 bp, Homo sapiens
ttgttctcccaatttagggtcagaaaaatctcataacatctccttctccaaggctgtccctttagcccctttgttgtgctctcatccttgctccaaactctgctagtcttctgtgtgcactgtgattgctgtttgccctggatcacaaattacttctatgtgtaaacacagctcagggtgtggtgggcaactttagacatgggaaacctgcgtcctgttgttctctctgcctggcctctttctcttctcagtcccataatttctcttctttctcttatttctcctttgctgatattttaggcctcccagtggtgtcaaaaagcattgcatacaacctt

SEQ ID NO: 87799 - DNA, 694 bp, Homo sapiens
agacgcccctctcggaacctcagtgactcgccgataatcgaggacctgccaataacgcgatgaggtagcattttcacccatcaaaaaggcatttttctttggcagtgataatgcccaaatattcccttttgtcggagaagggacaccatcgtattctactggaattgtaagaaagaattaaggaaattctctgcagtttcaaagttattgctatagctcgcaacgttattagtaattgtgagtaaagtggaattaaccaaaatggccaacatcaggaaatttgttgtgtatcttgtggtacatccaaatgccatgcagccgtttaaaataattctgcaggtgaatatttattaatgagatgttgcgactatttgttaggagacatagttacaaaacagtatatatccgttttttcaaaaataattctttaaaggtctgcaagatgtatactgattgtgatctttccctccttatttttgcttagctttatttaataaagcttttctacaataaacaaatgtttttgtaataaagtttttactttttaaaagttgtcaccaggctgttctgcctatggagtagtcattctttgttcctttactttcctaataaacttcctttcacttaaaaaaaaattatcaccagatttgagacagtgctcaaaaattgtctccattgtcacaatggagacatt

SEQ ID NO: 87800 - DNA, 2023 bp, Homo sapiens
tgctcccggcccatgcggcccccgcgggctcccggccccggcttcagaactcagccctgcacctgagcgcggggcccggcggggcgtggcggcggcgatggggaaactgcagtcgaagcacgccgccgccgcccgcaagcggagagagagcccggaaggggacagcttcgtggcgtccgcgtacgcgagcggccgcaaaggcgcggaggaagcggagcggcgcgcgcgggacaagcaggagctgcccaatggggaccccaaggaggggcctttccgggaggaccagtgtcccctacaggtggcactccccgctgagaaagctgagggccgcgagcacccgggacaactcctcagcgcagatgacggagagagggcagcaaaccgcgagggcccgcgaggaccgggcgggcagcgcctcaacattgacgcactccagtgcgatgtctcggtggaggaggacgaccgccaggagtggacgttcacgctctatgactttgacaactgcgggaaggtcaccagggaggacatgtccagcctcatgcacaccatctatgaggtcgtggatgcctcggtcaaccactcctcgggcagcagcaagaccctccgtgtgaagctaaccgtcagccctgagccctccagcaagaggaaggagggtcctcctgctggccaggaccgggagcccacccgttgcaggatggagggtgaactggcagaggagccaagggtggctgacaggaggttgtctgcacacgtcaggaggcccagtactgacccccagccctgctcggagcgggggccctactgcgtggacgagaacacggagcgcagaaaccactacctggacctcgccgggattgagaactacacgtccagattcggccctgggtcccctcctgtgcaagcaaagcaggagccccagggcagggcctcgcacctccaggcccggtcccgctcccaggagccagatacacatgccgtacaccaccgcaggtcacaggtgctggtggaacacgtcgtgccagcctcggagcctgctgcccgggccctggacacgcagccccggccgaaggggccggagaagcagttcctcaagtcccccaagggctccgggaagccgcctggggtgccagccagcagcaagtccgggaaagccttcagctactacctgccggccgtcctgccgccccaggcccctcaggacggccaccacctcccgcagcccccaccgccaccctacggccacaagcggtaccgccaaaagggcagggagggccactcgccactcaaggccccacacgctcagcctgccacagtggagcacgaggtggtgcgggacctgccgcccacgccagcaggagagggctacgcggtgccagtgatccagcggcacgagcaccaccaccaccacgagcaccaccaccaccaccaccaccaccacttccacccgtcctagcgccactgccaagcacacctcgctcccagcacaccacggcccgcgacctcagggcagggagcagagcagctgccggctgtgtgcccatggggagcccagcccccaccccccacctccgacagcaaacagcaactgactgcaggtgctggcatgatggaggtggtgcaccttggacacgtggacaaggcccaggcgccctctgctcttctgccctcgatgccacatggcggtgaacacatctgaagccactatgtttcctggctctaaggctcgtctgtgtaacccataaaacctgctttgattccaaaatgaggccctggagtgcgcaaggagtgcccggatgcttggggtgggtgttcctcccggggcttcaaggggtgactgctgtaggctgtcccagtgcgaggccgggagcgaatggaaaagctgaggctttgcctggcttgtgcatcatgaagtgagaggggacagggccggtggggggaagcagcttgtgcttagcagggagcatccgcggctccccgcaggaggccaagcagcagaaggcagcagtgctagaaagagaagtgc

SEQ ID NO: 87801 - DNA, 308 bp, Homo sapiens
gaggatctttgcaatcctactcctggtttcccgctgccggcggtcatgggaataacgccgccgagcgcctcaacattgacgtgggtctctctccggcctcacttgcgggaacacgtccctggggccgggggctcagggacaggcatgtgttgccctaaactgggcatctgtggacacggcgtagttcactcagtcttccccacagttcaccccgtttaaggcattgaagcagaacttgaatgtgcaagccaaagtcagcaggagccagagagtgcaggatgttgctgtgaatttggccaaaactgact

SEQ ID NO: 87802 - DNA, 1758 bp, Homo sapiens
tgctcccggcccatgcggcccccgcgggctcccggccccggcttcagaactcagccctgcacctgagcgcggggcccggcggggcgtggcggcggcgatggggaaactgcagtcgaagcacgccgccgccgcccgcaagcggagagagagcccggaaggggacagcttcgtggcgtccgcgtacgcgagcggccgcaaaggcgcggaggaagcggagcggcgcgcgcgggacaagcaggagctgcccaatggggaccccaaggaggggcctttccgggaggaccagtgtcccctacaggtggcactccccgctgagaaagctgagggccgcgagcacccgggacaactcctcagcgcagatgacggagagagggcagcaaaccgcgagggcccgcgaggaccgggcgggcagcgcctcaacattgacgcactccagtgcgatgtctcggtggaggaggacgaccgccaggagtggacgttcacgctctatgactttgacaactgcgggaaggtcaccagggaggacatgtccagcctcatgcacaccatctatgaggtcgtggatgcctcggtcaaccactcctcgggcagcagcaagaccctccgtgtgaagctaaccgtcagccctgagccctccagcaagaggaaggagggtcctcctgctggccaggaccgggagcccacccgttgcaggatggagggtgaactggcagaggagccaagggtggctgacaggaggttgtctgcacacgtcaggaggcccagtactgacccccagccctgctcggagcgggggccctactgcgtggacgagaacacggagcgcagaaaccactacctggacctcgccgggattgagaactacacgtccagattcggccctgggtcccctcctgtgcaagcaaagcaggagccccagggcagggcctcgcacctccaggcccggtcccgctcccaggagccagatacacatgccgtacaccaccgcaggtcacaggtgctggtggaacacgtcgtgccagcctcggagcctgctgcccgggccctggacacgcagccccggccgaaggggccggagaagcagttcctcaagtcccccaagggctccgggaagccgcctggggtgccagccagcagcaagtccgggaaagccttcagctactacctgccggccgtcctgccgccccaggcccctcaggacggccaccacctcccgcagcccccaccgccaccctacggccacaagcggtaccgccaaaagggcagggagggccactcgccactcaaggccccacacgctcagcctgccacagtggagcacgaggtggtgcgggacctgccgcccacgccagcaggagagggctacgcggtgccagtgatccagcggcacgagcaccaccaccaccacgagcaccaccaccaccaccaccaccaccacttccacccgtcctagcgccactgccaagcacacctcgctcccagcacaccacggcccgcgacctcagggcagggagcagagcagctgccggctgtgtgcccatggggagcccagcccccaccccccacctccgacagcaaacagcaactgactgcaggtgctggcatgatggaggtggtgcaccttggacacgtggacaaggcccaggcgccctctgctcttctgccctcgatgccacatggcggtgaacacatctgaagccactatgtttcctggctctaaggctcgtctgtgtaacccataaaacctgctttgattcc

SEQ ID NO: 87803 - DNA, 1915 bp, Homo sapiens
agcgtcagagggagccgggccgccgtcgctgccgccggtgtccccgggccctgcgcccgttgctggcttgagggacccctgggaaaggccccagaagatccttccccctgtggagttgggcgtgttggcgtgggtaggaggcgaggtcccggcccccacgtccccccacaggcactccagtgcgatgtctcggtggaggaggacgaccgccaggagtggacgttcacgctctatgactttgacaactgcgggaaggtcaccagggaggacatgtccagcctcatgcacaccatctatgaggtcgtggatgcctcggtcaaccactcctcgggcagcagcaagaccctccgtgtgaagctaaccgtcagccctgagccctccagcaagaggaaggagggtcctcctgctggccaggaccgggagcccacccgttgcaggatggagggtgaactggcagaggagccaagggtggctgacaggaggttgtctgcacacgtcaggcgtccactctccttcctgctctgcgaggaggtgggtgctggtccaggatgcaccccggacccctgccgcctgctgtaggcaccccgtcatcaggggtgcgccacccagtctgtgcgggggtcaggcccttctctgtgctccaagcaggaggcccagtactgacccccagccctgctcggagcgggggccctactgcgtggacgagaacacggagcgcagaaaccactacctggacctcgccgggattgagaactacacgtccagattcggccctgggtcccctcctgtgcaagcaaagcaggagccccagggcagggcctcgcacctccaggcccggtcccgctcccaggagccagatacacatgccgtacaccaccgcaggtcacaggtgctggtggaacacgtcgtgccagcctcggagcctgctgcccgggccctggacacgcagccccggccgaaggggccggagaagcagttcctcaagtcccccaagggctccgggaagccgcctggggtgccagccagcagcaagtccgggaaagccttcagctactacctgccggccgtcctgccgccccaggcccctcaggacggccaccacctcccgcagcccccaccgccaccctacggccacaagcggtaccgccaaaagggcagggagggccactcgccactcaaggccccacacgctcagcctgccacagtggagcacgaggtggtgcgggacctgccgcccacgccagcaggagagggctacgcggtgccagtgatccagcggcacgagcaccaccaccaccacgagcaccaccaccaccaccaccaccaccacttccacccgtcctagcgccactgccaagcacacctcgctcccagcacaccacggcccgcgacctcagggcagggagcagagcagctgccggctgtgtgcccatggggagcccagcccccaccccccacctccgacagcaaacagcaactgactgcaggtgctggcatgatggaggtggtgcaccttggacacgtggacaaggcccaggcgccctctgctcttctgccctcgatgccacatggcggtgaacacatctgaagccactatgtttcctggctctaaggctcgtctgtgtaacccataaaacctgctttgattccaaaatgaggccctggagtgcgcaaggagtgcccggatgcttggggtgggtgttcctcccggggcttcaaggggtgactgctgtaggctgtcccagtgcgaggccgggagcgaatggaaaagctgaggctttgcctggcttgtgcatcatgaagtgagaggggacagggccggtggggggaagcagcttgtgcttagcagggagcatccgcggctccccgcaggaggccaagcagcagaaggcagcagtgctagaaagagaagtgc

SEQ ID NO: 87804 - DNA, 428 bp, Homo sapiens
gcggccgcaaaggcgcggaggaagcggagcggcgcgcgcgggacaagcaggtaggcggcggggcggaggctggggtcgcgctgcgcacccgcccgggggcggggagcggtgtcagagctgttcctggtgcccgcccgcggacaggcgagacgtgggccgccatggccgcacgagtgaccgggggccaggagagccagtctctccccagcctccacgacgtctggggctcccgtggggcgagcccttgctagtgtcccatgctgagtggcgggtaggggaatcggaattccttgtcctaggctgggagccgtgtgggggctccatgtttcgggctggaggagctgggcgagtgggaggggctggacctagacgtcccgggctgggggtcccggggagcgggaatgcagtaccccggctggatgagctgg

SEQ ID NO: 87805 - DNA, 1937 bp, Homo sapiens
tgctcccggcccatgcggcccccgcgggctcccggccccggcttcagaactcagccctgcacctgagcgcggggcccggcggggcgtggcggcggcgatggggaaactgcagtcgaagcacgccgccgccgcccgcaagcggagagagagcccggaaggggacagcttcgtggcgtccgcgtacgcgagcggccgcaaaggcgcggaggaagcggagcggcgcgcgcgggacaagcaggagctgcccaatggggaccccaaggaggggcctttccgggaggaccagtgtcccctacaggtggcactccccgctgagaaagctgagggccgcgagcacccgggacaactcctcagcgcagatgacggagagagggcagcaaaccgcgagggcccgcgaggaccgggcgggcagcgcctcaacattgacgcactccagtgcgatgtctcggtggaggaggacgaccgccaggagtggacgttcacgctctatgactttgacaactgcgggaaggtcaccagggaggacatgtccagcctcatgcacaccatctatgaggtcgtggatgcctcggtcaaccactcctcgggcagcagcaagaccctccgtgtgaagctaaccgtcagccctgagccctccagcaagaggaaggagggtcctcctgctggccaggaccgggagcccacccgttgcaggatggagggtgaactggcagaggagccaagggtggctgacaggaggttgtctgcacacgtcaggaggcccagtactgacccccagccctgctcggagcgggggccctactgcgtggacgagaacacggagcgcagaaaccactacctggacctcgccgggattgagaactacacgtccagattcggccctgggtctcagctgtgcgagaagagaagctccgctcccaggacacacagtggggacaaggctagaggagtcggcctttgcagggagctgtggagccaggcaggtcacccacagtggccaggccccttcccttcagggctggtggccgtctgactgcagacttggctaacagactggcctcagggtcccctcctgtgcaagcaaagcaggagccccagggcagggcctcgcacctccaggcccggtcccgctcccaggagccagatacacatgccgtacaccaccgcaggtcacaggtgctggtggaacacgtcgtgccagcctcggagcctgctgcccgggccctggacacgcagccccggccgaaggggccggagaagcagttcctcaagtcccccaagggctccgggaagccgcctggggtgccagccagcagcaagtccgggaaagccttcagctactacctgccggccgtcctgccgccccaggcccctcaggacggccaccacctcccgcagcccccaccgccaccctacggccacaagcggtaccgccaaaagggcagggagggccactcgccactcaaggccccacacgctcagcctgccacagtggagcacgaggtggtgcgggacctgccgcccacgccagcaggagagggctacgcggtgccagtgatccagcggcacgagcaccaccaccaccacgagcaccaccaccaccaccaccaccaccacttccacccgtcctagcgccactgccaagcacacctcgctcccagcacaccacggcccgcgacctcagggcagggagcagagcagctgccggctgtgtgcccatggggagcccagcccccaccccccacctccgacagcaaacagcaactgactgcaggtgctggcatgatggaggtggtgcaccttggacacgtggacaaggcccaggcgccctctgctcttctgccctcgatgccacatggcggtgaacacatctgaagccactatgtttcctggctctaaggctcgtctgtgtaacccataaaacctgctttgattcc

SEQ ID NO: 87806 - DNA, 1566 bp, Homo sapiens
ggggaaccgaatcacagggcacaaagctgggtccccccaagaagggctggagctgggcaagaaggggtctgctggttcagggcttgagctccagccacgctgccctctaggctccgcctttcctagctggcttgagggacccctgggaaaggccccagaagatccttccccctgtggagttgggcgtgttggcgtgggtaggaggcgaggtcccggcccccacgtccccccacaggcactccagtgcgatgtctcggtggaggaggacgaccgccaggagtggacgttcacgctctatgactttgacaactgcgggaaggtcaccagggaggacatgtccagcctcatgcacaccatctatgaggtcgtggatgcctcggtcaaccactcctcgggcagcagcaagaccctccgtgtgaagctaaccgtcagccctgagccctccagcaagaggaaggagggtcctcctgctggccaggaccgggagcccacccgttgcaggatggagggtgaactggcagaggagccaagggtggctgacaggaggttgtctgcacacgtcaggaggcccagtactgacccccagccctgctcggagcgggggccctactgcgtggacgagaacacggagcgcagaaaccactacctggacctcgccgggattgagaactacacgtccagattcggccctgggtcccctcctgtgcaagcaaagcaggagccccagggcagggcctcgcacctccaggcccggtcccgctcccaggagccagatacacatgccgtacaccaccgcaggtcacaggtgctggtggaacacgtcgtgccagcctcggagcctgctgcccgggccctggacacgcagccccggccgaaggggccggagaagcagttcctcaagtcccccaagggctccgggaagccgcctggggtgccagccagcagcaagtccgggaaagccttcagctactacctgccggccgtcctgccgccccaggcccctcaggacggccaccacctcccgcagcccccaccgccaccctacggccacaagcggtaccgccaaaagggcagggagggccactcgccactcaaggccccacacgctcagcctgccacagtggagcacgaggtggtgcgggacctgccgcccacgccagcaggagagggctacgcggtgccagtgatccagcggcacgagcaccaccaccaccacgagcaccaccaccaccaccaccaccaccacttccacccgtcctagcgccactgccaagcacacctcgctcccagcacaccacggcccgcgacctcagggcagggagcagagcagctgccggctgtgtgcccatggggagcccagcccccaccccccacctccgacagcaaacagcaactgactgcaggtgctggcatgatggaggtggtgcaccttggacacgtggacaaggcccaggcgccctctgctcttctgccctcgatgccacatggcggtgaacacatctgaagccactatgtttcctggctctaaggctcgtctgtgtaacccataaaacctgctttgattcc

SEQ ID NO: 87807 - DNA, 1570 bp, Homo sapiens
ttcagtagagcggtgttatcggagagggagtccagctctatgacttgacactgcgggaaggtaccaggaggacatgtccagcctcatgcacaccatctatgaggtcgtggatgcctcggtcaaccactcctcgggcagcagcaagaccctccgtgtgaagctaaccgtcagccctgagccctccagcaagaggaaggagggtcctcctgctggccaggaccgggagcccacccgttgcaggatggagggtgaactggcagaggagccaagggtggctgacaggaggttgtctgcacacgtcaggaggcccagtactgacccccagccctgctcggagcgggggccctactgcgtggacgagaacacggagcgcagaaaccactacctggacctcgccgggattgagaactacacgtccagattcggccctgggtcccctcctgtgcaagcaaagcaggagccccagggcagggcctcgcacctccaggcccggtcccgctcccaggagccagatacacatgccgtacaccaccgcaggtcacaggtgctggtggaacacgtcgtgccagcctcggagcctgctgcccgggccctggacacgcagccccggccgaaggggccggagaagcagttcctcaagtcccccaagggctccgggaagccgcctggggtgccagccagcagcaagtccgggaaagccttcagctactacctgccggccgtcctgccgccccaggcccctcaggacggccaccacctcccgcagcccccaccgccaccctacggccacaagcggtaccgccaaaagggcagggagggccactcgccactcaaggccccacacgctcagcctgccacagtggagcacgaggtggtgcgggacctgccgcccacgccagcaggagagggctacgcggtgccagtgatccagcggcacgagcaccaccaccaccacgagcaccaccaccaccaccaccaccaccacttccacccgtcctagcgccactgccaagcacacctcgctcccagcacaccacggcccgcgacctcagggcagggagcagagcagctgccggctgtgtgcccatggggagcccagcccccaccccccacctccgacagcaaacagcaactgactgcaggtgctggcatgatggaggtggtgcaccttggacacgtggacaaggcccaggcgccctctgctcttctgccctcgatgccacatggcggtgaacacatctgaagccactatgtttcctggctctaaggctcgtctgtgtaacccataaaacctgctttgattccaaaatgaggccctggagtgcgcaaggagtgcccggatgcttggggtgggtgttcctcccggggcttcaaggggtgactgctgtaggctgtcccagtgcgaggccgggagcgaatggaaaagctgaggctttgcctggcttgtgcatcatgaagtgagaggggacagggccggtggggggaagcagcttgtgcttagcagggagcatccgcggctccccgcaggaggccaagcagcagaaggcagcagtgctagaaagagaagtgc

SEQ ID NO: 87808 - DNA, 656 bp, Homo sapiens
ggtccaatatggcggcgcccagtggcggtgtgaactgtgaggagttcgccgagttccaggaattactcaaggtgatgaggacaattgatgacagaatagtacatgaattaaacactacggttccaacagcttcctttgcagggaaaattgatgccagccaaacctgtaaacaactttatgagtctttgatggcagctcatgccagtagagacagagtcataaaaaactgtatagcccagacttcagcagtagtaaaaaacctccgagaagagagagaaaagaatttggacgatttaacgttattaaaacaacttagaaaagagcagacaaagttgaaatggatgcagtcagaactgaatgttgaagaagtggtaaatgacaggagctggaaggtgtttaatgaacgctgccgaattcacttcaagcctccaaagaatgaataaagagagattcttttttttttttttttttaaggactgggtcatctcataagagctaagcatgacagatatcaacagggcgggctttctaggatgatttctgagccaacagtccaagaccttttgttgatttcagccccacttagccaagacctcaagtataaataattctgataattatggagaaatcaactgctattttatactgattctgta

SEQ ID NO: 87809 - DNA, 712 bp, Homo sapiens
ggagagcaaagttcaaaactctactgagtgtttgggaatgattgtgacacacaatttgctcagccttgagatctgcccttgtgtctttagggcccagatagaatcaccaggatgaccactgcaaggagggtttagaaaccaatcagtgagttgcatgaggtttgctttctagcttgataacatatagggttgggggtaaccatggggtagtacataagcaaataaggaaatgtgaattttttttttcaattttcaagtttgctatgaagattatggaatcagagagagctcttggagatggtacagctctacctcttcattttctatctgaggaaaaagactcagagatacttgagatactaactgacacccccaaagccacaagctattgaaatggatgcagtcagaactgaatgttgaagaagtggtaaatgacaggagctggaaggtgtttaatgaacgctgccgaattcacttcaagcctccaaagaatgaataaagagagattcttttttttttttttttttaaggactgggtcatctcataagagctaagcatgacagatatcaacagggcgggctttctaggatgatttctgagccaacagtccaagaccttttgttgatttcagccccacttagccaagacctcaagtataaataattctgataattatggagaaatcaactgctattttatactgattctgta

SEQ ID NO: 87810 - DNA, 637 bp, Homo sapiens
aaaggagttggtttcagtcatggatttaagtttggcaaaggaattactcaaggtgatgaggacaattgatgacagaatagtacatgaattaaacactacggttccaacagcttcctttgcagggaaaattgatgccagccaaacctgtaaacaactttatgagtctttgatggcagctcatgccagtagagacagagtcataaaaaactgtatagcccagacttcagcagtagtaaaaaacctccgagaagagagagaaaagaatttggacgatttaacgttattaaaacaacttagaaaagagcagacaaagttgaaatggatgcagtcagaactgaatgttgaagaagtggtaaatgacaggagctggaaggtgtttaatgaacgctgccgaattcacttcaagcctccaaagaatgaataaagagagattcttttttttttttttttttaaggactgggtcatctcataagagctaagcatgacagatatcaacagggcgggctttctaggatgatttctgagccaacagtccaagaccttttgttgatttcagccccacttagccaagacctcaagtataaataattctgataattatggagaaatcaactgctattttatactgattctgta

SEQ ID NO: 87811 - DNA, 244 bp, Homo sapiens
cttttggagcctactaaattgaatttagttccaggcctgatttacgcaggataactcaaagacttttgtttttgtttcaatattttaggtgtttaatgaacgctgccgaattcacttcaagcctccaaagaatgaataaagagagattcttttttttttttttttttaaggactgggtcatctcataagagctaagcatgacagatatcaacagggcgggctttctaggatgatttctgagcca

SEQ ID NO: 87812 - DNA, 861 bp, Homo sapiens
  misc_feature (646)..(646): n is a, c, g, or t
  misc_feature (653)..(653): n is a, c, g, or t
  misc_feature (655)..(655): n is a, c, g, or t
  misc_feature (666)..(666): n is a, c, g, or t
  misc_feature (670)..(670): n is a, c, g, or t
  misc_feature (674)..(674): n is a, c, g, or t
  misc_feature (676)..(676): n is a, c, g, or t
  misc_feature (683)..(683): n is a, c, g, or t
  misc_feature (694)..(694): n is a, c, g, or t
  misc_feature (696)..(696): n is a, c, g, or t
  misc_feature (699)..(699): n is a, c, g, or t
  misc_feature (707)..(707): n is a, c, g, or t
  misc_feature (721)..(722): n is a, c, g, or t
  misc_feature (726)..(726): n is a, c, g, or t
  misc_feature (732)..(732): n is a, c, g, or t
  misc_feature (734)..(734): n is a, c, g, or t
  misc_feature (739)..(739): n is a, c, g, or t
  misc_feature (742)..(742): n is a, c, g, or t
ggtccaatatggcggcgcccagtggcggtgtgaactgtgaggagttcgccgagttccaggaattactcaaggtgatgaggacaattgatgacagaatagtacatgaattaaacactacggttccaacagcttcctttgcagggaaaattgatgccagccaaacctgtaaacaactttatgagtctttgatggcagctcatgccagtagagacagagtcataaaaaactgtatagcccagacttcagcagtagtaaaaaacctccgagaagagagagaaaagaatttggacgatttaacgttattaaaacaacttagaaaagagcagacaaagttgaaatggatgcagtcagaactgaatgttgaagaagtggtaaatgacaggagctggaaggtgtttaatgaacgctgccgaattcacttcaagcctccaaagaatgaataaagagagattcttttttttttttttttttaaggactgggtcatctcataagagctaagcatgacagatatcaacagggcgggctttctaggatgatttctgagccaacagtccaagaccttttgttgatttcagccccacttagccaagacctcaagtataaataattctgataattatggagacaccacgggtatttaatcgnggttcgngncacacaaacancaantcgngncttaaanattgcggccgntnaanacaaaaanaaaaaaattggcgnncggnccgaantnaacantcngggggggcaggtagaagggactggcagacgggaagagggtgcccaaagcgggcggcgacccggtggtccgtcagcacagccccgcgggcactccagagccgtagaacgagagcagcacg

SEQ ID NO: 87813 - DNA, 839 bp, Homo sapiens
tgccgggcattttttcctggtttgggggcaaggtctcatgggaaaggtcatgtctctcgaagaaaggttataaaccctgagatatgagggttgggcgagacatccgagcctgtttcgttccgtgttgggaccaggaataaccctgacttctgagctttcataaccccaggatcctccagaaaatttgcggcgcgctgagggaaaaccttgctggcaagtcgggactgtgtggcagcggctatttttcttttcccacccagcacgttttcgggctggggacatagggttcagttgagatacggaggcttccttcgggatattgggttctctgaagtgcggatggactagggcagggctgagaccccattcattcactcatttgtttagctctcctttatgcccggcgcagaagataccccttagggtcccaaggcccttcctgtagttaagttccttccttaaggtcattcagctggggcaaagctggggactcgacacctttctatgctaaccattgagctgcctccactttgagcagctcagtggatgaatatagtatcttgaggatacctttgatttgtgcagggttttcttgtgcaggtttgtgacccaggtcagcttaggtcaggatgctgtactgcttgccacaaaatagcctgtactgtcgcgtcgttttttcttgtgaacagactgtttggcatagccgtagagaggggtctgagacatgaatttagtgatacagcgttgatttgtttgtgtaatgaagctgttcaagtggaaagaactgagttgtagtccctgcttcactagtactagaaggattttttaaacctttttga

SEQ ID NO: 87814 - DNA, 2926 bp, Homo sapiens
tgccgggcattttttcctggtttgggggcaaggtctcatgggaaaggtcatgtctctcgaagaaaggttataaaccctgagatatgagggttgggcgagacatccgagcctgtttcgttccgtgttgggaccaggaataaccctgacttctgagctttcataaccccaggatcctccagaaaatttgcggcgcgctgagggaaaaccttgctgaagctgtacattggaatgcgtttacagtcattgtaatggaagcaaaatacatgaaggaaaaactgttatttgtatccctgcttattgcacctgacgactagttgcagatggttttgtttacctaagaaaacttgtgatataaatgaaaaaaacacctgttttcctagagtcattggttacaaatatgcttcgtctaagagctatttgtccattctcctggagagtgtttcaatttcgacccatcagttgtgaaccactaattattcagatgaataagtgtacagatgaggagcaaatgtttggttttattgaaagaaacaaagccatactttcagaaaagcaagtgggatgtgcatttgatatgctttggaagcttcaaaagcagaagaccagcctgttaactacaaataaattcaaattaatgaatgacgataccctggtgaatgtgttatacgtcacacaacagtttgctggtgaggcccatgacccgctagttgaagcactagttacagaagcatggagaaggctagaaaggtttgatattaaactgctctcagaattttcctcttgcctagcagatcagcatttgtattttagtccattaatgggaaaaatagctgatattgttcataggaacttggaaaccacacaggacttaagttccttgtctgtcttgatggtcaacatatcttctttaatatcacgacattttcaacaacaactggtgaacaaaacagaacttctttttgacaccatagattcttctgaggtcaacgttgcaaaaagcatagcaaagtttcttcgaaatgttagatatcgttatcaaccactattagaaagatgtaataacgtatttttaagtaatgtggaccaccttgatttggattccatcagtaaaatacttagtgtatacaaatttctacaatttaatagttttgaatttattataatggctaaaaagaagctaactgaaatgattcctctgtgtaatcatcctgctagctttgtaaaattgtttgtagcattgggacccattgcaggacctgaagaaaagaaacaacttaaatcaactatgttattgatgtcagaggacctaactggcgagcaagccctggcagtgttgggagcaatgggagatatggaaagcagaaactcatgtctgattaaaagagttacttcagttctgcataaacatttggatggctataaaccattagagttgttgaagataactcaagaattgacttttctgcatttccaaaggaaggagttttttgcgaaacttagagaattactgcttagttatttgaaaaatagtttcataccaactgaggtgtctgttctggtccgtgctatttccctgctcccttctcctcacttggacgaagtggggatatcccgaattgaagccgttttaccacagtgtgacctaaataacctgagtagttttgccacatctgttttaagatggattcagcatgatcacgtgtatttggataatatgactgcgaaacaactgaaactacttcaaaaattagatcactatggtcgtcagagactacaacacagcaacagtttggatctgttacggaaggaacttaaatctctcaaaggaaacacgtttcctgagtcacttcttgaagaaatgattgctactttacagcatttcatggatgatattaattacataaatgttggggagattgcatcttttatttctagtactgattacctcagtactttgctactagataggatagcctcagtggctgttcagcagattgaaaagatccatccttttacaatccctgctattattcgtccattcagcgtattgaactatgatccacctcaaagggatgaatttttgggaacttgcgtgcaacatcttaattcttacttaggtatattggatccttttatattagtgtttcttggtttctctttggccacacttgaatattttccagaagatctgctaaaggcaatttttaacatcaaattcttagctagattggattctcaacttgaaattttatctccatctcgaagtgcaagagtccagtttcatcttatggagttaaatagatcagtctgcttggaatgccctgagtttcagattccatggtttcatgaccgcttctgtcaacaatataataaaggtattggtggcatggatggaacacaacagcagatttttaaaatgttagcagaggtactaggaggaatcaattgtgtaaaagcctcggttcttacgccttattaccacaaagtagattttgagtgtatcttggataaaagaaaaaaacctcttccgtatggaagccataatatagcattgggacaactaccagaaatgccctgggaatcaaatatcgaaatagttggatcaaggctgccaccaggggctgaaaggattgctttggaatttttggattcaaaagcactttgtagaaatatccctcacatgaaaggaaaatctgctatgaaaaaacgacatttggaaattctggggtatcgtgtaattcagatttcccagtttgaatggaactctatggcactgtcaacaaaggatgctcggatggactacctgagagaatgtatatttggagaagtcaagtcatgtttgtagtttttatttaaaatgaatgttatcgtgtgttacatttggacctattttaataaagtggcctgtctcaattaaaaaaaaaaa

SEQ ID NO: 87815 - DNA, 2406 bp, Homo sapiens
tacagtggcacaatcttggctcactgcaacctccgcctcccaggttcaagcaattctcctttaacaactgtaatactattgttaactgtgggcatttgaaattggattattgtggagttttgtgaaaatgtggttggctgcagatgaggatatagtaggtttgctggtgaggcccatgacccgctagttgaagcactagttacagaagcatggagaaggctagaaaggtttgatattaaactgctctcagaattttcctcttgcctagcagatcagcatttgtattttagtccattaatgggaaaaatagctgatattgttcataggaacttggaaaccacacaggacttaagttccttgtctgtcttgatggtcaacatatcttctttaatatcacgacattttcaacaacaactggtgaacaaaacagaacttctttttgacaccatagattcttctgaggtcaacgttgcaaaaagcatagcaaagtttcttcgaaatgttagatatcgttatcaaccactattagaaagatgtaataacgtatttttaagtaatgtggaccaccttgatttggattccatcagtaaaatacttagtgtatacaaatttctacaatttaatagttttgaatttattataatggctaaaaagaagctaactgaaatgattcctctgtgtaatcatcctgctagctttgtaaaattgtttgtagcattgggacccattgcaggacctgaagaaaagaaacaacttaaatcaactatgttattgatgtcagaggacctaactggcgagcaagccctggcagtgttgggagcaatgggagatatggaaagcagaaactcatgtctgattaaaagagttacttcagttctgcataaacatttggatggctataaaccattagagttgttgaagataactcaagaattgacttttctgcatttccaaaggaaggagttttttgcgaaacttagagaattactgcttagttatttgaaaaatagtttcataccaactgaggtgtctgttctggtccgtgctatttccctgctcccttctcctcacttggacgaagtggggatatcccgaattgaagccgttttaccacagtgtgacctaaataacctgagtagttttgccacatctgttttaagatggattcagcatgatcacgtgtatttggataatatgactgcgaaacaactgaaactacttcaaaaattagatcactatggtcgtcagagactacaacacagcaacagtttggatctgttacggaaggaacttaaatctctcaaaggaaacacgtttcctgagtcacttcttgaagaaatgattgctactttacagcatttcatggatgatattaattacataaatgttggggagattgcatcttttatttctagtactgattacctcagtactttgctactagataggatagcctcagtggctgttcagcagattgaaaagatccatccttttacaatccctgctattattcgtccattcagcgtattgaactatgatccacctcaaagggatgaatttttgggaacttgcgtgcaacatcttaattcttacttaggtatattggatccttttatattagtgtttcttggtttctctttggccacacttgaatattttccagaagatctgctaaaggcaatttttaacatcaaattcttagctagattggattctcaacttgaaattttatctccatctcgaagtgcaagagtccagtttcatcttatggagttaaatagatcagtctgcttggaatgccctgagtttcagattccatggtttcatgaccgcttctgtcaacaatataataaaggtattggtggcatggatggaacacaacagcagatttttaaaatgttagcagaggtactaggaggaatcaattgtgtaaaagcctcggttcttacgccttattaccacaaagtagattttgagtgtatcttggataaaagaaaaaaacctcttccgtatggaagccataatatagcattgggacaactaccagaaatgccctgggaatcaaatatcgaaatagttggatcaaggctgccaccaggggctgaaaggattgctttggaatttttggattcaaaagcactttgtagaaatatccctcacatgaaaggaaaatctgctatgaaaaaacgacatttggaaattctggggtatcgtgtaattcagatttcccagtttgaatggaactctatggcactgtcaacaaaggatgctcggatggactacctgagagaatgtatatttggagaagtcaagtcatgtttgtagtttttatttaaaatgaatgttatcgtgtgttacatttggacctattttaataaagtggcctgtctcaattaaaaaaaaaaa

SEQ ID NO: 87816 - DNA, 2911 bp, Homo sapiens
tgccgggcattttttcctggtttgggggcaaggtctcatgggaaaggtcatgtctctcgaagaaaggttataaaccctgagatatgagggttgggcgagacatccgagcctgtttcgttccgtgttgggaccaggaataaccctgacttctgagctttcataaccccaggatcctccagaaaatttgcggcgcgctgagggaaaaccttgctgaagctgtacattggaatgcgtttacagtcattgtaatggaagcaaaatacatgaaggaaaaactgttatttgtatccctgcttattgcacctgacgactagttgcagatggttttgtttacctaagaaaacttgtgatataaatgaaaaaaacacctgttttcctagagtcattggttacaaatatgcttcgtctaagagctatttgtccattctcctggagagtgtttcaatttcgacccatcagttgtgaaccactaattattcagatgaataagtgtacagatgaggagcaaatgtttggttttattgaaagaaacaaagccatactttcagaaaagcaagtgggatgtgcatttgatatgctttggaagcttcaaaagcagaagaccagcctgttaaaaaatgctgagtatgtcagagaccatcctcaatttcttactcttcataatttagctacaaataaattcaaattaatgaatgacgataccctggtgaatgtgttatacgtcacacaacagtttgatattaaactgctctcagaattttcctcttgcctagcagatcagcatttgtattttagtccattaatgggaaaaatagctgatattgttcataggaacttggaaaccacacaggacttaagttccttgtctgtcttgatggtcaacatatcttctttaatatcacgacattttcaacaacaactggtgaacaaaacagaacttctttttgacaccatagattcttctgaggtcaacgttgcaaaaagcatagcaaagtttcttcgaaatgttagatatcgttatcaaccactattagaaagatgtaataacgtatttttaagtaatgtggaccaccttgatttggattccatcagtaaaatacttagtgtatacaaatttctacaatttaatagttttgaatttattataatggctaaaaagaagctaactgaaatgattcctctgtgtaatcatcctgctagctttgtaaaattgtttgtagcattgggacccattgcaggacctgaagaaaagaaacaacttaaatcaactatgttattgatgtcagaggacctaactggcgagcaagccctggcagtgttgggagcaatgggagatatggaaagcagaaactcatgtctgattaaaagagttacttcagttctgcataaacatttggatggctataaaccattagagttgttgaagataactcaagaattgacttttctgcatttccaaaggaaggagttttttgcgaaacttagagaattactgcttagttatttgaaaaatagtttcataccaactgaggtgtctgttctggtccgtgctatttccctgctcccttctcctcacttggacgaagtggggatatcccgaattgaagccgttttaccacagtgtgacctaaataacctgagtagttttgccacatctgttttaagatggattcagcatgatcacgtgtatttggataatatgactgcgaaacaactgaaactacttcaaaaattagatcactatggtcgtcagagactacaacacagcaacagtttggatctgttacggaaggaacttaaatctctcaaaggaaacacgtttcctgagtcacttcttgaagaaatgattgctactttacagcatttcatggatgatattaattacataaatgttggggagattgcatcttttatttctagtactgattacctcagtactttgctactagataggatagcctcagtggctgttcagcagattgaaaagatccatccttttacaatccctgctattattcgtccattcagcgtattgaactatgatccacctcaaagggatgaatttttgggaacttgcgtgcaacatcttaattcttacttaggtatattggatccttttatattagtgtttcttggtttctctttggccacacttgaatattttccagaagatctgctaaaggcaatttttaacatcaaattcttagctagattggattctcaacttgaaattttatctccatctcgaagtgcaagagtccagtttcatcttatggagttaaatagatcagtctgcttggaatgccctgagtttcagattccatggtttcatgaccgcttctgtcaacaatataataaaggtattggtggcatggatggaacacaacagcagatttttaaaatgttagcagaggtactaggaggaatcaattgtgtaaaagcctcggttcttacgccttattaccacaaagtagattttgagtgtatcttggataaaagaaaaaaacctcttccgtatggaagccataatatagcattgggacaactaccagaaatgccctgggaatcaaatatcgaaatagttggatcaaggctgccaccaggggctgaaaggattgctttggaatttttggattcaaaagcactttgtagaaatatccctcacatgaaaggaaaatctgctatgaaaaaacgacatttggaaattctggggtatcgtgtaattcagatttcccagtttgaatggaactctatggcactgtcaacaaaggatgctcggatggactacctgagagaatgtatatttggagaagtcaagtcatgtttgtagtttttatttaaaatgaatgttatcgtgtgttacatttggacctattttaataaagtggcctgtctcaattaaaaaaaaaaa

SEQ ID NO: 87817 - DNA, 979 bp, Homo sapiens
tccttatttatatttttgaaatttaattacagttagtgcagaaggttgttcaactatccatccttttacaatccctgctattattcgtccattcagcgtattgaactatgatccacctcaaagggatgaatttttgggaacttgcgtgcaacatcttaattcttacttaggtatattggatccttttatattagtgtttcttggtttctctttggccacacttgaatattttccagaagatctgctaaaggcaatttttaacatcaaattcttagctagattggattctcaacttgaaattttatctccatctcgaagtgcaagagtccagtttcatcttatggagttaaatagatcagtctgcttggaatgccctgagtttcagattccatggtttcatgaccgcttctgtcaacaatataataaaggtattggtggcatggatggaacacaacagcagatttttaaaatgttagcagaggtactaggaggaatcaattgtgtaaaagcctcggttcttacgccttattaccacaaagtagattttgagtgtatcttggataaaagaaaaaaacctcttccgtatggaagccataatatagcattgggacaactaccagaaatgccctgggaatcaaatatcgaaatagttggatcaaggctgccaccaggggctgaaaggattgctttggaatttttggattcaaaagcactttgtagaaatatccctcacatgaaaggaaaatctgctatgaaaaaacgacatttggaaattctggggtatcgtgtaattcagatttcccagtttgaatggaactctatggcactgtcaacaaaggatgctcggatggactacctgagagaatgtatatttggagaagtcaagtcatgtttgtagtttttatttaaaatgaatgttatcgtgtgttacatttggacctattttaataaagtggcctgtctcaattaaaaaaaaaaa

SEQ ID NO: 87818 - DNA, 2257 bp, Homo sapiens
tgccgggcattttttcctggtttgggggcaaggtctcatgggaaaggtcatgtctctcgaagaaaggttataaaccctgagatatgagggttgggcgagacatccgagcctgtttcgttccgtgttgggaccaggaataaccctgacttctgagctttcataaccccaggatcctccagaaaatttgcggcgcgctgagggaaaaccttgctgaagctgtacattggaatgcgtttacagtcattgtaatggaagcaaaatacatgaaggaaaaactgttatttgtatccctgcttattgcacctgacgactagttgcagatggttttgtttacctaagaaaacttgtgatataaatgaaaaaaacacctgttttcctagagtcattggttacaaatatgcttcgtctaagagctatttgtccattctcctggagagtgtttcaatttcgacccatcagttgtgaaccactaattattcagatgaataagtgtacagatgaggagcaaatgtttggttttattgaaagaaacaaagccatactttcagaaaagcaagtgggatgtgcatttgatatgctttggaagcttcaaaagcagaagaccagcctgttaaaaaatgctgagtatgtcagagaccatcctcaatttcttactcttcataatttagctacaaataaattcaaattaatgaatgacgataccctggtgaatgtgttatacgtcacacaacagtttgctggtgaggcccatgacccgctagttgaagcactagttacagaagcatggagaaggctagaaaggtttgatattaaactgctctcagaattttcctcttgcctagcagatcagcatttgtattttagtccattaatgggaaaaatagctgatattgttcataggaacttggaaaccacacaggacttaagttccttgtctgtcttgatggtcaacatatcttctttaatatcacgacattttcaacaacaactggtgaacaaaacagaacttctttttgacaccatagattcttctgaggtcaacgttgcaaaaagcatagcaaagtttcttcgaaatgttagatatcgttatcaaccactattagaaagatgtaataacgtatttttaagtaatgtggaccaccttgatttggattccatcagtaaaatacttagtgtatacaaatttctacaatttaatagttttgaatttattataatggctaaaaagaagctaactgaaatgattcctctgtgtaatcatcctgctagctttgtaaaattgtttgtagcattgggacccattgcaggacctgaagaaaagaaacagtaagttcagtttaaaatgcattactttttttgttgtgaatacgtggagccttcaagcttaggtctccttgcagctctggaaggtacaaatatcaccctattaggttgtggaagggaaaataatctcttatgctctgctccttgattctttttctgattattctaatttacatctcaaactcttagtctgttgctgtgttctgaaaggtaaacctctgatactgggccaacatgaaaaaaaatgaggggaaacgccatgtgtttttattctcccttttgtgctacatgactggatttacacatataagactcccccacccagtgtaagtctgtggaatatttagaattatagtagtcatagcagagggccattttatgctttgctgtcttcatcacaataatcatcaaagcatttattatgcactgggcatatgttcccatgtcaggtttgagcaaattttgtgtggcgcctctcatttaggaatttccagttttgctagatactgatgtaggtagtaatatttgaaatataatgatgagcaaatattaaattaacatacaaatacggttaatagataagagtttctcttcctaggccatgtgactggatttatactagacataaacttcccccacccagcataattgtatgaaatatttagaattacaagctgggcacggcgttgcacgcctttaatcccatcactttgggaggccgaggcaggtggatccctggatcccaggaatttgagaccagcctaggcaagatgatgaaaccttgtctgtacaaaaaaatacaaaattagccagatgtggtggtgcccacctagattcccagctactcatgaggatcacctgagcccaaggaggttgagcctgcagtgaactgacattgcgccattgaattccagcctgggcacagaatgaaacc

SEQ ID NO: 87819 - DNA, 1113 bp, Homo sapiens
attacaggtgtgagccactgtgcctggcctggttgtcttttatacattaagactcatcagtgggttcgtatgttgtcagctgattcattcaacagaaagttcccctgtcagcttttcacctgctgattttagcagttattaatgatcactcattgcctaaatccatcattcagaggggtggtaaagtagcgatattctacatctatcatgccttctacatttattagctggaatttgtctaaaaaggactttcccatatcaactgtttagttactcttatgtacaattcatgtagaaaagacaggataaatgcttgtatctttttctttattaattttcagatgagttggtttagctttctccaaatgtaatcaagagccttaaagagattgaaactctttaatgtgatttggcctagcccagcgctaaatgtagcctagtacttaatattgttttgtaattcttctggttgatttttttattgattgatttccaaagagaggtgccattggaccagatcttataaaaataacttggataatctgagaggttcgtcattcttttgtgagtgtgtgtgtgtacaaatattatatgcatatatatttcaaatatatcttaaacttttatctgtaagactttacctaattcatactaccagtttctatgcttccttaagattttgagtgtatcttggataaaagaaaaaaacctcttccgtatggaagccataatatagcattgggacaactaccagaaatgccctgggaatcaaatatcgaaatagttggatcaaggctgccaccaggggctgaaaggattgctttggaatttttggattcaaaagcactttgtagaaatatccctcacatgaaaggaaaatctgctatgaaaaaacgacatttggaaattctggggtatcgtgtaattcagatttcccagtttgaatggaactctatggcactgtcaacaaaggatgctcggatggactacctgagagaatgtatatttggagaagtcaagtcatgtttgtagtttttatttaaaatgaatgttatcgtgtgttacatttggacctattttaataaagtggcctgtctcaattaaaaaaaaaaa

SEQ ID NO: 87820 - DNA, 1227 bp, Homo sapiens
tgccgggcattttttcctggtttgggggcaaggtctcatgggaaaggtcatgtctctcgaagaaaggttataaaccctgagatatgagggttgggcgagacatccgagcctgtttcgttccgtgttgggaccaggaataaccctgacttctgagctttcataaccccaggatcctccagaaaatttgcggcgcgctgagggaaaaccttgctgaagctgtacattggaatgcgtttacagtcattgtaatggaagcaaaatacatgaaggaaaaactgttatttgtatccctgcttattgcacctgacgactagttgcagatggttttgtttacctaagaaaacttgtgatataaatgaaaaaaacacctgttttcctagagtcattggttacaaatatgcttcgtctaagagctatttgtccattctcctggagagtgtttcaatttcgacccatcagttgtgaaccactaattattcagatgaataagtgtacagatgaggagcaaatgtttggttttattgaaagaaacaaagccatactttcagaaaagcaagtgggatgtgcatttgatatgctttggaagcttcaaaagcagaagaccagcctgttaaaaaatgctgagtatgtcagagaccatcctcaatttcttactcttcataatttagctacaaataaattcaaattaatgaatgacgataccctggtgaatgtgttatacgtcacacaacagtttgctggtgaggcccatgacccgctagttgaagcactagttacagaagcatggagaaggctagaaaggtttgatattaaactgctctcagaattttcctcttgcctagcagatcagcatttgtattttagtccattaatgggaaaaatagctgatattgttcataggaacttggaaaccacacaggacttaagttccttgggtctggtctgcatggccaacagtatctctctcacactatgaggacattccacaacaactgctggacgaaaagagacactcacttgtggacacacaacatctcctgggccaggcgcaacaagcatagcgaaagtcctcgacatgtccgatatcgctaccagcggtccccaagagcatcacggacccgcagccagtggacccctggcaggggctcaacgcagcaccgcggagaacatgcaacacacaacacaacacacaggccagaacaccccaaccgggcaacccacgcaacg

SEQ ID NO: 87821 - DNA, 2980 bp, Homo sapiens
tgccgggcattttttcctggtttgggggcaaggtctcatgggaaaggtcatgtctctcgaagaaaggttataaaccctgagatatgagggttgggcgagacatccgagcctgtttcgttccgtgttgggaccaggaataaccctgacttctgagctttcataaccccaggatcctccagaaaatttgcggcgcgctgagggaaaaccttgctgaagctgtacattggaatgcgtttacagtcattgtaatggaagcaaaatacatgaaggaaaaactgttatttgtatccctgcttattgcacctgacgactagttgcagatggttttgtttacctaagaaaacttgtgatataaatgaaaaaaacacctgttttcctagagtcattggttacaaatatgcttcgtctaagagctatttgtccattctcctggagagtgtttcaatttcgacccatcagttgtgaaccactaattattcagatgaataagtgtacagatgaggagcaaatgtttggttttattgaaagaaacaaagccatactttcagaaaagcaagtgggatgtgcatttgatatgctttggaagcttcaaaagcagaagaccagcctgttaaaaaatgctgagtatgtcagagaccatcctcaatttcttactcttcataatttagctacaaataaattcaaattaatgaatgacgataccctggtgaatgtgttatacgtcacacaacagtttgctggtgaggcccatgacccgctagttgaagcactagttacagaagcatggagaaggctagaaaggtttgatattaaactgctctcagaattttcctcttgcctagcagatcagcatttgtattttagtccattaatgggaaaaatagctgatattgttcataggaacttggaaaccacacaggacttaagttccttgtctgtcttgatggtcaacatatcttctttaatatcacgacattttcaacaacaactggtgaacaaaacagaacttctttttgacaccatagattcttctgaggtcaacgttgcaaaaagcatagcaaagtttcttcgaaatgttagatatcgttatcaaccactattagaaagatgtaataacgtatttttaagtaatgtggaccaccttgatttggattccatcagtaaaatacttagtgtatacaaatttctacaatttaatagttttgaatttattataatggctaaaaagaagctaactgaaatgattcctctgtgtaatcatcctgctagctttgtaaaattgtttgtagcattgggacccattgcaggacctgaagaaaagaaacaacttaaatcaactatgttattgatgtcagaggacctaactggcgagcaagccctggcagtgttgggagcaatgggagatatggaaagcagaaactcatgtctgattaaaagagttacttcagttctgcataaacatttggatggctataaaccattagagttgttgaagataactcaagaattgacttttctgcatttccaaaggaaggagttttttgcgaaacttagagaattactgcttagttatttgaaaaatagtttcataccaactgaggtgtctgttctggtccgtgctatttccctgctcccttctcctcacttggacgaagtggggatatcccgaattgaagccgttttaccacagtgtgacctaaataacctgagtagttttgccacatctgttttaagatggattcagcatgatcacgtgtatttggataatatgactgcgaaacaactgaaactacttcaaaaattagatcactatggtcgtcagagactacaacacagcaacagtttggatctgttacggaaggaacttaaatctctcaaaggaaacacgtttcctgagtcacttcttgaagaaatgattgctactttacagcatttcatggatgatattaattacataaatgttggggagattgcatcttttatttctagtactgattacctcagtactttgctactagataggatagcctcagtggctgttcagcagattgaaaagatccatccttttacaatccctgctattattcgtccattcagcgtattgaactatgatccacctcaaagggatgaatttttgggaacttgcgtgcaacatcttaattcttacttaggtatattggatccttttatattagtgtttcttggtttctctttggccacacttgaatattttccagaagatctgctaaaggcaatttttaacatcaaattcttagctagattggattctcaacttgaaattttatctccatctcgaagtgcaagagtccagtttcatcttatggagttaaatagatcagtctgcttggaatgccctgagtttcagattccatggtttcatgaccgcttctgtcaacaatataataaaggtattggtggcatggatggaacacaacagcagatttttaaaatgttagcagaggtactaggaggaatcaattgtgtaaaagcctcggttcttacgccttattaccacaaagtagattttgagtgtatcttggataaaagaaaaaaacctcttccgtatggaagccataatatagcattgggacaactaccagaaatgccctgggaatcaaatatcgaaatagttggatcaaggctgccaccaggggctgaaaggattgctttggaatttttggattcaaaagcactttgtagaaatatccctcacatgaaaggaaaatctgctatgaaaaaacgacatttggaaattctggggtatcgtgtaattcagatttcccagtttgaatggaactctatggcactgtcaacaaaggatgctcggatggactacctgagagaatgtatatttggagaagtcaagtcatgtttgtagtttttatttaaaatgaatgttatcgtgtgttacatttggacctattttaataaagtggcctgtctcaattaaaaaaaaaaa

SEQ ID NO: 87822 - DNA, 2998 bp, Homo sapiens
agcgggcgtcaccacgccctcctaggacttctaggattttggtgccttttaaattcctagtttataggtggcctaatgctttgtggatgcgttgactgggaacgcttgtaaccgttaaaatgccatatcctttgtgaaagacagggtctcattatgttgctcaggatggacttgaactcctggagtcaagcgattctcccaccttagtctccagagtagctgggactacagaagctgtacattggaatgcgtttacagtcattgtaatggaagcaaaatacatgaaggaaaaactgttatttgtatccctgcttattgcacctgacgactagttgcagatggttttgtttacctaagaaaacttgtgatataaatgaaaaaaacacctgttttcctagagtcattggttacaaatatgcttcgtctaagagctatttgtccattctcctggagagtgtttcaatttcgacccatcagttgtgaaccactaattattcagatgaataagtgtacagatgaggagcaaatgtttggttttattgaaagaaacaaagccatactttcagaaaagcaagtgggatgtgcatttgatatgctttggaagcttcaaaagcagaagaccagcctgttaaaaaatgctgagtatgtcagagaccatcctcaatttcttactcttcataatttagctacaaataaattcaaattaatgaatgacgataccctggtgaatgtgttatacgtcacacaacagtttgctggtgaggcccatgacccgctagttgaagcactagttacagaagcatggagaaggctagaaaggtttgatattaaactgctctcagaattttcctcttgcctagcagatcagcatttgtattttagtccattaatgggaaaaatagctgatattgttcataggaacttggaaaccacacaggacttaagttccttgtctgtcttgatggtcaacatatcttctttaatatcacgacattttcaacaacaactggtgaacaaaacagaacttctttttgacaccatagattcttctgaggtcaacgttgcaaaaagcatagcaaagtttcttcgaaatgttagatatcgttatcaaccactattagaaagatgtaataacgtatttttaagtaatgtggaccaccttgatttggattccatcagtaaaatacttagtgtatacaaatttctacaatttaatagttttgaatttattataatggctaaaaagaagctaactgaaatgattcctctgtgtaatcatcctgctagctttgtaaaattgtttgtagcattgggacccattgcaggacctgaagaaaagaaacaacttaaatcaactatgttattgatgtcagaggacctaactggcgagcaagccctggcagtgttgggagcaatgggagatatggaaagcagaaactcatgtctgattaaaagagttacttcagttctgcataaacatttggatggctataaaccattagagttgttgaagataactcaagaattgacttttctgcatttccaaaggaaggagttttttgcgaaacttagagaattactgcttagttatttgaaaaatagtttcataccaactgaggtgtctgttctggtccgtgctatttccctgctcccttctcctcacttggacgaagtggggatatcccgaattgaagccgttttaccacagtgtgacctaaataacctgagtagttttgccacatctgttttaagatggattcagcatgatcacgtgtatttggataatatgactgcgaaacaactgaaactacttcaaaaattagatcactatggtcgtcagagactacaacacagcaacagtttggatctgttacggaaggaacttaaatctctcaaaggaaacacgtttcctgagtcacttcttgaagaaatgattgctactttacagcatttcatggatgatattaattacataaatgttggggagattgcatcttttatttctagtactgattacctcagtactttgctactagataggatagcctcagtggctgttcagcagattgaaaagatccatccttttacaatccctgctattattcgtccattcagcgtattgaactatgatccacctcaaagggatgaatttttgggaacttgcgtgcaacatcttaattcttacttaggtatattggatccttttatattagtgtttcttggtttctctttggccacacttgaatattttccagaagatctgctaaaggcaatttttaacatcaaattcttagctagattggattctcaacttgaaattttatctccatctcgaagtgcaagagtccagtttcatcttatggagttaaatagatcagtctgcttggaatgccctgagtttcagattccatggtttcatgaccgcttctgtcaacaatataataaaggtattggtggcatggatggaacacaacagcagatttttaaaatgttagcagaggtactaggaggaatcaattgtgtaaaagcctcggttcttacgccttattaccacaaagtagattttgagtgtatcttggataaaagaaaaaaacctcttccgtatggaagccataatatagcattgggacaactaccagaaatgccctgggaatcaaatatcgaaatagttggatcaaggctgccaccaggggctgaaaggattgctttggaatttttggattcaaaagcactttgtagaaatatccctcacatgaaaggaaaatctgctatgaaaaaacgacatttggaaattctggggtatcgtgtaattcagatttcccagtttgaatggaactctatggcactgtcaacaaaggatgctcggatggactacctgagagaatgtatatttggagaagtcaagtcatgtttgtagtttttatttaaaatgaatgttatcgtgtgttacatttggacctattttaataaagtggcctgtctcaattaaaaaaaaaaa

SEQ ID NO: 87823 - DNA, 2851 bp, Homo sapiens
tgccgggcattttttcctggtttgggggcaaggtctcatgggaaaggtcatgtctctcgaagaaaggttataaaccctgagatatgagggttgggcgagacatccgagcctgtttcgttccgtgttgggaccaggaataaccctgacttctgagctttcataaccccaggatcctccagaaaatttgcggcgcgctgagggaaaaccttgctgaagctgtacattggaatgcgtttacagtcattgtaatggaagcaaaatacatgaaggaaaaactgttatttgtatccctgcttattgcacctgacgactagttgcagatggttttgtttacctaagaaaacttgtgatataaatgaaaaaaacacctgttttcctagagtcattggttacaaatatgcttcgtctaagagctatttgtccattctcctggagagtgtttcaatttcgacccatcagttgtgaaccactaattattcagatgaataagtgtacagatgaggagcaaatgtttggttttattgaaagaaacaaagccatactttcagaaaagcaagtgggatgtgcatttgatatgctttggaagcttcaaaagcagaagaccagcctgttaaaaaatgctgagtatgtcagagaccatcctcaatttcttactcttcataatttagctacaaataaattcaaattaatgaatgacgataccctggtgaatgtgttatacgtcacacaacagtttgctggtgaggcccatgacccgctagttgaagcactagttacagaagcatggagaaggctagaaaggtttgatattaaactgctctcagaattttcctcttgcctagcagatcagcatttgtattttagtccattaatgggaaaaatagctgatattgttcataggaacttggaaaccacacaggacttaagttccttgtctgtcttgatggtcaacatatcttctttaatatcacgacattttcaacaacaactggtgaacaaaacagaacttctttttgacaccatagattcttctgaggtcaacgttgcaaaaagcatagcaaagtttcttcgaaatgttagatatcgttatcaaccactattagaaagatgtaataacgtatttttaagtaatgtggaccaccttgatttggattccatcagtaaaatacttagtgtatacaaatttctacaatttaatagttttgaatttattataatggctaaaaagaagctaactgaaatgattcctctgtgtaatcatcctgctagctttgtaaaattgtttgtagcattgggacccattgcaggacctgaagaaaagaaacaacttaaatcaactatgttattgatgtcagaggacctaactggcgagcaagccctggcagtgttgggagcaatgggagatatggaaagcagaaactcatgtctgattaaaagagttacttcagttctgcataaacatttggatggctataaaccattagagttgttgaagataactcaagaattgacttttctgcatttccaaaggaaggagttttttgcgaaacttagagaattactgcttagttatttgaaaaatagtttcataccaactgaggtgtctgttctggtccgtgctatttccctgctcccttctcctcacttggacgaagtggggatatcccgaattgaagccgttttaccacagtgtgacctaaataacctgagtagttttgccacatctgttttaagatggattcagcatgatcacgtgtatttggataatatgactgcgaaacaactgaaactacttcaaaaattagatcactatggtcgtcagagactacaacacagcaacagtttggatctgttacggaaggaacttaaatctctcaaaggaaacacgtttcctgagtcacttcttgaagaaatgattgctactttacagcatttcatggatgatattaattacataaatgttggggagattgcatcttttatttctagtactgattacctcagtactttgctactagataggatagcctcagtggctgttcagcagattgaaaagatccatccttttacaatccctgctattattcgtccattcagcgtattgaactatgatccacctcaaagggatgaatttttgggaacttgcgtgcaacatcttaattcttacttaggtatattggatccttttatattagtgtttcttggtttctctttggccacacttgaatattttccagaagatctgctaaaggcaatttttaacatcaaattcttagctagattggattctcaacttgaaagtattggtggcatggatggaacacaacagcagatttttaaaatgttagcagaggtactaggaggaatcaattgtgtaaaagcctcggttcttacgccttattaccacaaagtagattttgagtgtatcttggataaaagaaaaaaacctcttccgtatggaagccataatatagcattgggacaactaccagaaatgccctgggaatcaaatatcgaaatagttggatcaaggctgccaccaggggctgaaaggattgctttggaatttttggattcaaaagcactttgtagaaatatccctcacatgaaaggaaaatctgctatgaaaaaacgacatttggaaattctggggtatcgtgtaattcagatttcccagtttgaatggaactctatggcactgtcaacaaaggatgctcggatggactacctgagagaatgtatatttggagaagtcaagtcatgtttgtagtttttatttaaaatgaatgttatcgtgtgttacatttggacctattttaataaagtggcctgtctcaattaaaaaaaaaaa

SEQ ID NO: 87824 - DNA, 2768 bp, Homo sapiens
tgccgggcattttttcctggtttgggggcaaggtctcatgggaaaggtcatgtctctcgaagaaaggttataaaccctgagatatgagggttgggcgagacatccgagcctgtttcgttccgtgttgggaccaggaataaccctgacttctgagctttcataaccccaggatcctccagaaaatttgcggcgcgctgagggaaaaccttgctgaagctgtacattggaatgcgtttacagtcattgtaatggaagcaaaatacatgaaggaaaaactgttatttgtatccctgcttattgcacctgacgactagttgcagatggttttgtttacctaagaaaacttgtgatataaatgaaaaaaacacctgttttcctagagtcattggttacaaatatgcttcgtctaagagctatttgtccattctcctggagagtgtttcaatttcgacccatcagttgtgaaccactaattattcagatgaataagtgtacagatgaggagcaaatgtttggttttattgaaagaaacaaagccatactttcagaaaagcaagtgggatgtgcatttgatatgctttggaagcttcaaaagcagaagaccagcctgttaaaaaatgctgagtatgtcagagaccatcctcaatttcttactcttcataatttagctacaaataaattcaaattaatgaatgacgataccctggtgaatgtgttatacgtcacacaacagtttgctggtgaggcccatgacccgctagttgaagcactagttacagaagcatggagaaggctagaaaggtttgatattaaactgctctcagaattttcctcttgcctagcagatcagcatttgtattttagtccattaatgggaaaaatagctgatattgttcataggaacttggaaaccacacaggacttaagttccttgtctgtcttgatggtcaacatatcttctttaatatcacgacattttcaacaacaactggtgaacaaaacagaacttctttttgacaccatagattcttctgaggtcaacgttgcaaaaagcatagcaaagtttcttcgaaatgttagatatcgttatcaaccactattagaaagatgtaataacgtatttttaagtaatgtggaccaccttgatttggattccatcagtaaaatacttagtgtatacaaatttctacaatttaatagttttgaatttattataatggctaaaaagaagctaactgaaatgattcctctgtgtaatcatcctgctagctttgtaaaattgtttgtagcattgggacccattgcaggacctgaagaaaagaaacaacttaaatcaactatgttattgatgtcagaggacctaactggcgagcaagccctggcagtgttgggagcaatgggagatatggaaagcagaaactcatgtctgattaaaagagttacttcagttctgcataaacatttggatggctataaaccattagagttgttgaagataactcaagaattgacttttctgcatttccaaaggaaggagttttttgcgaaacttagagaattactgcttagttatttgaaaaatagtttcataccaactgaggtgtctgttctggtccgtgctatttccctgctcccttctcctcacttggacgaagtggggatatcccgaattgaagccgttttaccacagtgtgacctaaataacctgagtagttttgccacatctgttttaagatggattcagcatgatcacgtgtatttggataatatgactgcgaaacaactgaaactacttcaaaaattagatcactatggtcgtcagagactacaacacagcaacagtttggatctgttacggaaggaacttaaatctctcaaaggaaacacgtttcctgagtcacttcttgaagaaatgattgctactttacagcatttcatggatgatattaattacataaatgttggggagattgcatcttttatttctagtactgattacctcagtactttgctactagataggatagcctcagtggctgttcagcagattgaaaagatccatccttttacaatccctgctattattcgtccattcagcgtattgaactatgatccacctcaaagggatgaatttttgggaacttgcgtgcaacatcttaattcttacttaggtatattggatccttttatattagtgtttcttggtttctctttggccacacttgaatattttccagaagatctgctaaaggcaatttttaacatcaaattcttagctagattggattctcaacttgaaattttatctccatctcgaagtgcaagagtccagtttcatcttatggagttaaatagatcagtctgcttggaatgccctgagtttcagattccatggtttcatgaccgcttctgtcaacaatataataaaggtattggtggcatggatggaacacaacagcagatttttaaaatgttagcagaggtactaggaggaatcaattgtgtaaaagcctcggttcttacgccttattaccacaaagtaggtaagttattgggtaggttattagttactttcagaaaatcaaactaatttgaatagaatcatcttatcagttggaattttttaaagttttttgaatttttttcaagttgttattattattaaaattttcaaacggagatagaaagagcaatagaataaatcctcaagttcccgtggcccagtgttgataaccaagagcgttttctattctttagaaaaaaaaaaa

SEQ ID NO: 87825 - DNA, 766 bp, Homo sapiens
gtccagcctgcagatttgtttttttgaattgaaggatagttaacaaagaaaatgcacagatcttaatgttccttctataggcatgttttttaaattatttatttccttaacatttaaacattgagagatctcacataaaaacccagacttctggttccttttgagaagccagaaattggccacacagaccctcattcttgcattcttgcaagacagccgtgagctggaggcacacttcagccaaactgctggttggcactccacatgttccccacagccacagtccctagccaggcccctttcctctttgcctgccaggtccctggaatccattcctctctgtctcagctgagacaatacttcctcaggtaagccttctggaccccttcagactagatgaggtcatttggttataaactggcatagtcccacgaactttcttcattgtaattaactcattatttgattgatatccatgtttttgggcaggagtggtggctcatgcctataatccctgcactttgggaagccaaggcaggcagatcacctgagatcaggagtttgagactagccttggccaacatggcgaaaccttggctctactaaaaatacaaaaattagccaggcgtggtggcgaacacctgtagtcccagctactcgggaggctgaggcaggagaatcacttgaacctgggaggcagaggttgcagtgagccaagatcgtgccattgcactccagcctgggcaacagagcgagactccatctc

SEQ ID NO: 87826 - DNA, 396 bp, Homo sapiens
ttaacttacaggcctttaatccatgtggtaattttttgtttacatctagttgattttcttattatggaaaatttagttattccaagacagtttactaactagtctatcacttgccttctagtttatgatgcctttgctctcatacccaggttctcatacaagtagagaattgtatctgtgctttgtagtctgctgcattgacttaaaaaaagttcctgcctagatactaccatgtttttattcatttatttatttttgagacagagtcttgctctgttgcccaggctggagtggagggaccacaggcacacaccaccacgcccagctaatttttgtgtaatttttgtacttttaatagaggcggggtttcaccacgttggccaggctggtctcgaa

SEQ ID NO: 87827 - DNA, 394 bp, Homo sapiens
aatgtagaaagagagatcaaaatatcttgagttataaattcaaatagaaagaaaattatgatgagtttaggccaggatatggtgaaactggcatcgtcatatgccaggttattgagtaaccttcctcaaaagttctttactatctttgaaccactacaaatgcataatcgttcaacagtgtcaaaaagtatttatttgaatgtggtgggagaatgaaacttcttctttgggttataacctggagtatgcttccagatggtgattgtgcccatttgtacaaatagaaagctacaagaccagtcttccgagcccatgtctgtgatctgcctatgtaagaagaatagttttgtaatagagtttgcttccaagggaatctctatggcatagtattctt

SEQ ID NO: 87828 - DNA, 308 bp, Homo sapiens
tgaaccattgtgcccagcccagtatctggggctttctttttaaatttttaaaaaatgtgtaccacactacacagatgtagtatcttgggctaaaaaaaatcttaaatagacaaaggaactattcatttggactagtaatactgttactatgcattcttgcatatctcctcaattaggaattgttatctaataacgaataattgtgctggcaaaattagaagattgcattcaaggactttttttgagataggtgctatatgcagtctttcttcctttgcacctttactttgggttgctgtttgtttaaa

SEQ ID NO: 87829 - DNA, 236 bp, Homo sapiens
gacaaaataggaagattctttttaaaaccagaatctctaaaatgagtttgtttgtgatgcaagtagggtctggatcctacaaaccacggaagacttgcagacaaggcagtttcttctggaagcttccccagggaagagcaggaacccccagaatggcagagctgcacgtgtgccgctgtgtgacattcctggtgctaaaaagaaacagtgatggatctttgccatagtggggaaaa

SEQ ID NO: 87830 - DNA, 481 bp, Homo sapiens
actacatgatttggtacttatggaaatatttcatgtatatgtttataggaaaagaatatactcaacttagtagaacatatcttagttaagatacatggagatatgagataagtaataggttctacattcttcctgcaaaagtcatagagctaagaatgctctgcataaggataactcctattgttagagccatggaatcctcacctcatgctactaacattctaatgtgcaaaaatcacaaataagtaaaccctcaggggcagagcaacagtaatcttgtgaatttcaccttggaagacagaagagctagggaggcatgaaaggaagggacaaaaagtgagatggtatcaggggggaatatggtagcaaagaaaagcagtctaagaaaatggtgaccagaataaaataaacctaagtgctcatgaatccacatagccttgtctacccaacttggtcgacaaggttaaacaggacagcctga

SEQ ID NO: 87831 - DNA, 418 bp, Homo sapiens
  misc_feature (402)..(402): n is a, c, g, or t
  misc_feature (409)..(409): n is a, c, g, or t
  misc_feature (411)..(411): n is a, c, g, or t
  misc_feature (414)..(414): n is a, c, g, or t
aataaactataactagatgagctctattttttagggcaatggaagaacatgggctttggatccacacacagagagccaggttcaatccttgctccatcactcactagctgtgcaactctgggaaattacgtattgagccttagtctccttatctgggaaaatgggaataatgatattttccttactcagttgtgaagaccagataggtaacgtgtaaagtgcatttgctgggtgttcaatgagggtagttcttttccttctctctttcctgtctcccgtcacagagtggagcatggtgtttgcacagaggctgacagctttccttctgttcacccctttttcttttttctctcttttttttttgagacagagtgagaccctgtctaaaaacaaacacatcanaaaaaanantancaga

SEQ ID NO: 87832 - DNA, 201 bp, Homo sapiens
ctccgtcaaaaaaaaaaaaaaaaagaagaaaagaaaagaaaagaaaacaggatatttattttagcttcttagttaacatcattaattttgtgtagttgagcgactcgttgactgcctcctccctgcagttttttacggtgcctccggctgtcgacaggcccactgtgagccgcaggtctgtgggtgcaagtgacaacagcc

SEQ ID NO: 87833 - DNA, 469 bp, Homo sapiens
tttttttctattagtttctgacttaactcatcttgtgttttatggtttttcccattagttaggaatgtaacccaactcaagccaacagcctcagggtactagccaagtgacccatgtgcttaatgtgaaaaagataggaccccaagagattgtatccatgtggacatgtaaaaaagatgtcttttgacataaagcatcacagaggtgaagatgacattaagcaactctggttcaaaaaagcactgccttcagcaatggaccaatgtacaagacacacaaaacaagatagactaataccttctgaaaaccttttcttatgaccttaatctgcatcatacaccatactatacattgcagggcattcagagatcaaaactgtggtcccagttctcagactgtttacagactaactctgacacaaatatgatctggaagagtacagttatgtttgaaaagccaaaaataaatt

SEQ ID NO: 87834 - DNA, 422 bp, Homo sapiens
gattgtgattgatgtgatggttgatagcacctctactgagagagtagttccactaatgtaacttaggcttgaaagatttattttgaaggaagagggtatatgcactcatgggttgcaaataacagcagagtttgggtttttgctagtaggtctacagtatgctctgtgcgtctctgcttctgtctgaagattaccatcctttcttttttgttggttgttctgtttgaaatggcaattgggaaaggagtttagtaagagataggaagtagaaaggagttttaaatctctattctgcctggaactttagctgtctcaatatgggagtaaacaattcaaattaacctttttaggaaaatctcacaacagattatattctatcaggtgaaagaaagtgaaatagaactagggtacatttttaaagc

SEQ ID NO: 87835 - DNA, 4017 bp, Homo sapiens
  misc_feature (1044)..(1044): n is a, c, g, or t
tgcaaacgttcccaaatcttcccagtcggcttgcagagactccttgctcccaggagataaccaggtaaaggagtatgaaagtttgggtacaaactcattgctgcaaattgaaaaccatgcaaaggctgtcttcctctggggagttcaatgcctctctttttcttatcactttaccattggttggactttgattccagggatcctacgattactcaataccctacaggatatacatggttaaccatttgcatttgggcaaataggcgttacttttcaataggaagtggcaatccagaacttgcttttgggcaattctagtagctcaccgcttttttcttaatgactgctagaagctgcatcttattgacagatggtcatcacattggtgagctggagtcatcagattgtggggcccggagtgaggctgaagggagtggatcagagcactgcctgagagtcacctctactttcctgctaccgctgcctgtgagctgaaggggctgaaccatacactcctttttctacaaccagcttgcattttttctgcccacaatgagcggggaatcaatgaatttcagcgatgttttcgactccagtgaagattattttgtgtcagtcaatacttcatattactcagttgattctgagatgttactgtgctccttgcaggaggtcaggcagttctccaggctatttgtaccgattgcctactccttgatctgtgtctttggcctcctggggaatattctggtggtgatcacctttgctttttataagaaggccaggtctatgacagacgtctatctcttgaacatggccattgcagacatcctctttgttcttactctcccattctgggcagtgagtcatgccactggtgcgtgggttttcagcaatgccacgtgcaagttgctaaaaggcatctatgccatcaactttaactgcgggatgctgctcctgacttgcattagcatggaccggtacatcgccattgtacaggcgactaagtcattccggctccgatccagaacactaccgcgcagnaaaatcatctgccttgttgtgtgggggctgtcagtcatcatctccagctcaacttttgtcttcaaccaaaaatacaacacccaaggcagcgatgtctgtgaacccaagtaccagactgtctcggagcccatcaggtggaagctgctgatgttggggcttgagctactctttggtttctttatccctttgatgttcatgatattttgttacacgttcattgtcaaaaccttggtgcaagctcagaattctaaaaggcacaaagccatccgtgtaatcatagctgtggtgcttgtgtttctggcttgtcagattcctcataacatggtcctgcttgtgacggctgcaaatttgggtaaaatgaaccgatcctgccagagcgaaaagctaattggctatacgaaaactgtcacagaagtcctggctttcctgcactgctgcctgaaccctgtgctctacgcttttattgggcagaagttcagaaactactttctgaagatcttgaaggacctgtggtgtgtgagaaggaagtacaagtcctcaggcttctcctgtgccgggaggtactcagaaaacatttctcggcagaccagtgagaccgcagataacgacaatgcgtcgtccttcactatgtgatagaaagctgagtctccctaaggcatgtgtgaaacatactcatagatgttatgcaaaaaaaagtctatggccaggtatgcatggaaaatgtgggaattaagcaaaatcaagcaagcctctctcctgcgggacttaacgtgctcatgggctgtgtgatctcttcagggtggggtggtctctgataggtagcattttccagcactttgcaaggaatgttttgtagctctagggtatatatccgcctggcatttcacaaaacagcctttgggaaatgctgaattaaagtgaattgttgacaaatgtaaacattttcagaaatattcatgaagcggtcacagatcacagtgtcttttggttacagcacaaaatgatggcagtggtttgaaaaactaaaacagaaaaaaaaatggaagccaacacatcactcattttaggcaaatgtttaaacatttttatctatcagaatgtttattgttgctggttataagcagcaggattggccggctagtgtttcctctcatttccctttgatacagtcaacaagcctgaccctgtaaaatggaggtggaaagacaagctcaagtgttcacaacctggaagtgcttcgggaagaaggggacaatggcagaacaggtgttggtgacaattgtcaccaattggataaagcagctcaggttgtagtgggccattaggaaactgtcggtttgctttgatttccctgggagctgttctctgtcgtgagtgtctcttgtctaaacgtccattaagctgagagtgctatgaagacaggatctagaataatcttgctcacagctgtgctctgagtgcctagcggagttccagcaaacaaaatggactcaagagagatttgattaatgaatcgtaatgaagttggggtttattgtacagtttaaaatgttagatgtttttaattttttaaataaatggaatacttttttttttttttaaagaaagcaactttactgagacaatgtagaaagaagttttgttccgtttctttaatgtggttgaagagcaatgtgtggctgaagacttttgttatgaggagctgcagattagctaggggacagctggaattatgctggcttctgataattattttaaaggggtctgaaatttgtgatggaatcagattttaacagctctcttcaatgacatagaaagttcatggaactcatgtttttaaagggctatgtaaatatatgaacattagaaaaatagcaacttgtgttacaaaaatacaaacacatgttaggaaggtactgtcatgggctaggcatggtggctcacacctgtaatcccagcattttgggaagctaagatgggtggatcacttgaggtcaggagtttgagaccagcctggccaacatggcgaaacccctctctactaaaaatacaaaaatttgccaggcgtggtggcgggtgcctgtaatcccagctacttgggaggctgaggcaagagaatcgcttgaacccaggaggcagaggttgcagtgagccgagatcgtgccattgcactccagcctgggtgacagagcgagactccatctcaaaaaaaaaaaaaaaaaaaaaggaaagaactgtcatgtaaacataccgacatgtttaaacctgacaatggtgttatttgaaactttatattgttcttgtaagctttaactatatctctctttaaaatgcaaaataatgtcttaagattcaaagtctgtatttttaaagcatggctttggctttgcaaaataaaaaatgtgttttgtacatgaagtaggaatcgtatttcagcttcaaggttcagattgaggggcccactgtttggagaggatggtattcaggctttctcatgtccttcaaatctgttagcgtttgactctagaaatcaaagcaaaggagtggttacccagacacttcttttggtgtgatcaatgcgctgatgtgatctatgaagatgattcatgcttgaaaactagcacagaaacatcttgcttatttgccaaagctgggagatgagcttctctgcataatttaaatgttcagataaatgaagctgacttatttaagcaataaccttttaaacattttagctaagatgtataaaaatgtttccaaaatataccacatactttatttcttcttaaatgtagtacattaggttacatcatttttcttgctgtcttgggcatcaaaacaggtgccatggtaacctgacactctcaggagacattaagatagaaggggctgttcttcagtggttcccattgattctccccatatctttttgctctcaggctctggccgtctcttcctgagccttaactgtgt

SEQ ID NO: 87836 - DNA, 3731 bp, Homo sapiens
  misc_feature (758)..(758): n is a, c, g, or t
tgcaaacgttcccaaatcttcccagtcggcttgcagagactccttgctcccaggagataaccagaagctgcatcttattgacagatggtcatcacattggtgagctggagtcatcagattgtggggcccggagtgaggctgaagggagtggatcagagcactgcctgagagtcacctctactttcctgctaccgctgcctgtgagctgaaggggctgaaccatacactcctttttctacaaccagcttgcattttttctgcccacaatgagcggggaatcaatgaatttcagcgatgttttcgactccagtgaagattattttgtgtcagtcaatacttcatattactcagttgattctgagatgttactgtgctccttgcaggaggtcaggcagttctccaggctatttgtaccgattgcctactccttgatctgtgtctttggcctcctggggaatattctggtggtgatcacctttgctttttataagaaggccaggtctatgacagacgtctatctcttgaacatggccattgcagacatcctctttgttcttactctcccattctgggcagtgagtcatgccactggtgcgtgggttttcagcaatgccacgtgcaagttgctaaaaggcatctatgccatcaactttaactgcgggatgctgctcctgacttgcattagcatggaccggtacatcgccattgtacaggcgactaagtcattccggctccgatccagaacactaccgcgcagnaaaatcatctgccttgttgtgtgggggctgtcagtcatcatctccagctcaacttttgtcttcaaccaaaaatacaacacccaaggcagcgatgtctgtgaacccaagtaccagactgtctcggagcccatcaggtggaagctgctgatgttggggcttgagctactctttggtttctttatccctttgatgttcatgatattttgttacacgttcattgtcaaaaccttggtgcaagctcagaattctaaaaggcacaaagccatccgtgtaatcatagctgtggtgcttgtgtttctggcttgtcagattcctcataacatggtcctgcttgtgacggctgcaaatttgggtaaaatgaaccgatcctgccagagcgaaaagctaattggctatacgaaaactgtcacagaagtcctggctttcctgcactgctgcctgaaccctgtgctctacgcttttattgggcagaagttcagaaactactttctgaagatcttgaaggacctgtggtgtgtgagaaggaagtacaagtcctcaggcttctcctgtgccgggaggtactcagaaaacatttctcggcagaccagtgagaccgcagataacgacaatgcgtcgtccttcactatgtgatagaaagctgagtctccctaaggcatgtgtgaaacatactcatagatgttatgcaaaaaaaagtctatggccaggtatgcatggaaaatgtgggaattaagcaaaatcaagcaagcctctctcctgcgggacttaacgtgctcatgggctgtgtgatctcttcagggtggggtggtctctgataggtagcattttccagcactttgcaaggaatgttttgtagctctagggtatatatccgcctggcatttcacaaaacagcctttgggaaatgctgaattaaagtgaattgttgacaaatgtaaacattttcagaaatattcatgaagcggtcacagatcacagtgtcttttggttacagcacaaaatgatggcagtggtttgaaaaactaaaacagaaaaaaaaatggaagccaacacatcactcattttaggcaaatgtttaaacatttttatctatcagaatgtttattgttgctggttataagcagcaggattggccggctagtgtttcctctcatttccctttgatacagtcaacaagcctgaccctgtaaaatggaggtggaaagacaagctcaagtgttcacaacctggaagtgcttcgggaagaaggggacaatggcagaacaggtgttggtgacaattgtcaccaattggataaagcagctcaggttgtagtgggccattaggaaactgtcggtttgctttgatttccctgggagctgttctctgtcgtgagtgtctcttgtctaaacgtccattaagctgagagtgctatgaagacaggatctagaataatcttgctcacagctgtgctctgagtgcctagcggagttccagcaaacaaaatggactcaagagagatttgattaatgaatcgtaatgaagttggggtttattgtacagtttaaaatgttagatgtttttaattttttaaataaatggaatacttttttttttttttaaagaaagcaactttactgagacaatgtagaaagaagttttgttccgtttctttaatgtggttgaagagcaatgtgtggctgaagacttttgttatgaggagctgcagattagctaggggacagctggaattatgctggcttctgataattattttaaaggggtctgaaatttgtgatggaatcagattttaacagctctcttcaatgacatagaaagttcatggaactcatgtttttaaagggctatgtaaatatatgaacattagaaaaatagcaacttgtgttacaaaaatacaaacacatgttaggaaggtactgtcatgggctaggcatggtggctcacacctgtaatcccagcattttgggaagctaagatgggtggatcacttgaggtcaggagtttgagaccagcctggccaacatggcgaaacccctctctactaaaaatacaaaaatttgccaggcgtggtggcgggtgcctgtaatcccagctacttgggaggctgaggcaagagaatcgcttgaacccaggaggcagaggttgcagtgagccgagatcgtgccattgcactccagcctgggtgacagagcgagactccatctcaaaaaaaaaaaaaaaaaaaaaggaaagaactgtcatgtaaacataccgacatgtttaaacctgacaatggtgttatttgaaactttatattgttcttgtaagctttaactatatctctctttaaaatgcaaaataatgtcttaagattcaaagtctgtatttttaaagcatggctttggctttgcaaaataaaaaatgtgttttgtacatgaagtaggaatcgtatttcagcttcaaggttcagattgaggggcccactgtttggagaggatggtattcaggctttctcatgtccttcaaatctgttagcgtttgactctagaaatcaaagcaaaggagtggttacccagacacttcttttggtgtgatcaatgcgctgatgtgatctatgaagatgattcatgcttgaaaactagcacagaaacatcttgcttatttgccaaagctgggagatgagcttctctgcataatttaaatgttcagataaatgaagctgacttatttaagcaataaccttttaaacattttagctaagatgtataaaaatgtttccaaaatataccacatactttatttcttcttaaatgtagtacattaggttacatcatttttcttgctgtcttgggcatcaaaacaggtgccatggtaacctgacactctcaggagacattaagatagaaggggctgttcttcagtggttcccattgattctccccatatctttttgctctcaggctctggccgtctcttcctgagccttaactgtgt

SEQ ID NO: 87837 - DNA, 1596 bp, Homo sapiens
  misc_feature (6)..(6): n is a, c, g, or t
  misc_feature (1486)..(1486): n is a, c, g, or t
gtgggngtggggtggacgtgggcatgggtgtggcagtgggctgtggacgtgggcatggatgtgggggtctcacacccttcgctctcttcctgcccagtgctgacggggacttcgcggtcacccacctgaccaaggcccacctgttccatgacgggcgggtgcagtggactcccccggccatttacaagagctcctgcagcatcgacgtcaccttcttccccttcgaccagcagaactgcaccatgaaattcggctcctggacctacgacaaggccaagatcgacctggtgaacatgcacagccgcgtggaccagctggacttctgggagagtggcgagtgggtcatcgtggacgccgtgggcacctacaacaccaggaagtacgagtgctgcgccgagatctacccggacatcacctatgccttcgtcatccggcggctgccgctcttctacaccatcaacctcatcatcccctgcctgctcatctcctgcctcaccgtgctggtcttctacctgccctccgagtgtggcgagaagatcacgctgtgcatctccgtgctgctgtcgctcaccgtcttcctgctgctcatcaccgagatcatcccgtccacctcactggtcatcccactcatcggcgagtacctgctgttcaccatgatcttcgtcaccctgtccatcgtcatcacggtcttcgtgctcaacgtgcaccaccgctcgccacgcacgcacaccatgcccacctgggtacgcagggtcttcctggacatcgtgccacgcctgctcctcatgaagcggccgtccgtggtcaaggacaattgccggcggctcatcgagtccatgcataagatggccagtgccccgcgcttctggcccgagccagaaggggagccccctgccacgagcggcacccagagcctgcacccgccctcaccgtccttctgcgtccccctggatgtgccggctgagcctgggccttcctgcaagtcaccctccgaccagctccctcctcagcagcccctggaagctgagaaagccagcccccacccctcgcctggaccctgccgcccgccccacggcacccaggcaccagggctggccaaagccaggtccctcagcgtccagcacatgtccagccctggcgaagcggtggaaggcggcgtccggtgccggtctcggagcatccagtactgtgttccccgagacgatgccgcccccgaggcagatggccaggctgccggcgccctggcctctcgcaacacccactcggctgagctcccacccccagaccagccctctccgtgcaaatgcacatgcaagaaggagccctcttcggtgtccccgagcgccacggtcaagacccgcagcaccaaagcgccgcccccgcacctgcccctgtcgccggccctgacccgggcggtggagggcgtccagtacattgcagaccacctgaaggccgaagacacagacttctcggtaagtcccgcccntggctgtgttgggcgcctctgacccagacggaaccggcggacgccctttcttcctggtgtgtaatccaggagccgggcccaggcctcaggctgcttcgctttggggtgca

SEQ ID NO: 87838 - DNA, 411 bp, Homo sapiens
tcccagccggctgaggcgggcagggccgggcggggccgcgccacggagtccacagcccggcgctccctgccgcgccgccgccgcaccgcgccccacaggagaagacgaaccgggcccggcggccgaagcggcccgcgaggcgcgggaggcatgaagttgggcgcgcacgggcctcgaagcggcggggagccgggagccgcccgcatctagagcccgcgaggtgcgtgcgccatggagctagggggccccggagcgccgcggctgctgccgccgctgctgctgcttctggggaccggcctcctgcgcggtaagttacggggcgcggatgggccccctttcgcccgcgttcgatggcctgggacccccagagccagagggaggcaggctcctgactgcgtcccaagccgcggg

SEQ ID NO: 87839 - DNA, 3880 bp, Homo sapiens
  misc_feature (2369)..(2369): n is a, c, g, or t
  misc_feature (2646)..(2646): n is a, c, g, or t
  misc_feature (2657)..(2658): n is a, c, g, or t
tcccagccggctgaggcgggcagggccgggcggggccgcgccacggagtccacagcccggcgctccctgccgcgccgccgccgcaccgcgccccacaggagaagacgaaccgggcccggcggccgaagcggcccgcgaggcgcgggaggcatgaagttgggcgcgcacgggcctcgaagcggcggggagccgggagccgcccgcatctagagcccgcgaggtgcgtgcgccatggagctagggggccccggagcgccgcggctgctgccgccgctgctgctgcttctggggaccggcctcctgcgcgccagcagccatgtggagacccgggcccacgccgaggagcggctcctgaagaaactcttctccggttacaacaagtggtcccgacccgtggccaacatctcggacgtggtcctcgtccgcttcggcctgtccatcgctcagctcattgacgtggatgagaagaaccagatgatgaccacgaacgtatgggtgaagcaggagtggcacgactacaagctgcgctgggacccagctgactatgagaatgtcacctccatccgcatcccctccgagctcatctggcggccggacatcgtcctctacaacaatgctgacggggacttcgcggtcacccacctgaccaaggcccacctgttccatgacgggcgggtgcagtggactcccccggccatttacaagagctcctgcagcatcgacgtcaccttcttccccttcgaccagcagaactgcaccatgaaattcggctcctggacctacgacaaggccaagatcgacctggtgaacatgcacagccgcgtggaccagctggacttctgggagagtggcgagtgggtcatcgtggacgccgtgggcacctacaacaccaggaagtacgagtgctgcgccgagatctacccggacatcacctatgccttcgtcatccggcggctgccgctcttctacaccatcaacctcatcatcccctgcctgctcatctcctgcctcaccgtgctggtcttctacctgccctccgagtgtggcgagaagatcacgctgtgcatctccgtgctgctgtcgctcaccgtcttcctgctgctcatcaccgagatcatcccgtccacctcactggtcatcccactcatcggcgagtacctgctgttcaccatgatcttcgtcaccctgtccatcgtcatcacggtcttcgtgctcaacgtgcaccaccgctcgccacgcacgcacaccatgcccacctgggtacgcagggtcttcctggacatcgtgccacgcctgctcctcatgaagcggccgtccgtggtcaaggacaattgccggcggctcatcgagtccatgcataagatggccagtgccccgcgcttctggcccgagccagaaggggagccccctgccacgagcggcacccagagcctgcacccgccctcaccgtccttctgcgtccccctggatgtgccggctgagcctgggccttcctgcaagtcaccctccgaccagctccctcctcagcagcccctggaagctgagaaagccagcccccacccctcgcctggaccctgccgcccgccccacggcacccaggcaccagggctggccaaagccaggtccctcagcgtccagcacatgtccagccctggcgaagcggtggaaggcggcgtccggtgccggtctcggagcatccagtactgtgttccccgagacgatgccgcccccgaggcagatggccaggctgccggcgccctggcctctcgcaacacccactcggctgagctcccacccccagaccagccctctccgtgcaaatgcacatgcaagaaggagccctcttcggtgtccccgagcgccacggtcaagacccgcagcaccaaagcgccgcccccgcacctgcccctgtcgccggccctgacccgggcggtggagggcgtccagtacattgcagaccacctgaaggccgaagacacagacttctcggtgaaggaggactggaagtacgtggccatggtcatcgaccgcatcttcctctggatgttcatcatcgtctgcctgctggggacggtgggcctcttcctgccgccctggctggctggcatgatctaggaagggaccgggagcctgcgtggcctggggctgccgtgcacggggccagcatccatgcggccggcctggggccgggctggcttctccctggactctgtggggccacacgtttgccaaattttccttcctgttctgtgtctgctgtaagacggccttggacggggacacggcctctggggagaccgagtgtggagctgcttccagttggactgtggcctcaggaggcagtggcttggagcagaggtgggggtcgncgccttctacctgcaggactcgggctaagtccagttcaagagtctcctgagctcccctgcagatggaactcactcctcccagtctctcagcagatctggtgatggtcccgaccgcaaggggcccttgaagggagttcacgccccttcagccccaagcgccccgtcttctggaggcccggccgcctctcccacccaccgtgtcctgcgcctgtgtgggcttcaacttctcccccagggtccttgagcctctcgggccccatgagggtgagccagcagngctccaatctnnttcgctaggagagggtccaggcagggattgtgtttggttgtgttttgggtaagttagtgagaactcaagtcttgtgcctaaggagccttggagaacagagttttgtggagctggttccgcgtggggagaatcgggaggcccacgcgggaccaggctctccccctgcgcaggccctccgcggcggacaggaacacccagccccagcgagtctggagaccaggactctgccttccaggcgtagggccagggctctggcaggtggccagggctccacgggggcctagtggcttcagcccctggggtacttctgtgttgtgattccccggagctgggaaggtcccgaatggagtccagacctgggccctggttcccccaggaccctgagggtttccaccttggcgcgcagcccgggagatccgccctgggctctgggttcgggaagaaggacttcctgctacagtagctgtggggagctggtgggggcatccttgaggacctccacctgggagatgctgggaccctcggggcaggaagtccctgagaagcctcatgggagtcagggagccctggggtttccacacaggcccatgccctccgtcctggcagggcaggcagagctcagcacagcctcacccctgcaggcggtatccagaggtgagggaggcctgaaatgtttccaggcatgaccctggagcccggcagtgcaccccctaaagatggcgcacccggcagccccccagtgtccccaggggcacacttcccccttgggatgggcacaggctgccccacccctccatgattccaagggcccagaggggcggggccaggatggcgtgtcccctgcctgtgagtgacatcggttcaggaggagacagtcaggaagcctcctgctgagtggtccacattctgctgcccccagaccccatccagccaggggtggggatggggttgggctctgcgtcccactgagtctcattcctctgtccccgagccgagctctcctgggccagggtctcgtcaggaggtgcctgagagcagaatgaataattgaggttaggaacccggcatgccgagtgccccagaaatgccgctgtgtccccgcgggcagtgacgtgagtggggaggagactcaggcccacattgcccacacctgcctctgaactgctgctggtcacccccacccccgggtgcctgtgaccggggtcctgaggctggggctttt

SEQ ID NO: 87840 - DNA, 1965 bp, Homo sapiens
  misc_feature (454)..(454): n is a, c, g, or t
  misc_feature (731)..(731): n is a, c, g, or t
  misc_feature (742)..(743): n is a, c, g, or t
ggcgccggggtcctgagggctgtcccgctggcggcggccgggccgtgctggagtgacggcgtctgtgcttgcaggtgaaggaggactggaagtacgtggccatggtcatcgaccgcatcttcctctggatgttcatcatcgtctgcctgctggggacggtgggcctcttcctgccgccctggctggctggcatgatctaggaagggaccgggagcctgcgtggcctggggctgccgtgcacggggccagcatccatgcggccggcctggggccgggctggcttctccctggactctgtggggccacacgtttgccaaattttccttcctgttctgtgtctgctgtaagacggccttggacggggacacggcctctggggagaccgagtgtggagctgcttccagttggactgtggcctcaggaggcagtggcttggagcagaggtgggggtcgncgccttctacctgcaggactcgggctaagtccagttcaagagtctcctgagctcccctgcagatggaactcactcctcccagtctctcagcagatctggtgatggtcccgaccgcaaggggcccttgaagggagttcacgccccttcagccccaagcgccccgtcttctggaggcccggccgcctctcccacccaccgtgtcctgcgcctgtgtgggcttcaacttctcccccagggtccttgagcctctcgggccccatgagggtgagccagcagngctccaatctnnttcgctaggagagggtccaggcagggattgtgtttggttgtgttttgggtaagttagtgagaactcaagtcttgtgcctaaggagccttggagaacagagttttgtggagctggttccgcgtggggagaatcgggaggcccacgcgggaccaggctctccccctgcgcaggccctccgcggcggacaggaacacccagccccagcgagtctggagaccaggactctgccttccaggcgtagggccagggctctggcaggtggccagggctccacgggggcctagtggcttcagcccctggggtacttctgtgttgtgattccccggagctgggaaggtcccgaatggagtccagacctgggccctggttcccccaggaccctgagggtttccaccttggcgcgcagcccgggagatccgccctgggctctgggttcgggaagaaggacttcctgctacagtagctgtggggagctggtgggggcatccttgaggacctccacctgggagatgctgggaccctcggggcaggaagtccctgagaagcctcatgggagtcagggagccctggggtttccacacaggcccatgccctccgtcctggcagggcaggcagagctcagcacagcctcacccctgcaggcggtatccagaggtgagggaggcctgaaatgtttccaggcatgaccctggagcccggcagtgcaccccctaaagatggcgcacccggcagccccccagtgtccccaggggcacacttcccccttgggatgggcacaggctgccccacccctccatgattccaagggcccagaggggcggggccaggatggcgtgtcccctgcctgtgagtgacatcggttcaggaggagacagtcaggaagcctcctgctgagtggtccacattctgctgcccccagaccccatccagccaggggtggggatggggttgggctctgcgtcccactgagtctcattcctctgtccccgagccgagctctcctgggccagggtctcgtcaggaggtgcctgagagcagaatgaataattgaggttaggaacccggcatgccgagtgccccagaaatgccgctgtgtccccgcgggcagtgacgtgagtggggaggagactcaggcccacattgcccacacctgcctctgaactgctgctggtcacccccacccccgggtgcctgtgaccggggtcctgaggctggggctttt

SEQ ID NO: 87841 - DNA, 3471 bp, Homo sapiens
  misc_feature (2369)..(2369): n is a, c, g, or t
tcccagccggctgaggcgggcagggccgggcggggccgcgccacggagtccacagcccggcgctccctgccgcgccgccgccgcaccgcgccccacaggagaagacgaaccgggcccggcggccgaagcggcccgcgaggcgcgggaggcatgaagttgggcgcgcacgggcctcgaagcggcggggagccgggagccgcccgcatctagagcccgcgaggtgcgtgcgccatggagctagggggccccggagcgccgcggctgctgccgccgctgctgctgcttctggggaccggcctcctgcgcgccagcagccatgtggagacccgggcccacgccgaggagcggctcctgaagaaactcttctccggttacaacaagtggtcccgacccgtggccaacatctcggacgtggtcctcgtccgcttcggcctgtccatcgctcagctcattgacgtggatgagaagaaccagatgatgaccacgaacgtatgggtgaagcaggagtggcacgactacaagctgcgctgggacccagctgactatgagaatgtcacctccatccgcatcccctccgagctcatctggcggccggacatcgtcctctacaacaatgctgacggggacttcgcggtcacccacctgaccaaggcccacctgttccatgacgggcgggtgcagtggactcccccggccatttacaagagctcctgcagcatcgacgtcaccttcttccccttcgaccagcagaactgcaccatgaaattcggctcctggacctacgacaaggccaagatcgacctggtgaacatgcacagccgcgtggaccagctggacttctgggagagtggcgagtgggtcatcgtggacgccgtgggcacctacaacaccaggaagtacgagtgctgcgccgagatctacccggacatcacctatgccttcgtcatccggcggctgccgctcttctacaccatcaacctcatcatcccctgcctgctcatctcctgcctcaccgtgctggtcttctacctgccctccgagtgtggcgagaagatcacgctgtgcatctccgtgctgctgtcgctcaccgtcttcctgctgctcatcaccgagatcatcccgtccacctcactggtcatcccactcatcggcgagtacctgctgttcaccatgatcttcgtcaccctgtccatcgtcatcacggtcttcgtgctcaacgtgcaccaccgctcgccacgcacgcacaccatgcccacctgggtacgcagggtcttcctggacatcgtgccacgcctgctcctcatgaagcggccgtccgtggtcaaggacaattgccggcggctcatcgagtccatgcataagatggccagtgccccgcgcttctggcccgagccagaaggggagccccctgccacgagcggcacccagagcctgcacccgccctcaccgtccttctgcgtccccctggatgtgccggctgagcctgggccttcctgcaagtcaccctccgaccagctccctcctcagcagcccctggaagctgagaaagccagcccccacccctcgcctggaccctgccgcccgccccacggcacccaggcaccagggctggccaaagccaggtccctcagcgtccagcacatgtccagccctggcgaagcggtggaaggcggcgtccggtgccggtctcggagcatccagtactgtgttccccgagacgatgccgcccccgaggcagatggccaggctgccggcgccctggcctctcgcaacacccactcggctgagctcccacccccagaccagccctctccgtgcaaatgcacatgcaagaaggagccctcttcggtgtccccgagcgccacggtcaagacccgcagcaccaaagcgccgcccccgcacctgcccctgtcgccggccctgacccgggcggtggagggcgtccagtacattgcagaccacctgaaggccgaagacacagacttctcggtgaaggaggactggaagtacgtggccatggtcatcgaccgcatcttcctctggatgttcatcatcgtctgcctgctggggacggtgggcctcttcctgccgccctggctggctggcatgatctaggaagggaccgggagcctgcgtggcctggggctgccgtgcacggggccagcatccatgcggccggcctggggccgggctggcttctccctggactctgtggggccacacgtttgccaaattttccttcctgttctgtgtctgctgtaagacggccttggacggggacacggcctctggggagaccgagtgtggagctgcttccagttggactgtggcctcaggaggcagtggcttggagcagaggtgggggtcgncgccttctacctgcaggactcgggctaagtccagctctccccctgcgcaggccctccgcggcggacaggaacacccagccccagcgagtctggagaccaggactctgccttccaggcgtagggccagggctctggcaggtggccagggctccacgggggcctagtggcttcagcccctggggtacttctgtgttgtgattccccggagctgggaaggtcccgaatggagtccagacctgggccctggttcccccaggaccctgagggtttccaccttggcgcgcagcccgggagatccgccctgggctctgggttcgggaagaaggacttcctgctacagtagctgtggggagctggtgggggcatccttgaggacctccacctgggagatgctgggaccctcggggcaggaagtccctgagaagcctcatgggagtcagggagccctggggtttccacacaggcccatgccctccgtcctggcagggcaggcagagctcagcacagcctcacccctgcaggcggtatccagaggtgagggaggcctgaaatgtttccaggcatgaccctggagcccggcagtgcaccccctaaagatggcgcacccggcagccccccagtgtccccaggggcacacttcccccttgggatgggcacaggctgccccacccctccatgattccaagggcccagaggggcggggccaggatggcgtgtcccctgcctgtgagtgacatcggttcaggaggagacagtcaggaagcctcctgctgagtggtccacattctgctgcccccagaccccatccagccaggggtggggatggggttgggctctgcgtcccactgagtctcattcctctgtccccgagccgagctctcctgggccagggtctcgtcaggaggtgcctgagagcagaatgaataattgaggttaggaacccggcatgccgagtgccccagaaatgccgctgtgtccccgcgggcagtgacgtgagtggggaggagactcaggcccacattgcccacacctgcctctgaactgctgctggtcacccccacccccgggtgcctgtgaccggggtcctgaggctggggctttt

SEQ ID NO: 87842 - DNA, 434 bp, Homo sapiens
  misc_feature (11)..(14): n is a, c, g, or t
  misc_feature (16)..(16): n is a, c, g, or t
  misc_feature (51)..(51): n is a, c, g, or t
  misc_feature (316)..(316): n is a, c, g, or t
ggggtgggaannnntnatgtgaggagctgaaggaagtggacgtgctgggcngggggctggggcagcctggagagctcctggacagctcccggctcctgtcccgcctgcacctgagccactggcctgcctctccccgcagccagcagccatgtggagacccgggcccacgccgaggagcggctcctgaagaaactcttctccggttacaacaagtggtcccgacccgtggccaacatctcggacgtggtcctcgtccgcttcggcctgtccatcgctcagctcattgacgtggtaggtgagggcgtggcatcgtgcnctgtgactgaggtcgccctgcaaggagcacaggggtctgggtgggcagaggggacacagccatcaacactcccctctgtgagtgtccggcgggctggtacgtcagaacgacagccacc

SEQ ID NO: 87843 - DNA, 1526 bp, Homo sapiens
ggagatgtttgtggccttgtccccacatccctaggtcccctcagagtccccatcctgggctcggctgcctccagggacggggcactcaccccctccacaggtcgcccgtccaccatatcttgccctggccgtgtccttgtgccagtggctgtagatgaggaaacctagggccagagaaagacaccaaggggtcactggcccccttcctctctcggtgccctaggatgagaagaaccagatgatgaccacgaacgtatgggtgaagcaggtgagtgggagggcactgcctgccccacccctgccctcccccacacccctcaccctgctgccctgtcctggccctgccccaccctggccctgctgagaactcaagtcttgtgcctaaggagccttggagaacagagttttgtggagctggttccgcgtggggagaatcgggaggcccacgcgggaccaggctctccccctgcgcaggccctccgcggcggacaggaacacccagccccagcgagtctggagaccaggactctgccttccaggcgtagggccagggctctggcaggtggccagggctccacgggggcctagtggcttcagcccctggggtacttctgtgttgtgattccccggagctgggaaggtcccgaatggagtccagacctgggccctggttcccccaggaccctgagggtttccaccttggcgcgcagcccgggagatccgccctgggctctgggttcgggaagaaggacttcctgctacagtagctgtggggagctggtgggggcatccttgaggacctccacctgggagatgctgggaccctcggggcaggaagtccctgagaagcctcatgggagtcagggagccctggggtttccacacaggcccatgccctccgtcctggcagggcaggcagagctcagcacagcctcacccctgcaggcggtatccagaggtgagggaggcctgaaatgtttccaggcatgaccctggagcccggcagtgcaccccctaaagatggcgcacccggcagccccccagtgtccccaggggcacacttcccccttgggatgggcacaggctgccccacccctccatgattccaagggcccagaggggcggggccaggatggcgtgtcccctgcctgtgagtgacatcggttcaggaggagacagtcaggaagcctcctgctgagtggtccacattctgctgcccccagaccccatccagccaggggtggggatggggttgggctctgcgtcccactgagtctcattcctctgtccccgagccgagctctcctgggccagggtctcgtcaggaggtgcctgagagcagaatgaataattgaggttaggaacccggcatgccgagtgccccagaaatgccgctgtgtccccgcgggcagtgacgtgagtggggaggagactcaggcccacattgcccacacctgcctctgaactgctgctggtcacccccacccccgggtgcctgtgaccggggtcctgaggctggggctttt

SEQ ID NO: 87844 - DNA, 355 bp, Homo sapiens
agacatagctgattcctagctagaaaccaaaggagcttagctttcggctagcttgtaggtgagactctgatcggccgagggtaggttggcagctatttaaaattgcaaatctcttccccacctcccaacctaaccctcctcctctttaggaaagaatttcaattgcaaatatatctctgcctcagtacatcctcccccaaccccaactccccatccccctttcttctcggagcttctcccatcacccactatttattacaaacctttagctgcagcgattatttttttgctttttttcccctcattgcattttcactcctccatctttccttccttccctctcagaatcgctagg

SEQ ID NO: 87845 - DNA, 720 bp, Homo sapiens
gtctgagactgcgagagggtcgtaaccatgaggggttcctgtgagaggtctggggaggatgaagagcagaaagaagaggctatggtggcctgtgggcgtctttcaggggtccccgaggccgagcagggtcccgaggccaattgggactccgacctggagacggaaggcaccgatgggcttggagaactggtcagggacacactgtacctgaggtcttgccgggcccatagtgttgtgcccatctcctgctttctgcgccaagggagcgcccaagagctgaacctccggcaccgtggcctggggccccagggcgcccgggctctggcttcctcattgagctccaatccatatgtcaagcggctggaccttcgagacaatgggctctgtggggcaggtgcagaggccctggcaggtgccctgagcaaaagcagcagcatccatggtaggtgctgggtctggggcaggtgggcaggcgtgtcctccttttcctcagggatgtgcctccatcgttgaaagctgggccgtgtcacctggggcctgctggtgttgctggtggatagaagaggggcctcatcacaggagggggcatgtggggtggagttagaccctctgctgtgcagccgatgcctgatagaagtcctttcctcacccaccccacaccatcactcccctcccttgctggccagcatccccctcttcacctagcacatgggagactcc

SEQ ID NO: 87846 - DNA, 274 bp, Homo sapiens
atgcacgccaaaaatttacaaacattctaaaaatgtagaaaggaaatatgtaagtataaaaaatgacagaaatagaattcaaaaaataagcaaataaaatatttaattgaaaaagaacagaattggggaaaagcaatttaatagaaatcatagtaaacaaaactaaagaaaagtcacaaaatagcaacataacatttcagtaaccataataattgtaaacaggctatacaaaccaattactaaaaacaaaattctgaaattacttgaaaaatta

SEQ ID NO: 87847 - DNA, 391 bp, Homo sapiens
ccagagccttaccaataacataaaagcaattaacatatattttgtatatgtactatatacaatattcttacaataaagctagagaaaataaaatcttattaagaaaatcaaaagaagagaacatatatttactattcattaactggaagtggatcatcaaaaatgtcatcatccttgttgtctttacattgagtcagttgagaaagtggaggaagaggataggttggccttgctgtctcaggggtgacagatatagaagaaaagccacataaagtgaacccatctggttcaaacctattgttcaaggatcaactgtacaatcatactagtaagtccacagaaaactgttggcataataaaattaacgccttctcatggccttagaaatcct

SEQ ID NO: 87848 - DNA, 236 bp, Homo sapiens
agaccaacctgggcaacctagtggaaccctgtctcttcaaaacaaataaataagtaaatagctgctatggtggcatatgcctgtcatcccaaccactcgggaagctgaggcagaagtattgcttgagccatgtttacaatgaactatgatcctaccactgcacttcaacctgggtgacagagcaagaccctgtttctaaaataataatcatgctgctgtgaacacttgtgtaccgg

SEQ ID NO: 87849 - DNA, 623 bp, Homo sapiens
  misc_feature (2)..(2): n is a, c, g, or t
  misc_feature (15)..(15): n is a, c, g, or t
  misc_feature (92)..(92): n is a, c, g, or t
  misc_feature (201)..(201): n is a, c, g, or t
  misc_feature (468)..(469): n is a, c, g, or t
  misc_feature (616)..(617): n is a, c, g, or t
anggcaggaaaatcntcactttttaaagtaattctctttggagatggtggagttggaaagagttatcttatgcacagatatgtaattaatangtttgatacccagctctttcatacataggtgtggaatttttaagtaaagatttggaagtggatggacattttggtaccaagtagaattgggacacagcaggtcaggagngattctgaagcctgaggatgccattttacagaggttctgactgctgcctgcttacttttagtgttgacaattccaaagcttccagaacttaagtaactggaagaaagaattcttatatttcgctgatgtgaaagaacccaaaagctttccttttgtaattttgggtaacaagactgacagtgaacagcaggtgtctgcagaagaagcccaagcctggtgcagggacggcagcgactatccttaatttgaaacaagtgcaaaagatcnncaaatgtggcagtagcatttgaaaagggggttccaagagttcttactaccagggataggtcagatcacttgactcagagagtgatggtctgacttcatcgaaaccattggtcaatcttcattgaaagcccaagcctagctcatcttnntgttga

SEQ ID NO: 87850 - DNA, 413 bp, Homo sapiens
ctgagaaattcaaagaggctggcagtaagcttggagagtaagtgttgcagatgcagatcagaagagattaggaagagctttgcagatcaccgcaagtatttgtatttcactctaaattaaacagaaaacccaggaagggttttaggcagataaatggcattatttagtttctgtatttaagtcatcatttaggttactgggggaggctgccctgaagtggatcagaagtaaaaggcagagataccagctaggaagctgttgcagtgagccaggtgagaagagagggccacctggaccaggtagaagcagtacaggtgaaaaaaatcagacacttccaaatcttcctcaagatttgatacattattggctgggcacggtggctcacacccgtaatcccagcactttgggaggcc

SEQ ID NO: 87851 - DNA, 699 bp, Homo sapiens
ggcagggagggcaggtagccggatgccactggccatagacttataagtctaagaggggagcctcaactggttggcgggggtggggctgcaggttgcataggtgaggctgggcccttcctgctgggaaaagcagaagagggagagtccatggcaggagaggcaggtgggctcgctaggcggagctcagctgggccagcaggcactgtggtccccttggctgaatagcacaggcgacccctaggagcaacaggccaaggtgtgtgagcctgctggtcggcgatagtgcttcagcgggggccagggaccctgccttcggtcacacactagcagctatggtggtacctgggagggagggaagggggctgtgtgtccccgcctggcctgtggagtgtggagtgtgttgtgggatgaccgtgtgcatgggactctcacctagataccactggattgccgacagatagatgaggtgggaccctgactatcagccctgctttgcagtggatttggctctcagcactcccaggctgggagctggatacctgccctggcagcatgactcagactgcacgacaggtacggcatgcccaggatgatgttcttagggactggttcagtgtgtgggtcaggagcaagtcgacaggccctgctccttaccccttggaagggactgccaccaggggcagttctgactaaggcctg

SEQ ID NO: 87852 - DNA, 185 bp, Homo sapiens
tcatttcagtagatccactgcctttggttgggccggctgaatcgctggggactgcggccagtctcttaaaaaaggagaacaaaaagccgaagaccttgtgtggccgccgggacaaagcaccttgggttcggcgagaagggacgcgcaggagcgctgaacccagaacacgcgtggccgctgcggaa

SEQ ID NO: 87853 - DNA, 994 bp, Homo sapiens
  misc_feature (8)..(8): n is a, c, g, or t
tttttagnggagacagggctttgcatgttcccaggagttccagacatgtctatgcaacaaagtgagaccctgactctaagaaaaaaataaaatgtataaaatttaaaatagtaatgtgtccattaaaccttttattttagagtagttttagatttacagaaaaactccaaatagagaggtcccatatacatctatgggcattaatgagccaatattgatcattacattcatacttcattcagatttccttagtttataacctaatgtcctttttctgtcccaggatcccattcaggataccacattacatttagttgtcatgtttccttaggcttcccttggctgtgacagtttctgcaactttccttgtttttgatgacagttttgagaaataaactgatattttgtagaatgtccttctatggggattcgtctgatgtttttctcgtgactagacacaggttttggtttttgaaagaacacaacggtaaagtgccatgctcatcacatggtatcaaaggtatatgccatcaccgggactcgtcttagctgtgacagtttctcaaactttaggctactcttagctgttgatgttaaccttgatcacttagctgaggtagcatctattatatttctccactgtaaagtaatgcgtttttaaagagattatattgaaggtaaattttctggacatttacactgagctaaaacaaattctaaacactaatattaggttccactaagtgattactaataaatgctataaagaaaatacagtgaagtggaaaaataaaactccagaagtcttagcctgaatattcacctaatagaggtgaaagtgaatttttcccttgaactgtctgcgcaatttacaataatcctccacatactttggatattaaagatcttatcttactaattgtcataagaggtatttaaatttaaactaaccatttgcttatgcattttatattggcctcactaatcaatgaac

SEQ ID NO: 87854 - DNA, 446 bp, Homo sapiens
cggtggctcacgcatacaatcccagcactttgggagactaaggcgtgaggatcacttgagcccaggagttccagacatgtctatgcaacaaagtgagaccctgactctaagaaaaaaataaaatgtataaaatttaaaatagtaatgtgtccattaaaccttttattttagagtagttttagatttacagaaaaactccaaatagagaggtcccatatacatctatgggcattaatgagccaatattgatcattacattcatacttcattcagatttccttagtttataacctaatgtcctttttctgtcccaggatcccattcaggataccacattacatttagttgtcatgtttccttaggcttcccttggctgtgacagtttctgcaactttccttgtttttgatgacagttttgagaaataaactgatattttgtagaatgt

SEQ ID NO: 87855 - DNA, 1160 bp, Homo sapiens
caaaaaaagggacatcatcttagcaggacacagaggaaactagaagatagtggagcaatatactcaaaattctgaggggaaattttttccaacctaaaattctgtaccaactcttatgagctggattgtgtccctccagtgtttctgtgttgaagccctaacccccagtaactcagatagggccatttaaagaagcaattaagttaaaataagaccattagagttggccataattcaatctggtgtccttttaagaagaggaaatttggacataggaagggccatgtgaggacacagcaagaaggcagccatctgcaagccaaggaaaagggtgtcagaggaaaccaaacctgctgacaccttgatcctgcacttctagcctccaaaactatgaagaataaatttctgttgtttgagccaccctatctttggcattttatatggcagccctagcagactaacataccaaccagcctatcaatgaaatatgagattagaaaaaaggaactcacaagaagataatcctcatgcatcttttctcaggaagctcctaggaggtgttcctcactaaaatgaaggaataaggtagaaataagaaagtcatagaatccaggaaataaggagcccccactaacatgtacggcacctagagaaaggccagtccaggtacggcagggcgaaggcccaggagacacaggtttgtcaaaacagatgaactccatgcaatgcaggctgtgattgaatagaggaagaagccaaacacagctattgacaccaggatgaatggaaggctgtgcggcaaaggaagactaaatgcagctgtgactcaaatttacatgaatgtgaccacataaatactaaacagtgctctattgcaggtataacatgctacagttagtggggagccaggtgcagggatgtgtgttgaacattccagaatcctcttcttcctagggaaaagttgagataatgcctcagactgactagcaataaaagcatgtgaaaaaaaatatgtgcagttttcaaaggtttgggaaaaaacaatccctctttctgctgatggaaggatagcttagtggaatgtttctgagggctggttggtctctatatgttaaaagcattaaaagtgtgtacacactttgacccaggaatttgagctc

SEQ ID NO: 87856 - DNA, 286 bp, Homo sapiens
ttttggtcaaataaatcagagtactacaatcatcaaacatttgattcatttaacatgtgagcatctatacctgcccatttgtgtgaatattcagtatatatctcatacctattctcatgccttcatttattgtggttatggctgtagatatggaaaaaacagtagctgagacatttttattatgaactatattataccttaatcaatcagtcagaaaatgcttaggaagaagaaatgcatgattgtaaatgcatgatttcaacatgatacccgaacaacaaagttg

SEQ ID NO: 87857 - DNA, 291 bp, Homo sapiens
agcagggaacttggattttatcctataggaaatggagagatcctgagcaggagaaggaaatggtcacacttgttgacaggattgtcgagaacagttgagagaaaggcatttaagaggctctttcagctgtcttgggtgtgacaaaagaatcaagttaaaagaggatatgcagaggctagtttgagagaagttaaggaggacaaattggcaatggatggactatggcaggaaggagagaaagagagaggaggtggagatgatgttcatgtccctggcttgggcgtacgggga

SEQ ID NO: 87858 - DNA, 403 bp, Homo sapiens
gagatggcgtctcactctgtcacccaggctggagtacagtggcaagatctcagctcactgcaacctctacctcctggattcaagcaattcttctgcctcagcctcccaagtagctgaggttacaggcgcctgccacaatgtacagctaagttttatatttttagtagagatggggtttcaccatgttggccaggctggtctcaaactcctaacctcaagtgatccgcctgccttggcctcccaacatgctgggattacaggcatgagccaccactcctcaccctcttttctcatttttaaaagcttgtatccttcaacatttttctctatattctgtgaatttgtcaggtttctttttttttttcaattggagtaccaataaatgccaaggttagccaatgaa

SEQ ID NO: 87859 - DNA, 555 bp, Homo sapiens
agaccctcttctattggtgggaaccatgtctcatgggcactcacagttacaagggagtctgaaacaccagatggctggcaacagtctgaggcagccagcttccaggaggagagagggtgtacctctctatcatctaaggaccagtaatctttcctttcagtcttattgagccaatttaagtcagatttccactctagatgaattactggcagggggatatgagattattcttaaaccaacagatcaaaccctacagccagaaaaggattagtttcctctaaatcaaataaatggtttatctggaggaaggtggacgctcaaagtcagacttttgttaagaagaaagaagcatgattgattgtgtgaaggcagtctactatgggctgacatggacccaaacattgttctttgctttcttttctctttttcttgccattcattttctaagaaatcttctccactgtggtttaactgctgtgaaaattctaccaaagctatgttccccaaatggacttctcactctttctattctatgttcagctctattaaaacatt

SEQ ID NO: 87860 - DNA, 393 bp, Homo sapiens
ttcatatttcatattaaaatggacatttagtaggattattagatgaaaagggtcccccagggatatctaatatcaaattatctgcaggacatcttctccagaaagcagactgactgtaatatgaactaattttcccccctttgagttgcttgaaagaatctctgagatctgacactgatgggctacagtaatcagcagttcttgcagtactcaagacattttaaggggcaggaaatctttcctatttccagtatctcctttttgggggcaacaagggtaagctgctagttttaagtacataatttgaacttagagatttaagatgctcctggctgtacaggaaaacgcctgaaaacagcatgggcctggatgaagacgctgcttttgaaagca

SEQ ID NO: 87861 - DNA, 1669 bp, Homo sapiens
tccagcccaagtgacagagagaccctgtctcagacaaacaaacaaacaaacaaaatttcaattctgacaaggtcttcccatactgtctgaatgactgaagtgactacatgatgaacgaaaggcactattttcaccccttcccattctgttctggtaaatagttgcatcttaaaacaaaacagtatacttaaattggaattaccttctcttttctatttaaagtaaacatctttctcaagtaatatttatacaggaacagtttttgtttatggtgacagttaaaatcaagttgctcaaagagtagcctaacagattagggacaagcaaatgtaaataaataccaaaagtagaagagcaaataaagaatggaacgtatctctgagcataaacagggttgttgcataatacttgtagataaactgctccaactgttggacaaaataaagaggggattgtgccagaccttgtgttttctgattcgaactttgccaaggcctggaacgctgaagaataatacttttatttttcttttctttctaattttattttactttttatttttctttccaaaaagcattaagaggtttttgtttgtctgtttcctttatcctcttggtaaaattttagcatatttaaccatataagatttaatgtttgggtgatacaaaaaacaagaaaaatcaggtgtgttattttactaaatattaaaaatatgaaaattatagttagcattaatttcaatattatgctataagcacagttttctcccttctgtcttaaaatacataaaattttgactctgaaattgtgcagtacaaaaatgttgaaaatagaaataatccacaaaatctaatttatagcactgttcttccacacttacccaacttcacacatttgtggagaaatacaaaaattaatcatatggagcaaggtggttcatgcctatcatcccagcagtttgggaggctaaggctggaggatcgcttgaggccaggagtttaagactagcctggacaacatagtaagaccctatctctacaaaaaaaaaaacaattaacaaaagagcattatgtagcaactacaacaacattttgaatataagccagtaatatttactgtttaagtggtaagtttctagggcaggatttggggatggggaaggtagagaatatgccaaccctcttgaagtctaaaatgttaatcacatgaatgtggtggtttattttagtgaagtatttgtttacaaattcttaatgaattttatttttctaggaaaatttccagaccaaccaattcacatcgtgtatgttccttctcacctccatcatatgctctttgaactatttaaggtatgatacttcacaataattgaaattttaccttttaaaaaggtttaacagttatatttttatctcctttattattcgccacaaaacagaagcctcaatatcttttcccaagaatgcttctagtcctcctaagagaaagaaactatacagtcaatgtttgacaaagtacatgtagctcattgtagcatcaacacatatttgagaatgcatcatacaattcatgatgtatcaatgctttacagccaagaggaagttcttattattttttcaggtgcccattaaagaactagtcatttattcattcattaagagaggtcatg

SEQ ID NO: 87862 - DNA, 3621 bp, Homo sapiens
agcggaagacttgaacttgaatctcgaaccactgcatctccgactctgcccagactcttcactccgcggcaccctcaaaccccagcccaggccggggcgcacaagccagccagcgcacctgcagtcctcgcccggacgcgccgcgccccctcggaaccaggctctgctccgagcagccttcgcccctcaagccagccacagtccccgccaggccgggtgggcgtcaagatgaaggcggcccgcttcgtgctgcgcagcgctggctcgctcaacggcgccggcctggtgccccgagaggtggagcatttctcgcgctacagcccgtccccgctgtccatgaagcagctactggactttggttcagaaaatgcatgtgaaagaacttcttttgcatttttgcgacaagaattgcctgtgagactcgccaacattctgaaggaaattgatatcctcccgacccaattagtaaatacctcttcagtgcaattggttaaaagctggtatatacagagcctgatggatttggtggaattccatgagaaaagcccagatgaccagaaagcattatcagactttgtagatacactcatcaaagttcgaaatagacaccataatgtagtccctacaatggcacaaggaatcatagagtataaagatgcctgtacagttgacccagtcaccaatcaaaatcttcaatatttcttggatcgattttacatgaaccgtatttctactcggatgctgatgaaccagcacattcttatatttagtgactcacagacaggaaacccaagccacattggaagcattgatcctaactgtgatgtggtagcagtggtccaagatgcctttgagtgttcaaggatgctctgtgatcagtattatttatcatctccagaattaaagcttacacaagtgaatggaaaatttccagaccaaccaattcacatcgtgtatgttccttctcacctccatcatatgctctttgaactatttaagaatgcaatgcgggcaacagttgaacaccaggaaaatcagccttcccttacaccaatagaggttattgttgtcttgggaaaagaagaccttaccattaagatttcagacagaggaggtggtgttcccctgagaattattgaccgcctctttagttatacatactccactgcaccaacgcctgtgatggataattcccggaatgctcctttggctggttttggttacggcttgccaatttctcgtctgtatgccaagtactttcaaggagatctgaatctctactctttatcaggatatggaacagatgctatcatctacttaaaggctttgtcttctgagtctatagaaaaacttccagtttttaacaagtcagccttcaaacattatcagatgagctctgaggctgatgactggtgtatcccaagcagggaaccaaagaacctggcaaaagaagtggccatgtgaagagggacactcaggacactttacgggatcaaagtgggtctacaccagtgctgcttcctgaatgtttgtgtgtgaacccttgtttcctccaaaacaaacgacagcaacgaaaactccttaatcagaacactgatccaatgaggaatggagcttgtttctgtgacccaggagaacttagtgcaagactacaggagttaacagatggccagctccttattttttaatgtagaataactcctgagtttatatcaaatcctgaagaaataagcctcagttttccatctgtttttgataagaataagaaagggagtgagtgtgaagatggtggttagcagtttcactaagactgatattttaggcctcttgttcacatcaaaagatattggtgtcagaataccagcattttcctgccatgcaaaggattaaaacttagtttacactatgtggttacaaatatatgtcaatgtacattttgaacatatttatgtgctatggaaggaaatgctggtgactaaaataaggtttactctgaaagaggaggaattttattcaaagcattcaaacattttattcaagtgtttcaaaattcaaagcattgtattcaaagttgcagtgaaggcatcaacttatgtaaaaactcagaaggaaggctcctctgataaaaacacagctcctttattatgctgcttttcttgttcactttacacactaagtaaacacttattgtcaggtgcctagtcttgagtgaattgttagatgtgcactgaactcgggatgttggggattggagagagagaattgccaaagtaacagcaaaaatatctcttactttgctttgtttataaataaattagtagattggaaaaactagtgttagggaaagaaatcacatgttcagagcctaattcagtaggaagggcttttctctaccctgaaatgaaggtaatccaaaggcatccattttctaggcttaaaagatatatttttgatatatttaattatattctctacactccagcattaatatgtctgtttaaaaattactaattctcaaatggctcaagaacattagaatttaagtaccttttagagtaattattttaagcaaatagcctggacgtaagagattctcatgccagcatgctttcatttgtcagttgttgtgactgagagataatgaatgacacctgaaatgcatatggtattttgggagagttaaggtataatttgaaggttggcagaccagttgcgctgattactcttagagaagaagaaatggaaaaatgaaagaaggcaggaaggaaagaaaggatataggaagagagggaagcagaaggcaggcatttttctattttccccacaaattatttcaaaaaaaatctgtattttctgggatatgtcattggcaagaggaagaactggtgttttgaaagcagtatggattctttaaatgcctctcactcttacaagatagtaggctttgagataataaacttacccgtgtcaattaacatttaaactggcatatagaaaaaaaggaggatttttctgcattgtaaaataatcagtatggtttatatgttgaatttgacatttgtgtgtaatttcatggtggcctagtgttgtggtgcttctggtaatggtaatagaagctcaactatttttttgtggatttcagtttttatcatcagaagtcctagacagtgacatttcttaatggtgggagtccagctcatgcatttctgattatacaaaacagtttgcagtaggttatttgtcatttcagttttttactgaaatttgagctaaacatttttacatgtaaatacttgtatttaccaaagatttaaatcagttgattaattaattaactcaaatactgtgaactatctttaaaacactagaaaaaagaaatgttagtatctcaattacaccaactgtgcaaatgaactttgataaaatagaaataatctacattggcctttgtgaaatctggggaagagctttaggattctagtagatggatactgaatactcaggcccacttaaattattaatgtatacattgtgtttttgtctttatgctatgtacagagaaatgtgataattttttataataaatattttttatgatgataaaagaaaaaaaaaaaaaag

SEQ ID NO: 87863 - DNA, 3820 bp, Homo sapiens
agcggaagacttgaacttgaatctcgaaccactgcatctccgactctgcccagactcttcactccgcggcaccctcaaaccccagcccaggccggggcgcacaagccagccagcgcacctgcagtcctcgcccggacgcgccgcgccccctcggaaccaggctctgctccgagcagccttcgcccctcaagccagccacagtccccgccaggccgggtgggcgtcaagatgaaggcggcccgcttcgtgctgcgcagcgctggctcgctcaacggcgccggcctggtgccccgagaggtggagcatttctcgcgctacagcccgtccccgctgtccatgaagcagctactggactttggttcagaaaatgcatgtgaaagaacttcttttgcatttttgcgacaagaattgcctgtgagactcgccaacattctgaaggaaattgatatcctcccgacccaattagtaaatacctcttcagtgcaattggttaaaagctggtatatacagagcctgatggatttggtggaattccatgagaaaagcccagatgaccagaaagcattatcagactttgtagatacactcatcaaagttcgaaatagacaccataatgtagtccctacaatggcacaaggaatcatagagtataaagatgcctgtacagttgacccagtcaccaatcaaaatcttcaatatttcttggatcgattttacatgaaccgtatttctactcggatgctgatgaaccagcacattcttatatttagtgactcacagacaggaaacccaagccacattggaagcattgatcctaactgtgatgtggtagcagtggtccaagatgcctttgagtgttcaaggatgctctgtgatcagtattatttatcatctccagaattaaagcttacacaagtgaatggaaaatttccagaccaaccaattcacatcgtgtatgttccttctcacctccatcatatgctctttgaactatttaagaatgcaatgcgggcaacagttgaacaccaggaaaatcagccttcccttacaccaatagaggttattgttgtcttgggaaaagaagaccttaccattaaggtaaccattctctgttttccttttgggtgtctcttgagagaattaaatagggtcaatagtaataaagctgtctgctttttgcaatagataacagtcatatatgccaggtgatttttaaatgaaggaaagccatttttatttagacaaatgcacattgtttttaatgtgtggctttgatgacttgtattgattgttttagatttcagacagaggaggtggtgttcccctgagaattattgaccgcctctttagttatacatactccactgcaccaacgcctgtgatggataattcccggaatgctcctttggctggttttggttacggcttgccaatttctcgtctgtatgccaagtactttcaaggagatctgaatctctactctttatcaggatatggaacagatgctatcatctacttaaaggctttgtcttctgagtctatagaaaaacttccagtttttaacaagtcagccttcaaacattatcagatgagctctgaggctgatgactggtgtatcccaagcagggaaccaaagaacctggcaaaagaagtggccatgtgaagagggacactcaggacactttacgggatcaaagtgggtctacaccagtgctgcttcctgaatgtttgtgtgtgaacccttgtttcctccaaaacaaacgacagcaacgaaaactccttaatcagaacactgatccaatgaggaatggagcttgtttctgtgacccaggagaacttagtgcaagactacaggagttaacagatggccagctccttattttttaatgtagaataactcctgagtttatatcaaatcctgaagaaataagcctcagttttccatctgtttttgataagaataagaaagggagtgagtgtgaagatggtggttagcagtttcactaagactgatattttaggcctcttgttcacatcaaaagatattggtgtcagaataccagcattttcctgccatgcaaaggattaaaacttagtttacactatgtggttacaaatatatgtcaatgtacattttgaacatatttatgtgctatggaaggaaatgctggtgactaaaataaggtttactctgaaagaggaggaattttattcaaagcattcaaacattttattcaagtgtttcaaaattcaaagcattgtattcaaagttgcagtgaaggcatcaacttatgtaaaaactcagaaggaaggctcctctgataaaaacacagctcctttattatgctgcttttcttgttcactttacacactaagtaaacacttattgtcaggtgcctagtcttgagtgaattgttagatgtgcactgaactcgggatgttggggattggagagagagaattgccaaagtaacagcaaaaatatctcttactttgctttgtttataaataaattagtagattggaaaaactagtgttagggaaagaaatcacatgttcagagcctaattcagtaggaagggcttttctctaccctgaaatgaaggtaatccaaaggcatccattttctaggcttaaaagatatatttttgatatatttaattatattctctacactccagcattaatatgtctgtttaaaaattactaattctcaaatggctcaagaacattagaatttaagtaccttttagagtaattattttaagcaaatagcctggacgtaagagattctcatgccagcatgctttcatttgtcagttgttgtgactgagagataatgaatgacacctgaaatgcatatggtattttgggagagttaaggtataatttgaaggttggcagaccagttgcgctgattactcttagagaagaagaaatggaaaaatgaaagaaggcaggaaggaaagaaaggatataggaagagagggaagcagaaggcaggcatttttctattttccccacaaattatttcaaaaaaaatctgtattttctgggatatgtcattggcaagaggaagaactggtgttttgaaagcagtatggattctttaaatgcctctcactcttacaagatagtaggctttgagataataaacttacccgtgtcaattaacatttaaactggcatatagaaaaaaaggaggatttttctgcattgtaaaataatcagtatggtttatatgttgaatttgacatttgtgtgtaatttcatggtggcctagtgttgtggtgcttctggtaatggtaatagaagctcaactatttttttgtggatttcagtttttatcatcagaagtcctagacagtgacatttcttaatggtgggagtccagctcatgcatttctgattatacaaaacagtttgcagtaggttatttgtcatttcagttttttactgaaatttgagctaaacatttttacatgtaaatacttgtatttaccaaagatttaaatcagttgattaattaattaactcaaatactgtgaactatctttaaaacactagaaaaaagaaatgttagtatctcaattacaccaactgtgcaaatgaactttgataaaatagaaataatctacattggcctttgtgaaatctggggaagagctttaggattctagtagatggatactgaatactcaggcccacttaaattattaatgtatacattgtgtttttgtctttatgctatgtacagagaaatgtgataattttttataataaatattttttatgatgataaaagaaaaaaaaaaaaaag

SEQ ID NO: 87864 - DNA, 3971 bp, Homo sapiens
tccagcccaagtgacagagagaccctgtctcagacaaacaaacaaacaaacaaaatttcaattctgacaaggtcttcccatactgtctgaatgactgaagtgactacatgatgaacgaaaggcactattttcaccccttcccattctgttctggtaaatagttgcatcttaaaacaaaacagtatacttaaattggaattaccttctcttttctatttaaagtaaacatctttctcaagtaatatttatacaggaacagtttttgtttatggtgacagttaaaatcaagttgctcaaagagtagcctaacagattagggacaagcaaatgtaaataaataccaaaagtagaagagcaaataaagaatggaacgtatctctgagcataaacagggttgttgcataatacttgtagataaactgctccaactgttggacaaaataaagaggggattgtgccagaccttgtgttttctgattcgaactttgccaaggcctggaacgctgaagaataatacttttatttttcttttctttctaattttattttactttttatttttctttccaaaaagcattaagaggtttttgtttgtctgtttcctttatcctcttggtaaaattttagcatatttaaccatataagatttaatgtttgggtgatacaaaaaacaagaaaaatcaggtgtgttattttactaaatattaaaaatatgaaaattatagttagcattaatttcaatattatgctataagcacagttttctcccttctgtcttaaaatacataaaattttgactctgaaattgtgcagtacaaaaatgttgaaaatagaaataatccacaaaatctaatttatagcactgttcttccacacttacccaacttcacacatttgtggagaaatacaaaaattaatcatatggagcaaggtggttcatgcctatcatcccagcagtttgggaggctaaggctggaggatcgcttgaggccaggagtttaagactagcctggacaacatagtaagaccctatctctacaaaaaaaaaaacaattaacaaaagagcattatgtagcaactacaacaacattttgaatataagccagtaatatttactgtttaagtggtaagtttctagggcaggatttggggatggggaaggtagagaatatgccaaccctcttgaagtctaaaatgttaatcacatgaatgtggtggtttattttagtgaagtatttgtttacaaattcttaatgaattttatttttctaggaaaatttccagaccaaccaattcacatcgtgtatgttccttctcacctccatcatatgctctttgaactatttaagaatgcaatgcgggcaacagttgaacaccaggaaaatcagccttcccttacaccaatagaggttattgttgtcttgggaaaagaagaccttaccattaagatttcagacagaggaggtggtgttcccctgagaattattgaccgcctctttagttatacatactccactgcaccaacgcctgtgatggataattcccggaatgctcctttggctggttttggttacggcttgccaatttctcgtctgtatgccaagtactttcaaggagatctgaatctctactctttatcaggatatggaacagatgctatcatctacttaaaggctttgtcttctgagtctatagaaaaacttccagtttttaacaagtcagccttcaaacattatcagatgagctctgaggctgatgactggtgtatcccaagcagggaaccaaagaacctggcaaaagaagtggccatgtgaagagggacactcaggacactttacgggatcaaagtgggtctacaccagtgctgcttcctgaatgtttgtgtgtgaacccttgtttcctccaaaacaaacgacagcaacgaaaactccttaatcagaacactgatccaatgaggaatggagcttgtttctgtgacccaggagaacttagtgcaagactacaggagttaacagatggccagctccttattttttaatgtagaataactcctgagtttatatcaaatcctgaagaaataagcctcagttttccatctgtttttgataagaataagaaagggagtgagtgtgaagatggtggttagcagtttcactaagactgatattttaggcctcttgttcacatcaaaagatattggtgtcagaataccagcattttcctgccatgcaaaggattaaaacttagtttacactatgtggttacaaatatatgtcaatgtacattttgaacatatttatgtgctatggaaggaaatgctggtgactaaaataaggtttactctgaaagaggaggaattttattcaaagcattcaaacattttattcaagtgtttcaaaattcaaagcattgtattcaaagttgcagtgaaggcatcaacttatgtaaaaactcagaaggaaggctcctctgataaaaacacagctcctttattatgctgcttttcttgttcactttacacactaagtaaacacttattgtcaggtgcctagtcttgagtgaattgttagatgtgcactgaactcgggatgttggggattggagagagagaattgccaaagtaacagcaaaaatatctcttactttgctttgtttataaataaattagtagattggaaaaactagtgttagggaaagaaatcacatgttcagagcctaattcagtaggaagggcttttctctaccctgaaatgaaggtaatccaaaggcatccattttctaggcttaaaagatatatttttgatatatttaattatattctctacactccagcattaatatgtctgtttaaaaattactaattctcaaatggctcaagaacattagaatttaagtaccttttagagtaattattttaagcaaatagcctggacgtaagagattctcatgccagcatgctttcatttgtcagttgttgtgactgagagataatgaatgacacctgaaatgcatatggtattttgggagagttaaggtataatttgaaggttggcagaccagttgcgctgattactcttagagaagaagaaatggaaaaatgaaagaaggcaggaaggaaagaaaggatataggaagagagggaagcagaaggcaggcatttttctattttccccacaaattatttcaaaaaaaatctgtattttctgggatatgtcattggcaagaggaagaactggtgttttgaaagcagtatggattctttaaatgcctctcactcttacaagatagtaggctttgagataataaacttacccgtgtcaattaacatttaaactggcatatagaaaaaaaggaggatttttctgcattgtaaaataatcagtatggtttatatgttgaatttgacatttgtgtgtaatttcatggtggcctagtgttgtggtgcttctggtaatggtaatagaagctcaactatttttttgtggatttcagtttttatcatcagaagtcctagacagtgacatttcttaatggtgggagtccagctcatgcatttctgattatacaaaacagtttgcagtaggttatttgtcatttcagttttttactgaaatttgagctaaacatttttacatgtaaatacttgtatttaccaaagatttaaatcagttgattaattaattaactcaaatactgtgaactatctttaaaacactagaaaaaagaaatgttagtatctcaattacaccaactgtgcaaatgaactttgataaaatagaaataatctacattggcctttgtgaaatctggggaagagctttaggattctagtagatggatactgaatactcaggcccacttaaattattaatgtatacattgtgtttttgtctttatgctatgtacagagaaatgtgataattttttataataaatattttttatgatgataaaagaaaaaaaaaaaaaag

SEQ ID NO: 87865 - DNA, 3755 bp, Homo sapiens
caccttaagctttttgatgcttcccaagagtcccctgaattggagagaaggaagcctaaaaaagacaaatctgcctctaattctgacataactctttccagaacttcctgtttcctaacttattctaatgttactgctgtgaggtactgactgtactacaaacatctgatctactttatttcactacagctaatgactagaacttaatattatttaaaaaccagaaagcagaaagtagacaggtggtgagaaaggaaaatgggttaagaaaaccaagactgtatctgtatgagattcagccaatagacggaaaacatcttttagtttgttctgtgttaaaggacaaaggatactttttcattgatttgatttatttttaagttgaatgatacaactcatagagttattctgccatcattggtaaaagttagatgataatcaaatgcaaattgaaattcaatttagaattattgactgtccttttaaatagtaacaaccttttcacagcaagttttatgaaagccaataaattggttcaatgatttcactgttcatttgttatatagtagtctttggtgcttggatgtaaaacgtaatagaaagatagaaaagggagagctaggaaatggactataaaaaccaatttctacatttaaattaagcttacaaataagaacttgacagctagcagaattggtttccattagacattactcccaggagctatattacatagtaaatgaatatttttcattatacatcctacatgacccattcataaatggctatttacaaagctgttttactactaacttaaaaaaataggaactttgaattaccctctgtgctacttttattttaaacataaaaaaaaaaacatttattgtccctcattcctctgccattgaattccttatggtttgctttgttttagaatgcaatgcgggcaacagttgaacaccaggaaaatcagccttcccttacaccaatagaggttattgttgtcttgggaaaagaagaccttaccattaaggtaaccattctctgttttccttttgggtgtctcttgagagaattaaatagggtcaatagtaataaagctgtctgctttttgcaatagataacagtcatatatgccaggtgatttttaaatgaaggaaagccatttttatttagacaaatgcacattgtttttaatgtgtggctttgatgacttgtattgattgttttagatttcagacagaggaggtggtgttcccctgagaattattgaccgcctctttagttatacatactccactgcaccaacgcctgtgatggataattcccggaatgctcctttggctggttttggttacggcttgccaatttctcgtctgtatgccaagtactttcaaggagatctgaatctctactctttatcaggatatggaacagatgctatcatctacttaaaggctttgtcttctgagtctatagaaaaacttccagtttttaacaagtcagccttcaaacattatcagatgagctctgaggctgatgactggtgtatcccaagcagggaaccaaagaacctggcaaaagaagtggccatgtgaagagggacactcaggacactttacgggatcaaagtgggtctacaccagtgctgcttcctgaatgtttgtgtgtgaacccttgtttcctccaaaacaaacgacagcaacgaaaactccttaatcagaacactgatccaatgaggaatggagcttgtttctgtgacccaggagaacttagtgcaagactacaggagttaacagatggccagctccttattttttaatgtagaataactcctgagtttatatcaaatcctgaagaaataagcctcagttttccatctgtttttgataagaataagaaagggagtgagtgtgaagatggtggttagcagtttcactaagactgatattttaggcctcttgttcacatcaaaagatattggtgtcagaataccagcattttcctgccatgcaaaggattaaaacttagtttacactatgtggttacaaatatatgtcaatgtacattttgaacatatttatgtgctatggaaggaaatgctggtgactaaaataaggtttactctgaaagaggaggaattttattcaaagcattcaaacattttattcaagtgtttcaaaattcaaagcattgtattcaaagttgcagtgaaggcatcaacttatgtaaaaactcagaaggaaggctcctctgataaaaacacagctcctttattatgctgcttttcttgttcactttacacactaagtaaacacttattgtcaggtgcctagtcttgagtgaattgttagatgtgcactgaactcgggatgttggggattggagagagagaattgccaaagtaacagcaaaaatatctcttactttgctttgtttataaataaattagtagattggaaaaactagtgttagggaaagaaatcacatgttcagagcctaattcagtaggaagggcttttctctaccctgaaatgaaggtaatccaaaggcatccattttctaggcttaaaagatatatttttgatatatttaattatattctctacactccagcattaatatgtctgtttaaaaattactaattctcaaatggctcaagaacattagaatttaagtaccttttagagtaattattttaagcaaatagcctggacgtaagagattctcatgccagcatgctttcatttgtcagttgttgtgactgagagataatgaatgacacctgaaatgcatatggtattttgggagagttaaggtataatttgaaggttggcagaccagttgcgctgattactcttagagaagaagaaatggaaaaatgaaagaaggcaggaaggaaagaaaggatataggaagagagggaagcagaaggcaggcatttttctattttccccacaaattatttcaaaaaaaatctgtattttctgggatatgtcattggcaagaggaagaactggtgttttgaaagcagtatggattctttaaatgcctctcactcttacaagatagtaggctttgagataataaacttacccgtgtcaattaacatttaaactggcatatagaaaaaaaggaggatttttctgcattgtaaaataatcagtatggtttatatgttgaatttgacatttgtgtgtaatttcatggtggcctagtgttgtggtgcttctggtaatggtaatagaagctcaactatttttttgtggatttcagtttttatcatcagaagtcctagacagtgacatttcttaatggtgggagtccagctcatgcatttctgattatacaaaacagtttgcagtaggttatttgtcatttcagttttttactgaaatttgagctaaacatttttacatgtaaatacttgtatttaccaaagatttaaatcagttgattaattaattaactcaaatactgtgaactatctttaaaacactagaaaaaagaaatgttagtatctcaattacaccaactgtgcaaatgaactttgataaaatagaaataatctacattggcctttgtgaaatctggggaagagctttaggattctagtagatggatactgaatactcaggcccacttaaattattaatgtatacattgtgtttttgtctttatgctatgtacagagaaatgtgataattttttataataaatattttttatgatgataaaagaaaaaaaaaaaaaag

SEQ ID NO: 87866 - DNA, 2946 bp, Homo sapiens
  misc_feature (2)..(2): n is a, c, g, or t
  misc_feature (13)..(13): n is a, c, g, or t
  misc_feature (42)..(43): n is a, c, g, or t
  misc_feature (92)..(92): n is a, c, g, or t
  misc_feature (125)..(125): n is a, c, g, or t
anttccagcagangtaaatccaatttggccctcagagacctnnatttttaacagcgtcttcatcaaggacatggccagcctggacaacatanactttgtaattatttgaacattgttttaatcangtaaatgaatatttttcattatacatcctacatgacccattcataaatggctatttacaaagctgttttactactaacttaaaaaaataggaactttgaattaccctctgtgctacttttattttaaacataaaaaaaaaaacatttattgtccctcattcctctgccattgaattccttatggtttgctttgttttagaatgcaatgcgggcaacagttgaacaccaggaaaatcagccttcccttacaccaatagaggttattgttgtcttgggaaaagaagaccttaccattaagatttcagacagaggaggtggtgttcccctgagaattattgaccgcctctttagttatacatactccactgcaccaacgcctgtgatggataattcccggaatgctcctttggctggttttggttacggcttgccaatttctcgtctgtatgccaagtactttcaaggagatctgaatctctactctttatcaggatatggaacagatgctatcatctacttaaaggctttgtcttctgagtctatagaaaaacttccagtttttaacaagtcagccttcaaacattatcagatgagctctgaggctgatgactggtgtatcccaagcagggaaccaaagaacctggcaaaagaagtggccatgtgaagagggacactcaggacactttacgggatcaaagtgggtctacaccagtgctgcttcctgaatgtttgtgtgtgaacccttgtttcctccaaaacaaacgacagcaacgaaaactccttaatcagaacactgatccaatgaggaatggagcttgtttctgtgacccaggagaacttagtgcaagactacaggagttaacagatggccagctccttattttttaatgtagaataactcctgagtttatatcaaatcctgaagaaataagcctcagttttccatctgtttttgataagaataagaaagggagtgagtgtgaagatggtggttagcagtttcactaagactgatattttaggcctcttgttcacatcaaaagatattggtgtcagaataccagcattttcctgccatgcaaaggattaaaacttagtttacactatgtggttacaaatatatgtcaatgtacattttgaacatatttatgtgctatggaaggaaatgctggtgactaaaataaggtttactctgaaagaggaggaattttattcaaagcattcaaacattttattcaagtgtttcaaaattcaaagcattgtattcaaagttgcagtgaaggcatcaacttatgtaaaaactcagaaggaaggctcctctgataaaaacacagctcctttattatgctgcttttcttgttcactttacacactaagtaaacacttattgtcaggtgcctagtcttgagtgaattgttagatgtgcactgaactcgggatgttggggattggagagagagaattgccaaagtaacagcaaaaatatctcttactttgctttgtttataaataaattagtagattggaaaaactagtgttagggaaagaaatcacatgttcagagcctaattcagtaggaagggcttttctctaccctgaaatgaaggtaatccaaaggcatccattttctaggcttaaaagatatatttttgatatatttaattatattctctacactccagcattaatatgtctgtttaaaaattactaattctcaaatggctcaagaacattagaatttaagtaccttttagagtaattattttaagcaaatagcctggacgtaagagattctcatgccagcatgctttcatttgtcagttgttgtgactgagagataatgaatgacacctgaaatgcatatggtattttgggagagttaaggtataatttgaaggttggcagaccagttgcgctgattactcttagagaagaagaaatggaaaaatgaaagaaggcaggaaggaaagaaaggatataggaagagagggaagcagaaggcaggcatttttctattttccccacaaattatttcaaaaaaaatctgtattttctgggatatgtcattggcaagaggaagaactggtgttttgaaagcagtatggattctttaaatgcctctcactcttacaagatagtaggctttgagataataaacttacccgtgtcaattaacatttaaactggcatatagaaaaaaaggaggatttttctgcattgtaaaataatcagtatggtttatatgttgaatttgacatttgtgtgtaatttcatggtggcctagtgttgtggtgcttctggtaatggtaatagaagctcaactatttttttgtggatttcagtttttatcatcagaagtcctagacagtgacatttcttaatggtgggagtccagctcatgcatttctgattatacaaaacagtttgcagtaggttatttgtcatttcagttttttactgaaatttgagctaaacatttttacatgtaaatacttgtatttaccaaagatttaaatcagttgattaattaattaactcaaatactgtgaactatctttaaaacactagaaaaaagaaatgttagtatctcaattacaccaactgtgcaaatgaactttgataaaatagaaataatctacattggcctttgtgaaatctggggaagagctttaggattctagtagatggatactgaatactcaggcccacttaaattattaatgtatacattgtgtttttgtctttatgctatgtacagagaaatgtgataattttttataataaatattttttatgatgataaaagaaaaaaaaaaaaaag

SEQ ID NO: 87867 - DNA, 2388 bp, Homo sapiens
ctctgaatgtattttgagtaataacttcaagtgcaaattatgccatgcataatttctttggtctcatgtttttccccccttttcttttaggctttgtcttctgagtctatagaaaaacttccagtttttaacaagtcagccttcaaacattatcagatgagctctgaggctgatgactggtgtatcccaagcagggaaccaaagaacctggcaaaagaagtggccatgtgaagagggacactcaggacactttacgggatcaaagtgggtctacaccagtgctgcttcctgaatgtttgtgtgtgaacccttgtttcctccaaaacaaacgacagcaacgaaaactccttaatcagaacactgatccaatgaggaatggagcttgtttctgtgacccaggagaacttagtgcaagactacaggagttaacagatggccagctccttattttttaatgtagaataactcctgagtttatatcaaatcctgaagaaataagcctcagttttccatctgtttttgataagaataagaaagggagtgagtgtgaagatggtggttagcagtttcactaagactgatattttaggcctcttgttcacatcaaaagatattggtgtcagaataccagcattttcctgccatgcaaaggattaaaacttagtttacactatgtggttacaaatatatgtcaatgtacattttgaacatatttatgtgctatggaaggaaatgctggtgactaaaataaggtttactctgaaagaggaggaattttattcaaagcattcaaacattttattcaagtgtttcaaaattcaaagcattgtattcaaagttgcagtgaaggcatcaacttatgtaaaaactcagaaggaaggctcctctgataaaaacacagctcctttattatgctgcttttcttgttcactttacacactaagtaaacacttattgtcaggtgcctagtcttgagtgaattgttagatgtgcactgaactcgggatgttggggattggagagagagaattgccaaagtaacagcaaaaatatctcttactttgctttgtttataaataaattagtagattggaaaaactagtgttagggaaagaaatcacatgttcagagcctaattcagtaggaagggcttttctctaccctgaaatgaaggtaatccaaaggcatccattttctaggcttaaaagatatatttttgatatatttaattatattctctacactccagcattaatatgtctgtttaaaaattactaattctcaaatggctcaagaacattagaatttaagtaccttttagagtaattattttaagcaaatagcctggacgtaagagattctcatgccagcatgctttcatttgtcagttgttgtgactgagagataatgaatgacacctgaaatgcatatggtattttgggagagttaaggtataatttgaaggttggcagaccagttgcgctgattactcttagagaagaagaaatggaaaaatgaaagaaggcaggaaggaaagaaaggatataggaagagagggaagcagaaggcaggcatttttctattttccccacaaattatttcaaaaaaaatctgtattttctgggatatgtcattggcaagaggaagaactggtgttttgaaagcagtatggattctttaaatgcctctcactcttacaagatagtaggctttgagataataaacttacccgtgtcaattaacatttaaactggcatatagaaaaaaaggaggatttttctgcattgtaaaataatcagtatggtttatatgttgaatttgacatttgtgtgtaatttcatggtggcctagtgttgtggtgcttctggtaatggtaatagaagctcaactatttttttgtggatttcagtttttatcatcagaagtcctagacagtgacatttcttaatggtgggagtccagctcatgcatttctgattatacaaaacagtttgcagtaggttatttgtcatttcagttttttactgaaatttgagctaaacatttttacatgtaaatacttgtatttaccaaagatttaaatcagttgattaattaattaactcaaatactgtgaactatctttaaaacactagaaaaaagaaatgttagtatctcaattacaccaactgtgcaaatgaactttgataaaatagaaataatctacattggcctttgtgaaatctggggaagagctttaggattctagtagatggatactgaatactcaggcccacttaaattattaatgtatacattgtgtttttgtctttatgctatgtacagagaaatgtgataattttttataataaatattttttatgatgataaaagaaaaaaaaaaaaaag

SEQ ID NO: 87868 - DNA, 2187 bp, Homo sapiens
gtgactctccaggacttagtattgaggtgaagagggacactcaggacactttacgggatcaaagtgggtctacaccagtgctgcttcctgaatgtttgtgtgtgaacccttgtttcctccaaaacaaacgacagcaacgaaaactccttaatcagaacactgatccaatgaggaatggagcttgtttctgtgacccaggagaacttagtgcaagactacaggagttaacagatggccagctccttattttttaatgtagaataactcctgagtttatatcaaatcctgaagaaataagcctcagttttccatctgtttttgataagaataagaaagggagtgagtgtgaagatggtggttagcagtttcactaagactgatattttaggcctcttgttcacatcaaaagatattggtgtcagaataccagcattttcctgccatgcaaaggattaaaacttagtttacactatgtggttacaaatatatgtcaatgtacattttgaacatatttatgtgctatggaaggaaatgctggtgactaaaataaggtttactctgaaagaggaggaattttattcaaagcattcaaacattttattcaagtgtttcaaaattcaaagcattgtattcaaagttgcagtgaaggcatcaacttatgtaaaaactcagaaggaaggctcctctgataaaaacacagctcctttattatgctgcttttcttgttcactttacacactaagtaaacacttattgtcaggtgcctagtcttgagtgaattgttagatgtgcactgaactcgggatgttggggattggagagagagaattgccaaagtaacagcaaaaatatctcttactttgctttgtttataaataaattagtagattggaaaaactagtgttagggaaagaaatcacatgttcagagcctaattcagtaggaagggcttttctctaccctgaaatgaaggtaatccaaaggcatccattttctaggcttaaaagatatatttttgatatatttaattatattctctacactccagcattaatatgtctgtttaaaaattactaattctcaaatggctcaagaacattagaatttaagtaccttttagagtaattattttaagcaaatagcctggacgtaagagattctcatgccagcatgctttcatttgtcagttgttgtgactgagagataatgaatgacacctgaaatgcatatggtattttgggagagttaaggtataatttgaaggttggcagaccagttgcgctgattactcttagagaagaagaaatggaaaaatgaaagaaggcaggaaggaaagaaaggatataggaagagagggaagcagaaggcaggcatttttctattttccccacaaattatttcaaaaaaaatctgtattttctgggatatgtcattggcaagaggaagaactggtgttttgaaagcagtatggattctttaaatgcctctcactcttacaagatagtaggctttgagataataaacttacccgtgtcaattaacatttaaactggcatatagaaaaaaaggaggatttttctgcattgtaaaataatcagtatggtttatatgttgaatttgacatttgtgtgtaatttcatggtggcctagtgttgtggtgcttctggtaatggtaatagaagctcaactatttttttgtggatttcagtttttatcatcagaagtcctagacagtgacatttcttaatggtgggagtccagctcatgcatttctgattatacaaaacagtttgcagtaggttatttgtcatttcagttttttactgaaatttgagctaaacatttttacatgtaaatacttgtatttaccaaagatttaaatcagttgattaattaattaactcaaatactgtgaactatctttaaaacactagaaaaaagaaatgttagtatctcaattacaccaactgtgcaaatgaactttgataaaatagaaataatctacattggcctttgtgaaatctggggaagagctttaggattctagtagatggatactgaatactcaggcccacttaaattattaatgtatacattgtgtttttgtctttatgctatgtacagagaaatgtgataattttttataataaatattttttatgatgataaaagaaaaaaaaaaaaaag

SEQ ID NO: 87869 - DNA, 2210 bp, Homo sapiens
gatagccgttctagagtatacccgtctgcatcttctgaatgctgaagatgtgaagagggacactcaggacactttacgggatcaaagtgggtctacaccagtgctgcttcctgaatgtttgtgtgtgaacccttgtttcctccaaaacaaacgacagcaacgaaaactccttaatcagaacactgatccaatgaggaatggagcttgtttctgtgacccaggagaacttagtgcaagactacaggagttaacagatggccagctccttattttttaatgtagaataactcctgagtttatatcaaatcctgaagaaataagcctcagttttccatctgtttttgataagaataagaaagggagtgagtgtgaagatggtggttagcagtttcactaagactgatattttaggcctcttgttcacatcaaaagatattggtgtcagaataccagcattttcctgccatgcaaaggattaaaacttagtttacactatgtggttacaaatatatgtcaatgtacattttgaacatatttatgtgctatggaaggaaatgctggtgactaaaataaggtttactctgaaagaggaggaattttattcaaagcattcaaacattttattcaagtgtttcaaaattcaaagcattgtattcaaagttgcagtgaaggcatcaacttatgtaaaaactcagaaggaaggctcctctgataaaaacacagctcctttattatgctgcttttcttgttcactttacacactaagtaaacacttattgtcaggtgcctagtcttgagtgaattgttagatgtgcactgaactcgggatgttggggattggagagagagaattgccaaagtaacagcaaaaatatctcttactttgctttgtttataaataaattagtagattggaaaaactagtgttagggaaagaaatcacatgttcagagcctaattcagtaggaagggcttttctctaccctgaaatgaaggtaatccaaaggcatccattttctaggcttaaaagatatatttttgatatatttaattatattctctacactccagcattaatatgtctgtttaaaaattactaattctcaaatggctcaagaacattagaatttaagtaccttttagagtaattattttaagcaaatagcctggacgtaagagattctcatgccagcatgctttcatttgtcagttgttgtgactgagagataatgaatgacacctgaaatgcatatggtattttgggagagttaaggtataatttgaaggttggcagaccagttgcgctgattactcttagagaagaagaaatggaaaaatgaaagaaggcaggaaggaaagaaaggatataggaagagagggaagcagaaggcaggcatttttctattttccccacaaattatttcaaaaaaaatctgtattttctgggatatgtcattggcaagaggaagaactggtgttttgaaagcagtatggattctttaaatgcctctcactcttacaagatagtaggctttgagataataaacttacccgtgtcaattaacatttaaactggcatatagaaaaaaaggaggatttttctgcattgtaaaataatcagtatggtttatatgttgaatttgacatttgtgtgtaatttcatggtggcctagtgttgtggtgcttctggtaatggtaatagaagctcaactatttttttgtggatttcagtttttatcatcagaagtcctagacagtgacatttcttaatggtgggagtccagctcatgcatttctgattatacaaaacagtttgcagtaggttatttgtcatttcagttttttactgaaatttgagctaaacatttttacatgtaaatacttgtatttaccaaagatttaaatcagttgattaattaattaactcaaatactgtgaactatctttaaaacactagaaaaaagaaatgttagtatctcaattacaccaactgtgcaaatgaactttgataaaatagaaataatctacattggcctttgtgaaatctggggaagagctttaggattctagtagatggatactgaatactcaggcccacttaaattattaatgtatacattgtgtttttgtctttatgctatgtacagagaaatgtgataattttttataataaatattttttatgatgataaaagaaaaaaaaaaaaaag

SEQ ID NO: 87870 - DNA, 2338 bp, Homo sapiens
ctctgaatgtattttgagtaataacttcaagtgcaaattatgccatgcataatttctttggtctcatgtttttccccccttttcttttaggctttgtcttctgagtctatagaaaaacttccagtttttaacaagtcagccttcaaacattatcagatgagctctgaggctgatgactggtgtatcccaagcagggaaccaaagaacctggcaaaagaagtggccatgtgaagagggacactcaggacactttacgggatcaaagtgggtctacaccagtgctgcttcctgaatgtttgtgtgtgaacccttgtttcctccaaaacaaacgacagcaacgaaaactccttaatcagaacactgatccaatgaggaatggagcttgtttctgtgacccaggagaacttagtgcaagactacaggagttaacagatggccagctccttattttttaatgtagaataactcctgagtttatatcaaatcctgaagaaataagcctcagttttccatctgtttttgataagaataagaaagggagtgagtgtgaagatggtggttagcagtttcactaagactgatattttcctgccatgcaaaggattaaaacttagtttacactatgtggttacaaatatatgtcaatgtacattttgaacatatttatgtgctatggaaggaaatgctggtgactaaaataaggtttactctgaaagaggaggaattttattcaaagcattcaaacattttattcaagtgtttcaaaattcaaagcattgtattcaaagttgcagtgaaggcatcaacttatgtaaaaactcagaaggaaggctcctctgataaaaacacagctcctttattatgctgcttttcttgttcactttacacactaagtaaacacttattgtcaggtgcctagtcttgagtgaattgttagatgtgcactgaactcgggatgttggggattggagagagagaattgccaaagtaacagcaaaaatatctcttactttgctttgtttataaataaattagtagattggaaaaactagtgttagggaaagaaatcacatgttcagagcctaattcagtaggaagggcttttctctaccctgaaatgaaggtaatccaaaggcatccattttctaggcttaaaagatatatttttgatatatttaattatattctctacactccagcattaatatgtctgtttaaaaattactaattctcaaatggctcaagaacattagaatttaagtaccttttagagtaattattttaagcaaatagcctggacgtaagagattctcatgccagcatgctttcatttgtcagttgttgtgactgagagataatgaatgacacctgaaatgcatatggtattttgggagagttaaggtataatttgaaggttggcagaccagttgcgctgattactcttagagaagaagaaatggaaaaatgaaagaaggcaggaaggaaagaaaggatataggaagagagggaagcagaaggcaggcatttttctattttccccacaaattatttcaaaaaaaatctgtattttctgggatatgtcattggcaagaggaagaactggtgttttgaaagcagtatggattctttaaatgcctctcactcttacaagatagtaggctttgagataataaacttacccgtgtcaattaacatttaaactggcatatagaaaaaaaggaggatttttctgcattgtaaaataatcagtatggtttatatgttgaatttgacatttgtgtgtaatttcatggtggcctagtgttgtggtgcttctggtaatggtaatagaagctcaactatttttttgtggatttcagtttttatcatcagaagtcctagacagtgacatttcttaatggtgggagtccagctcatgcatttctgattatacaaaacagtttgcagtaggttatttgtcatttcagttttttactgaaatttgagctaaacatttttacatgtaaatacttgtatttaccaaagatttaaatcagttgattaattaattaactcaaatactgtgaactatctttaaaacactagaaaaaagaaatgttagtatctcaattacaccaactgtgcaaatgaactttgataaaatagaaataatctacattggcctttgtgaaatctggggaagagctttaggattctagtagatggatactgaatactcaggcccacttaaattattaatgtatacattgtgtttttgtctttatgctatgtacagagaaatgtgataattttttataataaatattttttatgatgataaaagaaaaaaaaaaaaaag

SEQ ID NO: 87871 - DNA, 3567 bp, Homo sapiens
agcggaagacttgaacttgaatctcgaaccactgcatctccgactctgcccagactcttcactccgcggcaccctcaaaccccagcccaggccggggcgcacaagccagccagcgcacctgcagtcctcgcccggacgcgccgcgccccctcggaaccaggctctgctccgagcagccttcgcccctcaagccagccacagtccccgccaggccgggtgggcgtcaagatgaaggcggcccgcttcgtgctgcgcagcgctggctcgctcaacggcgccggcctggtgccccgagaggtggagcatttctcgcgctacagcccgtccccgctgtccatgaagcagctactggactttggttcagaaaatgcatgtgaaagaacttcttttgcatttttgcgacaagaattgcctgtgagactcgccaacattctgaaggaaattgatatcctcccgacccaattagtaaatacctcttcagtgcaattggttaaaagctggtatatacagagcctgatggatttggtggaattccatgagaaaagcccagatgaccagaaagcattatcagactttgtagatacactcatcaaagttcgaaatagacaccataatgtagtccctacaatggcacaaggaatcatagagtataaagatgcctgtacagttgacccagtcaccaatcaaaatcttcaatatttcttggatcgattttacatgaaccgtatttctactcggatgctgatgaaccagcacattcttatatttagtgactcacagacaggaaacccaagccacattggaagcattgatcctaactgtgatgtggtagcagtggtccaagatgcctttgagtgttcaaggatgctctgtgatcagtattatttatcatctccagaattaaagcttacacaagtgaatggaaaatttccagaccaaccaattcacatcgtgtatgttccttctcacctccatcatatgctctttgaactatttaagaatgcaatgcgggcaacagttgaacaccaggaaaatcagccttcccttacaccaatagaggttattgttgtcttgggaaaagaagaccttaccattaagatttcagacagaggaggtggtgttcccctgagaattattgaccgcctctttagttatacatactccactgcaccaacgcctgtgatggataattcccggaatgctcctttggctggttttggttacggcttgccaatttctcgtctgtatgccaagtactttcaaggagatctgaatctctactctttatcaggatatggaacagatgctatcatctacttaaaggctttgtcttctgagtctatagaaaaacttccagtttttaacaagtcagccttcaaacattatcagatgagctctgaggctgatgactggtgtatcccaagcagggaaccaaagaacctggcaaaagaagtggccatgtgaagagggacactcaggacactttacgggatcaaagtgggtctacaccagtgctgcttcctgaatgtttgtgtgtgaacccttgtttcctccaaaacaaacgacagcaacgaaaactccttaatcagaacactgatccaatgaggaatggagcttgtttctgtgacccaggagaacttagtgcaagactacaggagttaacagatggccagctccttattttttaatgtagaataactcctgagtttatatcaaatcctgaagaaataagcctcagttttccatctgtttttgataagaataagaaagggagtgagtgtgaagatggtggttagcagtttcactaagactgatattttaggcctcttgttcacatcaaaagatattggtgtcagaataccagcattttcctgccatgcaaaggattaaaacttagtttacactatgtggttacaaatatatgtcaatgtacattttgaacatatttatgtgctatggaaggaaatgctggtgactaaaataaggtttactctgaaagaggaggaattttattcaaagcattcaaacattttattcaagtgtttcaaaattcaaagcattgtattcaaagttgcagtgaaggcatcaacttatgtaaaaactcagaaggaaggctcctctgataaaaacacagctcctttattatgctgcttttcttgttcactttacacactaagtaaacacttattgtcaggtgcctagtcttgagtgaattgttagatgtgcactgaactcgggatgttggggattggagagagagaattgccaaagtaacagcaaaaatatctcttactttgctttgtttataaataaattagtagattggaaaaactagtgttagggaaagaaatcacatgttcagagcctaattcagtaggaagggcttttctctaccctgaaatgaaggtaatccaaaggcatccattttctaggcttaaaagatatatttttgatatatttaattatattctctacactccagcattaatatgtctgtttaaaaattactaattctcaaatggctcaagaacattagaatttaagtaccttttagagtaattattttaagcaaatagcctggacgtaagagattctcatgccagcatgctttcatttgtcagttgttgtgactgagagataatgaatgacacctgaaatgcatatggtattttgggagagttaaggtataatttgaaggttggcagaccagttgcgctgattactcttagagaagaagaaatggaaaaatgaaagaaggcaggaaggaaagaaaggatataggaagagagggaagcagaaggcaggcatttttctattttccccacaaattatttcaaaaaaaatctgtattttctgggatatgtcattggcaagaggaagaactggtgttttgaaagcagtatggattctttaaatgcctctcactcttacaagatagtaggctttgagataataaacttacccgtgtcaattaacatttaaactggcatatagaaaaaaaggaggatttttctgcattgtaaaataatcagtatggtttatatgttgaatttgacatttgtgtgtaatttcatggtggcctagtgttgtggtgcttctggtaatggtaatagaagctcaactatttttttgtggatttcagtttttatcatcagaagtcctagacagtgacatttcttaatggtgggagtccagctcatgcatttctgattatacaaaacagtttgcagtaggttatttgtcatttcagttttttactgaaatttgagctaaacatttttacatgtaaatacttgtatttaccaaagatttaaatcagttgattaattaattaactcaaatactgtgaactatctttaaaacactagaaaaaagaaatgttagtatctcaattacaccaactgtgcaaatgaactttgatttctagtagatggatactgaatactcaggcccacttaaattattaatgtatacattgtgtttttgtctttatgctatgtacagagaaatgtgataattttttataataaatattttttatgatgataaaagaaaaaaaaaaaaaag

SEQ ID NO: 87872 - DNA, 2518 bp, Homo sapiens
agcggaagacttgaacttgaatctcgaaccactgcatctccgactctgcccagactcttcactccgcggcaccctcaaaccccagcccaggccggggcgcacaagccagccagcgcacctgcagtcctcgcccggacgcgccgcgccccctcggaaccaggctctgctccgagcagccttcgcccctcaagccagccacagtccccgccaggccgggtgggcgtcaagatgaaggcggcccgcttcgtgctgcgcagcgctggctcgctcaacggcgccggcctggtgccccgagaggtggagcatttctcgcgctacagcccgtccccgctgtccatgaagcagctactggactttggttcagaaaatgcatgtgaaagaacttcttttgcatttttgcgacaagaattgcctgtgagactcgccaacattctgaaggaaattgatatcctcccgacccaattagtaaatacctcttcagtgcaattggttaaaagctggtatatacagagcctgatggatttggtggaattccatgagaaaagcccagatgaccagaaagcattatcagactttgtagatacactcatcaaagttcgaaatagacaccataatgtagtccctacaatggcacaaggaatcatagagtataaagatgcctgtacagttgacccagtcaccaatcaaaatcttcaatatttcttggatcgattttacatgaaccgtatttctactcggatgctgatgaaccagcacattcttatatttagtgactcacagacaggaaacccaagccacattggaagcattgatcctaactgtgatgtggtagcagtggtccaagatgcctttgagtgttcaaggatgctctgtgatcagtattatttatcatctccagaattaaagcttacacaagtgaatggaaaatttccagaccaaccaattcacatcgtgtatgttccttctcacctccatcatatgctctttgaactatttaagaatgcaatgcgggcaacagttgaacaccaggaaaatcagccttcccttacaccaatagaggttattgttgtcttgggaaaagaagaccttaccattaagatttcagacagaggaggtggtgttcccctgagaattattgaccgcctctttagttatacatactccactgcaccaacgcctgtgatggataattcccggaatgctcctttggctggttttggttacggcttgccaatttctcgtctgtatgccaagtactttcaaggagatctgaatctctactctttatcaggatatggaacagatgctatcatctacttaaaggctttgtcttctgagtctatagaaaaacttccagtttttaacaagtcagccttcaaacattatcagatgagctctgaggctgatgactggtgtatcccaagcagggaaccaaagaacctggcaaaagaagtggccatgtgaagagggacactcaggacactttacgggatcaaagtgggtctacaccagtgctgcttcctgaatgtttgtgtgtgaacccttgtttcctccaaaacaaacgacagcaacgaaaactccttaatcagaacactgatccaatgaggaatggagcttgtttctgtgacccaggagaacttagtgcaagactacaggagttaacagatggccagctccttattttttaatgtagaataactcctgagtttatatcaaatcctgaagaaataagcctcagttttccatctgtttttgataagaataagaaagggagtgagtgtgaagatggtggttagcagtttcactaagactgatattttaggcctcttgttcacatcaaaagatattggtgtcagaataccagcattttcctgccatgcaaaggattaaaacttagtttacactatgtggttacaaatatatgtcaatgtacattttgaacatatttatgtgctatggaaggaaatgctggtgactaaaataaggtttactctgaaagaggaggaattttattcaaagcattcaaacattttattcaagtgtttcaaaattcaaagcattgtattcaaagttgcagtgaaggcatcaacttatgtaaaaactcagaaggaaggctcctctgataaaaacacagctcctttattatgctgcttttcttgttcactttacacactaagtaaacacttattgtcaggtgcctagtcttgagtgaattgttagatgtgcactgaactcgggatgttggggattggagagagagaattgccaaagtaacagcaaaaatatctctactggctggtataataattgtgatggaaactagttgggagaaatactgttcgagcctatcaggggaggggtttctaccggaataagtatccaggtcattcaggtaagaatatttgaataaatttctacccgctaagtggtaaaataatcaggcaaaaaaacggatattaaaggggaactccttgtgggaaaacacttaggaggcacaaaagggttggcgtgtacgtga

SEQ ID NO: 87873 - DNA, 634 bp, Homo sapiens
atgatattagatattaatcattattttataaagagaagacttaatgaatacatctgatgaatgcattggttataaggctaatagttttacatataagctagaaacaaaatgagtctgtttgtgaaattatctcctctactctagtggaagaatctgtagtgagattactaataaaggactaatgttttatcatttgatttgttcagatgggtaatgcaaaaaaaactttagccttctgtgaagtaaccttaggagtataagtgaatgaaacgtatttgaacttttactaaccataaatattgtggcttagctttgtagatacactcatcaaagttcgaaatagacaccataatgtagtccctacaatggcacaaggaatcatagagtataaagatgcctgtacagttgacccagtcaccaatcaaaatcttcaatatttcttggatcgattttacatgaaccgtatttctactcggatgctgatgaaccagcacagtaagttagctcatcatgatcatggtatatagacatgggtgtagaatataagccatactataactagatgtctcactaatcagcgggtcacattctcagtgatagtactaatcattatcctgaattttataacaatttt

SEQ ID NO: 87874 - DNA, 1706 bp, Homo sapiens
agcggaagacttgaacttgaatctcgaaccactgcatctccgactctgcccagactcttcactccgcggcaccctcaaaccccagcccaggccggggcgcacaagccagccagcgcacctgcagtcctcgcccggacgcgccgcgccccctcggaaccaggctctgctccgagcagccttcgcccctcaagccagccacagtccccgccaggccgggtgggcgtcaagatgaaggcggcccgcttcgtgctgcgcagcgctggctcgctcaacggcgccggcctggtgccccgagaggtggagcatttctcgcgctacagcccgtccccgctgtccatgaagcagctactggactttggttcagaaaatgcatgtgaaagaacttcttttgcatttttgcgacaagaattgcctgtgagactcgccaacattctgaaggaaattgatatcctcccgacccaattagtaaatacctcttcagtgcaattggttaaaagctggtaagtggtgaaccatattgaagtctctagttttgaaacagttacccgggtatgaattcttatactatgttaacatcataattggaaaacaggtgatctgaatggtaactacttttgaaagatgtaagaattttaaaattaatttagggtaagttatcattagagaagttataaaactataaacagacatttttaccctgaaaaagtagattactttataataaaattttgagttctaggaaaaatttgaaaaaaattggcatgcaattttaattttcaattatagaagagcactttcaataataaaagagtttgatattgcaaaagaaatcctatgcctagaaaccaattcacatgactgctatttagggaaggcctaatctttgtaacttacaaagtgattgacagagtgggctctgggttcaaatcctgcctctgtcacttctagttgtggaatccttggcaagtgtcttaaactctttatgccattgagttattattcccatctgttattaaagagattaaagtatatgcctcagagggatgtttgagtgtaatgaaatgagataatccataaaaaagaaaaaaaaaaaccacttaggacagcacttggcacacagccagcagtcagtaagtgtcagttgttgtcatctcattttataaatgaagatactgatgcttagagaaggtaggtaacccaaaacagcaaatttttgggtcacagaagcaggatatgcacaggtagcagacatgcatgagacccttatcttaatccactgactgcacagccttttgttcattgattcaagaaatacatgtattatatacctataagacaattacaatctaaaacatatattcaatctgtagtatttactattgcagtcaagacttacactcttctatgaatgaatgtagtagaaaaaaaataaaaagctttaaaaaaagttgtttctaagtattattgctagaagaaatgaaaatatttgccaaacaaaacagtcaggaaactgaatactgacctgaaatagttaaagaaacattttgcgttaaattttaagtttgaaagtcaaggattaaaagttatagcattttaaatttatattattttccaaatgttctggaggaaagttttaagtttgaacataatgcttactttctcttttcaaattatttgaaaaagctattctattttcagccatttgt

SEQ ID NO: 87875 - DNA, 3571 bp, Homo sapiens
agcggaagacttgaacttgaatctcgaaccactgcatctccgactctgcccagactcttcactccgcggcaccctcaaaccccagcccaggccggggcgcacaagccagccagcgcacctgcagtcctcgcccggacgcgccgcgccccctcggaaccaggctctgctccgagcagccttcgcccctcaagccagccacagtccccgccaggccgggtgggcgtcaagatgaaggcggcccgcttcgtgctgcgcagcgctggctcgctcaacggcgccggcctggtgccccgagaggtggagcatttctcgcgctacagcccgtccccgctgtccatgaagcagctactggactttggttcagaaaatgcatgtgaaagaacttcttttgcatttttgcgacaagaattgcctgtgagactcgccaacattctgaaggaaattgatatcctcccgacccaattagtaaatacctcttcagtgcaattggttaaaagctggtatatacagagcctgatggatttggtggaattccatgagaaaagcccagatgaccagaaagcattatcagactttgtagatacactcatcaaagttcgaaatagacaccataatgtagtccctacaatggcacaaggaatcatagagtataaagatgcctgtacagttgacccagtcaccaatcaaaatcttcaatatttcttggatcgattttacatgaaccgtatttctactcggatgctgatgaaccagcacattcttatatttagtgactcacagacaggaaacccaagccacattggaagcattgatcctaactgtgatgtggtagcagtggtccaagatgcctttgagtgttcaaggatgctctgtgatcagtattatttatcatctccagaattaaagcttacacaagtgaatggaaaatttccagaccaaccaattcacatcgtgtatgttccttctcacctccatcatatgctctttgaactatttaagaatgcaatgcgggcaacagttgaacaccaggaaaatcagccttcccttacaccaatagaggttattgttgtcttgggaaaagaagaccttaccattaagatttcagacagaggaggtggtgttcccctgagaattattgaccgcctctttagttatacatactccactgcaccaacgcctgtgatggataattcccggaatgctcctttggctggttttggttacggcttgccaatttctcgtctgtatgccaagtactttcaaggagatctgaatctctactctttatcaggatatggaacagatgctatcatctacttaaaggctttgtcttctgagtctatagaaaaacttccagtttttaacaagtcagccttcaaacattatcagatgagctctgaggctgatgactggtgtatcccaagcagggaaccaaagaacctggcaaaagaagtggccatgtgaagagggacactcaggacactttacgggatcaaagtgggtctacaccagtgctgcttcctgaatgtttgtgtgtgaacccttgtttcctccaaaacaaacgacagcaacgaaaactccttaatcagaacactgatccaatgaggaatggagcttgtttctgtgacccaggagaacttagtgcaagactacaggagttaacagatggccagctccttattttttaatgtagaataactcctgagtttatatcaaatcctgaagaaataagcctcagttttccatctgtttttgataagaataagaaagggagtgagtgtgaagatggtggttagcagtttcactaagactgatattttcctgccatgcaaaggattaaaacttagtttacactatgtggttacaaatatatgtcaatgtacattttgaacatatttatgtgctatggaaggaaatgctggtgactaaaataaggtttactctgaaagaggaggaattttattcaaagcattcaaacattttattcaagtgtttcaaaattcaaagcattgtattcaaagttgcagtgaaggcatcaacttatgtaaaaactcagaaggaaggctcctctgataaaaacacagctcctttattatgctgcttttcttgttcactttacacactaagtaaacacttattgtcaggtgcctagtcttgagtgaattgttagatgtgcactgaactcgggatgttggggattggagagagagaattgccaaagtaacagcaaaaatatctcttactttgctttgtttataaataaattagtagattggaaaaactagtgttagggaaagaaatcacatgttcagagcctaattcagtaggaagggcttttctctaccctgaaatgaaggtaatccaaaggcatccattttctaggcttaaaagatatatttttgatatatttaattatattctctacactccagcattaatatgtctgtttaaaaattactaattctcaaatggctcaagaacattagaatttaagtaccttttagagtaattattttaagcaaatagcctggacgtaagagattctcatgccagcatgctttcatttgtcagttgttgtgactgagagataatgaatgacacctgaaatgcatatggtattttgggagagttaaggtataatttgaaggttggcagaccagttgcgctgattactcttagagaagaagaaatggaaaaatgaaagaaggcaggaaggaaagaaaggatataggaagagagggaagcagaaggcaggcatttttctattttccccacaaattatttcaaaaaaaatctgtattttctgggatatgtcattggcaagaggaagaactggtgttttgaaagcagtatggattctttaaatgcctctcactcttacaagatagtaggctttgagataataaacttacccgtgtcaattaacatttaaactggcatatagaaaaaaaggaggatttttctgcattgtaaaataatcagtatggtttatatgttgaatttgacatttgtgtgtaatttcatggtggcctagtgttgtggtgcttctggtaatggtaatagaagctcaactatttttttgtggatttcagtttttatcatcagaagtcctagacagtgacatttcttaatggtgggagtccagctcatgcatttctgattatacaaaacagtttgcagtaggttatttgtcatttcagttttttactgaaatttgagctaaacatttttacatgtaaatacttgtatttaccaaagatttaaatcagttgattaattaattaactcaaatactgtgaactatctttaaaacactagaaaaaagaaatgttagtatctcaattacaccaactgtgcaaatgaactttgataaaatagaaataatctacattggcctttgtgaaatctggggaagagctttaggattctagtagatggatactgaatactcaggcccacttaaattattaatgtatacattgtgtttttgtctttatgctatgtacagagaaatgtgataattttttataataaatattttttatgatgataaaagaaaaaaaaaaaaaag

SEQ ID NO: 87876 - DNA, 3560 bp, Homo sapiens
agcggaagacttgaacttgaatctcgaaccactgcatctccgactctgcccagactcttcactccgcggcaccctcaaaccccagcccaggccggggcgcacaagccagccagcgcacctgcagtcctcgcccggacgcgccgcgccccctcggaaccaggctctgctccgagcagccttcgcccctcaagccagccacagtccccgccaggccgggtgggcgtcaagatgaaggcggcccgcttcgtgctgcgcagcgctggctcgctcaacggcgccggcctggtgccccgagaggtggagcatttctcgcgctacagcccgtccccgctgtccatgaagcagctactggactttgactcgccaacattctgaaggaaattgatatcctcccgacccaattagtaaatacctcttcagtgcaattggttaaaagctggtatatacagagcctgatggatttggtggaattccatgagaaaagcccagatgaccagaaagcattatcagactttgtagatacactcatcaaagttcgaaatagacaccataatgtagtccctacaatggcacaaggaatcatagagtataaagatgcctgtacagttgacccagtcaccaatcaaaatcttcaatatttcttggatcgattttacatgaaccgtatttctactcggatgctgatgaaccagcacattcttatatttagtgactcacagacaggaaacccaagccacattggaagcattgatcctaactgtgatgtggtagcagtggtccaagatgcctttgagtgttcaaggatgctctgtgatcagtattatttatcatctccagaattaaagcttacacaagtgaatggaaaatttccagaccaaccaattcacatcgtgtatgttccttctcacctccatcatatgctctttgaactatttaagaatgcaatgcgggcaacagttgaacaccaggaaaatcagccttcccttacaccaatagaggttattgttgtcttgggaaaagaagaccttaccattaagatttcagacagaggaggtggtgttcccctgagaattattgaccgcctctttagttatacatactccactgcaccaacgcctgtgatggataattcccggaatgctcctttggctggttttggttacggcttgccaatttctcgtctgtatgccaagtactttcaaggagatctgaatctctactctttatcaggatatggaacagatgctatcatctacttaaaggctttgtcttctgagtctatagaaaaacttccagtttttaacaagtcagccttcaaacattatcagatgagctctgaggctgatgactggtgtatcccaagcagggaaccaaagaacctggcaaaagaagtggccatgtgaagagggacactcaggacactttacgggatcaaagtgggtctacaccagtgctgcttcctgaatgtttgtgtgtgaacccttgtttcctccaaaacaaacgacagcaacgaaaactccttaatcagaacactgatccaatgaggaatggagcttgtttctgtgacccaggagaacttagtgcaagactacaggagttaacagatggccagctccttattttttaatgtagaataactcctgagtttatatcaaatcctgaagaaataagcctcagttttccatctgtttttgataagaataagaaagggagtgagtgtgaagatggtggttagcagtttcactaagactgatattttaggcctcttgttcacatcaaaagatattggtgtcagaataccagcattttcctgccatgcaaaggattaaaacttagtttacactatgtggttacaaatatatgtcaatgtacattttgaacatatttatgtgctatggaaggaaatgctggtgactaaaataaggtttactctgaaagaggaggaattttattcaaagcattcaaacattttattcaagtgtttcaaaattcaaagcattgtattcaaagttgcagtgaaggcatcaacttatgtaaaaactcagaaggaaggctcctctgataaaaacacagctcctttattatgctgcttttcttgttcactttacacactaagtaaacacttattgtcaggtgcctagtcttgagtgaattgttagatgtgcactgaactcgggatgttggggattggagagagagaattgccaaagtaacagcaaaaatatctcttactttgctttgtttataaataaattagtagattggaaaaactagtgttagggaaagaaatcacatgttcagagcctaattcagtaggaagggcttttctctaccctgaaatgaaggtaatccaaaggcatccattttctaggcttaaaagatatatttttgatatatttaattatattctctacactccagcattaatatgtctgtttaaaaattactaattctcaaatggctcaagaacattagaatttaagtaccttttagagtaattattttaagcaaatagcctggacgtaagagattctcatgccagcatgctttcatttgtcagttgttgtgactgagagataatgaatgacacctgaaatgcatatggtattttgggagagttaaggtataatttgaaggttggcagaccagttgcgctgattactcttagagaagaagaaatggaaaaatgaaagaaggcaggaaggaaagaaaggatataggaagagagggaagcagaaggcaggcatttttctattttccccacaaattatttcaaaaaaaatctgtattttctgggatatgtcattggcaagaggaagaactggtgttttgaaagcagtatggattctttaaatgcctctcactcttacaagatagtaggctttgagataataaacttacccgtgtcaattaacatttaaactggcatatagaaaaaaaggaggatttttctgcattgtaaaataatcagtatggtttatatgttgaatttgacatttgtgtgtaatttcatggtggcctagtgttgtggtgcttctggtaatggtaatagaagctcaactatttttttgtggatttcagtttttatcatcagaagtcctagacagtgacatttcttaatggtgggagtccagctcatgcatttctgattatacaaaacagtttgcagtaggttatttgtcatttcagttttttactgaaatttgagctaaacatttttacatgtaaatacttgtatttaccaaagatttaaatcagttgattaattaattaactcaaatactgtgaactatctttaaaacactagaaaaaagaaatgttagtatctcaattacaccaactgtgcaaatgaactttgataaaatagaaataatctacattggcctttgtgaaatctggggaagagctttaggattctagtagatggatactgaatactcaggcccacttaaattattaatgtatacattgtgtttttgtctttatgctatgtacagagaaatgtgataattttttataataaatattttttatgatgataaaagaaaaaaaaaaaaaag

SEQ ID NO: 87877 - DNA, 3122 bp, Homo sapiens
agcggaagacttgaacttgaatctcgaaccactgcatctccgactctgcccagactcttcactccgcggcaccctcaaaccccagcccaggccggggcgcacaagccagccagcgcacctgcagtcctcgcccggacgcgccgcgccccctcggaaccaggctctgctccgagcagccttcgcccctcaagccagccacagtccccgccaggccgggtgggcgtcaagatgaaggcggcccgcttcgtgctgcgcagcgctggctcgctcaacggcgccggcctggtgccccgagaggtggagcatttctcgcgctacagcccgtccccgctgtccatgaagcagctactggactttggttcagaaaatgcatgtgaaagaacttcttttgcatttttgcgacaagaattgcctgtgagactcgccaacattctgaaggaaattgatatcctcccgacccaattagtaaatacctcttcagtgcaattggttaaaagctggtatatacagagcctgatggatttggtggaattccatgagaaaagcccagatgaccagaaagcattatcagactttgtagatacactcatcaaagttcgaaatagacaccataatgtagtccctacaatggcacaaggaatcatagagtataaagatgcctgtacagttgacccagtcaccaatcaaaatcttcaatatttcttggatcgattttacatgaaccgtatttctactcggatgctgatgaaccagcacattcttatatttagtgactcacagacaggaaacccaagccacattggaagcattgatcctaactgtgatgtggtagcagtggtccaagatgcctttgagtgttcaaggatgctctgtgatcagtattatttatcatctccagaattaaagcttacacaagtgaatggaaaatttccagaccaaccaattcacatcgtgtatgttccttctcacctccatcatatgctctttgaactatttaagaatgcaatgcgggcaacagttgaacaccaggaaaatcagccttcccttacaccaatagaggttattgttgtcttgggaaaagaagaccttaccattaagatttcagacagaggaggtggtgttcccctgagaattattgaccgcctctttagttatacatactccactgcaccaacgcctgtgatggataattcccggaatgctcctttggctggttttggttacggcttgccaatttctcgtctgtatgccaagtactttcaaggagatctgaatctctactctttatcaggatatggaacagatgctatcatctacttaaaggctttgtcttctgagtctatagaaaaacttccagtttttaacaagtcagccttcaaacattatcagatgagctctgaggctgatgactggtgtatcccaagcagggaaccaaagaacctggcaaaagaagtggccatgtgaagagggacactcaggacactttacgggatcaaagtgggtctacaccagtgctgcttcctgaatgtttgtgtgtgaacccttgtttcctccaaaacaaacgacagcaacgaaaactccttaatcagaacactgatccaatgaggaatggagcttgtttctgtgacccaggagaacttagtgcaagactacaggagttaacagatggccagctccttattttttaatgtagaataactcctgagtttatatcaaatcctgaagaaataagcctcagttttccatctgtttttgataagaataagaaagggagtgagtgtgaagatggtggttagcagtttcactaagactgatattttaggcctcttgttcacatcaaaagatattggtgtcagaataccagcattttcctgccatgcaaaggattaaaacttagtttacactatgtggttacaaatatatgtcaatgtacattttgaacatatttatgtgctatggaaggaaatgctggtgactaaaataaggtttactctgaaagaggaggaattttattcaaagcattcaaacattttattcaagtgtttcaaaattcaaagcattgtattcaaagttgcagtgaaggcatcaacttatgtaaaaactcagaaggaaggctcctctgataaaaacacagctcctttattatgctgcttttcttgttcactttacacactaagtaaacacttattgtcaggtgcctagtcttgagtgaattgttagatgtgcactgaactcgggatgttggggattggagagagagaattgccaaagtaacagcaaaaatatctcttactttgctttgtttataaataaattagtagattggaaaaactagtgttagggaaagaaatcacatgttcagagcctaattcagtaggaagggcttttctctaccctgaaatgaaggtaatccaaaggcatccattttctaggcttaaaagatatatttttgatatatttaattatattctctacactccagcattaatatgtctgtttaaaaattactaattctcaaatggctcaagaacattagaatttaagtaccttttagagtaattattttaagcaaatagcctggacgtaagagattctcatgccagcatgctttcatttgtcagttgttgtgactgagagataatgaatgacacctgaaatgcatatggtattttgggagagttaaggtataatttgaaggttggcagaccagttgcgctgattactcttagagaagaagaaatggaaaaatgaaagaaggcaggaaaaaaaaaaaaaaaaaaaaaaaaaattgggggggggcttgggccctggaaaagttttctcgaaaaacccactccgttgggaggcggcgcgggccccccagggaggtaaaggcgacacacgtgtggtcaaaagagggtggtccccagagggggagaacctcgggggacagaggaaaaagaggggccgtggggaattcctacacgccaatataaaaaaaacgccgcgaggggggcacaaccgggaggggttgtgggaaacacaagcccccacagaatgggggagctcggaaaagacacaataacggggaaatgtaatacacagggggagtcccagagagaagtccgaaattataaaattag

SEQ ID NO: 87878 - DNA, 1319 bp, Homo sapiens
agcggaagacttgaacttgaatctcgaaccactgcatctccgactctgcccagactcttcactccgcggcaccctcaaaccccagcccaggccggggcgcacaagccagccagcgcacctgcagtcctcgcccggacgcgccgcgccccctcggaaccaggctctgctccgagcagccttcgcccctcaagccagccacagtccccgccaggccgggtgggcgtcaagatgaaggcggcccgcttcgtgctgcgcagcgctggctcgctcaacggcgccggcctggtgccccgagaggtggagcatttctcgcgctacagcccgtccccgctgtccatgaagcagctactggactttggttcagaaaatgcatgtgaaagaacttcttttgcatttttgcgacaagaattgcctgtgagactcgccaacattctgaaggaaattgatatcctcccgacccaattagtaaatacctcttcagtgcaattggttaaaagctggtatatacagagcctgatggatttggtggaattccatgagaaaagcccagatgaccagaaagcattatcagactttgtagatacactcatcaaagttcgaaatagacaccataatgtagtccctacaatggcacaaggaatcatagagtataaagatgcctgtacagttgacccagtcaccaatcaaaatcttcaatatttcttggatcgattttacatgaaccgtatttctactcggatgctgatgaaccagcacattcttatatttagtgactcacagacaggaaacccaagccacattggaagcattgatcctaactgtgatgtggtagcagtggtccaagatgcctttgagtgttcaaggatgctctgtgatcagtattatttatcatctccagaattaaagcttacacaagtgaatggaaaatttccagaccaaccaattcacatcgtgtatgttccttctcacctccatcatatgctctttgaactatttaaggtatgatacttcacaataattgaaattttaccttttaaaaaggtttaacagttatatttttatctcctttattattcgccacaaaacagaagcctcaatatcttttcccaagaatgcttctagtcctcctaagagaaagaaactatacagtcaatgtttgacaaagtacatgtagctcattgtagcatcaacacatatttgagaatgcatcatacaattcatgatgtatcaatgctttacagccaagaggaagttcttattattttttcaggtgcccattaaagaactagtcatttattcattcattaagagaggtcatg

SEQ ID NO: 87879 - DNA, 1306 bp, Homo sapiens
ctaagaggtgttccccattcggcagccagactccttgaaataccctttcagtaatcattcaaccaacgcttccatgtctctactctgtcgtaacaaaggctgtgggcagcactttgaccctaataccaaccttcctgattcctgttgccatcaccctggggtcccaatcttccatgatgcacttaagggttggtcctgctgccgaaagcgaactgtagatttctctgagttcttaaacatcaagggctgtactatgggaccacactgtgctgagaagcttcctgaggcccctcaacctgaaggccctgctacaagcagttcacttcaggagcaaaaacctctgaatgtgattccaaagtcagcagagaccttgcgccgggagaggcccaagtcagagttgcctctgaagctgctgccgctaaatatatcccaagccctggaaatggcattggaacagaaggaattagaccaggaacctggggcaggacttgacagtctgatccggactggttccagctgccagaacccaggatgtgatgctgtttaccaaggccctgagagtgatgctactccatgtacctaccacccaggagcaccccgattccatgaggggatgaagtcttggagctgttgtggcatccagaccctggattttggggcattcttggcacaaccagggtgcagagtcggtagacatgactgggggaagcagctcccagcatcttgccgccatgattggcaccagacagattccttagtagtggtgactgtatatggccagattccacttcctgcgtttaactgggtgaaggccagtcaaactgagcttcatgtccacattgtctttgatggtaaccgtgtgttccaagcacagatgaagctctggggggtcataaacgtggagcagagctctgtcttcttgatgccatctcgggttgaaatctccctggtcaaggctgacccaggatcctgggcccagctggagcaccctgatgcactagctaagaaggctagggcaggggttgtgttagagatggatgaggaagaatctgacgattcagatgatgatctgagctggacagaggaggaggaagaggaggaagcaatgggggaatagtgacaccagacagttgatgtctagataggacctcaatgattcccttagaatcttagataccaggatattgttggccatgtggcatcattgagcagcaggaggctgaaggaggggagaacaaaattgtccaaaccatgctgtttttttcccttaaataaatcttgtattcttcagtttcaaaaaaaaaca

SEQ ID NO: 87880 - DNA, 1666 bp, Homo sapiens
ctaagaggtgttccccattcggcagccagactccttgaaataccctttcagtaatcattcaaccaacgcttccatgtctctactctgtcgtaacaaaggctgtgggcagcactttgaccctaataccaaccttcctgattcctgttgccatcaccctggggtcccaatcttccatgatgcacttaagggttggtcctgctgccgaaagcgaactgtagatttctctgagttcttaaacatcaagggctgtactatgggaccacactgtgctgagaagcttcctgaggcccctcaacctgaaggccctgctacaagcagttcacttcaggagcaaaaacctctgaatgtgattccaaagtcagcagagaccttgcgccgggagaggcccaagtcagagttgcctctgaagctgctgccgctaaatatatcccaagccctggaaatggcattggaacagaaggaattagaccaggaacctggggcaggacttgacagtctgatccggactggttccagctgccagaacccaggatgtgatgctgtttaccaaggccctgagagtgatgctactccatgtacctaccacccaggagcaccccgattccatgaggggatgaagtcttggagctgttgtggcatccagaccctggattttggggcattcttggcacaaccagggtgcagagtcggtagacatgactgggggaagcagctcccagcatcttgccgccatgattggcaccagacagattccttagtagtggtgactgtatatggccagattccacttcctgcgtttaactgggtgaaggccagtcaaactgagcttcatgtccacattgtctttgatggtaaccgtgtgttccaagcacagatgaagctctggggggtaagtgaagaccaggggacacaagagtgggaggcagatgggtgaaagagcggctagactggaatagagggtgtcttgagggaaggagttgtactaggaaaatggaggttttctcttcatttgctttcattttctctctctctcctactcttcctatttccctctttccctcccctcttccttctcccttttcatctctcatttctttcctctctctcccttattgtcttattcctcccttaccttttttcttaccttattaaaaatttctctctctcatttgtcaccactccaccctgaccccaatgcctttgatttcctcattctctctttcttctgttttcctttgctcctcctcaggtcataaacgtggagcagagctctgtcttcttgatgccatctcgggttgaaatctccctggtcaaggctgacccaggatcctgggcccagctggagcaccctgatgcactagctaagaaggctagggcaggggttgtgttagagatggatgaggaagaatctgacgattcagatgatgatctgagctggacagaggaggaggaagaggaggaagcaatgggggaatagtgacaccagacagttgatgtctagataggacctcaatgattcccttagaatcttagataccaggatattgttggccatgtggcatcattgagcagcaggaggctgaaggaggggagaacaaaattgtccaaaccatgctgtttttttcccttaaataaatcttgtattcttcagtttcaaaaaaaaaca

SEQ ID NO: 87881 - DNA, 2021 bp, Homo sapiens
ctaagaggtgttccccattcggcagccagactccttgaaataccctttcagtaatcattcaaccaacgcttccatgtctctactctgtcgtaacaaaggctgtgggcagcactttgaccctaataccaaccttcctgattcctgttgccatcaccctggggtcccaatcttccatgatgcacttaagggttggtcctgctgccgaaagcgaactgtagatttctctgagttcttaaacatcaagggctgtactatgggaccacactgtgctgagaagcttcctgaggcccctcaacctgaaggccctgctacaagcagttcacttcaggagcaaaaacctctgaatgtgattccaaagtcagcagagaccttgcgccgggagaggcccaagtcagagttgcctctgaagctgctgccgctaaatatatcccaagccctggaaatggcattggaacagaaggaattagaccaggaacctggggcaggacttgacagtctgatccggactggttccagctgccagaacccaggatgtgatgctgtttaccaaggccctgagagtgatgctactccatgtacctaccacccaggagcaccccgattccatgaggggtgagggaggggactgggtgggctatgaggctatgagacaggtttctcctaatatttggtcataagataatattgggggtgagagaattcagttgaattatcttcctacttcaggatgaagtcttggagctgttgtggcatccagaccctggattttggggcattcttggcacaaccagggtgcagagtcggtagacatgactgggggaagcagctcccagcatcttgccgccatgattggcaccagacagattccttagtagtggtgactgtatatggccagattccacttcctgcgtttaactgggtgaaggccagtcaaactgaggtgagcaatgatctgatgttggatgggaggatagtcaattgggtgatactacaatctcacaggcagagttgccatttgctgttaacctgtaggctccatagtacccttagaggaaaggagagttattaggtcagggctgtctggccaacctgtggatcatacctctgacctggttatctgtcgtaatgacctattctgaccttctgggtttgttactacccctgtaattcttttctctcagcttcatgtccacattgtctttgatggtaaccgtgtgttccaagcacagatgaagctctggggggtaagtgaagaccaggggacacaagagtgggaggcagatgggtgaaagagcggctagactggaatagagggtgtcttgagggaaggagttgtactaggaaaatggaggttttctcttcatttgctttcattttctctctctctcctactcttcctatttccctctttccctcccctcttccttctcccttttcatctctcatttctttcctctctctcccttattgtcttattcctcccttaccttttttcttaccttattaaaaatttctctctctcatttgtcaccactccaccctgaccccaatgcctttgatttcctcattctctctttcttctgttttcctttgctcctcctcaggtcataaacgtggagcagagctctgtcttcttgatgccatctcgggttgaaatctccctggtcaaggctgacccaggatcctgggcccagctggagcaccctgatgcactagctaagaaggctagggcaggggttgtgttagagatggatgaggaagaatctgacgattcagatgatgatctgagctggacagaggaggaggaagaggaggaagcaatgggggaatagtgacaccagacagttgatgtctagataggacctcaatgattcccttagaatcttagataccaggatattgttggccatgtggcatcattgagcagcaggaggctgaaggaggggagaacaaaattgtccaaaccatgctgtttttttcccttaaataaatcttgtattcttcagtttcaaaaaaaaaca

SEQ ID NO: 87882 - DNA, 606 bp, Homo sapiens
tgtagatttctctgagttcttaaacatcaaggtaaattatttatgtacttggattctgcccccaatagaaggattctatccctaatcctatctccttatctatactagggctgtactatgggaccacactgtgctgagaagcttcctgaggcccctcaacctgaaggccctgctacaagcagttcacttcaggagcaaaaacctctgaatgtgattccaaagtcagcagagaccttgcgccgggagaggcccaagtaaagaggaggaggcccctggacttttcttattttcatgtagcttcctaggagtgattaatgggtcattgaggactgggaactagggaccagggatgtgaggagggccagatgtcagggtttggatggtgtatatcctgtgccttaggggaaatttgtgtctggaaataacgccctttcctctaaggtggtgtgggatgatgggatagatacctgaatcaacagagtagatagcccctcacaaatacatccttagtgtataacacaaaagggattgttgagaatgacttctctttctagaaaagaactttaagataaatctcatatcaagaaaaggatgtattgtattatt

SEQ ID NO: 87883 - DNA, 284 bp, Homo sapiens
ccttccttgataacttctactgatgtccacagattcctgttgccatcaccctggggtcccaatcttccatgatgcacttaaggtgaggagtaggtgaggggggttagcaagagcatttcccagaagagataatacccaggaagctaagctgatctgggtctcttgttatcagggttggtcctgctgccgaaagcgaactgtagatttctctgagttcttaaacatcaaggtaaattatttatgtacttggattctgcccccaatagaaggattctatccctaat

SEQ ID NO: 87884 - DNA, 1053 bp, Homo sapiens
ctaagaggtgttccccattcggcagccagactccttgaaataccctttcagtaatcattcaaccaacgcttccatgtctctactctgtcgtaacaaaggctgtgggcagcactttgaccctaataccaaccttcctggtcagagttgcctctgaagctgctgccgctaaatatatcccaagccctggaaatggcattggaacagaaggaattagaccaggaacctggggcaggacttgacagtctgatccggactggttccagctgccagaacccaggatgtgatgctgtttaccaaggccctgagagtgatgctactccatgtacctaccacccaggagcaccccgattccatgaggggatgaagtcttggagctgttgtggcatccagaccctggattttggggcattcttggcacaaccagggtgcagagtcggtagacatgactgggggaagcagctcccagcatcttgccgccatgattggcaccagacagattccttagtagtggtgactgtatatggccagattccacttcctgcgtttaactgggtgaaggccagtcaaactgagcttcatgtccacattgtctttgatggtaaccgtgtgttccaagcacagatgaagctctggggggtcataaacgtggagcagagctctgtcttcttgatgccatctcgggttgaaatctccctggtcaaggctgacccaggatcctgggcccagctggagcaccctgatgcactagctaagaaggctagggcaggggttgtgttagagatggatgaggaagaatctgacgattcagatgatgatctgagctggacagaggaggaggaagaggaggaagcaatgggggaatagtgacaccagacagttgatgtctagataggacctcaatgattcccttagaatcttagataccaggatattgttggccatgtggcatcattgagcagcaggaggctgaaggaggggagaacaaaattgtccaaaccatgctgtttttttcccttaaataaatcttgtattcttcagtttcaaaaaaaaaca

SEQ ID NO: 87885 - DNA, 381 bp, Homo sapiens
gtaattcagtgcttgtgttttaacataaacttcaagtcacatgcatactaacactacttcatgagcaagaaattaccacgtctggttcattgacatttacttctgggaaccatttcaatcagattaattcatttatctaaataatcttccactcacttcacaacatcaaaactcaccaatacattttctgttgatgcttccaactttcctttttgtacagtgagaagcaagattaatttttacctggagttcacagactgggcacttattagagtatgagggaatgcaaataataacaacctctatcccaacagaacacaagaaaagggaaaaaagtagggcagatggagatgcaaatgtcaatctactactaatagggct

SEQ ID NO: 87886 - DNA, 704 bp, Homo sapiens
agcccagcctgcaaggaggcgccaccggacctgcacactcaggagcaggctcataaaatcccccagactcagctagattggaagagaggatgggaagacaatggatgacctacctgtggagagaaactacccattccagaacctcctctctgctgaaagctgaacactcaatgggaagacctgtttgcagagaggagccagccactccagggtctccgttctgctagaagctgaacactcgttgggacacccttgctgtggaaaggacatccttactgtggaaatgagctactaactgcaggagctgaggagctgcacagcaaggttaaaagagctgtaacacaaacagggctgcaacatgccccttgctccccacagggagagaagagctctggccctcggagaagcccagacctgggagctccttgagcccgggctgtgactccctctttggggccctggttggcgtcactgcattcgccagtgccactgttggaagctgcttgtgatgcgcctggtccagggggaagctgtttgttgtgtgcctggtccagccacctcatggagagcctgtgctggcacctggagctgcccaacctgggcagcagcttgtgtgtgtgactgcacagtggccacgcttgctcacacacccctagcacacccctctgctccacccgtctcaatctcccttggatccgggatcc

SEQ ID NO: 87887 - DNA, 349 bp, Homo sapiens
tgaggtttgagtgtttactggcatttgagttcttcagtactgcaccccaggtgatcttaggaaagaaaccatccactgtgggtacttctggcttctgtccagagaagattatcagctttggtccaaaaattgatttaaaagtagtttacttctttttctccaataaaatatttgccataatttaatgtctttaataccaacattttcttcatttcctatggtagccaggacaaatgaagtatttcagatctttcaaaaactcttaggatgaaaggtaggaatttggacttaggtttttaaaatagtgtgtatgtaaaagtgcaaagaatggggccctggctttctcttc

SEQ ID NO: 87888 - DNA, 390 bp, Homo sapiens
ctgacctcgtgatctgccctcctcagcctcccaaagtgctgggattacaggcgtgagccatctggccagtatcatggatttatgcatatttctccatacttctttgacctctttcccttgctccaaaagagtacattttaaagatgaatgataggatttaagctgcagcttggtttcatttgaacaacaacaaaaaatcagttcgtatacagggattgaatctgtgattttggcttccttttatacaatgctctaaccacatgagcctatcacattcaaatttatgctactcagaacttttaagctattaacttttccatcctaatgtagtgtaaatataaacatgccccatggtgtttcccagaaggttagcctcagcaagtgaaactt

SEQ ID NO: 87889 - DNA, 462 bp, Homo sapiens
gccccacaccccaaccatcagaggggactccaatgtctgcaactcaggacactgagcatacactaccctctattccacgcctctgtgtctctcagagccactaggggttcatgctgcaggcaagactttgaattcctaaagtaaaagaacatgaagacggacagttatcagaagcatctcattatatctagcagacgatttcctatcgaattcaagcaaactctgtaaatcaaacaatattttatgagcagtttagaaagctctgtggccctgccacaaatccttttgtgaagtgaagacatgcctggtactgtgataaggaatcctctaatgcaacaatgctgcaccctttctcaaagagaagcgttcttcatgtatggtatcaggacatgagaaagacccttactgctccctaaatggcttcctgaaggtgctcagggggcaacttgggtgtatcgggga

SEQ ID NO: 87890 - DNA, 334 bp, Homo sapiens
atgcccagctaatttttgtattttagtagagacagggtttcaccatgttggccaggctggtcttgaactcctgacctcaggtgatccgcctgccttggcctccccaagtgctaggattacaggcatgagccactgtgcccggcagagccaccgcgcccagcctcaatttctttctatttccttttttgagacggggtctggctctgttgcccaggctggagtgcagtggcacaatctcggctcactgcatccccccacttccacattggagtgattctcctacaggcatgcaccaccacacccaataaagcgaatggaccatcaaaaaaaaaaa

SEQ ID NO: 87891 - DNA, 396 bp, Homo sapiens
tttagaatatgactgtatttagacgtggggcctttaaagaggtaattaaggtaaaatgaggtctaatgggcaattcttaacctaatatgactggtgtccttttaagaagaggagacgaggacacagacaacactgaccaagggaagacagtatgaggacacaactagaaggcagccatctgtgagctaaggagagaagcgtcaggaaaaaacgaaactgctgtcacctcgatcttagacttctagcatccagaaccatgagaaaacaaatttctgctgttcaagccacccagtctgtggtgttttgttactgcagctctagcaaactaatatatcggtattttaaaatcgcacaaataatgtgccttgggatgggtctaactccattctttttttt

SEQ ID NO: 87892 - DNA, 1941 bp, Homo sapiens
acggaaagaggcagggcggtttactaaatcttatgcagtgaaaattcgccttagaaatcgaaggttggatgagtcagtattgatatattcaaaaatctaaatttcttagcatatttcatcgttcttagatgttgaaagtattaaatgtaaacaatacaaatttaaattccctaagtaatgaatcaaaatggcaagggagagagagagagagacggaaaatcaaccaattcgtagccaccctggctggctatttctcaaaagaaatttctatgcatttgcttgagtttgtctataaattcacaaacataaagggtgttaaaattagtaacagacaaaataattcaggttggacaatagagacagcaacaccgattttgatccaggtataacaatgggccatgcattgacaatgacctaaaagacatgtgttcattaagttattttttttacacgggatgtagatgtatcataaaattcatgaaataaagcggccaggtgcaatatcctcagagagctgccttctcaccccctgcctcagggcggattttatctgtcctcgaattttagaactctgcaagtcgggtctttcacattcatcgattactttggtttatatttaattttatccaatttcggagtgggtgggtaaagcacactggaaaataggggctgctcgaattacaaaatttaaggattgggaatattcctcttgtgccaattaaaagcagtcgttggaagcagaaatgaatttaaagcattacacgttatcatggcggccttgctttttccttccagtattcatccaattgcgctgatctcctgcatccacatcttgcgtaatccacaaagcagctatggtccagggctgcaaaatcgtcctgcctgattcctttagaattcatactacctcagaggagcaaacctaatcccctcagcctaatcctacctgtttaggatcatctaaacttgtccttcagaaagcttgatcagtttaaaattgctttctaaatagaaatgaaatacgtgatatgagagaggttaaaatactgcttaaaaagggaaacactcaatttagtaattcggttgcctagatgaaatcgagtggctattgatccgtgatgtttctagatttttaagactatgtacttcctatttctttggaaaataatcatccagtttgatgcccattacaaattttcctgctatgaaagaaattctatgcgcggcagttttgcaataaaacaacccgggcttcgcaatgggagaacttcggtgcggcgtgccgtgagagtcctttcacaatctcaactttcatctaggtctgaaattaaagcttctcggaataatttaggaacagcttgacccgttgagatactcaaggacaaccctccagggaaatagtatgtttccttcctgggaacaagatgctagcgcggtgcaccgggaggtatctggtgtcaacaatgccagagcgccctctgctgcctcaaagaggcaggacaccagttacaaaagccagatggcacagtggcaataagcggaggaaacattaagctcttagaaacgtttaatctgtgaaatttaaaagctctcatcatattctacttttgaaagggccacctgattttgattttgagcactccttggatgttatcttctattctggaggataatgaaaagtccgtgttttgaagttttcagattatttctgtagttatatttctccactctttctcgaattttatatggaaatacgaaattgcaaatctaagtgaaaaacctttgtgtaaaacaggtgagtggagaagacgtcctggtttctccaaataactaagatctaataaagaaacaaatcttaattaaaataaagataccgagcacatgtttttgtgttagtttaaaacgataataaaaagaaagaaattaagtctcgatgtaaat

SEQ ID NO: 87893 - DNA, 476 bp, Homo sapiens
aatttatgaacctgtaaccagtattagtgcagtcttgggttccttgttctgcataattgcaccctttctcaggtatgtcctgacaacataaattttaaaataatctcattagagattagattctcagtggatagtgtgtaaggggactaggggtggggggttgggggtagttggacacaggacactgacacagtagagcagggatttttaacagtcaatagccaaatagaatttcaatctagaatatttttaccccggtccccccccttttttttttttttgcattgtatgtcaaaagcgcttgttctttcgtgcatgtgtaagatttaatggttccattgtattatttgaccatgacattttggagaaacattcccagctgtaatgttgtgtatggtagttctcactggatgctagagttttcaaaaccactattcttctaataaattttgttgtgaaaaactgttaaaaaagct

SEQ ID NO: 87894 - DNA, 2900 bp, Homo sapiens
aatttatgaacctgtaaccagtattagtgcagtcttgggttccttgttctgcataattgcaccctttctcaggtatgtcctgacaacataaattttaaaataatctcattagagattagattctcagtggatagtgtgtaaggggactaggggtggggggttgggggtagttggacacaggacactgacacagtagagcagggatttttaacagtcaatagccaaatagaatttcaatctagaatatttttaccccctcagaatgagtgaaacaacttctattatttggtgtacccggtgctacactcctaaaagtcttttttttttttcatccaggtgacgttttttatttttcctgcttggtggtggaaggttatatagtaaacttcactgtcattaagaaagcgcttgtccaaaatgtttaaagtactagaaaagggataattcagcactttttctgttacaacactaaagtcttaatttatcttcagagtcttaggtactgtaagtttttggatgattatttaaaaatataaaacatactacataatatggggtcagatcacatttatataaataattcttattttaaaaaagacaataacattttgtacctttctagcaattccaagtgattgcctcattttctcttgttaagcatttcaagcttaagaatttggaatttgagagaaggtgagggggaaaattccctaaaataaaaatttgtttcaaaccattttagaaaaataaatcactaggaaaataggtagggattctctccccctttaagtcttcagggaatgagcagtatttagaatctttggctgaaattcaagcctttttactttgtaaatttttaatattaattcactgacatgctttttacaccagaggactgaaaatggatcttaatgtttttaagttgtggaagggtatatttctaaaatgaggggggatgattaactaggttagtattaccagcattagtaagtttaaggaattttagtatgtaatagcaaagtgtttgattaaaagtctaatcctatattactagtcaaaattagttacattctgatctaggaaagataatagtcattggatattgatatgctgtgctgtcagaaaaccagactaagatagaaacctttatctgactcccacatgttgcttgttgtgatgggatgtatactttacagcagcttattgctgctttgaaaaaaaatgtataaactatacatttggagtgtttgcatataattctttataacctccacttaaagctgtcagacattggtattttatcagtccacattgttgaataaaactaatgttcttaggaatccagcttgtacacactgtttaaaaaccctcagggacagtttacacactcttctcactcaattcaggtactttgatgctattcttaaacctaacagtgacttgtatttttctgttttgcttttatttcaacgtgctggtagcacatctgatgaatgtcaacttaaaaaactcagttcaggtatccaggtataactcagccaaacagattttaaagctgcatataactctccagcacatggtgcctcacactcttatagtggcattctatatattcagttattactactgagcagataatatgggggttcctgttaacagtgtattttttaaaaaaagcgcataaatgtatagccagcacactacacacacacacacaaacatgcacagttaaactatatatttttaaatgccactaatagccagcacaactaaaacaaaagacattcctaactgctctgtaagctgttaacagatgcagttccttcttgatgtggctcttgcttcttcacgataactactactaaattcaagcactggtccttgggtgtctgacctctacattctagtttatgcaatgtctttagagaattttgtgcactggccactgtgatggaaccattgggccaggagtgctttgagtttatcagtagtgattctgccaaagttggtgttgtaacatgagtatgtaaaatgtcaaaaaaattagcagaggtctaggtctgcatatcagcagacagttttgtccgtgtattttgtagccttgaagttctcagtgacaagttttttctgatgcgaagttctaattccagtgttttagtcctttgcatctttaatgttaagacttgcctctttaaaattgcttttgttttctgcagtactatctgtggttaacaaaatagattatttctctgctttaatatttgatatcttacatctaaaataaattctctccacatataaaacccatagcctttggagatatggaaaatggtatctttcagatttctagaagttcaagtgtcatacaacaaaacaggaaccccctttactcttatggacctcatttcaatatactgtttacagtttgatggaattgtataatttaatatttctcttgtactgtagtttatatttatttacagatttttttgtactgtgtgatttgaactttttgttccttgctatgatcaatgtttatgtagtagagcacttatgatcacaaattaagttttttggtttgattgcactacattaaattttttaatgcagttctgatttttgactggactaaaactgtgtcttaatgtatgtgatgagtacttaaaattttaatccatgtggtccccccccttttttttttttttgcattgtatgtcaaaagcgcttgttctttcgtgcatgtgtaagatttaatggttccattgtattatttgaccatgacattttggagaaacattcccagctgtaatgttgtgtatggtagttctcactggatgctagagttttcaaaaccactattcttctaataaattttgttgtgaaaaactgttaaaaaagct

SEQ ID NO: 87895 - DNA, 1221 bp, Homo sapiens
tctagagatccccggccgcacatttacacacacacacaaacatgcacagttaaactatatatttttaaatgccactaatagccagcacaactaaaacaaaagacattcctaactgctctgtaagctgttaacagatgcagttccttcttgatgtggctcttgcttcttcacgataactactactaaattcaagcactggtccttgggtgtctgacctctacattctagtttatgcaatgtctttagagaattttgtgcactggccactgtgatggaaccattgggccaggagtgctttgagtttatcagtagtgattctgccaaagttggtgttgtaacatgagtatgtaaaatgtcaaaaaaattagcagaggtctaggtctgcatatcagcagacagttttgtccgtgtattttgtagccttgaagttctcagtgacaagttttttctgatgcgaagttctaattccagtgttttagtcctttgcatctttaatgttaagacttgcctctttaaaattgcttttgttttctgcagtactatctgtggttaacaaaatagattatttctctgctttaatatttgatatcttacatctaaaataaattctctccacatataaaacccatagcctttggagatatggaaaatggtatctttcagatttctagaagttcaagtgtcatacaacaaaacaggaaccccctttactcttatggacctcatttcaatatactgtttacagtttgatggaattgtataatttaatatttctcttgtactgtagtttatatttatttacagatttttttgtactgtgtgatttgaactttttgttccttgctatgatcaatgtttatgtagtagagcacttatgatcacaaattaagttttttggtttgattgcactacattaaattttttaatgcagttctgatttttgactggactaaaactgtgtcttaatgtatgtgatgagtacttaaaattttaatccatgtggtccccccccttttttttttttttgcattgtatgtcaaaagcgcttgttctttcgtgcatgtgtaagatttaatggttccattgtattatttgaccatgacattttggagaaacattcccagctgtaatgttgtgtatggtagttctcactggatgctagagttttcaaaaccactattcttctaataaattttgttgtgaaaaactgttaaaaaagct

SEQ ID NO: 87896 - DNA, 1280 bp, Homo sapiens
gctgtgattctcactatactggtcctgaggaaagggcttctgtgaactgcggtttttagtttttattgtggttcttagttctcatgagacccctcttgaggatatgtgcctatctggtgcctctgctctccactagttgagtgaaaggaaggaggtaatttaccaccatgtttggttcctgtttataagatgttttaagaaagatttgaaacagattttctgaagaaagcagaagctctcttcccattatgacttcggaaatcacttatgctgaagtgaggttcaaaaatgaattcaagtcctcaggcatcaacacagcctcttctgcagcttccaaggagaggactgcccctctcaaaagtaataccggattccccaagctgctttgtgcctcactgttgatatttttcctgctattggcaatctcattctttattgcttttgtcattttctttcaaaaatattctcagcttcttgaaaaaaagactacaaaagagctggttcatacaacattggagtgtgtgaaaaaaaatatgcccgtggaagagacagcctggagctgttgcccaaagaattggaagtcatttagttccaactgctactttatttctactgaatcagcatcttggcaagacagtgagaaggactgtgctagaatggaggctcacctgctggtgataaacactcaagaagagcaggatttcatcttccagaatctgcaagaagaatctgcttattttgtggggctctcagatccagaaggtcagcgacattggcaatgggttgatcagacaccatacaatgaaagttccacattctggcatccacgtgagcccagtgatcccaatgagcgctgcgttgtgctaaattttcgtaaatcacccaaaagatggggctggaatgatgttaattgtcttggtcctcaaaggtcagtttgtgagatgatgaagatccacttatgaactgaacattctccatgaacaggtggttggattggtatctgtcattgtagggatagataataagctcttcttattcatgtgtaagggaggtccatagaatttaggtggtctgtcaactattctacttatgagagaattggtctgtacattgactgattcactttttcataaagtgagcatttattgagcattttttcatgtgccagagcctgtactggaggcccccattgtgcacacatggagagaacatgagtctctcttaatttttatctggttgctaaagaattatttaccaataaaattatatgatgtggtgtc

SEQ ID NO: 87897 - DNA, 1181 bp, Homo sapiens
gctgtgattctcactatactggtcctgaggaaagggcttctgtgaactgcggtttttagtttttattgtggttcttagttctcatgagacccctcttgaggatatgtgcctatctggtgcctctgctctccactagttgagtgaaaggaaggaggtaatttaccaccatgtttggttcctgtttataagatgttttaagaaagatttgaaacagattttctgaagaaagcagaagctctcttcccattatgacttcggaaatcacttatgctgaagtgaggttcaaaaatgaattcaagtcctcaggcatcaacacagcctcttctgcagcttccaaggagaggactgcccctctcaaaagtaataccggattccccaagctgctttgtgcctcactgttgatatttttcctgctattggcaatctcattctttattgcttttgtcaagacagcctggagctgttgcccaaagaattggaagtcatttagttccaactgctactttatttctactgaatcagcatcttggcaagacagtgagaaggactgtgctagaatggaggctcacctgctggtgataaacactcaagaagagcaggatttcatcttccagaatctgcaagaagaatctgcttattttgtggggctctcagatccagaaggtcagcgacattggcaatgggttgatcagacaccatacaatgaaagttccacattctggcatccacgtgagcccagtgatcccaatgagcgctgcgttgtgctaaattttcgtaaatcacccaaaagatggggctggaatgatgttaattgtcttggtcctcaaaggtcagtttgtgagatgatgaagatccacttatgaactgaacattctccatgaacaggtggttggattggtatctgtcattgtagggatagataataagctcttcttattcatgtgtaagggaggtccatagaatttaggtggtctgtcaactattctacttatgagagaattggtctgtacattgactgattcactttttcataaagtgagcatttattgagcattttttcatgtgccagagcctgtactggaggcccccattgtgcacacatggagagaacatgagtctctcttaatttttatctggttgctaaagaattatttaccaataaaattatatgatgtggtgtc

SEQ ID NO: 87898 - DNA, 870 bp, Homo sapiens
gagacaggttctcgctgtgttgcccaggctggtcttgaacttctgggatcaagcgattcttctgcctcagcctcccaaagtgctgggattacagatgtgagccaccgtgcccggccccatttttgttgtcttgattagacagcctggagctgttgcccaaagaattggaagtcatttagttccaactgctactttatttctactgaatcagcatcttggcaagacagtgagaaggactgtgctagaatggaggctcacctgctggtgataaacactcaagaagagcaggatttcatcttccagaatctgcaagaagaatctgcttattttgtggggctctcagatccagaaggtcagcgacattggcaatgggttgatcagacaccatacaatgaaagttccacattctggcatccacgtgagcccagtgatcccaatgagcgctgcgttgtgctaaattttcgtaaatcacccaaaagatggggctggaatgatgttaattgtcttggtcctcaaaggtcagtttgtgagatgatgaagatccacttatgaactgaacattctccatgaacaggtggttggattggtatctgtcattgtagggatagataataagctcttcttattcatgtgtaagggaggtccatagaatttaggtggtctgtcaactattctacttatgagagaattggtctgtacattgactgattcactttttcataaagtgagcatttattgagcattttttcatgtgccagagcctgtactggaggcccccattgtgcacacatggagagaacatgagtctctcttaatttttatctggttgctaaagaattatttaccaataaaattatatgatgtggtgtc

SEQ ID NO: 87899 - DNA, 1227 bp, Homo sapiens
gctgtgattctcactatactggtcctgaggaaagggcttctgtgaactgcggtttttagtttttattgtggttcttagttctcatgagacccctcttgaggatatgtgcctatctggtgcctctgctctccactagttgagtgaaaggaaggaggtaatttaccaccatgtttggttcctgtttataagatgttttaagaaagatttgaaacagattttctgaagaaagcagaagctctcttcccattatgacttcggaaatcacttatgctgaagtgaggttcaaaaatgaattcaagtcctcaggcatcaacacagcctcttctgcagcttccaaggagaggactgcccctctcaaaagtaataccggattccccaagctgctttgtgcctcactgttgatatttttcctgctattggcaatctcattctttattgcttttgtcattttctttcaaaaatattctcagcttcttgaaaaaaagactacaaaagagctggttcatacaacattggagtgtgtgaaaatcatttagttccaactgctactttatttctactgaatcagcatcttggcaagacagtgagaaggactgtgctagaatggaggctcacctgctggtgataaacactcaagaagagcaggatttcatcttccagaatctgcaagaagaatctgcttattttgtggggctctcagatccagaaggtcagcgacattggcaatgggttgatcagacaccatacaatgaaagttccacattctggcatccacgtgagcccagtgatcccaatgagcgctgcgttgtgctaaattttcgtaaatcacccaaaagatggggctggaatgatgttaattgtcttggtcctcaaaggtcagtttgtgagatgatgaagatccacttatgaactgaacattctccatgaacaggtggttggattggtatctgtcattgtagggatagataataagctcttcttattcatgtgtaagggaggtccatagaatttaggtggtctgtcaactattctacttatgagagaattggtctgtacattgactgattcactttttcataaagtgagcatttattgagcattttttcatgtgccagagcctgtactggaggcccccattgtgcacacatggagagaacatgagtctctcttaatttttatctggttgctaaagaattatttaccaataaaattatatgatgtggtgtc

SEQ ID NO: 87900 - DNA, 1010 bp, Homo sapiens
gctgtgattctcactatactggtcctgaggaaagggcttctgtgaactgcggtttttagtttttattgtggttcttagttctcatgagacccctcttgaggatatgtgcctatctggtgcctctgctctccactagttgagtgaaaggaaggaggtaatttaccaccatgtttggttcctgtttataagatgttttaagaaagatttgaaacagattttctgaagaaagcagaagctctcttcccattatgacttcggaaatcacttatgctgaagtgaggttcaaaaatgaattcaagtcctcaggcatcaacacagcctcttctgcagagacagcctggagctgttgcccaaagaattggaagtcatttagttccaactgctactttatttctactgaatcagcatcttggcaagacagtgagaaggactgtgctagaatggaggctcacctgctggtgataaacactcaagaagagcaggatttcatcttccagaatctgcaagaagaatctgcttattttgtggggctctcagatccagaaggtcagcgacattggcaatgggttgatcagacaccatacaatgaaagttccacattctggcatccacgtgagcccagtgatcccaatgagcgctgcgttgtgctaaattttcgtaaatcacccgagatgatgaagatccacttatgaactgaacattctccatgaacaggtggttggattggtatctgtcattgtagggatagataataagctcttcttattcatgtgtaagggaggtccatagaatttaggtggtctgtcaactattctacttatgagagaattggtctgtacattgactgattcactttttcataaagtgagcatttattgagcattttttcatgtgccagagcctgtactggaggcccccattgtgcacacatggagagaacatgagtctctcttaatttttatctggttgctaaagaattatttaccaataaaattatatgatgtggtgtc

SEQ ID NO: 87901 - DNA, 463 bp, Homo sapiens
ttaaagagaagtcaaatgtcaggctcccttctctccacagtcatgacctttcaaatcattgtaccttgatagtcctctaataccttcaagcagaggctgttttaacgatttattttcctggttattttagctcgctgttgggaaggttggtctgatctaatctagcccattatattgaagtagaagttgaagtacttctttaaggcactctaatcctacatgttttgataccttgatgctatgttcaataatttcaaatgccaagttgctgttaacctgtgccatcttgaactcttgtttatcagaagtttttgatcaagctactgaaaattttgtatagccataacgaaaacacctcaatgttatgtcatatgtttgcatttaaagatagtttacaaattttactcatattattgcatttaatctttacaacagtcatgtgatgtcaaatatcatgattaag

SEQ ID NO: 87902 - DNA, 802 bp, Homo sapiens
atataaatagaatcacacagtatttgtcttttcgtgactggcttattttagttaggatgtcttcaaggttcatccatgttgtagtgtccaaacttccatcctttttatggctgtataatattgcattgtgtatatagaccacgttgtgtttgtccactcaggttgctgtcaccttttgggtatttttgaaaatggttaattttggctaccatgaaacatgggtgtacaaataactctacaaatttctgctttccattcttttgagtatatacctggacgtggaattgctggatcgtatggtaattctatgtttaactttttagaaactgccattctgttttccatagtggctgcacaattttacattcccaccagcagtacacaagagttccaatttctccacatcctcatcagcacttattctttaataatagtcatcctgaggggtgaaaaagttatcttgttgtgattttgatttgaatttccctaatgactgtcactgctgagtgctatattcatgtgttattggccatttgtatatcttctttagaaaaatgtctattcaagtcctttgtccatttttttaattgagtcatttttgttgagttgaagttctttacatattctagatattacttatcagatataatttgtgattattttctatttttcggttgccttttcattctcatggtgtccctttgatgcatgaaagttttcaattttgatgtagtgcaactttttgcctttgcttttgatgtcataccccaagatattattgccaaatccaacatcatgaaaa

SEQ ID NO: 87903 - DNA, 895 bp, Homo sapiens
agctttatgttgatatatcaatatacgttggaaaaggaaatagacattttaatcattatcttaccatccaattgtgaaatggctgcaaggcctaaacactaactaacccaccttcccctcttgagattccatgccccatctcatatcctgaaggaagtcaaattacttcctaggcagaatcaattcatctgagaaaaatgaaaacattagggactttcccatttagaactgcattattcatacaaattcttagcttctgaaaaggggctcttgataatttggtggcttagagaagttagatcacagctgtgaagctctggctttggtatttgagccccatggcctgattgaggaagtggcagggacccatatctgaggccttcccaccttcctttttccctcttccccctccaaggagaaacaagacctttaatttccacagtagagcaatgggtttgtgcttgcagtccttctgctcattctttattccctctttatttcctttttttgtcactcatgcctagttccctgaaccccttacttacctggccttacctacatctctgagccccagcctgcagggctccttctttgactattcacctggtggcttttactcctccttcaagacccaactcacagatgacttctctggagtcttccctgaatgctctaggcaggtataaatgagaaaattgttcctctcttcccctctttattcctctcactgtgcctccaaagtactttgtccatacctcggtgatagtacttattctactgtgattttattgtagctttgtgattgtctgcccctctgcactgagcatctaagaacagggggccaagccttattcatttctgtgttaataaatatttgttaaatgtgaaaaagagt

SEQ ID NO: 87904 - DNA, 469 bp, Homo sapiens
aaaacctctcggtacttgttcttgtcaagtggtaagggatactttaaaaaaaaaaaaacctaccatgaagaacaactcacctattgcaagtttttgatctgtaggtcagagaagtgaccttttaacacaaatattatttgaatggcgttgtcaggttactttcactggggaaaaaaataaaaaatccatgaatattcagtgatacaaatggttagcagaagacaatgctaaaaatgaagggtattatgacagccaactgttttaaaacttcaagtttggagatctttgttacttagaattttgtaatctgaacaattattctgaaagattttgatggatcattagataggcaagcatctgttcaagtaaaactggttatttgctgacaaagcagaagataattaagaatcataattaactataagctagacataagtcaggattataacacttattataaccatgtata

SEQ ID NO: 87905 - DNA, 1517 bp, Homo sapiens
  misc_feature (1284)..(1284): n is a, c, g, or t
  misc_feature (1299)..(1299): n is a, c, g, or t
  misc_feature (1436)..(1436): n is a, c, g, or t
  misc_feature (1512)..(1513): n is a, c, g, or t
tgaataagagaatgctttctctttctttgagctgaaaaggttgcatcttctaggcttggagaaacaatgggaatgggcttttccataagaccatctttacttacctttcagtgctggattatactgcaaatcttactacctaagcattaatttttcttggttattgctccaacatgcaacagtgtcagagaagcaaggcaagcactatttaatacctgtttactgagcatcaactaagcacaacacacactttgttttgggagcttcataaatgcatcccacctggatccttcatccaggctctcagagcttcctttccttccttgttcgattcagaattcagttacattaatgcagaagtttccaggacttcagggatcctagggagaggtatccaatgatgtttcagagacagagtaggccctagaaaattttattgtgggagaatgtgtttgatagattctgttgactttaactttatggatttgtactttcactacatcagagaaccatcagaagtacaggcaatggtctgtaagaacaatttcaaatatttcttctagcagatggctgaaggagaagaggaaatgtaagctatttaccctggaacacttgaccagatttcagaatatggggcagcaagcatttcagacaggcattccttacattagaaaaatgtgaagaggagttgccatgtttatcagaattttgcaatgggacaaatttaaagccagttgtctttcatcctgagtggttctctcactcttcaaaatacttgggtgattacagagaagggctatgtctgtctgtctctctctctctttctttctctctctgtctctctcccacctcccccccatacgtgtgtgagagagaaaataaattatatatttccgtaagttaaatttaatgatcagatatctcacctatattcttacacttttctatttttcacagaatatacaagcacaggcatttaaatgttagtcacccaaaactccagatgctaagcagtgaaagtttatattctgccagcatatcagactctgtaatgagtctgatttggtttaattcctttctactgtttagtcatttgatgagctgcagatggaaatttaagccaaagccataacatttcagctaatactttttatgctgctgtaagaatttgttgtcatgtcaatttaagagagttgaaatcttttttgagaaggcattcaaatctgcattaagtgcttttatcaactctaatttgatatacaactctgactgcttctgctgttnttaatcaattgcaangtgcaaagtaatttagcagtggaagacagctttgcaattccaggatttctcagctaatgccataagcacaacattatggaaatatacaattaaatttacattaaaaatttttcctatgcttaagaaacacgaggccnacttctttgagtttagccttaaataggtaaatatgtattttggcagccatgaaaagaatagggtattagattaacnngggc

SEQ ID NO: 87906 - DNA, 258 bp, Homo sapiens
acacacacacacacacacacacacagaggcacatgcgcacactcaggcacacaaaaggaaggaaaagaaaaaaagtaaagtgatggggcagggggaataaaccacgtaaaggaaagctaaaatcttagaaagtatgaaaatgtgggcttcaattatatttgtcttcagctcatattcacatttactgtggaaacagaaatatcacaaatccaatgttaaaactgcccctcctggtttcacactggtcacaagtttcaa

SEQ ID NO: 87907 - DNA, 139 bp, Homo sapiens
ggcttaggacccatccatgctcctctcaccctgtctccactgccaccgtcctcatcccaccaaacagaatgcaaattctaaaggcgctggaggctaggactgcaagaaaagacaccatggggtacagctcaagttcata

SEQ ID NO: 87908 - DNA, 373 bp, Homo sapiens
atacaagtttttaaaaatgtgcccaggaacaaggctttagggacgctggtggagggttcctgctgaggctccaggacatgaccacgctgcacagaattcagagcacagtgtggagtctgacagccatggggtcacgtcctgtggcaacccttcactggctgggtgcccctaagcatgtggtccccctgtcgaaggctcagctgcctcatcaggcaagaagagcgaatactcatccccacctgatgaggctcactgaggatcaagggcaccaacaggtttaggatgcccaccccatactcctcccagtgctcctcagagggagttggcatgaccctctagagcccctctgcccacttctgggctcctctgggac

SEQ ID NO: 87909 - DNA, 448 bp, Homo sapiens
ggtattctagctgagggacagacaggaaacaaggtgttacagcattgagtgactgttctgacaagtgctgaagcagatggagaaggggctgtaagagtggatagcaaggcacctggcccagtggactggctggggtacagtcagagctggcttcctgagatgggaaaacggtggtaagagggacctgggagagtgtctaggcagatatacagtaggtacaaagacccagcggcagaaaggagtttggctcttccaggaacagagaagggacattgtgactagagaggagaaagcctgaggggtagggctggaggaagagcccccagggtaggcctggatgccaggatccaggacttcttagtggcctgggatccgtgttcagggaccttctcaaaggtcacagcaaataatatatagtagcttcttattttctgtagaaggaaggaca

SEQ ID NO: 87910 - DNA, 418 bp, Homo sapiens
tcaagcccatatccttgaaaacattgccatattttgagatcattaactagatgaataggaagtttagaatatgaatcttgttttatttccagaaaggcaacatttttaatgtaaaaatatttcctatagcttatatagtttatttaccagttattacccattaatgttcagcaaattagtacataatcttagtactgtcaattctgttcttaggatatttgtttctttgtccaagggatattgtccatgtcatgaataatgacaatatgataaaatgtttgctaattagaacaagtgatgatttggaggaggggaattggctgccctgtttccgataagttcagaggcttatgactatatattcctattaaattaactgttggatggcaaagggtatgcccataatggttagaaatgg

SEQ ID NO: 87911 - DNA, 349 bp, Homo sapiens
  misc_feature (346)..(346): n is a, c, g, or t
cattcctaagtagtgaaatacttggaaaaccagtagaaattaatttgcaagtttctactgacttgaaaaagtgaattaaaaaagtatatgatatgttgggtgtggtggcttgcacctgtaatcccagctactctggaggttgaggcagaaggactgcttgaggccaggagttgagttacagtgagctatgatcatgccactgcactccagcctgggcaacgagtgaaactctgtctcaaaaaaaaactaaacaaaaaatcagtcgatgtttgtgtcggtcatttctggactctattctgttccactgatctacttgcctttgtttttgcccataccacactgtctngac

SEQ ID NO: 87912 - DNA, 468 bp, Homo sapiens
gatttaaaaaaaatcacagtgaaatgtatgtatgtgtctgtgtattcatataattgccaacgatattcccagaatacaaaaatattaaaaagaatgaagttctaatcagtgttcagtaagatgggcagtgaaaattttcattaatagctcgttaccctgttgtttccaaagcacattacatagtaacatacttcttcacaatgtggtacactcaacatttgcaaggaatattctttggagacccccaaagaatggttggcatttatggatccactacttcacaaactcaaatgtttatacatgattctggcttattctcaaattaaatttccattcaaaatcacatttctggggctgggcatggtggctcacgccctgtaatcccagcactttgggaggaaagacgggcggataacttgagccctggagttcgagacaagactgggcaacaaagtaagacctcacctc

SEQ ID NO: 87913 - DNA, 398 bp, Homo sapiens
ggggatttgtgcaggcaatcctgtgcagcagccccccaaaatttcctaacaatcccggacataacacatatttttaaagttgtcccagcccctggttgccttgtgttacgaactcagaaagtaaaattcgtgatgttaaaggacttgagcctcacatctgcaactcttttagagaattttgactattttttaaatagctgtattgaagaatcattttattccctcttcttgagatgaacaaataatattaaacaccaggtataaggagttcttatgtctacatagatgagaaatattttattggaagctttagataggctgtagcatctatctgtgttgaataggccttaaaatatcctcttgcttctcatagaaattgagatgattgaaggttattt

SEQ ID NO: 87914 - DNA, 90 bp, Homo sapiens
gatctaaagtctaaaaaacaaatccttaggttaagaagaaaataatgcaataaataaaatgttataaataaatgacatattgctactttt

SEQ ID NO: 87915 - DNA, 515 bp, Homo sapiens
tgaaaccctgtctctactaaaaatataaaaattatccgggctgggtggtgagcacctgtaatcccagctacttgggaggctgatgtgagacaatcgcttgaacctgggaggcagaggttgcagtgagcgaagatcacgccactgcactccagcctgggtgagagagcaagactctgtctcaaaacaaacaaacaaacaaaaaaggatcaaaacaatattttggtgaactaaataaaaccagtttgctttcttgtcaccaaaaggactctctttcccactcctcaccaattcaaagcaacacacctgtactcatgatagaggtgaaggaagggagaggaggggtgagcacacaggtgtacatgtgccaatgcacactcaatcacaagcgtttgtgttatgtgtgttgggggatcctatactccattttatctttatagctgccccctcagggactcacaattaatgttatggagtgtcatactaacttttagatttagataatttttttctagaaa

SEQ ID NO: 87916 - DNA, 135 bp, Homo sapiens
aaaccaattaaaagggtctactcttatggaatggtatggggagatggagtggaggggaatgaaagcaagacttctctgtgttttcttttaaaaaataatttttggccaggcatgatggcttatctctgtaatccc

SEQ ID NO: 87917 - DNA, 429 bp, Homo sapiens
gtctttagatgtaatctaattgctcctaagtgtcaaccccttggtccaggcataactgctgatttccatggctattgattttaacatctgtaaagaaaagttttcatggatttttcttatcagtgcttcattgctctgatagaaagtggtgaaacttagttattctttgtctcttatctttaccaagcatttcttcattaaaagaggcaccaaaaaaactttaaaatagctggtgagcttccatttttagtagcaagttgaaagtgtctatttgctgtagctggttcatattcagagtatgtgttatactttataatcaaatttatgatgtagctattagttcacactaatatgtgtgattgattatgcaggactgggcaggtaatgtgtgagacctagtataaaatgaaaatatgaggttcttgttaa

SEQ ID NO: 87918 - DNA, 503 bp, Homo sapiens
tgacatgctgagaggccttcgaagctgcctcagaatcaaggtccctctaaccttctctcccaagtatagggaggcactctctctagaatttcctaatctgatcgagaaaacgtctttccaaaagaaacaaaattgccttcctcccctctccgaaatctcatctagctcagaaaagaagactgaggaaggcaactacgcctggatggatttttcacaagatgatgcctgtttctcgggctcattcaaattctaaagagaatcatttacaagttaatttctgtccattttttcgccctaagaatcacttgctgccctcagaagaattgtctatattctccatctctccccttcccctatgaaaaagagtgtatacgcttctgtaccccattgggttattgggtaatcattctcctgtgacccttcccttcccaccccctcgcctccccgccccgtgctatgcacgttaaaataaaattttgtatgtcttttctcctattaaaatg

SEQ ID NO: 87919 - DNA, 269 bp, Homo sapiens
ggcagaaccttgggattgtcatggccagcctctgatgtcaaaatgtgaccaatccctcgcgaacacatctctctagcagaataacagtagttggaagtagatcttccctccaaaaatctgtctatacttgagttgcacggcagggggccagggttgacacttattacaaatttattcatttttgccagatcccttctgccacaagagggttttatctagacaaggttcctaaattggctttgcaaaatgtaatcctctattgattgtct

SEQ ID NO: 87920 - DNA, 504 bp, Homo sapiens
cacgtgtcctcaccaccaatctgaaagtcagatccgccttcttatgaaaatactgcaggcacctcaactttggatgtaactaagaactacatatagattttacttttgcttccctgtgagagtgcagaagttgccaggagccagagattaaggactaagataaggtccagggtctacctgattcagtgatgtcagaagtggtggtgactggtttatttgtttttccgtcttagagatgtttactgttactctgaggtgtcacaaggccaggctaaccaggaacaacccttgcttaatattgtcatagaactccccccaaaaggaattttcctttctgagtggaaatttgcccaaactagagacatgggaccaaatttgccaagatgattttctatctacaactccttacattctaccactgttgaaaaaattgatctgtgcatggttatgtcttttatgttatttttttttccttttattttgaatggcttagaggcttcctag

SEQ ID NO: 87921 - DNA, 434 bp, Homo sapiens
ataatgcagcttttaaatatcagggagttgcgaggctcttgggttctagtgtcatcttccaggattttattcagatctcctcattctgtggccaggccctactgtgtaattgttgtgtatttgtttgttctaaggtcctgtgtactgataggattttatatactttactcaggttgcagtgacactagttaaaacactaataatcatttactcaggtttacagttggcacaattctcggtatttaccattcagtggtcatttcattgactattaatcactgagtctccaagcctggagcagttaccacacatgctaggcactcagtaaacatttatttagtgaatgacatttgtttctttgatcagatttggatctctgtgagaactggatgactaattgaacatatgattacacgtatgactacactttaaaa

SEQ ID NO: 87922 - DNA, 1113 bp, Homo sapiens
ccacactcagtctggcctcggggcctttgcactggctgtgtcccctgcctgtgatgccattctcctctgcctggccaactcctacgtttattcaagtctggaccttgtcatcggctcctcaggaaggcactccgggacccccagatgggggcggttccctgtgactcctggcacggaggccaaccccttccttgttcaatggttccttgagggaccattcccatgtgattatcgaccattcggcaggcgttcaaagtcaaaggccccacactgagtcctggcccagcgccctgtgcccgttggctgctggagggacagacggggcgtgcggctgaccatcccgtgcccgcaggctgaggatgcagcgctggaaggcggcggccttggcctcagtgctctgcagctccgtgctgtccatctggatgtgtcgagagggcctgcttctcagccaccgcctcggacctgcgctggtccccctgcaccgcctgcctcgaaccctggacgcccggattgcccgcctggcccagtaccgtgcactcctgcagggggccccggatgcgatggagctgcgcgagctgacgccctgggctgggcggcccccaggtccgcgccgtcgggcggggccccggcggcggcgcgcgcgtgcgcggttgggggcgcggccttgcgggctgcgcgagctggaggtgcgcgtgagcgagctgggcctgggctacgcgtccgacgagacggtgctgttccgctactgcgcaggcgcctgcgaggctgccgcgcgcgtctacgacctcgggctgcgacgactgcgccagcggcggcgcctgcggcgggagcgggtgcgcgcgcagccctgctgccgcccgacggcctacgaggacgaggtgtccttcctggacgcgcacagccgctaccacacggtgcacgagctgtcggcgcgcgagtgcgcctgcgtgtgaccctacctcactcggccggcgcggcggccactccccccgcctcgacggcaccactggccggccccgcgaaagactgcgcgtgcgtagagcacgccggcgcggccccgggactctcgcgataactgtactgagataaagtgtggcaactcgaaaaggctgg

SEQ ID NO: 87923 - DNA, 403 bp, Homo sapiens
ttaatggcactagcattctgtccatctcccatcctacaaactcttccattatctttacattacttagagctaggaaataaccaaaccttgtctattatctttaatttttttatacctcttatatccatcaatatttttcaacttcagcactacctccataacccagatctttttacctcacaagacttttaaaccctcttaactagtttccttgcttccattttttcttctgctagtatattttgcaccatgttgtacatttaatacttataacacattgctttacatatcatattccttgccactggttagttaactaaaagatggcttggatgggggaagagctaagccaagattccaggtggaaacagagtactcactaaacctaagcatttagctacag

SEQ ID NO: 87924 - DNA, 523 bp, Homo sapiens
ggtcccgcttccgtgagtagcacaggggtgcctgctcagagtgtagtacaacgctgacaagtagaaggcgaggattgcggggcctgggtgagatgggacccactaagttgtgggatcgaaatctcagtaggtccttggggaaagcggggacgggaggggagatgagcagattggaatagaaccgagagagacggaggaaactgacagttgcgtccctggtgggaagactaaaatctatgcagaaacagggataggcaaaagcattgtgcacaagcgggacaggcagagcgccgggacagaaacccttaggacattctgacaccttgctgaacctggatccttacagaatatgtcttgtaggtgaagctagatctgcaaggcataggcaagcctcttagagaatcagaaaagtgatttggaaggaacttcagctgttactactttgtttaagcaaatcaaatgctgttctttaatgttactggacgtttcaaattaaacacaagaaaacctgaaaaaaagcatt

SEQ ID NO: 87925 - DNA, 414 bp, Homo sapiens
ggctgtgttttgtttacacatgctggtttgggtttttgggtagacctgtgttgaattcacagggtggctcttatgccatgttgcaggaatttattagtatggaaccccacagaagattccacctccatttttaacattctgtatggctgtcgagtcgacaccaaagcaaatgtgtctccagacacctctctctcgttgtctcagtcttgttggctttaatcatcctgttttctctgttttacgaaagaagtaaacaaatttctattcatccacacgtgtgtccccaaagcaaggcatatgtggactgaaaggtgggctggggctttgcttcgagaacgtgagcgaagagcgtgtgagtgcacgttgcctttggtgatgcatcatttatattgacattatcagtgacacagacag

SEQ ID NO: 87926 - DNA, 835 bp, Homo sapiens
tactattgacttttgagagttatttatataggcagccctcacttttgcacaatttcagtatgtatgacttccacttgccatggcttaaatggttcaaattgaagttatgacatattaactgtgattgcatgaagtactccctcttacagtctacaaatcacaatataacaaatgtgtatatggtcattgaccaattacttttttgaaaatttgttcatgactgaccattgcacatctcttattaagacagacagtaaatgtttggttttgttgcctccttgtctcccagtaataaaaccacttgacattttacaaaaatggataagtgaaagagagacttggccacagacatgaaagtacagcacagaaacaaaaagttacaacactggaagtgaaatttgaattaaccatttgtggggttttagatgaaatggttgactgagaatgttgatcctgctgccattcaaacgagactctacatatgcatccagccagagaaatttagtgacagcaaaactgttggcataaataaggaaataaggaagatgtcccagaggaagtgaaatatatcttcacatttaaggaattcttaaagatatctcatgacattgaaaatgcaaaaggtaaaacgtcaaaagctgatccaaacttaggaatatgacaattcgccaagcaaagaaagggtgcttgctctattgtgttacatcatgagaagacactgcttaaactattactgatgttttttttacaaagatataaagcactttaattctaaaagtttctaatgctttaaattacaatgtattaaataaatattagttttactacttttaaa

SEQ ID NO: 87927 - DNA, 514 bp, Homo sapiens
agatatcttcaccttgcaatctgtatgaccaattattttgaagtgccaacttaatgaatgacccttcgtggtgccagactcctaagctctcccttgccttctcttagttctctctttggtagagttggttgaatgcaccagtgagtttgttacttctcagcaaaccttgggggagatatctgaacctaattgttggtgttctcccttagatttgggctttattgcctcttgctgtcagctttgggccctagttactgattctggaaaaagtggaaaaataccccttaacatcttgttagattatgaataggtaagtttaggaaatattattgcaggtagaagaaaacctaacaggtttttattttctaatgtttaaagagacatttaagtaaaagatctcaatggaattatacctttctttttgttgttgttgttgcagatagtatgtacttaattttttttttttttaaatttcaataggtttttcaggaagattgcgtgtttggttacatgg

SEQ ID NO: 87928 - DNA, 334 bp, Homo sapiens
cagacacaggatcgcactcagattcgaggcatcttttggacgtagagctggaagaatgtgttgatgggctggacatggactgtgagcaaaagggaagcagcaaggatggccccaaggtttttggcctccgaagctggtaaatgaagaagcctggagagagccacactgaactacctgaagctcccaagcactgcatgtcctcccaggcctcagctccctgcctggacctcccttcctagataactccaggtgttcctcggcctggacaactcctgttactgtcttttttttttttctttgagtcagagtcttgctctattgcccaggctggagt

SEQ ID NO: 87929 - DNA, 408 bp, Homo sapiens
ccttcaccttctctgacacatccataaaaggactttcattttccagggggagcaagcgaccaaagaaaagttatgtgacttgtcttcagatcagaggagagtcaaaagcataaagtaagtcaccatgctcctcgatgaatgtatatacatttacatgtatacagcaggtcctcaaataacggcatttcatttgcacgttctcctcacatctatgtggtttttcctgggaactctgggttcctcccacatcccaaagctgtgcctgtgaggtgaactggtgcatctctacggtcctagtgagtgtgggtgagcggagtgagtgtgtgagtgtgagtgggtgtgagtatgagtctccctacgatgggagggtgtcctggccagggcagttcccacctgacatcctgagct

SEQ ID NO: 87930 - DNA, 343 bp, Homo sapiens
ctgctcctggctaattaaaaaatatatatatattttgtagaaaggtggtcttactatgttgcccaggctggtcttgaactcctggggtcaagtgatcctctgccttggcttttcaaagcgctgagattacaaacgtgagccactgcacctagccctttaaaaaaaaaaatgttgttactagatagaattataattctaggtgtcatgttaccgtcaggcttttccctaatacagagatttttgggggcactgagggtgaagggaattgtttttgttttataagcctaataaatggtaggcttttggctatttttgtgcgtgaatgtatatacacacaccaaaa

SEQ ID NO: 87931 - DNA, 372 bp, Homo sapiens
  misc_feature (25)..(25): n is a, c, g, or t
ttatcgatgccaccggcttcaatcntcaagaacttggtcattacctataaccggacatatgagtcaaaggaagaagcccggtggcgcctgtccgtctttgtcaataacatggtgcgagcacagaagatccaggccctggaccgtggcacagctcagtatggagtcaccaagttcagtgatctcacagaggaggagttccgcactatctacctgaatactctcctgagaaaagagcctggcaacaagatgaagcaagccaagtctgtgggtgacctcgccccacctgaatgggactggaggagtaagggggctgtcacaaaagtcaaagaccagggcacgggtggcatcgataaacaccgggtacggagctcg

SEQ ID NO: 87932 - DNA, 1385 bp, Homo sapiens
  misc_feature (25)..(25): n is a, c, g, or t
ttatcgatgccaccggcttcaatcntcaagaacttggtcattacctataaccggacatatgagtcaaaggaagaagcccggtggcgcctgtccgtctttgtcaataacatggtgcgagcacagaagatccaggccctggaccgtggcacagctcagtatggagtcaccaagttcagtgatctcacagaggaggagttccgcactatctacctgaatactctcctgagaaaagagcctggcaacaagatgaagcaagccaagtctgtgggtgacctcgccccacctgaatgggactggaggagtaagggggctgtcacaaaagtcaaagaccagggcatgtgtggctcctgctgggccttctcagtcacaggcaatgtggagggccagtggtttctcaaccaggggaccctgctctccctctctgaacaggagctcttggactgtgacaagatggacaaggcctgcatgggcggcttgccctccaatgcctactcggccataaagaatttgggagggctggagacagaggatgactacagctaccagggtcacatgcagtcctgcaacttctcagcagagaaggccaaggtctacatcaatgactccgtggagctgagccagaacgagcagaagctggcagcctggctggccaagagaggcccaatctccgtggccatcaatgcctttggcatgcagttttaccgccacgggatctcccgccctctccggcccctctgcagcccttggctcattgaccatgcggtgttgcttgtgggctacggcaaccgctctgacgttcccttttgggccatcaagaacagctggggcactgactggggtgagaagggttactactacttgcatcgcgggtccggggcctgtggcgtgaacaccatggccagctcggcggtggtggactgaagaggggcccccagctcgggacctggtgctgatcagagtggctgctgccccagcctgacatgtgtccaggcccctccccgggaggtacagctggcagagggaaaggcactgggtacctcagggtgagcagagggcactgggctggggcacagcccctgcttccctgcaccccattcccaccctgaagttctgcacctgcacctttgttgaattgtggtagcttaggaggatgtcggggtgaagggtggtatcttggcagttgaagctggggcaagaactctgggcttgggtaatgagcaggaagaaaattttctgatcttaagcccagctctgttctgcccccgctttcctctgtttgatactataaattttctggttcccttggatttagggatagtgtccctctccatgtccaggaaacttgtaaccacccttttctaacagcaataaagaggtgtccttgt

SEQ ID NO: 87933 - DNA, 1112 bp, Homo sapiens
  misc_feature (56)..(56): n is a, c, g, or t
cggggaggggcctggacacatgtcaggctggggcagcagccactctgatcagcacncaggtcccgagctgggggcccctcttcagtccaccaccccgcgagctggccatggtgtgtcacgcacaggccccggaccctgctctccctctctgaacaggagctcttggactgtgacaagatggacaaggcctgcatgggcggcttgccctccaatgcctactcggccataaagaatttgggagggctggagacagaggatgactacagctaccagggtcacatgcagtcctgcaacttctcagcagagaaggccaaggtctacatcaatgactccgtggagctgagccagaacgagcagaagctggcagcctggctggccaagagaggcccaatctccgtggccatcaatgcctttggcatgcagttttaccgccacgggatctcccgccctctccggcccctctgcagcccttggctcattgaccatgcggtgttgcttgtgggctacggcaaccgctctgacgttcccttttgggccatcaagaacagctggggcactgactggggtgagaagggttactactacttgcatcgcgggtccggggcctgtggcgtgaacaccatggccagctcggcggtggtggactgaagaggggcccccagctcgggacctggtgctgatcagagtggctgctgccccagcctgacatgtgtccaggcccctccccgggaggtacagctggcagagggaaaggcactgggtacctcagggtgagcagagggcactgggctggggcacagcccctgcttccctgcaccccattcccaccctgaagttctgcacctgcacctttgttgaattgtggtagcttaggaggatgtcggggtgaagggtggtatcttggcagttgaagctggggcaagaactctgggcttgggtaatgagcaggaagaaaattttctgatcttaagcccagctctgttctgcccccgctttcctctgtttgatactataaattttctggttcccttggatttagggatagtgtccctctccatgtccaggaaacttgtaaccacccttttctaacagcaataaagaggtgtccttgt

SEQ ID NO: 87934 - DNA, 1795 bp, Homo sapiens
  misc_feature (25)..(25): n is a, c, g, or t
ttatcgatgccaccggcttcaatcntcaagaacttggtcattacctataaccggacatatgagtcaaaggaagaagcccggtggcgcctgtccgtctttgtcaataacatggtgcgagcacagaagatccaggccctggaccgtggcacagctcagtatggagtcaccaagttcagtgatctcacagaggaggagttccgcactatctacctgaatactctcctgagaaaagagcctggcaacaagatgaagcaagccaagtctgtgggtgacctcgccccacctgaatgggactggaggagtaagggggctgtcacaaaagtcaaagaccagggcatgtgtggctcctgctgggccttctcagtcacaggcaatgtggagggccagtggtttctcaaccaggggaccctgctctccctctctgaacaggagctcttggactgtgacaagatggacaaggcctgcatgggcggcttgccctccaatgcctactcggccataaagaatttgggagggctggagacagaggatgactacagctaccagggtcacatgcagtcctgcaacttctcagcagagaaggccaaggtctacatcaatgactccgtggagctgagccagaacgagcagaagctggcagcctggctggccaagagaggcccaatctccgtggccatcaatgcctttggcatgcagttttaccgccacgggatctcccgccctctccggcccctctgcagcccttggctcattgaccatgcggtgttgcttgtgggctacggcaaccgtgagttccgctgcctgtcctgcatccagccaggccacagcaggggtgggatcacagcatctcaggtcctctagaggggaaatagggggaatgcctaggaaccctgtccttacccactgcctgggccatgaccagctgggcatcatctgtcctctctatggcagggaagctgagctgtgggagggtaaatattgatggcctaataacctgcaataggcgggtgggtgcgtgcttcctccctgccccagggcttctccctgaggctggtaggtgggcccctcgctttctgctcttttcctagtccctgtcacacagtaggcccagtgcaagtatttgaagggtgcaaagtgattaaggctctgcctggagaattaaggaccctgatccttgcgctctgcactgcaccccaggctctgacgttcccttttgggccatcaagaacagctggggcactgactggggtgagaagggttactactacttgcatcgcgggtccggggcctgtggcgtgaacaccatggccagctcggcggtggtggactgaagaggggcccccagctcgggacctggtgctgatcagagtggctgctgccccagcctgacatgtgtccaggcccctccccgggaggtacagctggcagagggaaaggcactgggtacctcagggtgagcagagggcactgggctggggcacagcccctgcttccctgcaccccattcccaccctgaagttctgcacctgcacctttgttgaattgtggtagcttaggaggatgtcggggtgaagggtggtatcttggcagttgaagctggggcaagaactctgggcttgggtaatgagcaggaagaaaattttctgatcttaagcccagctctgttctgcccccgctttcctctgtttgatactataaattttctggttcccttggatttagggatagtgtccctctccatgtccaggaaacttgtaaccacccttttctaacagcaataaagaggtgtccttgt

SEQ ID NO: 87935 - DNA, 2199 bp, Homo sapiens
  misc_feature (25)..(25): n is a, c, g, or t
ttatcgatgccaccggcttcaatcntcaagaacttggtcattacctataaccggacatatgagtcaaaggaagaagcccggtggcgcctgtccgtctttgtcaataacatggtgcgagcacagaagatccaggccctggaccgtggcacagctcagtatggagtcaccaagttcagtgatctcacagaggaggagttccgcactatctacctgaatactctcctgagaaaagagcctggcaacaagatgaagcaagccaagtctgtgggtgacctcgccccacctgaatgggactggaggagtaagggggctgtcacaaaagtcaaagaccagggcatgtgtggctcctgctgggccttctcagtcacaggcaatgtggagggccagtggtttctcaaccaggggaccctgctctccctctctgaacaggagctcttggactgtgacaagatggacaaggcctgcatgggcggcttgccctccaatgcctactcggccataaagaatttgggagggctggagacagaggatgactacagctaccagggtcacatgcagtcctgcaacttctcagcagagaaggccaaggtctacatcaatgactccgtggagctgagccagaacgagcagaagctggcagcctggctggccaagagaggcccaatctccgtggccatcaatgcctttggcatgcagttttaccgccacgggatctcccgccctctccggcccctctgcagcccttggctcattgaccatgcggtgttgcttgtgggctacggcaaccgctctgacgttcccttttgggccatcaagaacagctggggcactgactggggtgagaagggttactactacttgcatcgcgggtccggggcctgtggcgtgaacaccatggccagctcggcggtggtggactgaagaggggcccccagctcgggacctggtgctgatcagagtggctgctgccccagcctgacatgtgtccaggcccctccccgggaggtacagctggcagagggaaaggcactgggtacctcagggtgagcagagggcactgggctggggcacagcccctgcttccctgcaccccattcccaccctgaagttctgcacctgcacctttgttgaattgtggtagcttaggaggatgtcggggtgaagggtggtatcttggcagttgaagctggggcaagaactctgggcttgggtaatgagcaggaagaaaattttctgatcttaagcccagctctgttctgcccccgctttcctctgtttgatactataaattttctggttcccttggatttagggatagtgtccctctccatgtccaggaaacttgtaaccacccttttctaacagcaataaagaggtgtccttgtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggagggcgcagccgcgcgataagaaaacacgggcgaagacaagcagacagtagacacaaccaccaacgtgatgagaaaagagagacgccaccaaacagaggaccgcaaaaaaacagacacacagagagcacccccacacacacacacacagcgagacggcaagcgacacgaccacacacgggggagaataaagagaaaagcgaaccccctcaacggcgggcgacggacgacaacacaacgcgggacaaaccgaccctgaagaacacacaaaacccccgaccgacgaaaaccacaacacaccgacagacaagagaacaaagagagccgcggaccacaacccgaacgaatgagcacagcgccggggacaggaagaggaaaccgaatcagctccagctacaccgacaggggaaaggagagtggacggagacacagaagcaaacaacaacagaacgagaaaggggagcgagagccgcagacaacaaccggggcacaggaacgaagagagcagaggaagaaacagaaacataccagaagcaagcgagacacaaaccgacagaagcgcagacaagggtgcgaggaaagagacaaccgagaaagcaaaaagagcgagagacaggcgagaaaaacgaagcagaaagacgaagcagaaaggaacgaaacgagaagcaacgaaagcagagaaacagaaacaaaaaaaaggaagaaacaaagagcgagcgaagg

SEQ ID NO: 87936 - DNA, 1464 bp, Homo sapiens
  misc_feature (25)..(25): n is a, c, g, or t
ttatcgatgccaccggcttcaatcntcaagaacttggtcattacctataaccggacatatgagtcaaaggaagaagcccggtggcgcctgtccgtctttgtcaataacatggtgcgagcacagaagatccaggccctggaccgtggcacagctcagtatggagtcaccaagttcagtgatctcacagaggaggagttccgcactatctacctgaatactctcctgagaaaagagcctggcaacaagatgaagcaagccaagtctgtgggtgacctcgccccacctgaatgggactggaggagtaagggggctgtcacaaaagtcaaagaccagggcatgtgtggctcctgctgggccttctcagtcacaggcaatgtggagggccagtggtttctcaaccaggggaccctgctctccctctctgaacagggtgagcatctcgctctactcctctgtccccagcctagcccctcaggagggcttcttgggaccagccttctgtctcctagagctcttggactgtgacaagatggacaaggcctgcatgggcggcttgccctccaatgcctactcggccataaagaatttgggagggctggagacagaggatgactacagctaccagggtcacatgcagtcctgcaacttctcagcagagaaggccaaggtctacatcaatgactccgtggagctgagccagaacgagcagaagctggcagcctggctggccaagagaggcccaatctccgtggccatcaatgcctttggcatgcagttttaccgccacgggatctcccgccctctccggcccctctgcagcccttggctcattgaccatgcggtgttgcttgtgggctacggcaaccgctctgacgttcccttttgggccatcaagaacagctggggcactgactggggtgagaagggttactactacttgcatcgcgggtccggggcctgtggcgtgaacaccatggccagctcggcggtggtggactgaagaggggcccccagctcgggacctggtgctgatcagagtggctgctgccccagcctgacatgtgtccaggcccctccccgggaggtacagctggcagagggaaaggcactgggtacctcagggtgagcagagggcactgggctggggcacagcccctgcttccctgcaccccattcccaccctgaagttctgcacctgcacctttgttgaattgtggtagcttaggaggatgtcggggtgaagggtggtatcttggcagttgaagctggggcaagaactctgggcttgggtaatgagcaggaagaaaattttctgatcttaagcccagctctgttctgcccccgctttcctctgtttgatactataaattttctggttcccttggatttagggatagtgtccctctccatgtccaggaaacttgtaaccacccttttctaacagcaataaagaggtgtccttgt

SEQ ID NO: 87937 - DNA, 1423 bp, Homo sapiens
  misc_feature (25)..(25): n is a, c, g, or t
ttatcgatgccaccggcttcaatcntcaagaacttggtcattacctataaccggacatatgagtcaaaggaagaagcccggtggcgcctgtccgtctttgtcaataacatggtgcgagcacagaagatccaggccctggaccgtggcacagctcagtatggagtcaccaagttcagtgatctcacagaggaggagttccgcactatctacctgaatactctcctgagaaaagagcctggcaacaagatgaagcaagccaagtctgtgggtgacctcgccccacctgaatgggactggaggagtaagggggctgtcacaaaagtcaaagaccagggcatgtgtggctcctgctgggccttctcagtcacaggcaatgtggagggccagtggtttctcaaccaggggaccctgctctccctctctgaacagggtgagcatctcgctctactcctctgtccccagcctagcccctcaggagggcttcttgggaccagccttctgtctcctagagctcttggactgtgacaagatggacaaggcctgcatgggcggcttgccctccaatgcctactcggccataaagaatttgggagggctggagacagaggatgactacagctaccagggtctacatcaatgactccgtggagctgagccagaacgagcagaagctggcagcctggctggccaagagaggcccaatctccgtggccatcaatgcctttggcatgcagttttaccgccacgggatctcccgccctctccggcccctctgcagcccttggctcattgaccatgcggtgttgcttgtgggctacggcaaccgctctgacgttcccttttgggccatcaagaacagctggggcactgactggggtgagaagggttactactacttgcatcgcgggtccggggcctgtggcgtgaacaccatggccagctcggcggtggtggactgaagaggggcccccagctcgggacctggtgctgatcagagtggctgctgccccagcctgacatgtgtccaggcccctccccgggaggtacagctggcagagggaaaggcactgggtacctcagggtgagcagagggcactgggctggggcacagcccctgcttccctgcaccccattcccaccctgaagttctgcacctgcacctttgttgaattgtggtagcttaggaggatgtcggggtgaagggtggtatcttggcagttgaagctggggcaagaactctgggcttgggtaatgagcaggaagaaaattttctgatcttaagcccagctctgttctgcccccgctttcctctgtttgatactataaattttctggttcccttggatttagggatagtgtccctctccatgtccaggaaacttgtaaccacccttttctaacagcaataaagaggtgtccttgt

SEQ ID NO: 87938 - DNA, 1410 bp, Homo sapiens
  misc_feature (25)..(25): n is a, c, g, or t
ttatcgatgccaccggcttcaatcntcaagaacttggtcattacctataaccggacatatgagtcaaaggaagaagcccggtggcgcctgtccgtctttgtcaataacatggtgcgagcacagaagatccaggccctggaccgtggcacagctcagtatggagtcaccaagttcagtgatctcacagaggaggagttccgcactatctacctgaatactctcctgagaaaagagcctggcaacaagatgaagcaagccaagtctgtgggtgacctcgccccacctgaatgggactggaggagtaagggggctgtcacaaaagtcaaagaccagggcatgtgtggctcctgctgggccttctcagtcacaggcaatgtggagggccagtggtttctcaaccaggggaccctgctctccctctctgaacaggagctcttggactgtgacaagatggacaaggcctgcatgggcggcttgccctccaatgcctactcggccataaagaatttgggagggctggagacagaggatgactacagctaccagggtcacatgcagtcctgcaacttctcagcagagaaggccaaggtctacatcaatgactccgtggagctgagccagaacgagcagaagctggcagcctggctggccaagagaggcccaatctccgtggccatcaatgcctttggcatgcagttttaccgccacgggatctcccgccctctccggcccctctgcagcccttggctcattgaccatgcggtgttgcttgtgggctacggcaaccgctctgacgttcccttttgggccatcaagaacagctggggcactgactggggtgagaagggttactactacttgcatcgcgggtccggggcctgtggcgtgaacaccatggccagctcggcggtggtggactgaagaggggcccccagctcgggacctggtgctgatcagagtggctgctgccccagcctgacatgtgtccaggcccctccccgggaggtacagctggcagagggaaaggcactgggtacctcagggtgagcagagggcactgggctggggcacagcccctgcttccctgcaccccattcccaccctgaagttctgcacctgcacctttgttgaattgtggtagcttaggaggatgtcggggtgaagggtggtatcttggcagttgaagctggggcaagaactctgggcttgggtaatgagcaggaagaaaattttctgatcttaagcccagctctgttctgcccccgctttcctctgtttgatactataaattttctggttcccttggatttagggatagtgtccctctccatgtccaggaaacttgtaaccacccttttctaacagcaataaagaggtgtccttgtaacaacacaaccacacagaaaaccc

SEQ ID NO: 87939 - DNA, 400 bp, Homo sapiens
cctgacctcaaggcagggacccccatttgctcacatccatttcacctttgggaagggggctctgcgggacaagaaatgtgcttttcctgcccctggagccctctgaacaaacctatgtccgtctacccccacccagccagggtccctggggtggacttcctgccaccccaaacccccaaggccacggggggctgcagcctccacaggttccggcctggcctgggaaccagttcgggtatagccaagctccctagttactcaattgctaagacaacagcccccaggggccttgcctcctcctccaaccggcaggtgttgacagcaccacccggggcccaggggagccagtgacctcagcctctgggggcgggaatgaggtgggtggggtggaggggctcga

SEQ ID NO: 87940 - DNA, 255 bp, Homo sapiens
agctcactgaatgaaaggcaaatgcataagtgtacactgatataaataaattagaaaatgaaaaattcttcctcacaatataaacactactactaacttataagcataactcacacctgtgaaaatgagttagggtaacttcacttatgataacctcaccaacattggactgtgatcattttaaaacctacgctaatttgaagggcatgaaatgatcttttatttggatttataggactttggatcattagggga

SEQ ID NO: 87941 - DNA, 2202 bp, Homo sapiens
ggccagttcctagtcggtggctccatgctggtctctgatgtttaggaagtggtgtcagcagagactgagctgcaccctttctttggacagatggcaggagaggagaacttcaaggaagagctcagatcccaggatgcttccaggaacttgaaccagcatgaggtagcaggacatccacattcctggtctctggagatgctgttacgcagattgagggctgtccacaccaagcaggatgacaagtttgccaacctcctggatgcggtgggggagtttggcacattccagcagaggctagtagccctcacctttatccccagcatcatgtcggccttcttcatgtttgctgaccacttcgtgttcacagcccagaagccctattgcaataccagctggatcctggcagtgggcccccacctgtccaaagctgagcagctgaatctgaccataccccaagcacccaatggcagtttcctgacatgcttcatgtaccttcctgtgccttggaatctggattctaccatccagtttggcctcaatgacacagacacatgccaagatgggtggatctatcctgacgctaagaagcgatcgctgatcaatgagtttgacttggtatgtggcatggagacgaagaaggacactgcacagatcatgttcatggcagggctcccgataggctctctcatcttcaggctcataactgacaagatgggccgctaccctgccatcctgctgtcactgctggggctgatcatcttcggctttgggacagccttcatgaacagctttcacctgtatttgttctttcgctttggcatctcgcagtcagtggtgggctacgccatcagcagcatttctttggccactgagtggttagtgggtgagcaccgggcccacgccattatcctgggacactgctttttcgctgtgtgggccatgttgctgacagggatcgcctacggtcttccccactggcagctgctgtttctggtgggtgggatacttgtgatccccttcatctcctatatctggattctcccggagtccccgcggtggctgatgatgaaagggaaggtgaaggaggccaagcaggtgctgtgctacgccgcaagtgtgaacaagaagaccattccttcaaatctgctggacgagctgcagctgcccagaaagaaggtgactcgggcctctgtcctggacttctgtaagaataggcagctctgcaaggtgaccttggtgatgagctgtgtgtggtttaccgtcagttacacctattttacgttgagcctgagaatgagagagctgggcgtgagcgtccacttcagacacgtggtccccagcatcatggaggtgcctgcccggctgtgctgcatctttctcctccagcagattgggaggaagtggagcctggctgtgactctcctccaagccatcatctggtgcttgcttctccttttcctccctgaaggggaggatggcctcagactcaagtggccacgttgtccggccacagagctgaaatccatgacgatcttggtgctcatgctcagagagttcagcctggccgccactgtcactgtgttcttcctctacaccgctgagctcctccccactgtgctcagggcgacaggtctggggctggtgtctctggcctcggtggctggagccatcttgtccctgacaatcatcagccagaccccctccctcctgcccatctttctctgctgcgtcttagccatcgtggccttttccctctcctccctgctgccggaaacgcgagatcagcccctctccgagagcctgaaccactcctcacagataaggaataaggtcaaggacatgaagactaaggaaacatcatctgatgatgtctgaggaagcggccaagaatgtcattctcaatgcccagatcctgagattggacccataccctgtctccaaccctgccttgaagcaattcaataaagaggaagcaaacagccaggctccctgagggccaggcccccagaccatcttgggttggaattgagtggccaagtatggggtcatggattccaggccacaaattccaggcctagttcagtttgggggcagggtcagtcctgctcccaggccagcccttgacattaaaaaaaaatgccccctccttctgcaggagctctgctgtgattcattccaataaaggtacaatgttggtcttga

SEQ ID NO: 87942 - DNA, 372 bp, Homo sapiens
caggtctctgtgcttatttctctcctccgttcctaccctgacccttgctgctctgcctctgtctttattcctggctccgtgtgcacgcgcacttgcctcctggcttcatccaggtttaccgtcagttacacctattttacgttgagcctgagaatgagagagctgggcgtgagcgtccacttcagacacgtggtccccagcatcatggaggtgcctgcccggctgtgctgcatctttctcctccagcagattgggaggaagtggagcctggctgtgactctcctccaagccatcatctggtgcttgcttctccttttcctccctgaaggtacagctcatccttcccctgtggcctgcccacagccttcctgc

SEQ ID NO: 87943 - DNA, 331 bp, Homo sapiens
tcaactactcagaaatagggaggaacatctttttcttactcattgacgaccctatcaatgcccagtgtgcagtgggtactggaaaacttatgatttacttaagatacccctacattcaaatgagttcaagtagttgtaggaggaagcattcaattcaatatggctgctttgggtgtggctgagctggaactcttcttcgggctttgccctcaaagtcccaggcatattcttttaaaaattctgttaaaaaatagttttaaaattataggatagttcttacattttgtgtatgaggctatcggaaagataattttataattaaggggggggg

SEQ ID NO: 87944 - DNA, 405 bp, Homo sapiens
cggcacgaggcggcacgagggaataaatagcttaaactctttgaagttatagtttctcacttataaaacacaagagttgggctaggttgtcacaaggcaccttttggttccaaaattctgtgattttttttggacctaccacaagcttattgctataaattgtataaagaagagggtgatgggaaagaataggaacaaagattattttggtcattgaaaatagctctcaaatgtttctgagcatggagacagattaaaatagaaattatgaatatttatttcacaaaagaaagtctgtgagactttctaacaaagatagaaaaaccataatgaagaatattttacaaataccatataaatacagattggcaagtaggaagaattataaaatgtttattaatctgt

SEQ ID NO: 87945 - DNA, 426 bp, Homo sapiens
atccttgtttggcctccttccctttgaagctctacttcccattcccctgagaacacttcctaacaaattatttttacatgatgtctcatctcaggattttgttttagggaactcagcctaagatagcaggaaagagactatcacacaaaaacatctagtccccctcttctcctttctggtatagagatgccagtcagaggcagtgtaaacatttcagactctgagcaagtggtcttccaggtcctgggaatctctcgtcctatctcatgcttcaatggggcagccagtttcaagcaaaccaggattttttaaacaaagaaatccacccgccaaacattaaggatggcttagcagacttatgtgactacatattgattttaatccacttaagtgccccttaaacatggactcatttaattaccattc

SEQ ID NO: 87946 - DNA, 324 bp, Homo sapiens
gtctctccagttctcccgtttcttcctccctcctcctcaccctcctcgttagttaggagctgcgacgcctggctctggggaggtgctggcactgagtgttttacagctctttaattctgccttattatcctctgttcctacaaccaaggtctttgactgctgctttcattgtgttgtcaggtttctctttgatgcctaaattaatactaatgggaagccctctcagctgtttgcttacttttccttctgctcagtttctcccagttgaatattccccagtccgtgctgtgcactgatctgtcagccctttctcggatccacttt

SEQ ID NO: 87947 - DNA, 360 bp, Homo sapiens
gagagagagagagagagagagagagagagagagagaagagagagagagagagagagagagagagagcttttcttccttccaggactgtttctctatatccactctccacagccagaatgatcattctgaaacacaaacttcatcatgagttttctgtttaagtctttagaggtccccactatctttaggatgaagtttaaaattcgcgtcatagcttcaaagctttttattatctagcctacctctccatccttcctctcctcacagcctcacactctcctccccagctggactgaactactttcagttccccaaaggcctgagctcactctccaacctccaggtcattgcacatgctgt

SEQ ID NO: 87948 - DNA, 799 bp, Homo sapiens
tttttagacagaatctcactctgttgctcaggctggagtgcagtggtgcaatcttggctcgctgcaacctccaccttccaggttcaagtgattctcctgcctcagcctcctgagtagctgggattacaggcgcctgccaccatacctggctaatttttgtatttttagtagaaacggggtttcaccatgttggccaggctggtctgataatagcagggagtattatgacattaatctgtttaatttttcagagctcctttgacagtacaatactttcttaggtaattaagattgatatttctacaatacttcattgggtaattaagactgatattcctgacatcttcaggaccttttgcacttcttgttttctgtgtttagttcacttgtccttcattgttcatcccttaccttcttgggtctttacccacatgtcacttgagtgaggccttccctgaccttaccttaccttaaaagtagaactcaaggccaggcatggtaactcatgcctgtaatcctagcactttcagaggccaaagcaggaggattgcttgagcccagcagtttgagaccagcctgagtgacatagtgagaccctgtctctacaaaaacataagaaaattagccaggtgtggtggcacatgcctgtagtcctagctactcaggaggctgaggtgggagggtcacttgagccttggagttgggggctatagtgagccatgattctgccactgcactccagcctgggcggcggagtgaggctgtgtcaaaaacacgtacaactcatcccagcatccca

SEQ ID NO: 87949 - DNA, 333 bp, Homo sapiens
cagtctcagtgccagcaccaccccttggctgcctgcccacactgctggattctcgggtggaactcgacccgcagggacagccagccccagagtccgcactggggagagaaggggccaggcccaggacactgccacctaccacccactccagtccaccgagatcactcggagaagagcctgggccatgtggccgctgcaggagccccacggtgcaagggtgaggatagcccaaggaagggctgggcatctgcccagacaggcctcccagagaaggctggtgaccaggtcccaggcgggcaagactcagccttggtggggcctgaggacagagga

SEQ ID NO: 87950 - DNA, 474 bp, Homo sapiens
cgactgtcaacccctcttgctggccatagcagattggacaaggggtgggccctggatttgagcagcaatcctgtctacccagcaacctacagaacttctggatatgaaaagatgagctggacctttcacaatctctctcacagaaatttgaactaaaagtatccaggctaggagtattagctcatccctgtaatcccagcactttgggaagctgaggccacttgagcccaggagtccaagaccagcataggcaacagggtgaaaccccatctctacaaaaactacaaaaaaattagccgagcatggtgatgcaggctgagtagtcgcagctactcaggagacagaggtgggagaatcacctgagctcagggaagtcgaggctccagtgagccatgattgcaccactgcactccagcctgggcaacacagtgagaacctgtctcataaataaataaataaataaaggtatgcaaa

SEQ ID NO: 87951 - DNA, 611 bp, Homo sapiens
gtgtgtggtttgaatgtcaaagcccaatgaaaggtcctaaatgcacataattgcattccatagctatccaagaacaaaggggaaaaggaggtggcttctcaaagcagaggcttattactcccctgcctttccttaagccccctaggaaaagtcagaacatatagtcaggactttgtattggctctttcaccactggtgaggggaggaattgtctacaggagtaggacagacaaaacattctgggtttatgctctgtgagtagacagtgatgtcctcttcacagaaactgaggaggtcgagacagtcatcttgggatggcttgcttgaagctctgtccctccagctgcatgcagtcctgatgtgggacacagtcaccagaaacccagactaccccttctctctcactcccgggatggagagagaagggggcaggatgtggcaggagggaaagagtacattatagaaaaccagtggacctccggttctgagagcagggatacttggatgaccctaaaggcagagtctctcctggggaaggtttggagaagatggtcaggatcctaccagtgaggctgctggggaaggagccctctgggtggaaaggactgcag

SEQ ID NO: 87952 - DNA, 692 bp, Homo sapiens
gggacatgtgggcccacacatgtgtgtgctgtgtttctggggtgtgtgatcctttgtgatcggggaagcttatgtctctgagcatgtggctgggtgtgtgtttggtaagtctgcgtgtgcgcgtgtgttaggaggtgggccccgtccatggccgtgatgtcatgcacatcacaccatgcctacagcaccgcgctctccttgcagccacggacacacaagccaccccctggtcagcaccccatgtgggtgtctcacgggcttctcaaactcacgtctcctccacccaccctgccaatcacacccaccccttctcagcaaatggcacccctttgctcacgcctgaaccttacatgacatccggcccttctccaagtcctaggtctgtcccctggcctccagcccctgcagaggggcagcactggccccgggtaccggcactgtgtgcgtggaagcccctccctctcagggttcccaatcttccttctgtgcctggactggcccggggtcagtgctgcccaggcaggaagcggaagcccaggtcaagacccacttggccctggctcgtttctccccttgggggcgttctgcaaccctctgcctggtgctgaggtccaccagatgccccagagcttccagactcccacgtgggaggtcctggttcctgtcgctggcaggtagattttgtggtgtgg

SEQ ID NO: 87953 - DNA, 553 bp, Homo sapiens
gtgttggttcctgggaggtgacagcaaaggcaacgccggcttctctgaggaagcgatctttaggccgaggcctgcaggatgagtgcgagtgtggtagcgagctgaggcttgcacattctagagcatggacacagcacaagcagaacttagggccaagaaggtgaataggcgtgtgccggccaaggggaggcctgtgtgtccagggctttggtgagcaggaagggtggaggtggtgggcccagctcccttggaactttgcaggccagagccttgggaagccattgctgcatcctgagcaggggagtgacatgctcgaatttacattcaacaaagatcactctggctgtagtggggagaaggactgggaagagttcgtggtgcaaatgtgcaggctgttgcactgcgccactgtgagaacatggtgctcaggatctcctaaggaggtcagcagccagggcctgttgcctggatagtggctgaggcagagggaggacccaagggggccccagcctgtgcaggagcaaccagatggctagtggctcaataaatgcat

SEQ ID NO: 87954 - DNA, 506 bp, Homo sapiens
aaatataaaaataattactaaaacagcatccacagtgtagcagcagatgtgcatttgcatggtatcggttagaggtgcggtgtgaggcaggccagggaatgcatgttaactaaaccaaatttcacaatgatgttatctttgtgtggtgaaataattggtgagagaagctgctagtccatctaagtacttttatctttaaatgggctgcttgtccatttaaaatggtctgtaactataaaatagtaagattaaaacctaacccctggatttattggaaagactgaagcacaggaagaacctaagtacacagcactatgcctagaacctgtttgtgcttggtacaagttccctttttcctctctgcctgccggatctgccctctttctgggcatttatctttaccaggcagagaagcaattctacatcactctcgggtctcaagacttcacttacagaaacagtgaattaaaataaatttggaaaagtcgcacaaaggataccaattt

SEQ ID NO: 87955 - DNA, 870 bp, Homo sapiens
atgtggaacgcgacgcccagcgaagagccggggttcaacctcacactggccgacctggactgggatgcttcccccggcaacgactcgctgggcgacgagctgctgcagctcttccccgcgccgctgctggcgggcgtcacagccacctgcgtggcactcttcgtggtgggtatcgctggcaacctgctcaccatgctggtggtgtcgcgcttccgcgagctgcgcaccaccaccaacctctacctgtccagcatggccttctccgatctgctcatcttcctctgcatgcccctggacctcgttcgcctctggcagtaccggccctggaacttcggcgacctcctctgcaaactcttccaattcgtcagtgagagctgcacctacgccacggtgctcaccatcacagcgctgagcgtcgagcgctacttcgccatctgcttcccactccgggccaaggtggtggtcaccaaggggcgggtgaagctggtcatcttcgtcatctgggccgtggccttctgcagcgccgggcccatcttcgtgctagtcggggtggagcacgagaacggcaccgacccttgggacaccaacgagtgccgccccaccgagtttgcggtgcgctctggactgctcacggtcatggtgtgggtgtccagcatcttcttcttccttcctgtcttctgtctcacggtcctctacagtctcatcggcaggaagctgtggcggaggaggcgcggcgatgctgtcgtgggtgcctcgctcagggaccagaaccacaagcaaaccgtgaaaatgctgggtgggtctcagcgcgcgctcaggctttctctcgcgggtcctatcctctccctgtgccttctcccttctctctga

SEQ ID NO: 87956 - DNA, 1101 bp, Homo sapiens
atgtggaacgcgacgcccagcgaagagccggggttcaacctcacactggccgacctggactgggatgcttcccccggcaacgactcgctgggcgacgagctgctgcagctcttccccgcgccgctgctggcgggcgtcacagccacctgcgtggcactcttcgtggtgggtatcgctggcaacctgctcaccatgctggtggtgtcgcgcttccgcgagctgcgcaccaccaccaacctctacctgtccagcatggccttctccgatctgctcatcttcctctgcatgcccctggacctcgttcgcctctggcagtaccggccctggaacttcggcgacctcctctgcaaactcttccaattcgtcagtgagagctgcacctacgccacggtgctcaccatcacagcgctgagcgtcgagcgctacttcgccatctgcttcccactccgggccaaggtggtggtcaccaaggggcgggtgaagctggtcatcttcgtcatctgggccgtggccttctgcagcgccgggcccatcttcgtgctagtcggggtggagcacgagaacggcaccgacccttgggacaccaacgagtgccgccccaccgagtttgcggtgcgctctggactgctcacggtcatggtgtgggtgtccagcatcttcttcttccttcctgtcttctgtctcacggtcctctacagtctcatcggcaggaagctgtggcggaggaggcgcggcgatgctgtcgtgggtgcctcgctcagggaccagaaccacaagcaaaccgtgaaaatgctggctgtagtggtgtttgccttcatcctctgctggctccccttccacgtagggcgatatttattttccaaatcctttgagcctggctccttggagattgctcagatcagccagtactgcaacctcgtgtcctttgtcctcttctacctcagtgctgccatcaaccccattctgtacaacatcatgtccaagaagtaccgggtggcagtgttcagacttctgggattcgaacccttctcccagagaaagctctccactctgaaagatgaaagttctcgggcctggacagaatctagtattaatacatga

SEQ ID NO: 87957 - DNA, 655 bp, Homo sapiens
tagtagagacggggtttcaccgtgctagccaggatggttttgatctcctgacctcatgatctgcccatcttgggctcccaaagtgctgggattacaggcatgagccaccgcacccggcctcgtctttatttttaaaaaagaaaaagaaagaaaaacggggagtcgttgggattcaccaagaaaaaataggtggctggcatgcagtggactgtcagtcactgtcaggtgcttccctacctgccttcaggtggcttaattggcagggggtgtttaacagaatacagatctttgagttgatggaaaccttcaatctctggtccgtaatagttaaaaatgtaaaagagtccttagaccaagaagtctgagaaccacttccccgagtcatttctaaagctaaattcagattcaccaggaaatcaagtatggtgaaagacagtgactatacccattgctcacctgatgtatggactcttaatacagcaccaggatcagcctaaaatgtactttcagagcgttcgtgaaccacaccaatcaaaatgacaagtgacactcagaggtcacccaaacccaaaataagaatcagcaaaattccctccattcaccatatcattagtcagtgaaaataactttgcatggcttccagcctttctcagca

SEQ ID NO: 87958 - DNA, 153 bp, Homo sapiens
ggctgctctcaggagaattgaggatagattgtgcacatcactggaccacagcccaaaaatgctggtgagaagagcagaaggagggtttgaaggtttgctgtagccagcaccgtctcagcactcacaccaaggggctctgtcagggcattaaga

SEQ ID NO: 87959 - DNA, 549 bp, Homo sapiens
ttttagaaaaaagttttaaacatcttccttaggaacaaccttataaacgttttaattttcatttatagtgaaagaaacttgtctctcaagctttctaaaagtaattttgagaagttactataaataacctagttacagggctgggtgcagtggctcacacctgtaatcccagcactttgggaggccgaggcatggggtggatcaaaaggtcaagagtttgagaccagcctggacaacatggtgaaaccccgtctctactaagaatacaaaaattagccaagcatggtggcatgtgcctgtaatcccagctactcgggaggctgaggcaggagaattgcttgaacctggggggtggaggttgcagtgagcagaggtcataccactgcactccagcctgggtgacagagcaagactctgtctcaaaaaaacaaacaaacagaggaggagccaagatggccgaataggaacagctccggtctacagctcccagcgtgagcgacgcagaagacggtgatttctgcatttccatctgaggtacgcggttcatct

SEQ ID NO: 87960 - DNA, 185 bp, Homo sapiens
  misc_feature (1)..(2): n is a, c, g, or t
nngcagcaaggccagtgacatttccccctgggcggataggtgaagacggaggctgaggcttgagaagtgagaggacagtaaactgagtggggcccagatgccagggccagtcctctcggcacacctggtgccagacctcccactgtctgacctgccgtctcacggcccctgcctgccctcccacg

SEQ ID NO: 87961 - DNA, 476 bp, Homo sapiens
gaggaaaaaaatcttccaggacactcctggagatctgatgtattcatgaggattgttgacccaatatcaaatagaacagaggttaattgcatgaactgagctaatagaagactaaaataattttttgtgtgatctttttgtctgaaacattggtgattcttttcattttttgggttgtttacagcttttaacaattgagtaaaatatgctcttgtgagcaaaatttaaagcatatttctttctctctacctgatttctccagaatttgaaaactatttttgagtattcttaatttataacaatatagttatttgtatgagctcaataagaatctgctttcttttgtaacaggacacaattggagactattattttactaaagctttgactagaatgaaatattttaagctataaacaaaacaacaaactgttttaaggaattgccattgacttatagagccaataaaagatcctta

SEQ ID NO: 87962 - DNA, 915 bp, Homo sapiens
ttttttctgtatgttttgcaaagatgaggtttcgccatgttgctcaggctggtcttagacctcctgagctcaggcaatctgcccaccttggcctcccaaagtgctaggactataagcgtgaaccacgacgcccggacagccactgcgcccagccttattttgtttttgagacagggtctctcactctgtccccaaagctggggtgcaatggtgcaatcttgcctcactgcagccttgaagtcctgggctcaaacattcctcccacctcagtctcctggggagctaggactacaggcatggaccaccacacctggttacttttttttttttttttttggtagagatagagtctctatgttgaccaggctggtcacaggagctatgttgactcctggcctcaagtgactctctgacctcggcctcccaaagtgctgggattacaggcatgaggcaacatgcctagctgaagttatgtgtaaaatggaactagctatttcgaaaaaatggtaagcttcttaaaaatgttcaaaaacccaggcgtggtggctcacgcctgtaatcccagcactttgggaggccaagacgggtggatcacttgaggtaaggagtttgagaccagcctggccaacatggcgaaatcccatctccacgaaaaatacaaaaattatcggaaggctgggcacagtggctcatgcctgtaatcccagcactttgggaagccgagtcaggcagatcacgaggtcaggagttcgagaccagcctaaccaacatggtgaaactctgtctctactaaaaatacaaaaaattagcagggtgtggtggcgcacgcctgtaatcccagctactcaggaggctgaggcaagagaactgcttgaacctgggaggcggaggctgcagcgagccaagattgcacca

SEQ ID NO: 87963 - DNA, 298 bp, Homo sapiens
cctcctgggttcacgtcattctcctgcctcagcctcccgagtagctgggactacaggtgcccgccaccacgcccagctaattttttgtatttttagtagagacggggtttcaccatgttagccaggatggtctcgatctcctgacctcgtgatttgcccacctccgcctcccaaagtgctgggattacaggcatgagccattgcgcccagcctaaaattcattcttttaaagtgtgcaattcagtgtttcttagtatattcccaaagttctgcagccatcgccgctatctaaacccag

SEQ ID NO: 87964 - DNA, 339 bp, Homo sapiens
tgaaagaacatttcagactgctttcttcttcatttcacactttccatgagacttgacaagtaggcaggattctacagacaatggcaacattgctacagctgtagaacttctcacctaagaggttcacaggtgtggtgatggttcaaaacagaagtctttcgaggtaggatgtgtgctgacttagggaaagaatgctgtacctgcattattacagacctcttttggatctttaatgttgctaaaattatctgggtggcaaacataaaaatagtgaaattatgtaatttggctaatactctctatctgcttgtgtggcctcttcacattggggataaaatg

SEQ ID NO: 87965 - DNA, 810 bp, Homo sapiens
ggagaggacattgtctgagtggcccctcaggtctgttttggggacattcacccagaccccagctaatgcgcgccccttcccctaaaccatttagtcttggaagctgactctgccctctgggaccttttcttccaggccactccttgctcagactccagtctcaggtgggatggtcctcagaaccgtgtgatgtgacggtggggcctgtcccaaaatacaaaccccaatgcccagtttccagtcctcttggaagcatgggcaggacaggacttaggctaggctggaggggtggtttcttttgacctctgtggggtctattaatatttgggagcactgcctgggatctggggtgataggcatctggggatggtaatcctgtccctgcgacaaataagcggggtaatctccgcttgctcagtacccacacccatcttgtgtcggtagttttgggagtgtgggaagctggcagggcccctggcaagatgaccagtgttgtcttgacttactgggttttgggaaaggagtatggcaactgataccccggctcccagggctttggctgaacattctctctgacgcctgctgtctttcctccctctactcccctctccaccctctggctgctgtctggagcccacacagtttgtggggggatgcacggtggggggcagggcctggatctccgtgtgtgtccagggagtattctgggaattggcaggattggctgagggtgtcttggtgtccccgcagggtgggcggcatgtggggacctagtgtgagaatgtgtcagcgttggtgtgtctgtcccca

SEQ ID NO: 87966 - DNA, 446 bp, Homo sapiens
  misc_feature (208)..(208): n is a, c, g, or t
  misc_feature (216)..(216): n is a, c, g, or t
  misc_feature (262)..(262): n is a, c, g, or t
ggaggtcctcctcctaaaaagtctgctccttctgctgtggtaagaagcaataattggatgagaggccaaggtcccatatcatgtggaagagagaattatggaggtcctacacgtagacggccaatctcttcctggagaaatgaccacatgtctctaagagacgatggttatgcaactaaggagagaaatcatccaagctcctgagaanctaggacnccacctagagactatgcataccatgattatggtcattctagctggnatgaacattcttctagaggatatagcctgcagggacctctcatggtgcaccacctgcacgagggcctcggatgtcttatggtggaagcagccgccctgattataacaatacactagatagatatggcagaagtcaggagagttactcaagaagctgcggtgatttttatttttgtggtcatgag

SEQ ID NO: 87967 - DNA, 113 bp, Homo sapiens
ggccgcctctcctcccggagcgagcgcgcagccctgcgcagcagcgcccactggtcccgtcctgtgagccccggccccagccgcggacagacccgcggagtcgcctcccggcc

SEQ ID NO: 87968 - DNA, 395 bp, Homo sapiens
tttttaaagcattttaagtgaataattgagcatttgatttattatcctggcttttctatctgggtctttgaaagggacaaaaggagcacatatacaccatgggatgtagcctggccagattgaaaactgaaaattgatggatttggagtatgcaggcagatagttgaatgctgggacagggatcctctttgctgactgcctcatggttaagcttttaaaaatttgttggttaagcttttaaaaaaattttagggtttttagggcaatgaagttactctgtatgatgctataatacatcgtggatacgtgtcattgtacatttgtccaaacacatagaatgcaggacaccaagagtgaaccctgacataaactgtggactttgggtgataacgaca

SEQ ID NO: 87969 - DNA, 632 bp, Homo sapiens
gtaccacttgtgcgagataactcagctcagggcagaggatcggtggaaaagatgactgacctcctggcctgacttggaagtcagtggcctgtaactcaacaggtgggagccaggcacctgtgctaagagcagagcagaagtgggcagaggcatcctgggctggactcagcttccacaaggatccttcatcctcacttccaccctcctgctagcttgtgggaggggtgctacatggagaaattgggtgggaagggaaaaaaggaaggagccacatcagtgacaatgccacattcacagatccccacagcctgaatgccctccatgaagtcctctgtctcccgggtgtgtacccaactaggccagatggagctctccccagcatttctccattctttctatggaggcacctggaaaacagtagctgggagcctgcactgtggcatcggattgcctgggtctacattctgattctgtctctttcaaattgctgactttagatgagttatttcaattatttggacctggctggacacagtggctcacacctgtaatcccaccactttgggaggccaaggtgggtggatcacttgaggtcaggagtttgagaccagcctgggcaacatggcaaaacc

SEQ ID NO: 87970 - DNA, 192 bp, Homo sapiens
caagtcaccagggaccacagcaatgcacagtgctggcgggcgtcccatgctcgcaagagaagctggaaatccagtatctttttcatgcgaactcccaatttttaaacgttggcaacaaattccaatgaaaaagatacagttcaaacaaaacacattttctggctatatcacacaagggtggctgggttagtt

SEQ ID NO: 87971 - DNA, 407 bp, Homo sapiens
tgtacatgtgtgtgtataatttaaagtaccttcctcatgattggaaatgcataattatgaagtgccatacaatgttgcactagactttaaatttttgcattaaaatctactttaatattaactgtagtttttgcttttattaactacttttcataaagcacatgttgttatccacttcctctatcatttttgcgttttgagtgactttcttctagagtgtatataaaagggttttttaaattttattattattttgtggtaggtagtcaagccacacttcctgtattttattttactatgtttgattaatattatattaattgaaaaatcaaaattgtatacatgtatggggtataatgtggtgtttaaatatatgtatacaatgtagaataaaatgatttctttgt

SEQ ID NO: 87972 - DNA, 387 bp, Homo sapiens
aaagaatgtggatcatacagtagattacacagctacacttggacagtgacttcatcagccatgcgatattctaatttgcaaaatgatgagatgagacaggggcagcaacggcagcacagagagatgacccgttccacctcttcctttggtggccacattctatatttaatacagagaatataaagccataaaccagcttccttttctctgcagccacacctaagagaaaacatgcatattcagaacataccatgggctctttttctctctagcagtctgtatttagtcacatttcagaacttcatgagatgatgaatctccagcatctgagagggatgttgtgtgttactagaatcatgaaatcattttgaggagctaagaggcaag

SEQ ID NO: 87973 - DNA, 292 bp, Homo sapiens
ggccgggctgactccgcttctgggcggccgggcctccgcgagtaccgggtcgacttcggagtctgcgagcccagccaggggtgcccgcttcccacccctctccccgagcggcgtccccgtcggggtcgaacctcccccgcgacaggcgcccagccgcctgttcccccaggccttgcctgcggaccgccctgggaacggcgtctgggagccccgaggggctggcgggactcggggcccgggccatgcggcagccgcccccgcccctccgcgaccatccccggcccaagcggga

SEQ ID NO: 87974 - DNA, 2148 bp, Homo sapiens
  misc_feature (33)..(33): n is a, c, g, or t
ctgacacggatccagtcatacctggggctggangggatttggaggccctggtcatttgcagagtgaatggtgaagggcgcggaaaaggtttgcttggaggaaagaccggttgcagaggcgaggcggagggaggaggggcggaggcagcaggtctttgtttgtggtaggtctctggcttccatcagggaggaggaaagaggctgtgcccttcctggctcttggctgcaccactgaggacgctccgagggacagcgtgctcacccatcctttgcacagtgctggccccaagccccacggccttccagctaggattttctgctgggctcatgcagaggcaggggacaggtgcatggaagagccgccccacccgacacaccattgtttgaaaatcactgttctctttactcacttaaaaaagtgtacagggaacacctgttcctggcataatgctccaacctcgcggaaggggccaggtgcccttcatctggctctggctgcttccgacctgggcccacgtcatcgttcacgtcctctgtgaccaccactggtcacggtgctccctggcccagcctccaacccacccagcaccctggcatctcccaggccagtctgctgcacccagcgagcttccagtcagaagccaggctgaacggccctcctgccccatcagcttcgtgtcttctttttttttaaagaactgaaatagtccccaagaggcctcatggcctgaagactcacaatcatccacctgtaatttatgataaatgtctgggagcatttaccatttgcgtccgtgagtatttatagccctgaatgggcgggggggagggggggtggaggaggccctgcagccaggagctacacacctgtccccactagtgtcccctggttgacagagccccctcagcctccccaaggctgtcactgcggctgtgacagctgaggagtgccgcctttgaaagccagtggacagtcgctccactagggggagaggccctggccctggcgcagaggaggcgttgcgaggcgggacgggggctggaggggctgagcagccttcagggcagggactgggccctgggtcactggagacgttgatattagtccgtctgctgccaaattgctccccaccacatgagccccaggggtttatgtcccaggaaggcgagggtgcccatctgagcggaattgggaggggacggcaccagctcatctccctcagggcctttgcctcctggtgctgccctggtggctgctcctgcaccacagcccctgatggctgctgctagtcctgagttgctgggtttacccccagcccacacttcccacctgggcctgagggtgcggccagtgccctagtcctagccactacaggagtcattctgagacctgctggaggccatggggtcttcccaggcccctcaatcagctgcttccagggtcagcagggcagggtgctgccagtaaggtcctcagggagcacagcccggccgcccaggctgggggatactggggcagagcttccaggtctgtggggcctgatctctccccaaggctctccaggccttggtgcgccctccacagtgaccttcagagaggctgcaccccctcagaagaacagtgagaaatctctccatcacacgctccctggtccttatgtccctgaggccacccttccccaccccccagtgcctggagaagcgtgagactctggaggggcgccaggaggccaggggtcctcagggctaggcctggagctcggcccaagagctgcttttgcgaagcctgtcttgaatccggattcaccagagaacaagagcctcccagcctttggcgtttctgggcctgtaaagatgtgtgtacctcccaggccactctgatgcaagggcagggaccatgccaggcctgggttgggaatggctctgtgactccagaagctccgtctaaaactccaaagatgcccaaaaggctgtgctgctatgtggaatgtgtattatttgtgagcacgatgcggcttcttcctcattttgcagagcaacctaagcgggcagatgtacaaaccgtgtgttcgaaacccctgagtccatgtgtgtgaaaatgcaggttttctcttagaaataaagtggtgacttgtgctgtaaacgagtc

SEQ ID NO: 87975 - DNA, 1906 bp, Homo sapiens
  misc_feature (33)..(33): n is a, c, g, or t
ctgacacggatccagtcatacctggggctggangggatttggaggccctggtcatttgcagagtgaatggtgaagggcgcggaaaaggtttgcttggaggaaagaccggttgcagaggcgaggcggagggaggaggggcggaggcagcaggtctttgtttgtggtaggtctctggcttccatcagggaggaggaaagaggctgtgcccttcctggctcttggctgcaccactgaggacgctccgagggacagcgtgctcacccatcctttgcacagtgctggccccaagccccacggccttccagctaggattttctgctgggctcatgcagaggcaggggacaggtgcatggaagagccgccccacccgacacaccattgtttgaaaatcactgttctctttactcacttaaaaaagtgtacagggaacacctgttcctggcataatgctccaacctcgcggaaggggccaggtgcccttcatctggctctggctgcttccgacctgggcccacgtcatcgttcacgtcctctgtgaccaccactggtcacggtgctccctggcccagcctccaacccacccagcaccctggcatctcccaggccagtctgctgcacccagcgagcttccagtcagaagccaggctgaacggccctcctgccccatcagcttcgtgtcttctttttttttaaagaactgaaatagtccccaagaggcctcatggcctgaagactcacaatcatccacctgtaatttatgataaatgtctgggagcatttaccatttgcgtccgtgagtatttatagccctgaatgggcgggggggagggggggtggaggaggccctgcagccaggagctacacacctgtccccactagtgtcccctggttgacagagccccctcagcctccccaaggctgtcactgcggctgtgacagctgaggagtgccgcctttgaaagccagtggacagtcgctccactagggggagaggccctggccctggcgcagaggaggcgttgcgaggcgggacgggggctggaggggctgagcagccttcagggcagggactgggccctgggtcactggagacgttgatattagtccgtctgctgccaaattgctccccaccacatgagccccaggggtttatgtcccaggaaggcgagggtgcccatctgagcggaattgggaggggacggcaccagctcatctccctcagggcctttgcctcctggtgctgccctggtggctgctcctgcaccacagcccctgatggctgctgctagtcctgagttgctgggtttacccccagcccacacttcccacctgggcctgagggtgcggccagtgccctagtcctagccactacaggagtcattctgagacctgctggaggccatggggtcttcccaggcccctcaatcagctgcttccagggtcagcagggcagggtgctgccagtaaggtcctcagggagcacagcccggccgcccaggctgggggatactggagctcggcccaagagctgcttttgcgaagcctgtcttgaatccggattcaccagagaacaagagcctcccagcctttggcgtttctgggcctgtaaagatgtgtgtacctcccaggccactctgatgcaagggcagggaccatgccaggcctgggttgggaatggctctgtgactccagaagctccgtctaaaactccaaagatgcccaaaaggctgtgctgctatgtggaatgtgtattatttgtgagcacgatgcggcttcttcctcattttgcagagcaacctaagcgggcagatgtacaaaccgtgtgttcgaaacccctgagtccatgtgtgtgaaaatgcaggttttctcttagaaataaagtggtgacttgtgctgtaaacgagtc

SEQ ID NO: 87976 - DNA, 307 bp, Homo sapiens
ggttgtagtgagcagagatcacaccactgcactccagcctgggcgacaacagcgaaactctgcctcaaaataaataaataaccacagactgtgctgggagaatgtataatgaggaactggccccacctggagggtaaggaagcaacactgatcagagatcagaaatggtagggctaataaccagctaaatgagacaacaggactaggaagagcgcaagctctccgtacttggtgtttctttgctctgaaggttttcagatccttccccttcacaagtttcttcctctctttcttcttctttctttct

SEQ ID NO: 87977 - DNA, 659 bp, Homo sapiens
tcccaaaaagaaaaaatagcaaaaggaagaaattaactgctgataaaacaacatgaatcagttcaacaataaaaaaaaccttactgagttaaaccagatacaaaagcatacaaactgcgagattctatgtatttgaaagtctagaacaagcaaaaccaacctatagtgaaaaagagcagtggttgcctttgtaggggaggaggaaagtggaaactgactagaaagggtcgtgaggggactttctgaactgatgatgatatgccgcatcgtaataggattacacagttacatgcatttgtcaatgctcaggaaatagcccacttaagttgtgatttcattatatttaggttttacgtcacacacacaaaaagaattataggctggccatggtggctcacacctgtaaccccagaactttgggaggccaaggtgggtggatcactttagcccaggagttcgagaccagctgggcaacatgatgaaacgccatctctacaaaaaaaaaaaaatacaaaaattagctgggcatggttgtgcatgcctgtgatcccagatactcaggaggctgagatgggaggatcacttgatccccggaggttgagggtgcagtgagccttgattgcacaattgtattccaacctgagggaaagcctgcctca

SEQ ID NO: 87978 - DNA, 410 bp, Homo sapiens
tgcgggagggctgcctggaattgaggccttattactggctctagccaaataggagaaaacagggagtttctcgaattagttcatgtcccatttgggttacccaggaaggatagtctgtgctattgtccacagagtcaaggcaggccagagaactggcagacaagcccagctccagaagccagagttactgctgtagctggacctggaaaccactcctcagctggaccagtcactgtgtgtggggcctttaatgggaggggaagggaaactatgaaacacatcctaataccatgtaagggtgatgactgtgattagagacattattagatggcggatacacagaatccttaactttttccagaccgtgacttaaaaaaaaattgtcattgtttctttttggcaattacttg

SEQ ID NO: 87979 - DNA, 305 bp, Homo sapiens
caggttcctgttgttgtgacaaaggcttcttagtaggaggaatgccttggccctagaagctggttaaggtctacagattgagtgagtcctatttggaacagggatgggccttacagtattctttgccatcttaaggtcagggaacttaagaatagcaaacctggactactctgtcaaaaggtcatgctcagtcgggcctgacggggtgctcctgtagtcccagctactccgtaggctgtggtgggtggatcagtcgagcccaggagttcaagtccaggttgtgcaacatagcaagaccttgtctc

SEQ ID NO: 87980 - DNA, 141 bp, Homo sapiens
tcagtaggtgctgggagatgtgattcttggtggcagaggcctccaaacagagtggtaaaaaccaactgcctaggtgcgaaccttgcctctcccacttcctggctgtgagacttacgtactttttctggttgttttttctcg

SEQ ID NO: 87981 - DNA, 332 bp, Homo sapiens
ggtcaccgcagcaggccgggcccatgcgttatgagccgggtgcggacgtgatggtgctcggggaagtcgggggctttgacgcctgaaggcgcgggagccgggcgcctgggggaagggggtccggcgccgtcacctcccactcctcgcccgcgggtcggggagcccctgccgcgggggaaggaggctgtttcctttgtaaactggcggaggcgcgcctggcccctgggcccggcaacccgaagagacacgcccgagacctccggagggagttaaccccccgggccccggtgccggccacccccaggcgcgcagggtggccctgagccgggcgc

SEQ ID NO: 87982 - DNA, 898 bp, Homo sapiens
tgcagtcaggacagacgtcccaggcgagcagaggccctgcgtgaggatggggcggcggggccagatggtgtcctgagtatccatcctccctggtggctgaggacacgctgaccagcgtggggtcaggagcatggcccctggaaagcaaagatttctgaagacgtctttctagaaatgactggaaagtttcaagaggcataagatacagcatttcttctgaggccctgaagaagtatcaagtgggctttgacattgcggtggtgagagcgacccctcctcacctggagaactgggaaatgtggattctcagggaccgcgctgttcacgagctccaggctgtgctgctggccctggtcctggggcgctgagccgcatctgcaatagcacacttgcccggccacctgctgccgtgagcctttgctgctgaagcccctggggtcgcctctacctgatgaggatgtgcacccccattagggggctgctcatggcccttgcagtgatgtttgggacagcgatggcatttgcacccataccccggatcacctgggagcacagagaggtgcacctggtgcagtttcatgagccagacatctacaactactcagccttgctgctgagcgaggacaaggacaccttgtacataggtgcccgggaggcggtcttcgctgtgaacgcactcaacatctccgagaagcagcatgaggtgtatcggaagggtctcagaaagacaaggaaaacgcaaatggtgcagaaaacaggggagaccaaacacgaacagagtggctcaactacatccaggggggcggcaggcaatcaagaggccgatacggatacgtgagtggggaccaaggcatccaagcgggcctggtgacacccgaacataacatcttaaatacgg

SEQ ID NO: 87983 - DNA, 4753 bp, Homo sapiens
agcattggcaacccgctcgggtccccttccacactgtggaagctttgttctttcgctcttgctactgctagctctttgggtccacgctgcttttatgagctgtaacactcaccgcgaagatctgcagcttcactcctgagcccagcgagaccacgagcccaccgggaggaacgaacaactccagacgcgctgccttaagagctgtaacactcaccgtgaaggtctgcagcttcactcccgagccagcgagaccacgaacccaccagaaggaagaaactctgaacacatctgaacatcagaagggacagactccagacgcgccaccactctgctaacaccagatagtggaaagaaaccatgtgctgaaatgtttgacgacactgatggtttgcaaagatttctgaagacgtctttctagaaatgactggaaagtttcaagaggcataagatacagcatttcttctgaggccctgaagaagtatcaagtgggctttgacattgcggtggtgagagcgacccctcctcacctggagaactgggaaatgtggattctcagggaccgcgctgttcacgagctccaggctgtgctgctggccctggtcctggggcgctgagccgcatctgcaatagcacacttgcccggccacctgctgccgtgagcctttgctgctgaagcccctggggtcgcctctacctgatgaggatgtgcacccccattagggggctgctcatggcccttgcagtgatgtttgggacagcgatggcatttgcacccataccccggatcacctgggagcacagagaggtgcacctggtgcagtttcatgagccagacatctacaactactcagccttgctgctgagcgaggacaaggacaccttgtacataggtgcccgggaggcggtcttcgctgtgaacgcactcaacatctccgagaagcagcatgaggtgtattggaaggtctcagaagacaaaaaagcaaaatgtgcagaaaaggggaaatcaaaacagacagagtgcctcaactacatccgggtgctgcagccactcagcgccacttccctttacgtgtgtgggaccaacgcattccagccggcctgtgaccacctgaacttaacatcctttaagtttctggggaaaaatgaagatggcaaaggaagatgtccctttgacccagcacacagctacacatccgtcatggttgatggagaactttattcggggacgtcgtataattttttgggaagtgaacccatcatctcccgaaattcttcccacagtcctctgaggacagaatatgcaatcccttggctgaacgagcctagtttcgtgtttgctgacgtgatccgaaaaagcccagacagccccgacggcgaggatgacagggtctacttcttcttcacggaggtgtctgtggagtatgagtttgtgttcagggtgctgatcccacggatagcaagagtgtgcaagggggaccagggcggcctgaggaccttgcagaagaaatggacctccttcctgaaagcccgactcatctgctcccggccagacagcggcttggtcttcaatgtgctgcgggatgtcttcgtgctcaggtccccgggcctgaaggtgcctgtgttctatgcactcttcaccccacagctgaacaacgtggggctgtcggcagtgtgcgcctacaacctgtccacagccgaggaggtcttctcccacgggaagtacatgcagagcaccacagtggagcagtcccacaccaagtgggtgcgctataatggcccggtacccaagccgcggcctggagcgtgcatcgacagcgaggcacgggccgccaactacaccagctccttgaatttgccagacaagacgctgcagttcgttaaagaccaccctttgatggatgactcggtaaccccaatagacaacaggcccaggttaatcaagaaagatgtgaactacacccagatcgtggtggaccggacccaggccctggatgggactgtctatgatgtcatgtttgtcagcacagaccggggagctctgcacaaagccatcagcctcgagcacgctgttcacatcatcgaggagacccagctcttccaggactttgagccagtccagaccctgctgctgtcttcaaagaagggcaacaggtttgtctatgctggctctaactcgggcgtggtccaggccccgctggccttctgtgggaagcacggcacctgcgaggactgtgtgctggcgcgggacccctactgcgcctggagcccgcccacagcgacctgcgtggctctgcaccagaccgagagccccagcaggggtttgattcaggagatgagcggcgatgcttctgtgtgcccggataaaagtaaaggaagttaccggcagcattttttcaagcacggtggcacagcggaactgaaatgctcccaaaaatccaacctggcccgggtcttttggaagttccagaatggcgtgttgaaggccgagagccccaagtacggtcttatgggcagaaaaaacttgctcatcttcaacttgtcagaaggagacagtggggtgtaccagtgcctgtcagaggagagggttaagaacaaaacggtcttccaagtggtcgccaagcacgtcctggaagtgaaggtggttccaaagcccgtagtggcccccaccttgtcagttgttcagacagaaggtagtaggattgccaccaaagtgttggtggcatccacccaagggtcttctcccccaaccccagccgtgcaggccacctcctccggggccatcacccttcctcccaagcctgcgcccaccggcacatcctgcgaaccaaagatcgtcatcaacacggtcccccagctccactcggagaaaaccatgtatcttaagtccagcgacaaccgcctcctcatgtccctcttcctcttcttctttgttctcttcctctgcctctttttctacaactgctataagggatacctgcccagacagtgcttgaaattccgctcggccctactaattgggaagaagaagcccaagtcagatttctgtgaccgtgagcagagcctgaaggagacgttagtagagccagggagcttctcccagcagaatggggagcaccccaagccagccctggacaccggctatgagaccgagcaagacaccatcaccagcaaagtccccacggatagggaggactcacagaggatcgacgacctttctgccagggacaagccctttgacgtcaagtgtgagctgaagttcgctgactcagacgcagatggagactgaggccggctgtgcatccccgctggtgcctcggctgcgacgtgtccaggcgtggagagttttgtgtttctcctgttcagtatccgagtctcgtgcagtgctgcgtaggttagcccgcatcgtgcagacaacctcagtcctcttgtctattttctcttgggttgagcctgtgacttggtttctctttgtccttttggaaaaatgacaagcattgcatcccagtcttgtgttccgaagtcagtcggagtacttgaagaaggcccacgggcggcacggagttcctgagccctttctgtagtgggggaaaggtggctggacctctgttggctgagaagagcatcccttcagcttcccctccccgtagcagccactaaaagattatttaattccagattggaaatgacattttagtttatcagattggtaacttatcgcctgttgtccagattggcacgaaccttttcttccacttaattatttttttaggattttgctttgattgtgtttatgtcatgggtcatttttttttagttacagaagcagttgtgttaatatttagaagaagatgtatatcttccagattttgttatatatttggcataaaatacggcttacgttgcttaagattctcagggataaacttccttttgctaaatgcattctttctgcttttagaaatgtagacataaacactccccggagcccactcaccttttttctttttctttttttttttttaactttattccttgagggaagcattgtttttggagagattttctttctgtacttcgttttacttttctttttttttaacttttactctctcgaagaagaggaccttcccacatccacgaggtgggttttgagcaagggaaggtagcctggatgagctgagtggagccaggctggcccagagctgagatgggagtgcggtacaatctggagcccacagctgtcggtcagaacctcctgtgagacagatggaaccttcacaagggcgcctttggttctctgaacatctcctttctcttcttgcttcaattgcttacccactgcctgcccagactttctatccagcctcactgagctgcccactactggaagggaactgggcctcggtggccggggccgcgagctgtgaccacagcaccctcaagcatacggcgctgttcctgccactgtcctgaagatgtgaatgggtggtacgatttcaacactggttaatttcacactccatctccccgctttgtaaatacccatcgggaagagactttttttccatggtgaagagcaataaactctggatgtttgtgcgcgtgtgtggacagtcttatcttccagcatgataggatttgaccattttggtgtaaacatttgtgttttataagatttaccttgtttttatttttctactttgaattgtatacatttggaaagtacccaaataaatgagaagcttctatcctt

SEQ ID NO: 87984 - DNA, 249 bp, Homo sapiens
taaatagccttgtttcccattattttcacagcaaagatttctgaagacgtctttctagaaatgactggaaagtttcaagaggcataagatacaggtaaaaccactttattcatgatctgtaatttcagttgagcagagttgataatgtgtagaggcctcagttggatctggcaggtggttggttgcttggtcccttggtccctgatatcctgtggggcaaagcttcagacttggctgccatcccttggg

SEQ ID NO: 87985 - DNA, 4690 bp, Homo sapiens
agcattggcaacccgctcgggtccccttccacactgtggaagctttgttctttcgctcttgctactgctagctctttgggtccacgctgcttttatgagctgtaacactcaccgcgaagatctgcagcttcactcctgagcccagcgagaccacgagcccaccgggaggaacgaacaactccagacgcgctgccttaagagctgtaacactcaccgtgaaggtctgcagcttcactcccgagccagcgagaccacgaacccaccagaaggaagaaactctgaacacatctgaacatcagaagggacagactccagacgcgccaccactctgctaacaccagatagtggaaagaaaccatgtgctgaaatgtttgacgacactgatggtttgcatttcttctgaggccctgaagaagtatcaagtgggctttgacattgcggtggtgagagcgacccctcctcacctggagaactgggaaatgtggattctcagggaccgcgctgttcacgagctccaggctgtgctgctggccctggtcctggggcgctgagccgcatctgcaatagcacacttgcccggccacctgctgccgtgagcctttgctgctgaagcccctggggtcgcctctacctgatgaggatgtgcacccccattagggggctgctcatggcccttgcagtgatgtttgggacagcgatggcatttgcacccataccccggatcacctgggagcacagagaggtgcacctggtgcagtttcatgagccagacatctacaactactcagccttgctgctgagcgaggacaaggacaccttgtacataggtgcccgggaggcggtcttcgctgtgaacgcactcaacatctccgagaagcagcatgaggtgtattggaaggtctcagaagacaaaaaagcaaaatgtgcagaaaaggggaaatcaaaacagacagagtgcctcaactacatccgggtgctgcagccactcagcgccacttccctttacgtgtgtgggaccaacgcattccagccggcctgtgaccacctgaacttaacatcctttaagtttctggggaaaaatgaagatggcaaaggaagatgtccctttgacccagcacacagctacacatccgtcatggttgatggagaactttattcggggacgtcgtataattttttgggaagtgaacccatcatctcccgaaattcttcccacagtcctctgaggacagaatatgcaatcccttggctgaacgagcctagtttcgtgtttgctgacgtgatccgaaaaagcccagacagccccgacggcgaggatgacagggtctacttcttcttcacggaggtgtctgtggagtatgagtttgtgttcagggtgctgatcccacggatagcaagagtgtgcaagggggaccagggcggcctgaggaccttgcagaagaaatggacctccttcctgaaagcccgactcatctgctcccggccagacagcggcttggtcttcaatgtgctgcgggatgtcttcgtgctcaggtccccgggcctgaaggtgcctgtgttctatgcactcttcaccccacagctgaacaacgtggggctgtcggcagtgtgcgcctacaacctgtccacagccgaggaggtcttctcccacgggaagtacatgcagagcaccacagtggagcagtcccacaccaagtgggtgcgctataatggcccggtacccaagccgcggcctggagcgtgcatcgacagcgaggcacgggccgccaactacaccagctccttgaatttgccagacaagacgctgcagttcgttaaagaccaccctttgatggatgactcggtaaccccaatagacaacaggcccaggttaatcaagaaagatgtgaactacacccagatcgtggtggaccggacccaggccctggatgggactgtctatgatgtcatgtttgtcagcacagaccggggagctctgcacaaagccatcagcctcgagcacgctgttcacatcatcgaggagacccagctcttccaggactttgagccagtccagaccctgctgctgtcttcaaagaagggcaacaggtttgtctatgctggctctaactcgggcgtggtccaggccccgctggccttctgtgggaagcacggcacctgcgaggactgtgtgctggcgcgggacccctactgcgcctggagcccgcccacagcgacctgcgtggctctgcaccagaccgagagccccagcaggggtttgattcaggagatgagcggcgatgcttctgtgtgcccggataaaagtaaaggaagttaccggcagcattttttcaagcacggtggcacagcggaactgaaatgctcccaaaaatccaacctggcccgggtcttttggaagttccagaatggcgtgttgaaggccgagagccccaagtacggtcttatgggcagaaaaaacttgctcatcttcaacttgtcagaaggagacagtggggtgtaccagtgcctgtcagaggagagggttaagaacaaaacggtcttccaagtggtcgccaagcacgtcctggaagtgaaggtggttccaaagcccgtagtggcccccaccttgtcagttgttcagacagaaggtagtaggattgccaccaaagtgttggtggcatccacccaagggtcttctcccccaaccccagccgtgcaggccacctcctccggggccatcacccttcctcccaagcctgcgcccaccggcacatcctgcgaaccaaagatcgtcatcaacacggtcccccagctccactcggagaaaaccatgtatcttaagtccagcgacaaccgcctcctcatgtccctcttcctcttcttctttgttctcttcctctgcctctttttctacaactgctataagggatacctgcccagacagtgcttgaaattccgctcggccctactaattgggaagaagaagcccaagtcagatttctgtgaccgtgagcagagcctgaaggagacgttagtagagccagggagcttctcccagcagaatggggagcaccccaagccagccctggacaccggctatgagaccgagcaagacaccatcaccagcaaagtccccacggatagggaggactcacagaggatcgacgacctttctgccagggacaagccctttgacgtcaagtgtgagctgaagttcgctgactcagacgcagatggagactgaggccggctgtgcatccccgctggtgcctcggctgcgacgtgtccaggcgtggagagttttgtgtttctcctgttcagtatccgagtctcgtgcagtgctgcgtaggttagcccgcatcgtgcagacaacctcagtcctcttgtctattttctcttgggttgagcctgtgacttggtttctctttgtccttttggaaaaatgacaagcattgcatcccagtcttgtgttccgaagtcagtcggagtacttgaagaaggcccacgggcggcacggagttcctgagccctttctgtagtgggggaaaggtggctggacctctgttggctgagaagagcatcccttcagcttcccctccccgtagcagccactaaaagattatttaattccagattggaaatgacattttagtttatcagattggtaacttatcgcctgttgtccagattggcacgaaccttttcttccacttaattatttttttaggattttgctttgattgtgtttatgtcatgggtcatttttttttagttacagaagcagttgtgttaatatttagaagaagatgtatatcttccagattttgttatatatttggcataaaatacggcttacgttgcttaagattctcagggataaacttccttttgctaaatgcattctttctgcttttagaaatgtagacataaacactccccggagcccactcaccttttttctttttctttttttttttttaactttattccttgagggaagcattgtttttggagagattttctttctgtacttcgttttacttttctttttttttaacttttactctctcgaagaagaggaccttcccacatccacgaggtgggttttgagcaagggaaggtagcctggatgagctgagtggagccaggctggcccagagctgagatgggagtgcggtacaatctggagcccacagctgtcggtcagaacctcctgtgagacagatggaaccttcacaagggcgcctttggttctctgaacatctcctttctcttcttgcttcaattgcttacccactgcctgcccagactttctatccagcctcactgagctgcccactactggaagggaactgggcctcggtggccggggccgcgagctgtgaccacagcaccctcaagcatacggcgctgttcctgccactgtcctgaagatgtgaatgggtggtacgatttcaacactggttaatttcacactccatctccccgctttgtaaatacccatcgggaagagactttttttccatggtgaagagcaataaactctggatgtttgtgcgcgtgtgtggacagtcttatcttccagcatgataggatttgaccattttggtgtaaacatttgtgttttataagatttaccttgtttttatttttctactttgaattgtatacatttggaaagtacccaaataaatgagaagcttctatcctt

SEQ ID NO: 87986 - DNA, 278 bp, Homo sapiens
ctcactgctcttgggcaatttaaagttactgtcagggactatggctggtaacaacagtgtggttttcagttatctgttgagttctggaaaccttgtttttgcttggaagaaagaattgatacttggatgttaaagttctgtaggggtacagcctggcgtggtagctcatgcatataatcccagcactttgggaggctgaggtgggtggatctcttgaggccaggagttcgagaccagcctggtcaacatggcgaaactcttgtctctactaacaatac

SEQ ID NO: 87987 - DNA, 1432 bp, Homo sapiens
gcaacatattcctaaaatgtttttatcttgcaaagctaaatatcaatacccattaaaaaactatgaattttacccatttcctggcacttttcaaacaccactctgttttctctaagagtgtaactgcttcatatatctcatacaatctctgtctttttgtgactggctcattttattttgcacaatatcatcaagctttatagttgttagaatattttctgctttttaaatactgggtgatatttaagtattttgtattttagattatatctactgagtaatttggtgacaaatttgcactgcttttacctattggctttcagtaacaatgctgcaataattacaggtatgcaaatgacctatatgatcatatatgtgtaagtttatatatgtgccgcattctgttctactagtgtacgtttttacctttgtactcataccaaattgttacaattctgtagctctgtaatgtgtttcaaaatcagaaactgtaatgccttcaaaattgtttattttattgcagatttttgggtactttattatctcttaagactttatatactttgggggttgctgtttctatttcttcaaaaatgcatgagaaatttgaacaacattgcattaaatctgtaaattacattgagcaggatggacatcttcacaagattaattattttaacatttcaacaagcatgctcaagagtgtattgttttaatttctatgtatttgtgaatttttcagttttttcttcttactgttctatactcatttcattttggtcatagaaagtaatccataaaaatttagttttaaataatttgttaagacttcttttttggtttaccaggttttctatcaaggagaatttcgtatgaggtattgagaaggctgtttatcattatgttgttgagtgttctttatgcctctgttattaataattgttttatactcccttcaagtccggtttctttaccaatattttgtctttttaaaatctttattacagaaagtgaagcattaaaatattctactataaaaaaaaaaaaaaacaaaaaaacaaacacaaccaaacaaacaacacaaaacaaaaaaaaaaaaaaaaaaaaaaacaaaaaaaacaccaaaaaaaaaacaaaaacccccccacccaacttcaaaacaaaacacacacgaaatacaacaaccatataacagcgagggcatacatcaatataaatccaacactgcgcgcacaacacacactgtcacatcatcatttaatcacgataacaccacatcgatcattagcgatttataaacagatacgcagagcaacatcatcaacttctagcaggcacgaacacaatctactagaatgcagaacaccaacactcccgctgtaagttgatgaggcacaacagatacataacagattgagaaatcaccaggctg

SEQ ID NO: 87988 - DNA, 163 bp, Homo sapiens
caatcaataaagtgaaaagtgaaaagaattataagtggatggacaaatatgtgaaacacaagcagttaaatgcccacagcaaaacctaggctgtgcatacaggtaggtgttcattaaattttttattttattattattatattttgaagtgcagtttaactct

SEQ ID NO: 87989 - DNA, 392 bp, Homo sapiens
ggagaactaggttcttatcctggctctgctatggacttgcttcatatgggacaaatggcttcgtttccttgcttctctcaaaggtagggtgtaggaattgggcaagaaaagtactgtttggggggttctgtggttccaaggacagcctaagattctgatcttgcattgatggtctgtatttttctcaaccttagtttttcacatttgtaaactacgattaataatcataatggttgctgtaagaactacataaaaccatacatgtggggccgggcacggtggctcacacctgtaatcccagcactttgggaggccgaggtgggcggatcatgaggtcaggagatcaagaccatcctggctaacatggtgaaaccctgtctctactaaaaata

SEQ ID NO: 87990 - DNA, 728 bp, Homo sapiens
aaattaacacctttcacttttaccccttgcctagaaatttgtatttattaaagcatgatatttatttagccactatgaatagtttatagacagacctggaaatttatagatttgtctttgttggaatacttgcttaaacagacttgtttcctaaaccactggcctggttttctactattaaaagattatttaaattggttacctagagaagatctccatgctgttatgagccatattttgagataggagaaggaagcccagccatactcccttatctgtgtcctggcagatgcaaacctgccctgccctgcacatttggttagagatgatagtgccaaaccaccacttctgacgcgatcatgaggctggtctccttgtctcctttgtgcacagggactgctcatcttacagtaagcttctatttggaagcaagagatttgaattctttgaaaacattgataaagcaagtcaggaggggagtgcagggactggctatttgatatacctacacagaaagctaggtacagatcttcagatctgcaagacatgggaaataaacccttacccaaaccaaacatgtcttcctctgtagaatatgaaacgaggtggccagtgaccaagctgaccacacattttgaatgaaagtgatgatgtatgctgccattcacactccagtagatttctgacatggaattaagctcttttttagggagactaatgggccctta

SEQ ID NO: 87991 - DNA, 710 bp, Homo sapiens
accactgcactccagcttgggtgacagaccaacactccatccccaccaccccatctcccccaaaaaatatatattctaggaatgaagcccgaatggccaatggacatgcaaggaatggggaaagatccaaattaaccaatggggcacatttggcaataactactgagtcctgattttataagccggagggaaagagctttattctttaccaaattttaactagggatggctcatgcctgtaatcccagtgctttgagaggctgaggtgggagggattgcttgaagccaggagttagagaccagctggggtaacatatcgagatcttgtcttgacaaaaaattttaaaaaatagcctggagtggtagtgtgtccctgtagtctcagccacacgggtggctgaggccgagagggtcacttgggccccaggaatttgaggttacagtgagctgtgattgtgccactgcactccaaccttgatgacatggtgggaccctgtctctaaaaataaaacaacaaaataaaaaaaactttatctagtgctgggaaagtgcagtgaacaagacaggcagccagccagacagaaagtatgtccacccttttcacatgcagtctctccttcatctttccatgaatccagtgaggaaatgggcttggagaggtaaaaatgaattttcaaaaacatatagcaccaatagcagacaggtgcttc

SEQ ID NO: 87992 - DNA, 308 bp, Homo sapiens
ttgtaaccccccaacctctacattcctatgtccaagccctaacccctaatgtgactgtgtttgataaggcctacaagaaattaattaaggtttaatgaagtcatgaagatgggggcctgatccaataggattattgtccttataaaagactgttggagagctcgtgctctccctctccctgcacacactcagaggaaaagctatgtgagtacaaagtggccgtatagcagccttaaagcctagtaaaggaagagagcctttaccaggaactgaactctgccagtaccttaatcttgggctttctagcc

SEQ ID NO: 87993 - DNA, 435 bp, Homo sapiens
attgcactccagcctaggcaacaagagtgaaactctgtctcaaaaaaaaaccaataaaacaaaaaacctacctgattctgggtaatttataaagaacagagatttcattgattcacagttccgcatggctggggaggccttaggaaacttataatcatggcggaaggagaagaagaggcaaggcacgtcttacacagtggcaggagagagagagcaagaggggaaatgccacacttctgagccatcacatcttgtgagaactcgctatcatgagaacagcatgggggaaatccgcccccatgatcccatcacctcccaccaggttcctcccctgacatgtggggattacagtttgacatgagatttgggtggggacaaaggtgaaccatatcaatgtgacaggttgacatgacgtcacggcagacgtggaaggtc

SEQ ID NO: 87994 - DNA, 360 bp, Homo sapiens
ctcgttactggcatttagtggatacaggtcatggatgcgctaaacatcctatagtgcagaggacagctaaggaaatccagaattgtcacacagctggtgagaggggtggctgtgactgtgacctcataccacccctcaaacctcaccactgtgctcttattgtgggttgaatggtggcctccaaaaaggcagttccatatccaaatccctgcaacttgtgaaggcaagcttattgggaatcaggtctttgcagatgtaattaagttacggatcttgacatgagatcagccaggaagaccctaaatccaaaaacaagtgtcttcatagcagaaaggtagagggagatttgaggcagacagg

SEQ ID NO: 87995 - DNA, 750 bp, Homo sapiens
tacaaaagcagttctactgaaaagtgaattcccagaaagcatttcagcttgtttagactggcttgacaattttaactgaacaacctctataattacatatttcatgtctcaactaacttgtggatcttttcatttactcttatagcactgtttaatatattttgaaggagatatagtctttttttcagattttaattaagaatgatattcagttttaagggatatttttttttaacatacagtctttatgtccaaggaattgaatactggaaggtataataatatacattttaatttaaccctctaagagccaaataacccccaacaagcagaaatgttaaagactagagattttgacattttgaattcaaaaagctgatgtttttccggtctcttatttataactagccccagtagttacatcaaggcaaaccagggaaattcatctcatttgattttaaaactgatatagaagcgggagggataaagagagattgattaatgggtacagatacagacatagatagaagtgagacctggtgttcaatagatcagtatggcaactgtagttaacattaattgattgaatatttgaaaaaaatctagaataattcagatatttctagaataaagaaaacataatattttaggtgatggatttctcaattactgtgatttgattatatgaatgtatctaattatcacatctaccttgaaaatatatatatctaatatgtttcaattaaaaca

SEQ ID NO: 87996 - DNA, 301 bp, Homo sapiens
tgagacatagtttcactctgttgcccaggctggagtagagtgacatgatctcggctcactgtaacccccgcctcccaggttcaagtgattctcctgcctcagcctcccaactagctgggattacaggtatgtgccaccacactcagctaaggatgtaagatatttaaacaacatgatgaacacactaggcctatttgatatatgtagaatataagagccaacaaatgcaaagtccacatttaatgcacatggaatatttacaaaaactgaccacatgctgagtcattcactgaccatatgg

SEQ ID NO: 87997 - DNA, 3539 bp, Homo sapiens
gccatttgaagcagaatccaaaccatgaattgtagagaattacccttgaccctttgggtgcttatatctgtaagcactgcagaatcttgtacttcacgtccccacattactgtggttgaaggggaacctttctatctgaaacattgctcgtgttcacttgcacatgagattgaaacaaccaccaaaagctggtacaaaagcagtggatcacaggaacatgtggagctgaacccaaggagttcctcgagaattgctttgcatgattgtgttttggagttttggccagttgagttgaatgacacaggatcttactttttccaaatgaaaaattatactcagaaatggaaattaaatgtcatcagaagaaataaacacagctgtttcactgaaagacaagtaactagtaaaattgtggaagttaaaaaattttttcagataacctgtgaaaacagttactatcaaacactggtcaacagcacatcattgtataagaactgtaaaaagctactactggagaacaataaaaacccaacgataaagaagaacgccgagtttgaagatcaggggtattactcctgcgtgcatttccttcatcataatggaaaactatttaatatcaccaaaaccttcaatataacaatagtggaagatcgcagtaatatagttccggttcttcttggaccaaagcttaaccatgttgcagtggaattaggaaaaaacgtaaggctcaactgctctgctttgctgaatgaagaggatgtaatttattggatgttcggggaagaaaatggatcggatcctaatatacatgaagagaaagaaatgagaattatgactccagaaggcaaatggcatgcttcaaaagtattgagaattgaaaatattggtgaaagcaatctaaatgttttatataattgcactgtggccagcacgggaggcacagacaccaaaagcttcatcttggtgagaaaagcagacatggctgatatcccaggccacgtcttcacaagaggaatgatcatagctgttttgatcttggtggcagtagtgtgcctagtgactgtgtgtgtcatttatagagttgacttggttctattttatagacatttaacgagaagagatgaaacattaacagatggaaaaacatatgatgcttttgtgtcttacctaaaagaatgccgacctgaaaatggagaggagcacacctttgctgtggagattttgcccagggtgttggagaaacattttgggtataagttatgcatatttgaaagggatgtagtgcctggaggagctgttgttgatgaaatccactcactgatagagaaaagccgaagactaatcattgtcctaagtaaaagttatatgtctaatgaggtcaggtatgaacttgaaagtggactccatgaagcattggtggaaagaaaaattaaaataatcttaattgaatttacacctgttactgacttcacattcttgccccaatcactaaagcttttgaaatctcacagagttctgaagtggaaggccgataaatctctttcttataactcaaggttctggaagaaccttctttacttaatgcctgcaaaaacagtcaagccaggtagagacgaaccggaagtcttgcctgttctttccgagtcttaatcttcagaaacagtgaacgccaaaaagaactcaagatattctggggactgagcatatgaacctgttcataacaaaggctgtgactcgaaataattaactttgtcaaaatcctgctcacaatttgaagatgaaacttgtcattaggttggcgggaatgagactaaagattgcgctgtgggctgtggtcacgtgctcccagaagacctggaattcaaaagaaatggagctattctttttctccctctttcataactggatgcagctgctcatactcaatcccatattcagcaagtgtgaagctggacgtgatgcaaaataaccgatgccctacaaaaagggcgcatctttaagagttttaatgccagtgcttaattcgaatgaggggattttaagtgtctgaagaggcattttctagggaccagtgggtgactgagtaactgaaatgctgctttcactccctaacaccatggatctggttgtgcataggatgtgggaggaggggctggcagggccgccttcagaggctgcagggcctcagcctcaggatgcatttaatgtatcctggccacagttgcagccaacggttcttgaaagctcggtaaggccctgcaacgcagagcctgcttatgtggatctatttatgggaacttcttaaaaggaccccagaatagctctttatctttcacaagagacacaaattctaattgagttaattatctgggcctttcactttggatgctctgaaacatttgttgattttgtgtgaatgtttatatcaaaatgtttgccaggttgtattagccattgaatagcaaaaaactgatagttacttgcttgttttttaaaaattacatattaaaaatgcccttggcataaggcagcatggtgtggcagttaagagatgggctgtgcagcccatcctgagctccagtcctgagtttgctacttacttctgtggcctctggaaccttatccaacctcttggtgcttcagtttcctcatctgtgaaattagaatttataataattgcacctacctcccaggggtaactaaatgaataaatataataaagtacttacagtggttcctgacacagactcagcactccgtcagtgttgccatgactatttttattatcattattaatgattacttagatcaattatttagcagtggactaatggaagctacagagcagggaagggaagcagatctagggaggaaggcagttttgatttgaggaggtttgcacatgtagagaagcatactggagaagcatatccagagggcgaaagatatctctccattgtgcatctgcctcttttgacgttggaagacacatgtcttactccccaaagggagcccagcactgggagccttcttgatgatctcaaaaataatagctattcaagaaaatcaccaagtgactgtgaaaccgtcagttcggaaggctggttagaacatgtgggagcaacatgaatgttctacaaaagtttaaagcagagattgtttcaaatgggtgtagtagatattactgaaaaccaaaaaagagtgagattgtcagtgtaagaatgtgatttaatgtttgtagtgcttacaattttgtgtaccaactggatgactaaaaagagtaaaataatttaattaatagctcatattttatgtgtgaaaacatgttagtgaacatatataatcaaaatagatttcattgctattgcatagtctctaatacatagaatgattttgcttttctcttttattatacttgctttaaaatacttgaaatatattttgcattaaatgcatttcaagttaaatgtcttaaatgtatacattagatgtgtgttttaaaatgcataaaacacgttgaaatacattaatgaaccatt

SEQ ID NO: 87998 - DNA, 1492 bp, Homo sapiens
gccatttgaagcagaatccaaaccatgaattgtagagaattacccttgaccctttgggtgcttatatctgtaagcactgcagaatcttgtacttcacgtccccacattactgtggttgaaggggaacctttctatctgaaacattgctcgtgttcacttgcacatgagattgaaacaaccaccaaaagctggtacaaaagcagtggatcacaggaacatgtggagctgaacccaaggagttcctcgagaattgctttgcatgattgtgttttggagttttggccagttgagttgaatgacacaggatcttactttttccaaatgaaaaattatactcagaaatggaaattaaatgtcatcagaagaaataaacacagctgtttcactgaaagacaagtaactagtaaaattgtggaagttaaaaaattttttcagataacctgtgaaaacagttactatcaaacactggtcaacagcacatcattgtataagaactgtaaaaagctactactggagaacaataaaaacccaacgataaagaagaacgccgagtttgaagatcaggggtattactcctgcgtgcatttccttcatcataatggaaaactatttaatatcaccaaaaccttcaatataacaatagtggaagatcgcagtaatatagttccggttcttcttggaccaaagcttaaccatgttgcagtggaattaggaaaaaacgtaaggctcaactgctctgctttgctgaatgaagaggatgtaatttattggatgttcggggaagaaaatggatcggatcctaatatacatgaagagaaagaaatgagaattatgactccagaaggcaaatggcatgcttcaaaagtattgagaattgaaaatattggtgaaagcaatctaaatgttttatataattgcactgtggccagcacgggaggcacagacaccaaaagcttcatcttggtgagaaaagcagacatggctgatatcccaggccacgtcttcacaagaggaatgatcatagctgttttgatcttggtggcagtagtgtgcctagtgactgtgtgtgtcatttatagagttgacttggttctattttatagacatttaacgagaagagatgaaacattaacaggtaacacatataatgctggaatttcttaccttatgttctcattaagaaatcagataaataggcattaatcttcatcttattgtgatgatattgtagaattaatctgtgggagaggttttctatgggaaatattgttctgcctgtaccatccattatgaatgttgtctatgtcttcttttcttgtgcttacttatgtgttgcccaaaattgttctgattgtctcgtgtatgtatgtcatagcttcctaaatgccctgggagatgctcgggcccaggaactgtatatctgggtgtctttgtgcatgcatcacttaggtatctttatagtacatacactcaataaagttgctttaagtta

SEQ ID NO: 87999 - DNA, 546 bp, Homo sapiens
aaataaagaacccacaggaaattgacaccgagatttctcaggactttcttgctaaccttgcttcttcacctaatgcattaggagaccaaaaaaagttaccttgtcattttggtttttgtttttatttattttactttactaatcttttgaagaatcttgtacttcacgtccccacattactgtggttgaaggggaacctttctatctgaaacattgctcgtgttcacttgcacatgagattgaaacaaccaccaaaagctggtacaaaagcagtggatcacaggaacatgtggagctgaacccaaggagttcctcgagaattgctttgcatgattgtgttttggagttttggccagttgagttgaatgacacaggatcttactttttccaaatgaagtgagtaaccctttcttttcaaaatgtatttcacagccctcttgtcctttgttcagcaactcaaatatgcagtaatctgaaaggtcagataatcaccacatccttttctttcctactcttcctatgacatgaaatacattctttgttatg

SEQ ID NO: 88000 - DNA, 807 bp, Homo sapiens
gctgtgtgctgtattaactactttttgtgtaatatttcatttaatcttccccaaaggagcagccttgtaagtgaagcagttagtatcttcattttacagatgaaggtaccaaggtttaagggcattcacgatttttcctacaatacaaaataattgatggagcccagctgcaaacccagacaaatgtcaatccagtgctctctctcttctctcaaaactatgcacctcaacccacttgctaatatttctgtgagtccctatgtgtttcagcctagtatctcttcaccccagaaatctgatttccacgggtacggatagaatacattactgtgtaatgttttcacttcagttctctaaatatccgtgtacacatttttattctttaaaaatctgagtagaaatatcactactccagactaaaggcaggaatgtggagtcactcagtggaatgtgtcagcacgtgggttggcaactactgcattagtgttagcagtaaaaatggacaagcacgtgatgatggacaacactggtaagatttcttgattattttcttttcctttttccctttcttttctagcagacatggctgatatcccaggccacgtcttcacaagaggaatgatcatagctgttttgatcttggtggcagtagtgtgcctagtgactgtgtgtgtcatttatagagttgacttggttctattttatagacatttaacgagaagagatgaaacattaacaggtaacacatataatgctggaatttcttaccttatgttctcattaagaaatcagataaataggcattaa

SEQ ID NO: 88001 - DNA, 2577 bp, Homo sapiens
gccatttgaagcagaatccaaaccatgaattgtagagaattacccttgaccctttgggtgcttatatctgtaagcactgcagaatcttgtacttcacgtccccacattactgtggttgaaggggaacctttctatctgaaacattgctcgtgttcacttgcacatgagattgaaacaaccaccaaaagctggtacaaaagcagtggatcacaggaacatgtggagctgaacccaaggagttcctcgagaattgctttgcatgattgtgttttggagttttggccagttgagttgaatgacacaggatcttactttttccaaatgaaaaattatactcagaaatggaaattaaatgtcatcagaagaaataaacacagctgtttcactgaaagacaagtaactagtaaaattgtggaagttaaaaaattttttcagataacctgtgaaaacagttactatcaaacactggtcaacagcacatcattgtataagaactgtaaaaagctactactggagaacaataaaaacccaacgataaagaagaacgccgagtttgaagatcaggggtattactcctgcgtgcatttccttcatcataatggaaaactatttaatatcaccaaaaccttcaatataacaatagtggaagatcgcagtaatatagttccggttcttcttggaccaaagcttaaccatgttgcagtggaattaggaaaaaacgtaaggctcaactgctctgctttgctgaatgaagaggatgtaatttattggatgttcggggaagaaaatggatcggatcctaatatacatgaagagaaagaaatgagaattatgactccagaaggcaaatggcatgcttcaaaagtattgagaattgaaaatattggtgaaagcaatctaaatgttttatataattgcactgtggccagcacgggaggcacagacaccaaaagcttcatcttggtgagaaaagcagacatggctgatatcccaggccacgtcttcacaagaggaatgatcatagctgttttgatcttggtggcagtagtgtgcctagtgactgtgtgtgtcatttatagagttgacttggttctattttatagacatttaacgagaagagatgaaacattaacagatggaaaaacatatgatgcttttgtgtcttacctaaaagaatgccgacctgaaaatggagaggagcacacctttgctgtggagattttgcccagggtgttggagaaacattttgggtataagttatgcatatttgaaagggatgtagtgcctggaggagctgttgttgatgaaatccactcactgatagagaaaagccgaagactaatcattgtcctaagtaaaagttatatgtctaatgaggtcaggtatgaacttgaaagtggactccatgaagcattggtggaaagaaaaattaaaataatcttaattgaatttacacctgttactgacttcacattcttgccccaatcactaaagcttttgaaatctcacagagttctgaagtggaaggccgataaatctctttcttataactcaaggttctggaagaaccttctttacttaatgcctgcaaaaacagtcaagccaggtagagacgaaccggaagtcttgcctgttctttccgagtcttaatcttcagaaacagtgaacgccaaaaagaactcaagatattctggggactgagcatatgaacctgttcataacaaaggctgtgactcgaaataattaactttgtcaaaatcctgctcacaatttgaagatgaaacttgtcattaggttggcgggaatgagactaaagattgcgctgtgggctgtggtcacgtgctcccagaagacctggaattcaaaagaaatggagctattctttttctccctctttcataactggatgcagctgctcatactcaatcccatattcagcaagtgtgaagctggacgtgatgcaaaataaccgatgccctacaaaaagggcgcatctttaagagttttaatgccagtgcttaattcgaatgaggggattttaagtgtctgaagaggcattttctagggaccagtgggtgactgagtaactgaaatgctgctttcactccctaacaccatggatctggttgtgcataggatgtgggaggaggggctggcagggccgccttcagaggctgcagggcctcagcctcaggatgcatttaatgtatcctggccacagttgcagccaacggttcttgaaagctcggtaaggccctgcaacgcagagcctgcttatgtggatctatttatgggaacttcttaaaaggaccccagaatagctctttatctttcacaagagacacaaattctaattgagttaattatctgggcctttcactttggatgctctgaaacatttgttgattttgtgtgaatgtttatatcaaaatgtttgccaggttgtattagccattgaatagcaaaaaactgatagttacttgcttgttttttaaaaattacatataccgagctcagcctgagttgtactacttctgggccttggacctatcaccccttgggctcagttctcattga

SEQ ID NO: 88002 - DNA, 359 bp, Homo sapiens
gatttgagccatcagaattcagcttttgtagataaagaatatgaactaattgactatggatggaattattgtacatagttagcttgctgaattattggttaagcactactaactatatcttggtaaactatggtgcaactgagccaccccctaaaagcaaaagacatttagcagttcaccatattttgcaattaaccaaatgagagcctatgagaatgaaatggtttcaggtggagtttgacaatacaattcatccataatatatagggaaaaatatttcctcaaaaataacatctatgtggtaggcccttaaaaacgatggatgaatgcatgcaaaattctctgtacacagacacatg

SEQ ID NO: 88003 - DNA, 779 bp, Homo sapiens
acaaaaagaattaatgtcctgaatgctcatcatttgtatttaactgaaaaagtggtccatctaacagtttctacattaatgagggaaaaagaatatatccatagtaagaccacaccaaattatcagtactgtagtagttttctctaggtgaatgagattagggtcatttttctcccactacatctgaaaactggggatgataatgatacccaccaacttcatagttagttgttaataatcaaatgagatcatgcattttaagtacttaacacagtgcctggcatatacatagcaaacctcaaatacttatttttgccattatcatttcttcattttacttatcagcagttcccaaaatttctacaagagatactactttttaaaacaaagtcatattgttttaatgtatactcattttcaatgaagtcctatatttcaataaataccttttaaaaagtatcttctaagtagaaaatattatactaaaatgaggatgaaaagatgtacaagataaagcctatgctgacaagggctctgtaatctattaaaaatgacagggaaaatgtgcagtgtgaaatgtgcagtaagaaaaacaaaatgctatggggtatagaaaaaggaaaattatatccaggttttccgtgtctcgggtttggggtttggctggggcagtgagagagagcttctgggaggagatggcatgtgaaatgaatgaaatgaaccttgaataaagctgggacccactcagcattctgtgacaggagtggtctgctccagct

SEQ ID NO: 88004 - DNA, 460 bp, Homo sapiens
ggaaagtacattaggaattctttaaggggaaacttgtaaagaaattataaggaagaactgcctggagattggtttcctgtgtatgctaaagcaagatccaaaatatccatttcgcagagacatgaccagaaagtcccagcacacttgggaacagcattttaagaggttttgaattattgtgctcattaatatattttcccttctttgatccttttcttgaggataactagagctgctttgctctacaatatttcaagcatggtgagaatttagcactaggagaaaccacgtagtcagaaaaaaaaaaaacacacatatcttaagaatttttcctataatcaaaatgaacaaaggtggagttgaacccaccaaaagaaaatacctgccccttctaagcctgataggatgtgatcagaaagggagttttggggccaggcatggtggctcacgcctgtaatcc

SEQ ID NO: 88005 - DNA, 758 bp, Homo sapiens
tgaagatgatgatggtgatgataatgataattaatgatgatggtgatgatgaccatcatcacctcaggctattggggcctatgatattggggttacatttggaagaaattcatgattttcaccttgggagtatttatttgactcacatgctattgctgagtgggccaggaagcatgtgcagaactggaaattgagaacttgaagtttggttttggtcaagttccccagaagcagcccctaaaatgaaggtctgtgcataagtgattcattaaaggggcactcccccaaaaaactggtcaggtagagatagaaggtacagagagaaactggagagggaaggggaagagaccaaggaaaggtgaggcttcacctgagtcccagcttcagcctgagcctgtggggagctctggatcataaatcttatcttgaggttcgtcttgctcaagacaaaggagctgggcttctgcatttctgcgtcaatctaccctcggctgtgacctgccctgggggatgagggtttgagaaaccagactcccaggcactcctggccctcagtccaagtgagccattccagtagcacaggcatcatcctctaaagaagactgacactgtgagctgttagaagcaaacacacagaagccgggtggtggcgggtggggaggggacacacattagggagatcagaggcatgcgggtggagcactgatgtgtctgtgcaccacggagttcacatctactcttccagtaatggcatgtga

SEQ ID NO: 88006 - DNA, 263 bp, Homo sapiens
gaaaagacatcaggcagagaggaagctgtggctaaataagtaatacaagataattttcttgagttggggaaatccgtcttcagcccacaacccccactacgtgccaggccagggtataaaatagactctctgtgtttcctgcttttccttatttattccaaggataaagaaaaatcttggaatcatcctgcccaacaaaccaacaacgagggaagatactaggagggaaaatccatctggcatcagacttatcactaaacact

SEQ ID NO: 88007 - DNA, 2664 bp, Homo sapiens
gagagaacagcgtgagcctgtgtgcttgtgtgctgagccctcatcccctcctggggccaggcttgggtttcacctgcagaatcgcttgtgctgggctgcctgggctgtcctcagtggcacctgcatgaagccgttctggctgccagagctggacagccccaggaaaacccacctctctgcagagcttgcccagctgtccccgggaagccaaatgcctctcatgtaagtcttctgctcgacggggtgtctcctaaaccctcactcttcagcctctgtttgaccatgaaatgaagtgactgagctctattctgtacctgccactctatttctggggtgacttttgtcagctgcccagaatctccaagccaggctggttctctgcatcctttcaatgacctgttttcttctgtaaccacaggttcggtggtgagaggaagcctcgcagaatccagcagaatcctcacagaatccagcagcagctctgctggggacatggtccatggtgcaacccacagcaaagccctgacctgacctcctgatgctcaggagaagccatgggcccctcctgtcctgtgttcctgtccttcacaaagctcagcctgtggtggctccttctgaccccagcaggtggagaggaagctaagcgcccacctcccagggctcctggagacccactctcctctcccagtcccacggcattgccgcagggaggctcgcataccgagactgaggaccggctcttcaaacacctcttccggggctacaaccgctgggcgcgcccggtgcccaacacttcagacgtggtgattgtgcgctttggactgtccatcgctcagctcatcgatgtggatgagaagaaccaaatgatgaccaccaacgtctggctaaaacaggagtggagcgactacaaactgcgctggaaccccgctgattttggcaacatcacatctctcagggtcccttctgagatgatctggatccccgacattgttctctacaacaatgcagatggggagtttgcagtgacccacatgaccaaggcccacctcttctccacgggcactgtgcactgggtgcccccggccatctacaagagctcctgcagcatcgacgtcaccttcttccccttcgaccagcagaactgcaagatgaagtttggctcctggacttatgacaaggccaagatcgacctggagcagatggagcagactgtggacctgaaggactactgggagagcggcgagtgggccatcgtcaatgccacgggcacctacaacagcaagaagtacgactgctgcgccgagatctaccccgacgtcacctacgccttcgtcatccggcggctgccgctcttctacaccatcaacctcatcatcccctgcctgctcatctcctgcctcactgtgctggtcttctacctgccctccgactgcggcgagaagatcacgctgtgcatttcggtgctgctgtcactcaccgtcttcctgctgctcatcactgagatcatcccgtccacctcgctggtcatcccgctcatcggcgagtacctgctgttcaccatgatcttcgtcaccctgtccatcgtcatcaccgtcttcgtgctcaatgtgcaccaccgctcccccagcacccacaccatgccccactgggtgcggggggcccttctgggctgtgtgccccggtggcttctgatgaaccggcccccaccacccgtggagctctgccaccccctacgcctgaagctcagcccctcttatcactggctggagagcaacgtggatgccgaggagagggaggtggtggtggaggaggaggacagatgggcatgtgcaggtcatgtggccccctctgtgggcaccctctgcagccacggccacctgcactctggggcctcaggtcccaaggctgaggctctgctgcaggagggtgagctgctgctatcaccccacatgcagaaggcactggaaggtgtgcactacattgccgaccacctgcggtctgaggatgctgactcttcggtgaaggaggactggaagtatgttgccatggtcatcgacaggatcttcctctggctgtttatcatcgtctgcttcctggggaccatcggcctctttctgcctccgttcctagctggaatgatctgactgcacctccctcgagctggctcccagggcaaaggggagggttcttggatgtggaagggctttgaacaatgtttagatttggagatgagcccaaagtgccagggagaacagccaggtgaggtgggaggttggagagccaggtgaggtctctctaagtcaggctggggttgaagtttggagtctgtccgagtttgcagggtgctgagctgtatggtccagcaggggagtaataagggctcttccggaaggggaggaagcgggaggcaggcctgcacctgatgtggaggtacaggcagatcttccctaccggggagggatggatggttggatacaggtggctgggctattccatccatctggaagcacatttgagcctccaggcttctccttgacgtcattcctctccttccttgctgcaaaatggctctgcaccagccggcccccaggaggtctggcagagctgagagccatggcctgcaggggctccatatgtccctacgcgtgcagcaggcaaacaaga

SEQ ID NO: 88008 - DNA, 817 bp, Homo sapiens
ccggacgcgtgggtccgacccacgcgtcggctacgctcttcatattccagataccaactgcctaccaaggactaatgagatggtatatttcttccacatcagggcaagctgaaaatatattgattcagcgttactgttacgtaaatgaatttccatcttctcatatgtgttatttttgaaagaatgaatacactctctgtcttaaatccgctcttaacaaatgatctcttctcagaatactacatctgtattgagagtacagacagcccattggtcactgcaccttttgcaagacagcgaaacggatgcatcaaattgcattgatacatcatcaccatcaatcttttgcactgatttttagacttaatcttcttatttgaaaataaactcatttttaaataaaataaaaaatattttagggaaagctctataaaattaaaattacagaattatatgctttttaaaatttatgcaaaaatgtgcagacaaatgtattctgtattggtttatgtatcactttgcccttgtatattttgagattattaagatttgttgacttttttggtttgatatttatcatctgttaaatttttccttttaaattattaaatgcaaagtgcaagaaaaagagataaatatttactgattgctagatgtaaaaatatctatgaatatatatatttaaacttctgccagagagcaaccatctgacagtcaacttactaaaatctaaattgagtactttttactgttgcagagaattaagtcactaaacgttatttagatatatagatgctagttgcaagtaacacccttt

SEQ ID NO: 88009 - DNA, 624 bp, Homo sapiens
ccggacgcgtgggtccgacccacgcgtcggctacgctcttcatattccagataccaactgcctaccaaggactaatgagatggtatatttcttccacatcagggcaagctgaaaatatattgattcagcgttactgttacgtaaatgaatttccatcttctcatatgtgttatttttgaaagaatgaatacactctctgtcttaaatccgctcttaacaaatgatctcttctcagaatactacatctgtattgagagtacagacagcccattggtcactgcaccttttgcaagacagcgaaacggatgcatcaaattgcattgatacatcatcaccatcaatcttttgcactgatttttagacttaatcttcttatttgaaaataaactcatttttaaataaaataaaaaatattttagggaaagctctataaaattaaaattacagaattatatgctttttaaaatttatgcaaaaatgtgcagacaaatgtattctgtattggtttatgtatcactttgcccttgtatattttgagattattaagatttgttgacttttttggtttgatatttatcatctgttaaatttttccttttaaattattaaatgcaaagtgcaaga

SEQ ID NO: 88010 - DNA, 395 bp, Homo sapiens
aactggaacatgtctcattaaggtttacatacacactaagacagcaaaggattggaattaactttatggagacagttccagggactaatattgaagcagtggttatttgataatgcatggaaccaccatttggattcaataaaccaattacataaaagcaatgatgctacgctcttcatattccagataccaactgcctaccaaggactaatgagatggtatatttcttccacatcagggcaagctgaaaatatattgattcagcgttactgttacgtaaatgaatttccatcttctcatatgtgttatttttgaaagaatgaatacactctctgtcttaaatccgctcttaacaaatgatctcttctcagaatactacatctgtattgagagta

SEQ ID NO: 88011 - DNA, 397 bp, Homo sapiens
gttattccaaccaaaatttcctaagattgaaatgcagaaacttacagaattgagtaaaaagacaaaaacgtaaatactaaatattgaaaagatgcaagttctccccaaatacactcatagatttaataaaattcaaatttaaaggcaattaattagggatgaggcaagaatctgggaagaaaattaatctgaagtttgtctggaaaaatcaatgggtgaaacgaaaatattttaggataagattaatgagaagtaaaattatttcaattataaaagtaaaatgataaaatagttagacctatatggtactgatgccaggaatgttatacaaagctacgtcaaggcttgagataattttattgaaagatattcgtggttatctcattggctataaaag

SEQ ID NO: 88012 - DNA, 443 bp, Homo sapiens
aggcttctcatccccctgaaatgtctcaatgggtcagaaaggcagggcccaagagagaaactctctctttgccatgtccatgcagacagcagatacccctagaaactaaactaaaggattagggctaccaagtggcttccctcatcctaggaccaccatatctgcaggaggatgggagtgaggcaggctgtgcgggccccttgggcacccgcctgccctggttgctgccctgatcctgcagggagagcctgggtgttgctgtgaatataggcgagggcattagggctgggtattggagagtaatgaagggaggacaggctatctttcattgtggtcagagggctacattctggtagtcaccaccacaatatacaattttgtttaatttattcccttttattcccattttcaccaccatccttcatatccttttattcgtacgt

SEQ ID NO: 88013 - DNA, 481 bp, Homo sapiens
cttctgctctggctctcctaagccttcctcagccccctcagtcccttacggcctggcctggcaacacagcagaacccctaggaacccctacaagagagggcaaggccccactaggccacagcactgagattcggaggccaaggagcaagaggaaccagcctcaacaactatcatgcagtcatcagccaacaccatggccacattcttacactcacagtccgtatcctctcacagtgatgctcaagttatagctggcaatttaggacttcattctttccctaatattatgcttgttctcccataagccccagtcttagactgagaccaagcctggggaaggctcagaagctattgaagtccatggtgagggcctctgagactgggaattgtccagaggagtgaaatgaaagcatgttccttagggctgcactgtgagcacaggctcagtgctgggtgcacgtacggtactgtgtggtggtag

SEQ ID NO: 88014 - DNA, 411 bp, Homo sapiens
atgtaccctggaaattagtgctagatggatgatgcacaggggttctactactgataaaaacactgaccacaaagattcacatatagactttgagtaggatggttttatgaacaatgagagtggttaaagcaatccttctacattattgcaatgcttcataaaatgtaactacattaataaatttaaaattttaccatttaatctatttccttagaagtttataaggggagactgctttatatttgggcttgccaccttatattctggcatacatattaacttttcctgtaaatgaccataaaggataaagtctcctcactcttccctccccattacagaagaccattattgtgcacaactgtgtgttctgattttataacagttcaactcttattttcttttagggtaata

SEQ ID NO: 88015 - DNA, 152 bp, Homo sapiens
gatccgcccaccttggcctcccaaagtgctgggattataggcgtgagccacccctggcctccaatcttcacatttatatactgaattatacattacattatgtacatatgataactagttgcttaaatattttaataaattatatctaatgt

SEQ ID NO: 88016 - DNA, 575 bp, Homo sapiens
gcccccatttgcatggagacaatggtctcagccctgaatccggagctgtgggggcactgggcattggttggcacaatcgccctttgtgccggctccagcgggcaggcgggagcacgtcccgggggctcactgagatgtggtcgggtcccagcccaatcctgatggcatctaagtcctggggagcctggtgcccagtggagcgggagcctggacttggtcttgcctgctgacttccacatgggatgcccaggaaagccccaaggggcagggaacaccacccagcctcctgccaaggaggtggggatgcaggtgagccatcctgaatgaactggagcttggcgggctgggctggtgcctgcgagcacaaagggttgcgaacactgtgggtttgtcccctctctgccatgcataagatgtgacagcatccttacaactgctggtaagctgagacattcgggttagtcccaggcactgggaagaggtccgagagggagagatggatgcagaaatgaccaaagggtaaagggacggctgctgagaagggaatggatcatattacttggatggctgagcac

SEQ ID NO: 88017 - DNA, 716 bp, Homo sapiens
tgtggggaaacagaatcagatatcgccatactcaggagtatgaaaagaagaacaggaaattctttttcttcagtttgcacttgaatggactcaagcaaagagtgtggatatgtatcttgttactgtttatagttaataatgtggagattagtatatatgggatttcatttgccttgtttgaactaattggatgcattatatagaaatcacctgagcctgtgctagatcaacaaagaaaatggaaatgtatacctcaggattgaaatccgagaaaattagacaattcaatgctatttaataacgcattaagaagaaatactattgccaatcagggaaagtgagaatctagtgaacgtgagaggaagtaaaatttaggcaattattacacttgttgaaacataacttatgacggtgtaaaagcagaagatagatcacagtatatgtcacagacattttacacagtttccaactgaatttggggttaactatgtaagtgttctaggaatgtatggccattatatcaataagaaactgtccttttaaatttgtgatcctacacatttatatatgcagaagagggcctttttaaatttattgaggatgaattgcatgctggaagtacctctttgcattacagttacttgctcaattgaagatactgtataaagtctaatttttgtatgggtgtgaaggtatgtgtatgcacttatgtgtgc

SEQ ID NO: 88018 - DNA, 996 bp, Homo sapiens
agtattttgtagctaatttttaaaaatttggagcactattataaacacaaagatgactcacaagttatctcttttataatattttaagtactccaaatttaaatatttaagtctatgatattgatatttattaaggtaatgtttttaggagtggagatataggaaatacaaggccaaaaaatcttaaaggcccactttctcatggaaaaataatctcttgctcaggttttctcaacaggagggaatgaaatggaaatgtagcagagtttcaaaactagaaatgtactagagatggaagctgtattctttactaaaggcatcagcattactgttaacttccaggcttcctgcaaataatgcgtgttaccactctctccttaactttttgactctgtcgagagaaggctcatgtttccttcaggtctctcctctaggtcaggagcatatctagggacatctgtgcttcactcagtctagaaaacctgcttgtcatagccaagccactgctgtgagctcctggcctccagtttagaaggaaacctgctgtccaaactaagatgctgtcctgacagttcccagcttgcagctgctggtccacgcttatgttcgcctgccaaactccgctcccgctctttcttctctgctgtgacaccctccaaggctgcaactttcatccgtaatggattcgtttacacttggtcaaggctctcgacaacagtgggaccaaaacccagaggttcacagaaactacaatagtcaccgtgagtcaggccagtctgcccagaggatggcctgcaggactgcccacagcatttggaggccaggcctcagctgcatctctgaagcccaggcaaaggcggccctggggaaggtggaacaccagcatttctactgatgctctggggtcctgcagaaccctgactgtgccacagaccttctgtaccgtgtccatttccatataatctaataaatccttcttacaaaggaaacctgagt

SEQ ID NO: 88019 - DNA, 588 bp, Homo sapiens
gaaattatatttatgtttgtttcatcttgaaagtgtgcttttacatatatatttatgaatgtatattgaagctttattattaggatatgtctttcatttggtcaaatgagatgcgaaaatgcaacgtgcttaatttcattctattttttaaatttctaaacattgaaattgttttttgaaatgacgctttaaaatatttaacttatgaaataaatttgtctctgaaaatctagatgttgtgttatgtatctattttctctagacaggaatacatttctaatatggatatatatgtctgtcttttttcaggcctggttgcagcatgcttgaaatctgggatgtggaagacccttccaatgcagctaaccctcccttatgtagcgtcctccttgagccgagattgtgccactgcactccagcctgggcgacaaatcaagaccccgtctccaaaaaaaaaaaaaaaaaaacttgattgggatccaaaatcatacaactatacactaaaatcagtgaatattaccttatgtaaattaaaaattaggaaatcaaaagaaaagcatacatataaaaaacagttttttctaagca

SEQ ID NO: 88020 - DNA, 949 bp, Homo sapiens
ttcagactctgctgatatacacaaagacattattgcttccagttgttatggtgattacatgttttatctttaaaaagactgttggtgatatttcgcgtgttttagctacaaacgtttatctaagaaaacagctccttgaacacagtgagctggcttttcacacattgcagttgttagcatttactgcccttgccattttaattttgaggctaaagctgtttttgacacagcacatgtgtgttatggcttccttgatatgctcttgacggctctttggctggctttttcgcagagttcgcagagagaatgttatctttggcattctaacagtgatgtcaatacaaggttatgcaaacctctgtaatcaatggagcataacaggagaatttaatgatttgcctcaggaagaacttttacagtggatcaaatacaataccgtaccagatgctgtctttgcaggtgccatgcctacaatggcaagtgtcaagctgtctacacttcatcccattgtgaatcatccacattacgaagatgcagacttgagggcttggacaaaaatagtttattctacatatagtggaaaatctgccaaagaagtaagagataaattgttggagttacatgtgaattattatgttttagaagaggcatggtgtgttgtgagaactaagcctggttgcagcatgcttgaaatctgggatgtggaagacccttccaatgcagctaaccctcccttatgtagcgtcctccttgagccgagattgtgccactgcactccagcctgggcgacaaatcaagaccccgtctccaaaaaaaaaaaaaaaaaaacttgattgggatccaaaatcatacaactatacactaaaatcagtgaatattaccttatgtaaattaaaaattaggaaatcaaaagaaaagcatacatataaaaaacagttttttctaagca

SEQ ID NO: 88021 - DNA, 928 bp, Homo sapiens
tgaaaataactcaaaagtttcagtggtcatctaaagtattgtatacactgtatatataggttgaatagaaggtcatcctattcatttattaatgagaggtacaatctccagggatctgtaaaatctattttgtcttaaccaaagaacaaatttttgacatatcttgaataggatgactataaattatgacttttaaattgtcgtaatttttgtactattatgtgatatttttatttttatgtatgttcctaagtagtttagagatagtcacattttaaaaatccaagatcaaacaaatgaatcttatttttatgtattcatagtatagaagaccttcagtaaatagataatatttttgttttattctagaaaacagctccttgaacacagtgagctggcttttcacacattgcagttgttagcatttactgcccttgccattttaattttgaggctaaagctgtttttgacacagcacatgtgtgttatggcttccttgatatgctcttgacggctctttggctggctttttcgcagagttcgcagagagaatgttatctttggcattctaacagtgatgtcaatacaaggttatgcaaacctctgtaatcaatggagcataacaggagaatttaatgatttgcctcaggaagaacttttacagtggatcaaatacaataccgtaccagatgctgtctttgcaggtgccatgcctacaatggcaagtgtcaagctgtctacacttcatcccattgtgaatcatccacattacgaagatgcagacttgaggcctggttgcagcatgcttgaaatctgggatgtggaagacccttccaatgcagctaaccctcccttatgtagcgtcctccttgagccgagattgtgccactgcactccagcctgggcgacaaatcaagaccccgtctcc

SEQ ID NO: 88022 - DNA, 1304 bp, Homo sapiens
tgaaaataactcaaaagtttcagtggtcatctaaagtattgtatacactgtatatataggttgaatagaaggtcatcctattcatttattaatgagaggtacaatctccagggatctgtaaaatctattttgtcttaaccaaagaacaaatttttgacatatcttgaataggatgactataaattatgacttttaaattgtcgtaatttttgtactattatgtgatatttttatttttatgtatgttcctaagtagtttagagatagtcacattttaaaaatccaagatcaaacaaatgaatcttatttttatgtattcatagtatagaagaccttcagtaaatagataatatttttgttttattctagaaaacagctccttgaacacagtgagctggcttttcacacattgcagttgttagcatttactgcccttgccattttaattttgaggctaaagctgtttttgacacagcacatgtgtgttatggcttccttgatatgctcttgacggctctttggctggctttttcgcagagttcgcagagagaatgttatctttggcattctaacagtgatgtcaatacaaggttatgcaaacctctgtaatcaatggagcataacaggagaatttaatgatttgcctcaggaagaacttttacagtggatcaaatacaataccgtaccagatgctgtctttgcaggtgccatgcctacaatggcaagtgtcaagctgtctacacttcatcccattgtgaatcatccacattacgaagatgcagacttgagatttatacttcaagatggacaagaagttctatcagctgatgagaaatgatgccagatggtaactcagatatacaagaaatactgaaatgcgctggaaaaggtaaatatgtggatattaatcactatacgtttttcttctctgaaaatctttaaaagacattatttaaggcaaaagtgataccattatattttttagtttatgacagaaattaaatatacatgacaatagcacaaaaattgagtaaaccgtggaaatgtacgatttactagaaataacccaatttaaatggtaagtaaatcatgatatgttaaagatgcttgttgtcatccctatcaaaaccactcaaaaaataaataaaacagtggggaaaaaaagagcataatggcaagcctagatatggatgagcctggatacattaagtgaaataagtcagacacagaaagatgaatagtgcatgttgtcactcatgtggaagctcaaagaagtagctcatagaagtagagtagaattgtgg

SEQ ID NO: 88023 - DNA, 363 bp, Homo sapiens
ttcagactctgctgatatacacaaagacattattgcttccagttgttatggtgattacatgttttatctttaaaaagactgttggtgatatttcgcgtgttttagctacaaacgtttatctaagatgctgtctttgcaggtgccatgcctacaatggcaagtgtcaagctgtctacacttcatcccattgtgaatcatccacattacgaagatgcagacttgaggcctggttgcagcatgcttgaaatctgggatgtggaagacccttccaatgcagctaaccctcccttatgtagcgtcctccttgagccgagattgtgccactgcactccagcctgggcgacaaatcaagaccccgtctcc

SEQ ID NO: 88024 - DNA, 1168 bp, Homo sapiens
tgaaaataactcaaaagtttcagtggtcatctaaagtattgtatacactgtatatataggttgaatagaaggtcatcctattcatttattaatgagaggtacaatctccagggatctgtaaaatctattttgtcttaaccaaagaacaaatttttgacatatcttgaataggatgactataaattatgacttttaaattgtcgtaatttttgtactattatgtgatatttttatttttatgtatgttcctaagtagtttagagatagtcacattttaaaaatccaagatcaaacaaatgaatcttatttttatgtattcatagtatagaagaccttcagtaaatagataatatttttgttttattctagaaaacagctccttgaacacagtgagctggcttttcacacattgcagttgttagcatttactgcccttgccattttaattttgaggctaaagctgtttttgacacagcacatgtgtgttatggcttccttgatatgctcttgacggctctttggctggctttttcgcagagttcgcagagagaatgttatctttggcattctaacagtgatgtcaatacaaggttatgcaaacctctgtaatcaatggagcataacaggagaatttaatgatttgcctcaggaagaacttttacagtggatcaaatacaataccgtaccagatgctgtctttgcaggtgccatgcctacaatggcaagtgtcaagctgtctacacttcatcccattgtgaatcatccacattacgaagatgcagacttgagatttatacttcaagatggacaagaagttctatcagctgatgagaaatgatgccagatggtaactcagatatacaagaaatactgaaatgcgctggaaaaggcctggttgcagcatgcttgaaatctgggatgtggaagacccttccaatgcagctaaccctcccttatgtagcgtcctccttgagccgagattgtgccactgcactccagcctgggcgacaaatcaagaccccgtctccaaaaaaaaaaaaaaaaaaacttgattgggatccaaaatcatacaactatacactaaaatcagtgaatattaccttatgtaaattaaaaattaggaaatcaaaagaaaagcatacatataaaaaacagttttttctaagca

SEQ ID NO: 88025 - DNA, 749 bp, Homo sapiens
tgaattattatgttttagaagaggcatggtgtgttgtgagaactaagtgagtattaaacctatgctatctgatatggtatatttttgagcaacaaatgtttcactttattacagtagtcctgattctttaagaatttttattttaaatttattaaaatattatcctggtaccttagtttaaattatttcatctagagacataaaactatattatcaatgaagtagaatttaattccaaacattatagtatatttaatatcctgatttttcaatttaacatcttccacttagcttttttcataatttttgaaatatttatgaaaatttttattagatatctgtaatatggatttgaatttacaacaaagtgagatattggcattctgtattatagctgaattatattggatttgtaagacttaaaagaaaagtgacaaaacccaaaatgacctaaggaaaacattcctaattaaaattttttaatttctgaattttgaatctctaaaaatcataaaattctaagatgtgtaattgatcttatgagtcctttgtttaggctcctaagcacagatattagctgctgcacatgacaggaaattcaggcacattaattgtctcctagaatgacacattggcaatcagaagaacaaaacaggttctacggtcacttcaaaatatcatttaaaatgtgcaaaaagtttcagagattcaaactaaaatgagaaagtatgaccaatactctgaaaaaa

SEQ ID NO: 88026 - DNA, 2679 bp, Homo sapiens
  misc_feature (911)..(911): n is a, c, g, or t
  misc_feature (928)..(928): n is a, c, g, or t
  misc_feature (941)..(941): n is a, c, g, or t
  misc_feature (978)..(978): n is a, c, g, or t
  misc_feature (1842)..(1842): n is a, c, g, or t
agcgattctcctgcctcagcctctttagctgggactacaggcgcacgccaccacgcccggctgatttttgtattttagtagagatgggtttcaccatgttggcaaggctggtcttgaactcctgacctcaggtgatacacccatctcggcctcccaaagtgctgggattacaggcttgagccaccacgcccagcttaaatgtgattcttgatactgttttaagtatttaggttgcaattaactttggcaaagtcagtcgacataagccctgtggatatggccttatgtacactgtaatgcagacaggtgcttttcatcattcatgtaacattctcacacagttgaggatattcatctcctcaccaattccagattgtaaatgtaccatcttaaacaactctgaggtcaccaaacagtagttatttgactgttaataggtgctacttgcttgcaaggatttggagatgtaaacatgaagaaaatatagttactgcctgcaaagaattaacatccgtctagtgggagaaacaaacacaccccactcactaagtatggaaaactgattctgggaggaagcagaaatgtccctagataacagcatgtattgcagatacccaaatgtttattgttttctcagcccttcaattttgcttttctctctcaaatgctacagactcaatttaaatcttacctttgattgttgaaaaaagtcactaagatgtgaatacagaatagacattgagaggttatatatgtccaaaactcatctgtccagcagtcaccgtcctcttcagagtggtcacgttgggcagatgggcacaggtgctggtgatgcctctcctgggcaaaacgccccatttgtggcactttcagatactatttatttactttttaagagagagacaggctcnctctgtcacccaggccngagtgcagtggcncgatcatagttaccgcagcatcaaattcctggactgnagcggtccttttgcctcggcctcgcggatagctgggaccacaagcagtagagacaagatctccgtatgttatacaggctggcctcaggtggatcctcttgccttggcctcccaaacaccgggattataggcgtgagcccccgtgcctggcctcaaattttattttagctcgaccctatggcagtttgtgtttggaaatcgtgatgtgaagtcatcagtatctgtgcatatccctaaactaatggtttaagcgttgaagcatgcgcaagcaacatgaacaactgaatacagaaagtaactgaaagcagcacagagactgtgtcgtccctacagacttctaaccctgcattcagcaacatcattcgacccgaagccagattcaaaccctatgtcttctagcaggttctgaatttagaggacaaataaggtgacaggtactaagagaagagtgaattaagtgaaaatcttccctttgttaaggagctttttaacaagagtgtctttgctgggtggtgattgggatgtaacagatcagttctactggacttgtagcttgatagtgaaataaggagcttgggctaaggtatcaatcaacacactgcttccttcctccagaaggtcttactgtgaaggaaaaaatgtcagttgaactaaattgtgcttcacgcctcggtagatttgcattctgatgcaagcccccaacctcacggaccaagaggatccctggctgcctgtgaatggcccacatttgagtggtgctaacttgatgtgagtaggcattaattatgggtgcggctactaagatgggaaaaactatcacgacagtggcaccacctgatttcatgatgtaccatatgcagtaacncatgtttgaggtacagaattgaagctgatttttctgcaaaagatgaatttctataaacaatcccatttttatattttattattaaaacaaaaatacctctctttgctagagagtatatgtatgacttaaattattagctatggtttgcatttagtacatggcagattgcctgtaagtctgttcattttaacaacatacggggctgggcacggtggctcacgcctgtaatcccagcactttgggaggttgcgggtggatcacttgaggtcaggagttcgagaccagcctggccaacatggcaaaaccccgtctctatgaaaaatataaaaattagctgggcatggtggcaggcacctgtaatcccagctactcgggaggctgaggcaggagaatcgcttgaacctgggaggtggatgttgcagtgagcagagatcgtgccattgcactccagcctgggaacaagagtgaaactctcaaaagcagaaacaaaaacccaacatatatgggctgttagatagtaattgtaatttcgtataaatagtaaatgagtacatcttgattaaaagctatgaattcagaattgcttttaaatatatagggggttttttgaaatttattacagtgcaattgaaaatacacttaaaatactgcaggatgcttagtgctcagtgttatgtatgaacttgtggactttacaatgcaggttgagaactgctaatgtatagaatgactaaacagctgtctttcagggtatctcatttttaaaggtataaggaacaaactttaatgtattgaaatgcataaataaaatttattttttatatttaaaaaaaaaaa

SEQ ID NO: 88027 - DNA, 2589 bp, Homo sapiens
  misc_feature (821)..(821): n is a, c, g, or t
  misc_feature (838)..(838): n is a, c, g, or t
  misc_feature (851)..(851): n is a, c, g, or t
  misc_feature (888)..(888): n is a, c, g, or t
  misc_feature (1752)..(1752): n is a, c, g, or t
tgttatattgtattatttagacgcacatacctctctttgctagagagttatatgtatgacttagattattgctgggattacaggcttgagccaccacgcccagcttaaatgtgattcttgatactgttttaagtatttaggttgcaattaactttggcaaagtcagtcgacataagccctgtggatatggccttatgtacactgtaatgcagacaggtgcttttcatcattcatgtaacattctcacacagttgaggatattcatctcctcaccaattccagattgtaaatgtaccatcttaaacaactctgaggtcaccaaacagtagttatttgactgttaataggtgctacttgcttgcaaggatttggagatgtaaacatgaagaaaatatagttactgcctgcaaagaattaacatccgtctagtgggagaaacaaacacaccccactcactaagtatggaaaactgattctgggaggaagcagaaatgtccctagataacagcatgtattgcagatacccaaatgtttattgttttctcagcccttcaattttgcttttctctctcaaatgctacagactcaatttaaatcttacctttgattgttgaaaaaagtcactaagatgtgaatacagaatagacattgagaggttatatatgtccaaaactcatctgtccagcagtcaccgtcctcttcagagtggtcacgttgggcagatgggcacaggtgctggtgatgcctctcctgggcaaaacgccccatttgtggcactttcagatactatttatttactttttaagagagagacaggctcnctctgtcacccaggccngagtgcagtggcncgatcatagttaccgcagcatcaaattcctggactgnagcggtccttttgcctcggcctcgcggatagctgggaccacaagcagtagagacaagatctccgtatgttatacaggctggcctcaggtggatcctcttgccttggcctcccaaacaccgggattataggcgtgagcccccgtgcctggcctcaaattttattttagctcgaccctatggcagtttgtgtttggaaatcgtgatgtgaagtcatcagtatctgtgcatatccctaaactaatggtttaagcgttgaagcatgcgcaagcaacatgaacaactgaatacagaaagtaactgaaagcagcacagagactgtgtcgtccctacagacttctaaccctgcattcagcaacatcattcgacccgaagccagattcaaaccctatgtcttctagcaggttctgaatttagaggacaaataaggtgacaggtactaagagaagagtgaattaagtgaaaatcttccctttgttaaggagctttttaacaagagtgtctttgctgggtggtgattgggatgtaacagatcagttctactggacttgtagcttgatagtgaaataaggagcttgggctaaggtatcaatcaacacactgcttccttcctccagaaggtcttactgtgaaggaaaaaatgtcagttgaactaaattgtgcttcacgcctcggtagatttgcattctgatgcaagcccccaacctcacggaccaagaggatccctggctgcctgtgaatggcccacatttgagtggtgctaacttgatgtgagtaggcattaattatgggtgcggctactaagatgggaaaaactatcacgacagtggcaccacctgatttcatgatgtaccatatgcagtaacncatgtttgaggtacagaattgaagctgatttttctgcaaaagatgaatttctataaacaatcccatttttatattttattattaaaacaaaaatacctctctttgctagagagtatatgtatgacttaaattattagctatggtttgcatttagtacatggcagattgcctgtaagtctgttcattttaacaacatacggggctgggcacggtggctcacgcctgtaatcccagcactttgggaggttgcgggtggatcacttgaggtcaggagttcgagaccagcctggccaacatggcaaaaccccgtctctatgaaaaatataaaaattagctgggcatggtggcaggcacctgtaatcccagctactcgggaggctgaggcaggagaatcgcttgaacctgggaggtggatgttgcagtgagcagagatcgtgccattgcactccagcctgggaacaagagtgaaactctcaaaagcagaaacaaaaacccaacatatatgggctgttagatagtaattgtaatttcgtataaatagtaaatgagtacatcttgattaaaagctatgaattcagaattgcttttaaatatatagggggttttttgaaatttattacagtgcaattgaaaatacacttaaaatactgcaggatgcttagtgctcagtgttatgtatgaacttgtggactttacaatgcaggttgagaactgctaatgtatagaatgactaaacagctgtctttcagggtatctcatttttaaaggtataaggaacaaactttaatgtattgaaatgcataaataaaatttattttttatatttaaaaaaaaaaa

SEQ ID NO: 88028 - DNA, 4795 bp, Homo sapiens
  misc_feature (318)..(318): n is a, c, g, or t
  misc_feature (322)..(322): n is a, c, g, or t
  misc_feature (329)..(329): n is a, c, g, or t
  misc_feature (342)..(342): n is a, c, g, or t
  misc_feature (366)..(366): n is a, c, g, or t
  misc_feature (372)..(372): n is a, c, g, or t
  misc_feature (376)..(376): n is a, c, g, or t
  misc_feature (397)..(397): n is a, c, g, or t
  misc_feature (399)..(399): n is a, c, g, or t
  misc_feature (403)..(404): n is a, c, g, or t
  misc_feature (427)..(427): n is a, c, g, or t
  misc_feature (433)..(433): n is a, c, g, or t
  misc_feature (2234)..(2234): n is a, c, g, or t
atatttaaaatgtttttcatttatttactgaaccatttgagagttaactgcagatgagagattttatccttaaatacttttgtgtttatctcctaagaataaggaacataatagtattattatgattaagaaatttaacataaataaaaactaatgaggccaggcgcggtggctcacacctgtaatcccagcaccctgagagcctgaggcgggtggatcgtgagatcaggagatcaagactatcctggccaacatggtgaaaccccatctctaccaaaaatacaaaaaaaaaaaaaaaattagccgggcgtggtggcnggcncctgtantcccagctactcnggaggctgaggcaggagaatggcntgaacncggnaggcggagcttgcagtgagcngngatnncgccactgcactccagcctgggngacagngcgagactctgtctcaaaaaaaaaaaaaactaatgaaatttaacattaataaaatactactaggccaggtgcggtggctcatgcctgtaatcccggcactgtgtgatgccaaggtgggcagatcacttgaggtcaggagttcaagaccagctgggccaacatggtgaaatcctatctgtaccaaaaacacaaaaattagctgggcatggtggtgtgcacctacaattccagccactcgggaggctgaggcaggagaaccgcttgaacccaggaggcagaggttgcagtgagccaagattgcgccactgcactccagcctgagcaacagagtgagactccgtcgctcatcaaccccagcttccttgaagtgtttctggagagccgcgatgcctctcgactgagtggccgggacccctcctcatggacagtcgaggatgtgatgcagtttgtccgggaagctgatcctcagcttggaccccacgctgacctgtttcgcaaacacgtaggtgctgctgcctgacctctcagtaggaacctgtgtggagagcctcacctgggaagggcccagcttggcagggaaaggagcgctgactggaaccctcgatccagcagggtttcctgcctcggctgcaggagggtgggcagaactgggcccctcggcctggtgaggggcatcaggatgtccgtaagagtcaggctgcagcaggggcctgactgggggttcttgcagtccttctcagggtcagggctcccatttcctggctggacccatacattcattcttgactaccaccctaggagaaggaggaggaggaggaggacagtggcctgagccctggccccagtccaggctctggtgtcccgctgcccacctggcctacacacacgctgcctgataggccccaggcccagcagctgcagagctgccagggccggcccagcggcgtgtgctccgacagtgccattgtgcaccagcagatcgtgggcaaggaccagctcttccagggtgccttcctgggcagcgagacccgcaatatggagttcaagcggggtagcggcgagtacctcagcctggccttcaagcaccacgtgcggcgctacgtgtgcgccttcctcaacagcgagggcggcagcctgctcgtgggagtagaggacagcggcctggtgcagggcatccgctgcagccaccgtgacgaggaccgcgcacgcctgctggtggactccatcctgcagggcttcaagcctcagatctttcccgatgcctacactctcaccttcatccctgtgatcagtacctcggagaccagcgtccccctcaaggtgagcctgcaggacaggagggcctctgggcctgtcatctgtcatcactcagtaagacgatggcctgcactcctgccaggcagtgctggggcagggacgggactgggggccacaggagaagaggctggggatggcccctgtgccagccctgctggcctgccctaaggaatcagtgagcaatgctgagcagcctggcaggatgggggctgccgaccgtgaggggcggcgcctccagagctgctgttgcccctaccaaggtgatccgcctgaccgtgcacacccccaaggcccagagccagccgcaactctaccagacagaccagggggaggtgtttctgcggcgcgacgggagcatccagggcccgctgtctgccagcgccatccaggagtggtgcaggcaggtacggaagctgaggccagtgggtggggtggagcggagctgaccccagaccccttcagccacccactgagcagcccgggnaagccaccatggttccctgggtcctgcatcaccccgttgaacccaaggggttggaatacaatcacaccacatcccatactccgcgggtaggtggctggtgggaaggaagaggcccaagctctctccttttaaaaatctatgcagtggccaggcgcagtggctcacgcctgtaatcccagcactttgggaggatgaggcgaacagatcacaaggtcaggagttcgagaccagcctggccaacatggtgaaccctcgtctctactaaaaatacaaaaattagctgggcatggtggcgggcgcctgtagttccaaatactcgagagggtgaggcaggagaatcgatcgaatctgggaagcggaggttgcagtgagccgagatcgcgccactgcactccagcctgggcgacagaccgagactccatctcaaaaaaaaaaaaatcctatgcagtatcctcccttcaggggtgcctgaaacccctcaccctctacttgggcagttaacacactcgatcttgagtgagggagcagagagactggaatgttgagatgtcaccagaaaaccccaaagactatacactgcattttaggggaggccctaaagcggcagagggggcaagacacagtcccaaggaagagctttttcaagagggaaacagagaatggaggacaagggaccaacagtgaggaggcacatggcctgcccagcacggaggaggctcccttccatggctggcagccggcagcttccctcaggctgacacggttgaaggtggcagcaggccgaggggcctgacttttcccctagctgagaaagctctcaggctcctgggctttgccttcctccctcagtttggccccaggtggaggacggacaggcccgagaccaggcgggcttggccacatgcttttcccatgtcccctcagaggtggctggtggagctgggcaagctggaagagaagatgaaggcgctgatgatggagaaggagcagctccagcagcagctgcagcagcacgggcctgtgtcctgcacctgctgtgtcctgtgagggccctggggagcaggcaggacggcacggcactctccacctgagacccagggatttcctgtttgagtgtaaggccaaccagtaaagcccatgcgggctgctgagaggcggacagggactccttcaacatggcacatgagcaggcacccatgtggcttcaaccctgacagacccatctgtgtagccaagaaactgctctcagccctgtccccaaatgaccttactttcagaaagaatgtgtaaaaccctgcccagagctcccctagggctaagctataagggattgtccttctccctaaaatgctcatttggcccaggctgaggtctgtgactccagttggctacacagtgccagaaaggaatctgtcatctcaggaaagcccctcaaagatggcgaggcatatttgatgactgtggttacagggcaagaggccaccctgcagcccccacccctgacttgctggaacttgtgactgtcaaagctccattaataaattacatgcacctgggacaagaatggttctttctaggacactgggtcagccggtcagatgctgcagggtcatgagtcccaggcccagcccacctctgtccaggaggcagaggacagacctgcaagggcagggagcccagcccctcagactccagtccagctctgtcttaaagaccagggaccgtggggcaaagtgctatgcctctgtgcttcagtttcttcatctataagacagtgacaatggccaggggcattttgtcaccatcggccagtgccctgtgtctacgccagctgtggcacagagcagcacctcacactaagggtctcagttcctttccaagacccctctggtccagtaagaccgttagcttaaaacaaacaaaaaaaaccagactcctccagctgcttcctgcctctggccgtttctcctgctgtctccaccagctgagccagaggctgcaaagccagagtctgatcacactcacgccacacctgcacccatagccctccaaattcttcaagagcaaagcccaaacttgatggcctacatggttctccaccacctagcccacccaacctcaatgtcttccgccccttatgtaagccacttcagccacgcccaccaacttgtttcatttgcactcctgcctcggggcctctgcgctacatagcggcctatttcctttcctcttcaccttcaagtccatgcttaatttcccacccaccctattttaaagacaccacctcccagcactgccactcccctgctcacttccacccttggtctccatctatgaactaccacactctgtagcttatatttggtgcttcccccactgaataactgctctgggggacaggggtttgggtatggctggcatatggtagacacccaataaatacctgctggtgagacaattaaggatactcctaaatttggggtctgagccaccagaaaatcaccaaaccttgttgaacagggcatttcacaggactagtgtccacagaacacacttcagtt

SEQ ID NO: 88029 - DNA, 841 bp, Homo sapiens
accctggttctggccgtccctgtgccaagcctccaagttccctgagagctaccggccaggggtcgggaggctatgggagctcagggcaggcacctcccatgctcccgcgggagccaccaggacatgaaggtcataggcctctcctctcctcctcttcctgtttgacctgaatgcccccaggccaactgcctcaaggattccatttgagaagatgcaggctgggtgtgtggggagcagtagaggggctggtgtgtgcacatatgtgcacagctcaggacagaggctccctggacttggggcgggggcactagggccccaactctaaccctcgttctgccctgttgacctctgctctctggaccaaaaatggaggactcagtctagactagttcttagggtctaggagccaccttaagttatgtttatatgcaaaggccatttttctgagaggccatagctttcatcagtgtgccaaaaagcgtgagatcctctgctctaaaagcctctgccccagcgctgcctagtttcagagcccccgatggcctcacatggggttttagagcaggcagagaagctgcaatggggccaccagccagtcctcagagtcctgggttaaggcctcctctccaggaggccctgtgtaaaggttttctctgttgcctggaggcaggagtgaactggtaggcaggaaaccctgagggtacctaggaggcccctagcctgtgggttggggagggaagacaggacccctggggccactgaaatggtggagctctcagagacctgagttctggtcccttctgccactttttgggcagatcccgtcttcccacaggccctg

SEQ ID NO: 88030 - DNA, 483 bp, Homo sapiens
gtggcaggccctttcctgcttgccctctgccctccctctctctggccctgcccagtctctgccaatctgtgtacctcccaggagccgggacactccctgagtcctctgggagcccttaagccacactgagaacacagaccctgggagaagcagccagcagtgaggaatcctggaaccccttcccagggagagccttcccatgacccccatgaagagatcagtgcaaacacaggtgtcagagcccttcatggagtcctggggtgaggagtccctgccggagctacccgcagagcagtccctgacggagtactctgacctcgaggaggctccctcgagctgaggaccatcgttgcaacgatggtcctcagctcacttggatcttgcaagtgagctgagagaacaaagtagaaccccataacctttggccaggcatggtggctcacgcctgtggtcccagctttttggaagctgaggactatcgtt

SEQ ID NO: 88031 - DNA, 1504 bp, Homo sapiens
accctggttctggccgtccctgtgccaagcctccaagttccctgagagctaccggccaggggtcgggaggctatgggagctcagggcaggcacctcccatgctcccgcgggagccaccaggacatgaagctcccaggagccgggacactccctgagtcctctgggagcccttaagccacactgagaacacagaccctgggagaagcagccagcagtgaggaatcctggaaccccttcccagggagagccttcccatgacccccatgaagagatcagtgcaaacacaggtgtcagagcccttcatggagtcctggggtgaggagtccctgccggagctacccgcagagcagtccctgacggagtactctgacctcgaggaggctccctcggcgcacactctctatgtgggccatctgaacccccagttctcagtgccggtgcttgcctgcctgctgcgagacaccctggagcggctggagatgccggtggcgcgggagcacattgaagtggtgaggcggccgcggaaggcctatgcactggtgcaggtgactgtccacagggacaccctggcctccctcccctggcgcctgcagacggccctggaggagcacctaatcctcaaggagctggcagcccgtgggaaggacctgctattgagtgaggcccaagggcccttcagccacagagaggtaagtgggacttttcccaagcaagctccaaagcctcaccccaagggagagcctctgagtgggagtggcctgcagagtggggatggaggggtgtctctggggaagcagggacaaatctgcaaacttgggggctgccactcaaatgaccatggcttgcggctggtactgccagctttctctgggaaaaacagtttgcctcaagctcaagcccgacgtttgtgtgaagaaaggccacgaggggacctcctctccttaggtccttttacattccagcctctgggcctgggagaccctagaagacacaggggccccgattttctccttggcccaactcatttgttcaattgacaaacatgaacaccccctctgtgccaagagtaaggcagggatgagaggcccagccaggcccccaggaagccctgcatctgtggccagagctggacagccacccaccgagctgcaaggtggctgcgctcagagctgtgagagaagacaggaaggtttgccctgctctctggggacagattaacaggggaagtgaaatccaggccgggacttagggagttggacaggcacttgcaagggaggacattccaggcaagggacacagaatatgcagaggaacctgggggcttagagggagtgtcatgtctgcagaagggcaaaccatttggtgtccctggagctcccactaaaggctgcagggggtgctaaggaaggaagttgggccagaaggtagggtaggggccaggtcaccaaggctatcatccaaggcaaggctgaactgctggctttattgggtgggacatgggacg

SEQ ID NO: 88032 - DNA, 3996 bp, Homo sapiens
  misc_feature (1435)..(1435): n is a, c, g, or t
accctggttctggccgtccctgtgccaagcctccaagttccctgagagctaccggccaggggtcgggaggctatgggagctcagggcaggcacctcccatgctcccgcgggagccaccaggacatgaagctcccaggagccgggacactccctgagtcctctgggagcccttaagccacactgagaacacagaccctgggagaagcagccagcagtgaggaatcctggaaccccttcccagggagagccttcccatgacccccatgaagagatcagtgcaaacacaggtgtcagagcccttcatggagtcctggggtgaggagtccctgccggagctacccgcagagcagtccctgacggagtactctgacctcgaggaggctccctcggcgcacactctctatgtgggccatctgaacccccagttctcagtgccggtgcttgcctgcctgctgcgagacaccctggagcggctggagatgccggtggcgcgggagcacattgaagtggtgaggcggccgcggaaggcctatgcactggtgcaggtgactgtccacagggacaccctggcctccctcccctggcgcctgcagacggccctggaggagcacctaatcctcaaggagctggcagcccgtgggaaggacctgctattgagtgaggcccaagggcccttcagccacagagaggagaaggaggaggaggaggaggacagtggcctgagccctggccccagtccaggctctggtgtcccgctgcccacctggcctacacacacgctgcctgataggccccaggcccagcagctgcagagctgccagggccggcccagcggcgtgtgctccgacagtgccattgtgcaccagcagatcgtgggcaaggaccagctcttccagggtgccttcctgggcagcgagacccgcaatatggagttcaagcggggtagcggcgagtacctcagcctggccttcaagcaccacgtgcggcgctacgtgtgcgccttcctcaacagcgagggcggcagcctgctcgtgggagtagaggacagcggcctggtgcagggcatccgctgcagccaccgtgacgaggaccgcgcacgcctgctggtggactccatcctgcagggcttcaagcctcagatctttcccgatgcctacactctcaccttcatccctgtgatcagtacctcggagaccagcgtccccctcaaggtgatccgcctgaccgtgcacacccccaaggcccagagccagccgcaactctaccagacagaccagggggaggtgtttctgcggcgcgacgggagcatccagggcccgctgtctgccagcgccatccaggagtggtgcaggcaggtacggaagctgaggccagtgggtggggtggagcggagctgaccccagaccccttcagccacccactgagcagcccgggnaagccaccatggttccctgggtcctgcatcaccccgttgaacccaaggggttggaatacaatcacaccacatcccatactccgcgggtaggtggctggtgggaaggaagaggcccaagctctctccttttaaaaatctatgcagtggccaggcgcagtggctcacgcctgtaatcccagcactttgggaggatgaggcgaacagatcacaaggtcaggagttcgagaccagcctggccaacatggtgaaccctcgtctctactaaaaatacaaaaattagctgggcatggtggcgggcgcctgtagttccaaatactcgagagggtgaggcaggagaatcgatcgaatctgggaagcggaggttgcagtgagccgagatcgcgccactgcactccagcctgggcgacagaccgagactccatctcaaaaaaaaaaaaatcctatgcagtatcctcccttcaggggtgcctgaaacccctcaccctctacttgggcagttaacacactcgatcttgagtgagggagcagagagactggaatgttgagatgtcaccagaaaaccccaaagactatacactgcattttaggggaggccctaaagcggcagagggggcaagacacagtcccaaggaagagctttttcaagagggaaacagagaatggaggacaagggaccaacagtgaggaggcacatggcctgcccagcacggaggaggctcccttccatggctggcagccggcagcttccctcaggctgacacggttgaaggtggcagcaggccgaggggcctgacttttcccctagctgagaaagctctcaggctcctgggctttgccttcctccctcagtttggccccaggtggaggacggacaggcccgagaccaggcgggcttggccacatgcttttcccatgtcccctcagaggtggctggtggagctgggcaagctggaagagaagatgaaggcgctgatgatggagaaggagcagctccagcagcagctgcagcagcacgggcctgtgtcctgcacctgctgtgtcctgtgagggccctggggagcaggcaggacggcacggcactctccacctgagacccagggatttcctgtttgagtgtaaggccaaccagtaaagcccatgcgggctgctgagaggcggacagggactccttcaacatggcacatgagcaggcacccatgtggcttcaaccctgacagacccatctgtgtagccaagaaactgctctcagccctgtccccaaatgaccttactttcagaaagaatgtgtaaaaccctgcccagagctcccctagggctaagctataagggattgtccttctccctaaaatgctcatttggcccaggctgaggtctgtgactccagttggctacacagtgccagaaaggaatctgtcatctcaggaaagcccctcaaagatggcgaggcatatttgatgactgtggttacagggcaagaggccaccctgcagcccccacccctgacttgctggaacttgtgactgtcaaagctccattaataaattacatgcacctgggacaagaatggttctttctaggacactgggtcagccggtcagatgctgcagggtcatgagtcccaggcccagcccacctctgtccaggaggcagaggacagacctgcaagggcagggagcccagcccctcagactccagtccagctctgtcttaaagaccagggaccgtggggcaaagtgctatgcctctgtgcttcagtttcttcatctataagacagtgacaatggccaggggcattttgtcaccatcggccagtgccctgtgtctacgccagctgtggcacagagcagcacctcacactaagggtctcagttcctttccaagacccctctggtccagtaagaccgttagcttaaaacaaacaaaaaaaaccagactcctccagctgcttcctgcctctggccgtttctcctgctgtctccaccagctgagccagaggctgcaaagccagagtctgatcacactcacgccacacctgcacccatagccctccaaattcttcaagagcaaagcccaaacttgatggcctacatggttctccaccacctagcccacccaacctcaatgtcttccgccccttatgtaagccacttcagccacgcccaccaacttgtttcatttgcactcctgcctcggggcctctgcgctacatagcggcctatttcctttcctcttcaccttcaagtccatgcttaatttcccacccaccctattttaaagacaccacctcccagcactgccactcccctgctcacttccacccttggtctccatctatgaactaccacactctgtagcttatatttggtgcttcccccactgaataactgctctgggggacaggggtttgggtatggctggcatatggtagacacccaataaatacctgctggtgagacaattaaggatactcctaaatttggggtctgagccaccagaaaatcaccaaaccttgttgaacagggcatttcacaggactagtgtccacagaacacacttcagtt

SEQ ID NO: 88033 - DNA, 1449 bp, Homo sapiens
gtggcaggccctttcctgcttgccctctgccctccctctctctggccctgcccagtctctgccaatctgtgtacctcccaggagccgggacactccctgagtcctctgggagcccttaagccacactgagaacacagaccctgggagaagcagccagcagtgaggaatcctggaaccccttcccagggagagccttcccatgacccccatgaagagatcagtgcaaacacaggtgtcagagcccttcatggagtcctggggtgaggagtccctgccggagctacccgcagagcagtccctgacggagtactctgacctcgaggaggctccctcggcgcacactctctatgtgggccatctgaacccccagttctcagtgccggtgcttgcctgcctgctgcgagacaccctggagcggctggagatgccggtggcgcgggagcacattgaagtggtgaggcggccgcggaaggcctatgcactggtgcaggtgactgtccacagggacaccctggcctccctcccctggcgcctgcagacggccctggaggagcacctaatcctcaaggagctggcagcccgtgggaaggacctgctattgagtgaggcccaagggcccttcagccacagagaggtaagtgggacttttcccaagcaagctccaaagcctcaccccaagggagagcctctgagtgggagtggcctgcagagtggggatggaggggtgtctctggggaagcagggacaaatctgcaaacttgggggctgccactcaaatgaccatggcttgcggctggtactgccagctttctctgggaaaaacagtttgcctcaagctcaagcccgacgtttgtgtgaagaaaggccacgaggggacctcctctccttaggtccttttacattccagcctctgggcctgggagaccctagaagacacaggggccccgattttctccttggcccaactcatttgttcaattgacaaacatgaacaccccctctgtgccaagagtaaggcagggatgagaggcccagccaggcccccaggaagccctgcatctgtggccagagctggacagccacccaccgagctgcaaggtggctgcgctcagagctgtgagagaagacaggaaggtttgccctgctctctggggacagattaacaggggaagtgaaatccaggccgggacttagggagttggacaggcacttgcaagggaggacattccaggcaagggacacagaatatgcagaggaacctgggggcttagagggagtgtcatgtctgcagaagggcaaaccatttggtgtccctggagctcccactaaaggctgcagggggtgctaaggaaggaagttgggccagaaggtagggtaggggccaggtcaccaaggctatcatccaaggcaaggctgaactgctggctttattgggtgggacatgggacg

SEQ ID NO: 88034 - DNA, 414 bp, Homo sapiens
cagcccactgtggtgaggggcaagtaggaagaggtgaggctgggcaggtgggcagggccagggcagatggggctctgtaggctatggaggagctgcgatcttatcacaaggaaagtgaacagccctatgattaactattgaaggcagtgatataatttatgcttttatattaatagcaattattctggctgttgtatagagtatagattggagaacagaattgggtgggggaactagagaaggtgaacagactggtgaagaggcttttatagttatccaggcaagagatgatggtgacttggaagaccaggaagagaagcaggggtagagagaaatggagatagtgaagatatagcagacatatttgaggagtccttcagttacagataatagaaaactagctcaagcacattt

SEQ ID NO: 88035 - DNA, 400 bp, Homo sapiens
cccctgtccccttcaggccccttagatagttaaccaacaatgtaattattcctcattcatacattaaaaaaccaccgcctcatatgtggacttgaaaaattgtactgtaatgtacttacatcaaagttacaataagggtcaactaaaaattattttcctttttttagagatggggatctcactatgttgcccaggctggtctcaaactcctgggctcaggtgatcctcctacctcagcctcccaaagtgctcggattacaggcatgagccagcatgcctggcctaattattttatcctattttgtatttatcacaataattattttgttcaaatagtagtattacaataatgaagattaaaaagtatttccgttagtctgaaatacatgtaaaatggcca

SEQ ID NO: 88036 - DNA, 373 bp, Homo sapiens
cactgtcttaaattctacttctagaaaatccaaactatgagactcttattaagaaaaataagcagtatttttctgaaattcttattctttctttttttcccaatataaaaggtttttttttcttttgctagtattgcagattttgtttcacatagcattctttctctctctctttcgctccttctctctttgtctgagagcggtcagggattattatcagtctgtcatcggtcagggattatttgatttaaccttcacagtggttttagcagatagggagcattatcataactggttttgttttgacaacagttagagtagctgtaaattggataatgtaaatattggccaaggtcacacatttagtaagtgg

SEQ ID NO: 88037 - DNA, 398 bp, Homo sapiens
cctaacgtctaatgatgttgaatatctttttatgtgcttattatgtatcttcttagaatagagacatgtctatacaaatccttagtccattttttttcattgggttgtgttctaattgttgagttataagctttcttcacatattttctggatacaagtcctttatcagatatgtgataggaacattttttcttccattttgtggactgtcttttcactttcttgatgacatctgttgagcacaaaagtttttaatttttatgaagtctaattttgttgttgttgctgttgcttttgttttagagtgtgtgtgtgtgtgtgtgtgggtgacagagcagaccctgtctcaaaaaaatgtgttcttttgcctttagtgagctagagtcatggaagaattt

SEQ ID NO: 88038 - DNA, 404 bp, Homo sapiens
ggaagggaacctacctggacagactgaaataaaggggctaagtcacagacggcttttgcaagatgttaagaaacttagtggcaatgggaaaccattggagaaagttagggaagagagtgatgtgatatgatgggctctcctgcttaaaaagctggtcctggtggccatggacaggcagaggaaggacaaggcctaagatggggagctcctgcagcaatgcaagaaagaaaggaaggtggaggccaggtgcagtggctcacgcctataatcccagcactttgacaggccaaggtaggcagatcgcttgagcctgggagtttgagaccagcctgggtaacatggagaaactccgtctctactaaaaatagaaaaatatcagccagctgtggtggcacatgcctgtg

SEQ ID NO: 88039 - DNA, 367 bp, Homo sapiens
agctctggaccgttgatggctgagggtccagatagtggggtgatggaagaaggagcaaaaccataggagcagataggacaaggacaggaggaggttgtggtgagccgagatcacttcagccaaaaacacatagcaggtgatgcccccaccaaggacgtcaagtgtaagcatggagtcaggccaggctctgctgtactggccgaatgacactgtcaggaggtcaggctttaggactcaaaaagacacccagtaccatctgtgtaggaagcagctgatttccagagggctttgcaaattaattagaattaactactggggcccagactaatgaccataggcaaataataacaatgccagccatgcaagg

SEQ ID NO: 88040 - DNA, 426 bp, Homo sapiens
cacattcttggctaccataggatgtgtagttgcatttagagtaagaacaaatcctgagtaaaacaatttgaggtatttatctcttcctaaaaaaagagtttgctaagtaaatgtgccatctccttatatgtaagaatttggtcccattttaaacacaatgtgttatctaactacaaaattcaatacagattagagaaaatgttaacaactactaaatggctctacatgtactttgcatatcactgaactgagactcaaaatgaaaaatgcatttgccatacttgaaaggagaaaaatgaagaaaagtaggttcattttcttagttaagtaggtaggcattttttatacatgtaaactttaaatgctgtatgcatactgttttattaagctatagattttagctctttattagtaaaaataggtagg

SEQ ID NO: 88041 - DNA, 141 bp, Homo sapiens
gatctgcccgcctcagcctcccattgttgaccatttttatatgtttatttacctatgtggttttcttttctcataaaatgcttgttcatatattttccccatttctacttatcttgttcttattaaattgccaaagtgcat

SEQ ID NO: 88042 - DNA, 478 bp, Homo sapiens
attgttttctgttgcttccacccaaagaaccctggttatccaggcttagagagggcgaagtagttttcctatgatcacgcacacagcaagtggcagaactggggtacagtcaggtctttcggcctctattgccaagcccttgattagagaccccctctgtgtgctgaacagcactggactggcagtccgaggatcagaggatggatgtagttcctgtggtacctgcctctggggccttgggccactgcctctttgagctggacagggtagacaggatgaaatctatacataactaggtgacacccagtttgagaggattttcttgtccatgagacttttggacacattttgccccggttttctaaaggcttttactttgaggtttgaggaacggtctgaagcagtggttttcaaagtgtgactccaggagatgtatcagtgtcatctaggaacttgttagcagaacttgggtggggcc

SEQ ID NO: 88043 - DNA, 418 bp, Homo sapiens
tttcttgtaacaaggcatttatttgggatgaggaaaggaaattgagcagtaggaaaactgtagtgtgacttttcagttaccttttcaaagattcaactaaatatctgctatttttaacttgagttccttttattacttctttttaaaaagtggccctgttgacacttgtgacctcaataaaagagatattttaatgttaaaatgtcttaaattaatgttgaaaataaaagtattttttctcatcccacctaaagaaggagggattttctttagcttcttcttgatcttgacagcattgctgctgcatccgtgactctggattcagtgtcagtgatacagtaggtgaccggtgacttgagctgggggctaggttatagcatgcaatgtaaatagttatttgtcacgtggttgacaactt

SEQ ID NO: 88044 - DNA, 500 bp, Homo sapiens
acaacagctcagttacaacagctgaggagaatatttttcttttgacatcacttatgcttctagttgtagctttttatgatgaaaaccgtgattgatttactagtaaactcagagaagatagcttaaagcagtaggaaaactgtagtgtgacttttcagttaccttttcaaagattcaactaaatatctgctatttttaacttgagttccttttattacttctttttaaaaagtggccctgttgacacttgtgacctcaataaaagagatattttaatgttaaaatgtcttaaattaatgttgaaaataaaagtattttttctcatcccacctaaagaaggagggattttctttagcttcttcttgatcttgacagcattgctgctgcatccgtgactctggattcagtgtcagtgatacagtaggtgaccggtgacttgagctgggggctaggttatagcatgcaatgtaaatagttatttgtcacgtggttgacaactt

SEQ ID NO: 88045 - DNA, 369 bp, Homo sapiens
ctgggattacaggcgtgagccaccgcgcccggcctgcagttcctcttatagtaaaaacatggagaaatcccacatgaggatcataaaaattacattgtttttccatgtttacattgatcacagtaggactttgcacccacaaaggtacaatatctaattgtcataatttactgtaatatactgccacaacacatttgaggtatgtcctatctgctgctggtggcggaggcaacatgaactaatgagccagctcattcatgctaacatgcgtcgctcagaccatttagtccaggtgcaatccctcctcccccgcagcgtgggcctggggtcaggacttaccacgaatgtgcagactagagtcttgaaaaa

SEQ ID NO: 88046 - DNA, 411 bp, Homo sapiens
tcaagcggaggcaggtgaatcatggaggcggtttcccccatgttgttcttgtgatagtgagttcttacaaggtctgatggttttataagggctctttcccctttgtttggcacttcttcctgctgccttgtgaagaaggtgccttgcttcctcctcctctgtgattgtgagtttcctgaggcctccccaaccatgctgaactgtgagtcaattaaacctcttagctttataaactaccccgtcttgggcagttcttcatcgcagtgtgagaatggactaatacaggtggaaagaccgatgaccagacattggagccctggagtcatcttctttctttgtcagttattcactttgtgaccatagccaagtccctcaagcaatctgagcctcagtttccatacttacaaaaaa

SEQ ID NO: 88047 - DNA, 372 bp, Homo sapiens
acgatcatcaaggagaatattctcaggcttcaagtctctacaagaaacaacaacaaaaggcccaattattcagaagttggcactgtgattcctgagtacccagtaggaacaaccagcgtgagcaagggctagcgcggcaaaacacgaaactgcccttcatgagccacggcaaacaggcaggacaagaatgttacaaaattcatctcagcaaacaactcacatgtgacgacagtgtaaaatgaacttctttgcatagttatacagatttgaagacatttcagtgattaaatatgcagcccagtaggaaggaaagcaaacagtccttaatgaacgtggcacaatttctcttaccattaacatatttttaagtgt

SEQ ID NO: 88048 - DNA, 2329 bp, Homo sapiens
  misc_feature (1823)..(1823): n is a, c, g, or t
  misc_feature (2284)..(2284): n is a, c, g, or t
  misc_feature (2286)..(2286): n is a, c, g, or t
  misc_feature (2325)..(2326): n is a, c, g, or t
  misc_feature (2329)..(2329): n is a, c, g, or t
agttgacataattaatttgacaaggtggagttgtgaaaagagcactcaacttcagggaggtgagttccagtctagactatgtccttaactacctgtgtatgttctccaagctacctcactgacccctgtgacccctcaactataccacctgtttctgctctttctgtgcccagtactctccttaggggcagcagcagaagaggggcgtttcccacccctctcccaacctctccactagggtctccagtggacaagttacagagtcacctgcccaaacttcgtgcaatacttactggctacttgatttctaaatccccgctatgtaaaccacgactccaccctcagtcaggcaggtttcactaactgactgatttttacagtggatgatttagaaactccactgggccatcagttttcccacagtgcctgcgtaccacctgaaaacagaaatgcacacagattgtgataaccattcccattctagctacgcagtggcacgtaaagaataggcataatagatgtggaacccaatggtcagagaaattaaggcacatctcaaaattaataaacatcaaaactaagattcagaccttggtcttttgactccaacactgaagctgtttctactctgttccactttactccattgtcaactgttatcatttgtctgatgagattcaagacttgaagacatgtcagtgttccaatcagctttcactctgacccttatatacatacagacaactttatcctctgcctgaagtcttgtattttcaatcctgcaccaaattattgattgattcactgatcacttcattcacaaaataatcattttgttcttacattgtgttaaggataaaacttcaaggatctaactgcatattacccttttttttttttacccattgctcctttagggccatctcacactgcagatagttacctaaaatgcacatccacttgtttcattctcttgcgtaaaattcctcaaggttaccactgctgttaggatgaagtccaaactctttaatatgaagtacaagagatgcaaattctggccactgcttccatccccagcctcttttccagccctccttccccttgtgtttcaacaaattcagccactttcagatcctcatggtccttcacatttgcaattctagtgtaagtactgtatactctacctgcacagtttcacccaaccagtttctaccttggctttggggtcaacttgacatcccctcttccaggaagttttcttgatgccagtgtttgggttgggtcctttctgcatccttctcataacacctggacttttccctatcatagcacttatcacactatattgtcattgtctgtttacttctccgtatctcccacttgccagtgacccaggaatgatatcagtcttgttaaccattgtatacctagtacctatcacaatgccaggcacacagtgtgcattcaataaatatttattcaattgactcaaatcacactgaatggaattaactcctggtataccttgtgtgctctggcttctcccagactctgtctgtggcattctccctcacctcccaacatacagacacacataccacacacacaccctgcatttctgttatgccttttcttccattcttccgctggttaaaggccaaatcctaggcttctatcttcttcctctgacctcctttagttttccttgatgccacctccttgacctcagggatgcattatagtaactttatgtttgtatgaaaactctctgaaaagcagagactatctcagttgcttccttgcgtggctcatttgtctaggangggggaaattgcgcaaagtaggtatcccatcaacatctagtggttaattaactgatttgctatgaagctgtgtcaactctgtggagcctatctgattctggctccaagaaagaattagttggtagatagagattgccaaagggaaaggtctttatactgatttttataacaatctgaactcctagctgggggaaaatgcaggtatggcttatcttagtgtgtcattcattcattattaggattctactatatgccgggaaccattctaggccttggaaagaaagcagaaaaccagacagtttctggtttaggctgatgggaaagaattttcccagcagagtaccttgcgtattgcacacctcaataaatatctccagagtaaaggaatgaatgaccctcgtggtcacagcaacgaatcttaaaagaagaaaccaatatattttaaagtcatatttatatananacattaaactaacattttgttttctgttaaaaaagcctnnacn

SEQ ID NO: 88049 - DNA, 361 bp, Homo sapiens
atccatcttgagttaatttttgtatgaggtgtaaggaaggtgcccagtttcaattttctgcatatggctagccagttttcccagcaccatttattaaatagagaatcctctccccattgcttgtttttgtgtcaggtttgtcaaagatcagatggttgtaggtgtgtggtcttatttctgagatcactattctgttccattggtctatgtgtctgtttttgtaccagtaccatgctgttttggttactgtagccttgtagtatagtttgaactcaggtagcagagaaatacttttaacaatttgaccaaatattccctaataaatttgactgtgtttaaaaggaaatggagtttgtaagaa

SEQ ID NO: 88050 - DNA, 246 bp, Homo sapiens
tgttaatgtacttgcctagtggattcttcctgcctgctgcacagacaaaaccagttcactgagaccaaggcattgcagtaaagaatttaattgatgaaggcctgctatgccacatgggagacagagttactactcacatagtcccctgcaaaattcggagactagggtgttttaaggatagtttagtgggtcgggcggcggggggttagaggaatgggttcttttgattggttgggggtgcaatca

SEQ ID NO: 88051 - DNA, 576 bp, Homo sapiens
caggatagagtagtgcaggaagtaatgccagtattgactgttacacgttgcacttttataggcataactcgcctaattcatgcaacagccctgggggttaacagatgaagaaactgaggcgcagagaggcgaaccgattaccttgcccaggctcctacaccacctcctatcctctggctgcagctgcagtgtgctttggaggattcggaggcctctctaggtggcaattattttgcaaggcaggtcccacagaggcacccccagcagctttatcttgttgctgatgctggtcctgcatgagcaggtatgaaggccagaaagtataactcagagggttttcccggctccggggagctcgcattggagccagcagtcagtgtctggacaggcagaagtccagtgaggaaagacatgggcttccaaggtgctgcatggacctaagcctgagccatcacccatatgtccacatccagtgtcccagtggggagttagaggaatggttctcatctccaggaaagacactggactgataccaggtggcatttgtatgggaaagaatccctcaaatgtaataaa

SEQ ID NO: 88052 - DNA, 378 bp, Homo sapiens
ctgttttgaaaaatgagttctgctagtatcctgctgtgatcatttggtcataaatcagacttggttccagaacatgagttacatttgaaaactgataaaacactgagaatacgcaaaggaaactggcctaagatctggcacatagtgggcactccataatgtttgttgaataagtaaatgattgcatgaagtttatttacagtttttatccaagattgtaggggatctcatcacaagatgaccaaaagagtttgaactgtgtgtgctatttagaagatttaacttttatgtatctatagataccacagctgttgcttctgataaatttacctaccttttaactgaaagtttaataaagccaaatcaatttgaaatact

SEQ ID NO: 88053 - DNA, 343 bp, Homo sapiens
aaattacggatataataacatttgggtacttaaaatgtgttaggcactgtgcggagccctttatatgcattttcttcatttaatcctaacaacagatgtagaagaggtactattatctctattttacaaataaggttgagtgacttgtccaggtcttctcagcagtttgagtggcagtgctgtaatttaaagccaggaagcatgattccagatactgagctctttatccctatgtagtttactgcctcatcagtgaagccagtacagaaggttaaatttcatggtgagttaacttttaagatttaatatctctaaatcagaatcttccctaagcataccaata

SEQ ID NO: 88054 - DNA, 411 bp, Homo sapiens
agacaggcagctgatgtcctcatgaccttccccagtcctcccagccttaaagacgacaatcataacccacccagagctcttcatacttcctgcagccggttcatccacaataggtcacaagatgggcatcaccacccaggaggctggccgctcaggagacagtgtgcctcctttacagatggagaaactgaggtcctgactaggccaagcacttcccagggcagggatctaaatagtgggaagtcttctggcttctggatagggctcaagctgagagccaggttgcaggccaggtctgggccaatggaatctcggccagggcgggtgcaggggcctgaggccacaccccagaggtgtcactgggggcctgcatccgtcttgtccctttccctgagggatgaagcagcccct

SEQ ID NO: 88055 - DNA, 578 bp, Homo sapiens
ttcttcaaaaaccttttcaaaatgcctgacttttcctggaaatatatcctcactaaaaacataaagccttttatcatggatatagctcactataacatcaacatcaatacaactggttaaaaggtaaagtctttggtgattaaacaaggatctcttcttccagatacccattcctgatccttaagggaatgtgacccctctcttcttgggttcccctaattctctacctctcttacagcatgacatacccaaaggatgtttatttgtttgtatgtctcttctccgatccaattaactgtatactcctagggggatggaaccgtgacttctctatccctatatctcccagggtcatcacaatgcctggtatctgagttcaataaaatgaaaaagatagttgaagaatcctcatattaaaataaaattcactttttgcaaaaaacaaacaacaacaacaaaaaacatgacacaaaaaacaacaccaaaaaataagcgcgggcgccgcccctagatttctccccctggggaggcccccaatctcgccctgccccccgttgcttttacacaagggccaccct

SEQ ID NO: 88056 - DNA, 279 bp, Homo sapiens
gcaaccatccaagcccatgcaattcttcctcggttacttagagtggtttccatttcacacactaatagaatggtacatgttacatgaaaagtcagtagcaaaaacaggatgataaacatatgatagcagagtgaagtgacttgaagacagaaatattactcagtttttgtttttgtttctgtatgaatgctttaagaactttttttttttttttgagacagagtctctctctgtcccccaggctggagtacagtggtgtgatctcagctcaccacaacc

SEQ ID NO: 88057 - DNA, 2118 bp, Homo sapiens
ccccacagtgagaggaaggaaggcaacagtcgccagcagccgatgtgaagaccggactccgtgcgcccctcgccgcctctgcctggccacatcgatgttgtgtccgccgcctgctcgcccggatcacgatgaacgcgcagctgaccatggaagcgatcggcgagctgcacggggtgagccatgagccggtgcccgcccctgccgacctgctgggcggcagcccccacgcgcgcagctccgtggcgcaccgcggcagccacctgccccccgcgcacccgcgctccatgggcatggcgtccctgctggacggcggcagcggcggcggagattaccaccaccaccaccgggcccctgagcacagcctggccggccccctgcatcccaccatgaccatggcctgcgagactcccccaggtatgagcatgcccaccacctacaccaccttgacccctctgcagccgctgcctcccatctccacagtctcggacaagttcccccaccatcaccaccaccaccatcaccaccaccacccgcaccaccaccagcgcctggcgggcaacgtgagcggtagcttcacgctcatgcgggatgagcgcgggctggcctccatgaataacctctataccccctaccacaaggacgtggccggcatgggccagagcctctcgcccctctccagctccggtctgggcagcatccacaactcccagcaagggctcccccactatgcccacccgggggccgccatgcccaccgacaagatgctcacccccaacggcttcgaagcccaccacccggccatgctcggccgccacggggagcagcacctcacgcccacctcggccggcatggtgcccatcaacggccttcctccgcaccatccccacgcccacctgaacgcccagggccacgggcaactcctgggcacagcccgggagcccaacccttcggtgaccggcgcgcaggtcagcaatggaagtaattcagggcagatggaagagatcaataccaaagaggtggcgcagcgtatcaccaccgagctcaagcgctacagcatcccacaggccatcttcgcgcagagggtgctctgccgctcccaggggaccctctcggacctgctgcgcaaccccaaaccctggagcaaactcaaatccggccgggagaccttccggaggatgtggaagtggctgcaggagccggagttccagcgcatgtccgcgctccgcttagcagcatgcaaaaggaaagaacaagaacatgggaaggatagaggcaacacacccaaaaagcccaggttggtcttcacagatgtccagcgtcgaactctacatgcaatattcaaggaaaataagcgtccatccaaagaattgcaaatcaccatttcccagcagctggggttggagctgagcactgtcagcaacttcttcatgaacgcaagaaggaggagtctggacaagtggcaggacgagggcagctccaattcaggcaactcatcttcttcatcaagcacttgtaccaaagcatgaaggaagaaccacaaactaaaacctcggtggaaaagctttaaattaaaaaaaatttttaaaagaccaggacctcaagatagcaggtttatacttagaaatatttgaagaaaaaaaagcgttatttatagtccaaagaaaccaaagacttagctcacctgcattctgactttgtttggagacacacacttcagcagggcggcgacttggcaagacaaatgatgagcaggaaaacaccactggatctcacaccttcaatccatgaccatcctcgctgtgcttggctgtttagtggtttggagcatagtgattttgagccattgagcggacatcttttaagatcgaactttctcatctgttctaccatgccacgaaggtgtatggtgtctcagtactaccaccaccagtggttacagacttaggcagagctggtcttcagaaatggttgttctataggagtgcaaccaacatggtatggggttgtctgagttcattggattaggagtgtgattttgctcgtctagcctaacgtttgaacctgccaggcccgcaacctaaatgcagattcaaacccagcaaagaaaatttgaatgac

SEQ ID NO: 88058 - DNA, 964 bp, Homo sapiens
gaactttcataattacattacaagtactggacatctgattaaatggtatcattacattcatattttgttagaagggaatttattaccagataaaagctgtctcctcctcctacgcccaatagttataaaattttaaaaagacacatttacaagtcacaaccacagggatcaaaataacatttggcaggtcaactcatagaaatgaagaaaagcttttgtttcttcagtggatgagtatctctagggttgtgaaactactaaatttctttgcatataaaaatcacaataaagcatcacattttattattgtaattaatacaataaaaaactaaagctttataatctccactactacagagctttctgcgcaatcttaaaattacattcctctttcagatcccatttacctttttcactgtagcatctccttcaacgcccttcttagcattctgatcccatcccaagttccaaaaggttaaaagtcctgtgcattacgttcaggaccgcaatgtacttagagaagctcaatattttgaatgaattaacgaatactaaactgtccttccttccctcatccagttagaatggtatgttacatttattccccactcaaaaattctcagatgtagggaggaagattaaaaagaaaactcccaccttatggaaagaaagtggcaggaaattaaatgagatactatgtaatcttaatagacaaactggttctatcctctttcccttttttgtttccacaaatttgcttctgcttaagtgacaagactctcgcagacaagtcaataaatcaggtccccatcctgctttacctattcaacatctctagctctctgtaggatggtgaaggagaaaagggtagagaaaattgggcaaattctataataccatttggtactatatatttcatcttaaatcaggttttagttcaacatctgtgtattgccatgcaaga

SEQ ID NO: 88059 - DNA, 485 bp, Homo sapiens
tgaagcagtaggcaaggtgtctgttttaaagtccaccttaaagataaggaaaccgagactctgataggatgtttatcctatcagaggtggtaagtggctggacctgaccctttctatgccccgtgtctttctaatttcatcaaatggataactttctatccttggagttgcccttggtcagagtcagcagagaggaagaaaagcagtatgcctgttcctgcaatttttctacatcaacatcattaatttccaagtcattttcattgtttgagagtgggtatatgtatgcagcttttctaaagcatagtgtactcagttgtggatttttttttctaatggaatcaagtaaaaggcattaaaaaggggtaagtcaaatgtgtacaaaggaaaagaattccatctacatgcgcatttttttccataggatttcttccattcttggaaatgatagcataaatgacctgattgtagttataagtcacagg

SEQ ID NO: 88060 - DNA, 252 bp, Homo sapiens
ctgagttgatctaaaagcagatgctgtagctgcctactttaacccatttttcaacctgtttgttttttaaagggcttcactaagggttgatatgtaccattgtagggggcaattttaagtcagctaaggcaataaccttatgcatgaacatttcccagactttcatgaagctgttgaggtcctaggcaattaatgcggcagttgtgataaataaaaacatctcacctaagtctccttttcttcataatatag

SEQ ID NO: 88061 - DNA, 366 bp, Homo sapiens
gtgctaaagccatgcaggaaggaggaaataatcagtgagccacgggctgaacttgtggaaaagaaatggagggcaaggtcacaaaccagtccctaactgcttctaatttaatgtaatcctcactgtttgtcattattgcttttgatggccatgaaatctgttttttcccagttctctagtgtaatttggaattaatttcccagctgctttattttttttctagaagagtcggggacattttcaggattagtagaggtgtttctacaacaccttcatgccttcgatagtgtgtaagagttcaccaattgaattaccttattctgttcagaagtagtaactatggagtttaaccactctggacatatt

SEQ ID NO: 88062 - DNA, 366 bp, Homo sapiens
ggtcacgttttcatgtacttattggtcattcatgtgtcatctcttaaaagtgttcaaatcttttggtaaattcatgtggctgagtgcagtggctcacgcctgtaatatcaacacttggagaggccaaggcaggtggattgcttgagcccaggagttcgagaccagtgtgggcaaggcaacatggcgaaaccccgtctctactaaaaatacaaaaattagctgggtgtggtggtgcctgcctgtaatcccagctactcaggaggctgtggcacaagaattgcttgaacctgaaaggtggaggttgcagtgagccaagattgcaccactgcattgcagcctggatgacagaacgggacttggtctcaa

SEQ ID NO: 88063 - DNA, 187 bp, Homo sapiens
tcataacctttgggttgctctggtattttgacacatttgctgggttctgagccacatcctggaaggccaccataacttctggatcctgcatggctgcaagaacctctggatcactaagaatttcattgaatccaggcattccagccattccagacatgccccctcccattccaggcattcctctggg

SEQ ID NO: 88064 - DNA, 341 bp, Homo sapiens
tgatgtcttaagtcaaacctataatttactgttattgaaatttgttgaagtctgccttcaagtataaaaagctttttcattaattcgttatatgggatacggcatagtggactatatactgaattgcaggccaggttctgccctcagccacttaagtccaaatacatcactttatattttagggcctcactgtaattagcataaaaagaacctctttcctctgaggttgagacaaacagcctgccttgtaggggaagtcaccttataataaaattcccttaggtggacaactaagtgagttctacattctctccttctctctctttccccatctctctccc

SEQ ID NO: 88065 - DNA, 481 bp, Homo sapiens
atttcagtaaacctctgcttactgctattgattaagatatttcagttttatgtaattttcaggatgggagctggaaggcttttaattgatgaaggtaaagaatgtctcctatgagcaagagaagtcaactggacatacaatagcatgatagaaaatttgggggttttctcctataattatttgtattcttactgagagttgggaggaaaagggacaaatggttacaggagagctctttgaaaatgaataccttgaaaaagaggttgtgattttagcagtatcgtgaaccacagagaggcctgggaagtgaagtagatgtttatgcatttgctggtagttgagtttatgatggagagaggaaaatgcaaagacaaaaacacttaatccctctcacattagtatctgattagaaaataattattccagataattaaaaataattgttttgactactagttgcacaaaagctgtaacaaaattt

SEQ ID NO: 88066 - DNA, 140 bp, Homo sapiens
ttcagccaagggcaaagggaaaaccagtagctataattaacttagactttcaagaagactaaactgaagtttcatacccaatgctgctcagggaaaaaaaaacccaaattaccaggagaccattaacgatagaaaattga

SEQ ID NO: 88067 - DNA, 464 bp, Homo sapiens
cctactaagctgggaatacaggtgcctgctaccatacccggctaatttttgtatttttagtaaaggtgaggtttcgccatattggccaggaggatcttgaactcctgaccttaagtgatctgctgccctccacctcccacagtgctgggattacatgggattacaggcatgagccatggtgaactgcctaaagttattaaatagtaattttttcttttgtttacttctgggtcctattttgatgtcctatgatattcaatgttctcatagtgccctttagtttctgagtcatttcaaataactagaagaatactgaatgtactcaacgtgaataaatgataaatgtttaagaatagatagatatgcctattaccctgatcttatcactaacctatatcttgcaacatcactctgcattccatgaatttgtacaattattgtgccaaactaagaaagtaaattca

SEQ ID NO: 88068 - DNA, 554 bp, Homo sapiens
gtcaatttaaggtttaattaagagataaattatgcatatctatcataatcagattacatttgtatgtgtatttatctataaatatgaccccaattttagttatggcttatattctttcttagctgatttttgatggtagttttatcttgtctaagtgagtacttatggagatagtcttattatcaccatgtgtttaacaatgaatatatatttgcttttgtgagagacacttctatgatttgaaagtaaatttcaaaaagatacataattgttttttttttttttttttcagtttttctttaaaaaaaattgcttaaaaacacgtaatataaaatttaccaccttaaatctattgaagtgtgcatttcagggccaggcttggtggaggctcttatttgtaatcccaggattttgagaggccaagactggaggatccatggagcccaacagtttgagaccagccagggcaacatatggtgacacctctctataaaaaataataataataatagccagccatagtgatgtgcagctgtggccccagctacttggga

SEQ ID NO: 88069 - DNA, 955 bp, Homo sapiens
gcggccgcctactactactaaattcgcggccgcgtcgacctccagagcaccagcactggcactggcactggcacacgctatggcaaatgaagtgcaagacctgctctcccctcggaaagggggacatcctcctgcagtaaaagctggaggaatgagaatttccaaaaaacaagaaattggcaccttggaaagacataccaaaaaaacaggattcgagaaaacaagtgccattgcaaatgttgccaaaatacagacactggatgccctgaatgacgcactggagaaggaacaagttcagctgggagtgaggaatgaaaggcaggtccagccttttcaccatggttgcagctggaaggaaacaagtggatttgacacaagctcagaggatccagaacggctgttcctgtccatgtgcctggtcacggtgctggggaacctgctcatcatcctggccgtcacccctgactcccacctccacatccccatgtgcttcttcctctccaacctgtccttgcctgacatcggtttcacctccaccacggtccccaagatgattgtggacatccagtctcacagcagagtcatctcctatgcaggctgcctgactcagatgtctctctttgccatttttggaggcatggaagagagacatgctcctgagtgtgatggcctatgaccggtttgtagccatctgtcaccctctatgtcattcagccatcacgaacccgtgtttctgtggctttctagttttgtagtctataaatactactcaggtcttttagacgcccaagacttgcacaactttgattggccttacacaaggacctgctatacgaggactgtggaaattccttaataccatcctgtgacacccttctcaagttccccgtattgcatgtgtgggaccattcagcaatcacataatccatgactaccctgctagcaacaaatatac

SEQ ID NO: 88070 - DNA, 581 bp, Homo sapiens
gcggccgcctactactactaaattcgcggccgcgtcgacctccagagcaccagcactggcactggcactggcacacgctatggcaaatgaagtgcaagacctgctctcccctcggaaagggggacatcctcctgcagtaaaagctggaggaatgagaatttccaaaaaacaagaaattggcaccttggaaagacataccaaaaaaacaggattcgagaaaacaagtgccattgcaaatgttgccaaaatacagacactggatgccctgaatgacgcactggagaagctcaactataaatttccagcaacagtgcacatggcgcatcaaaaacccacacctgctctggaaaaggttgttccactgaaaaggatctacattattcagcagcctcgaaaatgttaagcctggatttaaaacacagccgtctggccagctgcctcgaatatctgacagcttagcaaaaagggccaaagctttccataggcgtgctgcacttgcttggtaaattaaacagcttttgtatcttcccctttgactttaggtaataaagcatccaaacttgtaaatctgaaaaaaaact

SEQ ID NO: 88071 - DNA, 144 bp, Homo sapiens
gtggggcagccacagctggcattcagcctccagagcaccagcactggcactggcactggcacacgctatggcaaatgaagtgcaagacctgctctcccctcggaaagggggacatcctcctgcaggtaggctgccacctgccct

SEQ ID NO: 88072 - DNA, 468 bp, Homo sapiens
ttttattgaaaagaaaatcccatttttgtttttattgtttagtgtgctgagaattgtattaaagagtcacagaatttcatatgaagaagggacaggaagtccttggctctagcctgttcttactgataagaaatgtgatctaatggccattttagtgtgtgtgtgtgtgtgtgtgtgtgtgtgtgtgtgtgtgacaaatgctttttgaaacaggcttaagtgtatagcaggaaacaacaattaactggtttgtaattctatttggaataatgttttagccatgtcactggtatatattttgtcatatacacaaaaggagtcaggttatactatattttaagttacagcacttgttttcatcttatttaaagatttcatttatccaatggattcctggcttttagcaaaaaaatggaaatgaagtaggattttgccacagatttaaaaaatggaatgaaagggaattaa

SEQ ID NO: 88073 - DNA, 372 bp, Homo sapiens
cagaagtcaatcagctacgcacccagttctcaaagacctcacatgctagggaaggtgcggaggcagagttgtggttcagaagcagttacaggtctcaaagcaagaacagcagccaaagcttccacgccctgacgctgcctctgaatggtaaaccaatggcatatggtatccacagctaggctttgcttttttctgagtgaaggtaaaaggcatttgaaaataaaccaaagtttcacagactatgtttatggaacaaacatgggccattttcagggatataaaagtcgatgttctatgtaggcccccatatgagtatttatctactttatttacttatttatgtatttattgacagggtctcactctgtcgca

SEQ ID NO: 88074 - DNA, 658 bp, Homo sapiens
tcaagtttgtaagaacttaaaagtacaaatcatgagtctttgggaaaaaaccgcccaataatgaaattcaactaaagaagaaatgaatcaaattaaggacttaggaacaaagaatcagtaaaaggagtgttagtaaacacttcagaaactttaaaaataatgggcaatgattataaagtcaaatattatgaacactgtctatatagaaataacaagtagagtgtgctggtttcatctttcatagcaggaatcacgtacagtctctaattaaaacatacatgaagctagaaaaaaaaatagcctctttattgttttccgtaattgtccttaattttaggagaaatcttacaagactagattctcttgtggggaaaaaagtatttaaattgagcattttttcagtttcacacttgttttccttttgttaatttgctatatttgttaaatatagcatatgagcccacttttgtaaaactatttgtatatatgtgcctgtatgattaagagagatggttggaatgaatgaagttcaccagatagtacttctttctggctgatgaacttttgaatgatttttaaactttgtacttttatataatgcttattttctttttacaataaacatgttaatttctacaaggaagaaatgagttgttgg

SEQ ID NO: 88075 - DNA, 270 bp, Homo sapiens
aaaaaaagaaaaaagaaaaagaaaagaaactagggtgacgccagtagaaatggaaacaagggggtgagctgggaaactattttgaaagtagaagcaatggaaattagtaattatttggtaggaagatctgaagagtcctctgcccttcccccgtgaggcaccatgcatgcttccgcaagggagtaggttgccctgcgctgtagtttgctgctggcattccttctctcctaataggccctgtgctccaggaagagcatgaatgagaagaat

SEQ ID NO: 88076 - DNA, 571 bp, Homo sapiens
taagtaacaggcattttattgatgtggcatctgagcaaatcccattgccacctcacagtgtagaaccagtagaactaagaatactccagcctgtgcccccacccagccacctgccccggcccctcatgggaaatgacacataccctgaaagacaacagctccctttctgcttcggacaccactcaaacatttagacgcagctctatcccttttcctagctagagaaggtgatgccttcttccattactcagagatgttgagacgttttcagaatttcttgttgaaatgaaaaacatcaagataaaggacgcctttcaggcattagctaaacttccacttcataactttcggcgagacatggtgagcctcctggtgtagagttcttttgtctttgtatggaatgactttttgctgtgatggttttgaatgttgggtttctgctgtctgcttagtacccatgcctgaattttttgagattgtaaatatcaaaggagttagattgtgttctgacatggttgtagactttcacctggattattgatattctacttctaataaatttttaataggc

SEQ ID NO: 88077 - DNA, 1437 bp, Homo sapiens
gcggaagggtgcggcgaggcggaatggcggcggctgcggactcgttctcaggcggccccgcgggggtgcggcttccgaggtcgccgccactcaaggtgctggcggagcagctgcggcgcgacgcggagggcggcccgggcgcgtggcggctgtcacgggcggcggcgggccgcgggccgctggacctggcggccgtgtggatgcagggcagggtagtgatggcggaccgcggcgaggctcggctgagggacccgagcggggacttctcggtccgcggcctggagcgggtgccgcgcgggcggccctgtctagtcccaggaaagtatgtgatggtgatgggagtggttcaggcctgcagccctgagccctgcctgcaggctgtgaagatgacagacctttctgataatcccatccatgaaagtatgtgggaactggaggtagaagatttacacaggaatattccttagagtatgttggaactgtcgttaaaaacaaccaaaatcccgaaactatttagaagcttataatgatgtggatttcatggacacttttcaatgcgtatttttcaaatgcttctcagagagccttgctttggttgaccaaggagtccggatgtaggaatgtttaaatcctcggatacttcagtgacacagcctctgctgccccttgctttgcctgtgtttgctgatgaaaagcagatgcttgtgtttcattttccttcctggtttgtgtgtgttaattctctctctctctctcagacacagaagtctcatgttgcattttccaaattttatgagtgatgatactttttccattactgctgcgtccctgttttacaatgcaaaatttaagtacggtcattgcccatggtgattaaagtgtggttatgggcaggaagacagactgtgtaaaaaaggaatgacatcctggctcctcatcttcttcatcagcaactaccataaccagtttgcgagtcaaatggcatttcctaacggcaggcatggcggcccctgaaagacaacagctccctttctgcttcggacaccactcaaacatttagacgcagctctatcccttttcctagctagagaaggtgatgccttcttccattactcagagatgttgagacgttttcagaatttcttgttgaaatgaaaaacatcaagataaaggacgcctttcaggcattagctaaacttccacttcataactttcggcgagacatggtgagcctcctggtgtagagttcttttgtctttgtatggaatgactttttgctgtgatggttttgaatgttgggtttctgctgtctgcttagtacccatgcctgaattttttgagattgtaaatatcaaaggagttagattgtgttctgacatggttgtagactttcacctggattattgatattctacttctaataaatttttaataggc

SEQ ID NO: 88078 - DNA, 277 bp, Homo sapiens
atcaatagaaggaaaagtttaagccgatttaaaacttaagaatataaattccctacacaggtctgttgagaatgttcttcctgtaagtttctgaaagaaagagtctttctttctggaaacgaagcagtgagtcttaatagttatgaagttagttataagtgtaagtgaagaagatcaatataagaatttgtgctcatattgttttactgctccaatttctactaatctctccattgttagataccaaaatttttatgtatacttcttaatggtatat

SEQ ID NO: 88079 - DNA, 431 bp, Homo sapiens
gcgcccagcctaaaaaatattttttaaatgtcagttgttaatattaccaatcttcagaaaagactaagtattgggaagctatcaagcacatgaatacaagttttccaaaattctgtttttcactagaaagcttaaactttatcactggcaacaaatactgtcacttgttttatgtgacaggtttgctttactcattctcaagaaaatgactgccaaatacccaagtgtgaacaactgtaatttgtcagttgttcttcaggtaaaatagtattccataaaaaagcagctagttcagcatgcaactctaataataacacaagtgcttttcctggtaaccatcatgttttggtatgcagcagaaacattttagtcatacttcctcttatttttttttttttcttttttgacagggtcttcactctgtcgtccag

SEQ ID NO: 88080 - DNA, 1046 bp, Homo sapiens
ccctccagatctaagggtggggtggtggcatgtttcttgagttggttcctggaaagggagctgaaatggtttaatcgctcttccatgaaacgcaggcggtgaggacagccaccagacaggtaaacacactgtgcattgatccttttacgacttttgtgaaactgatggacaggcaggcagggaggagtcctgggagagagtctggggcactccatcttggggtaactcttttgctctcctcctttaattataattattaaataattaaataataaataattagagaagtgcacagatacatatgcccctggacgttcagatcagcgtggtggataatagtaacgtttcagaagtagggtctggttaaataaactactgcacatctttaccaagggatggtgcttcctatggaaaaagtttcctaaggaaaaaggttcctgtggaaaaaggttcctgtggaaaaaggttcctatggaaaatgctttcctgaagagcacatgctttgaaggtggccagacttgggtggaaactgaaactctgctagtgactagatgtgtaattcagggaacattccttcactctttcagcttcagtttccttatctttaaaaggaaatgatcataatagcacttatgctgctgtgagatttaaatgagataatgtgtccacagtactcagtacagtgccggacacacagtaagcactcaaacaatggtaatgattattataatgtattttaaaatatgacactatattcaaacataccattataatatgtcaaatgggaatatggacagaatatatgagacaacctgttcacaactgtttaatgaggaggttatccaacattaggaatgatttgatccttcaataaaaaatcaatgtgtgaaggttcctaggcataaaagaaagttcagaaggatatgtaggaaatactgttgtctctctggggattgggattacagggattttttcctcttttctttttgttaagtttgtgtttcctaaagtttctgcaataaacatatgatgcttgtataataaaa

SEQ ID NO: 88081 - DNA, 359 bp, Homo sapiens
actactactactaaattcgcggccgcgtcggcgattattataatgtattttaaaatatgacactatattcaaacataccattataatatgtcaaatgggaatatggacagaatatatgagacaacctgttcacaactgtttaatgaggaggttatccaacattaggaatgatttgatccttcaataaaaaatcaatgtgtgaaggttcctaggcataaaagaaagttcagaaggatatgtaggaaatactgttgtctctctggggattgggattacagggattttttcctcttttctttttgttaagtttgtgtttcctaaagtttctgcaataaacatatgatgcttgtataataaaa

SEQ ID NO: 88082 - DNA, 785 bp, Homo sapiens
aggaaaagtgaccgtcttcctttggtgtgagttccctgagtcttcacacaagtagattcacacagccgttggcaggatgcagaagaggtctgtcaccctgcaaaactctccgtgctgtcccttcactatcacaccgtccccaccattagccccggcaaacactgatctgttctctcactgtacttttgtctctgctggaactttatgtagatggcatcgcgagacaagtaacctgttgagactggcttcccgccatccacataatgtctctaatgagattcatccaagttgttccctccctgtatccacaggtcgttccctctcagatctgagtggtattccattgtatggatgcctacagtttatctgactgtccgctgagggtggtttgtgaaaaccaaacaaggccgctatccaaaatgcaaacaagactgctacaaacactggtgtgtgggtttctacaaggctgcgcgctttcacttctctgggggtaaatcttatacccaggagtggggcagccaagtcccacgggaagtgcgcttttaactgcatcagagatggccaaaccattttctacagtgcccgtaccacctgccttcccgccagtaacactggagtgtcccagttcctctgcatcctcccaggcacgtggcctcgtcagtgttgctgagtttcaccattctgaagccatgtgtttcgggccctcatcctggttgtagtttgtcttccctaacctgtaatggcgttgagcatcttttcctgtgctttttcgccatgtgtatatc

SEQ ID NO: 88083 - DNA, 406 bp, Homo sapiens
ccaactccaaagtcatcttcttaaacactagtgctaacttcttccatgaagcttcttgtgattacaccagcccaacatgcgatatggtcacagcatgggatggtggtcaggaccctttgatggttgaggagatgaagacccagaaaggcaaggggtttggcctagggagcctggcaagtgagtgacagagcctggtctaaagtccaggatatctctgttgttgctgttttccttttttcgttaattgcaaaagaatttacatgttcatagttaaaaacagagaagtgtatcaagtagaaaacagtagcaaactctcacccttattctgacactccagagttgcattcactctcaggcatccagatcctttccccatatacaaacatccatccatccatatatctat

SEQ ID NO: 88084 - DNA, 393 bp, Homo sapiens
ttaaggatagggtccaggcctagaatgacagaccagaagagtttaactagagagtgtgtgccaattacatatgtgatcttgtatctgaactttctgaaaacccacatcatcacctccttgtttaaaacccttctgggtttcccgttgcctgtaagtgaaagctgtttaacatcgtctgctggattcgacccctcctgctcttcacactctgctgatccctctctgccagccacactggcttttgggacttcataattgcagagctcctttctcaacaggcactgacgttctctctgtctgagctctccctctttgtctcattcttgagtgctcagctccagctgtcactttctcagtgaagcctttctggactcccctactttgtgctcataa

SEQ ID NO: 88085 - DNA, 351 bp, Homo sapiens
tgataaataaagaagttcaaaaaaatcttttaatagaagctataaaatagcagataagctaagtcattctcataaaacaccatttgtcatttgaatgcgtgcattgtggcctgttacttttaactagtctcactaatttatagttatatatgatgtagatctagattgtgatgtacactaagtgggttgatcctgagatcaagctatgattgctgcttgcgtaaagtgttccttttgggaaataaataatctttcatatctgtaaactttggtataattggttatttatgcaatgtattgttgtggttgtcaactcaagattgtattctcatctggggacattatgaatct

SEQ ID NO: 88086 - DNA, 272 bp, Homo sapiens
tttctttatctctaggattcctattagttgtacattggacatcctggactgattctgtaattttcgtatcttttttctcccatgttccctttatttgtcttttggttctgctttttgggagattttcttaacttgatctacctgaggctcagtcctcatctgtaaaatgctgataaaaggacctaccacctagcgttgctgtgaggtgtcagtgaaataaaatgtaaaatgcttagcacagtgaactttaataaatggtagttgtggttgca

SEQ ID NO: 88087 - DNA, 415 bp, Homo sapiens
tgatctacaggatcttaactggcatttaggaggctgaggcaggtggatcacttagaccaggagtttgagaccagcctggccaacatggtgaaaccccatctctatgaaacatttaaaaattagcctggcatgatggcctgtgcctgtggtctcagctacttgtgaggctgaggtgggaggattgctccggcctgggaggttgaggctgcagtgagctgtgattataccactgcatcccagcctagctgacagagcaagaccttgtctcaaaacaaaaacaaagaaaacaaaaacaaatcagacagaggcttggtcctcagtcagacagctcctggctttctggaggggtctttctgcatctgacttcttctgataccttgtctcccagcttaggcatcctgagccccccatgatg

SEQ ID NO: 88088 - DNA, 468 bp, Homo sapiens
gatgatattgatatttcaaacaccttgcagtccagttaaatgatacaaaagggcagatgatgtaaccccccaacaatgaagttataattacctttgctgtaatctaatttaggtgttttgttttacgattctcatgaaataatataggcagtccatatataagaaagcctatatccaaagatcctgaaagaattctttgaggaaaaagtgaaaagataggctaacatttgtatagctagattcaatcctttcctctaataatggaatgttaaaatagcaaacaagaacaacacatataagtgaaaaaacaacatatatctgaatatatttatcagaatataacctctggcaacagacaaagaaatctatcatttttaaatacataactctcactatattgtatacttttctttttcctcaaatctaatccaattttccaagtccattttttatgagttacttgttgaa

SEQ ID NO: 88089 - DNA, 2141 bp, Homo sapiens
ccagtctgatctcgtactcctggcctcaagtgatccaccagcactttgggaggccgaggcaggtggatcacgaggtcaggagttcaagaccagcctggccaagatggtgaaaccccatctctactaaaaatacaaaaattagccgggcgtggaggtgggcgcctgtcagctactcgtgaggctgaggcagagaattgcttgaactcaggaggtggaggttttggtgagctgagatggcgccactgcactccaacccgagcgacagagcaagattccgtcccaaaaagaaaaagcagtttttgccatcagcaaggatatctcctccactttaatggacaggcctcatttttggcagctatgctgtttgagatgtagactgaatatccaaggttcctccctagctcaagtttttacttgtgattacacacaccacattgaattccgtcttcagaggcaaagatttgggcttcatatctcaacagcaaaagggcctgttcagcaattcccttcattttagactcatatgacctcagcgattgcatgatagtagtaaactagtctcctggaaataatggatgtaggtgcttctagaatatgttacagaatttcagacttaacctattaatagataaatggatcttgacttaaggtgacaaaatgaaacttttattattgcttaaaaatgctgtgccaatattgtataactagctcctctaatacttttggtattttggatttaataataagaccttaagcattttaaatgtgaacatgttcagggaagtatgctttgatgtaaatgtctcagatctaagttgtaacacaattgaatacttgtggcttattcttggtttaacttaggaaaactggttaaacaatcccccatttgggcctgtcatcattttaatagtgacgatgttctttctgaaatcttcagggtcggagtcaggctgaatttttttaaaaattaaatattatgttcaaattctttcctttttgccattgtgaaaaagcaaaattttaaatgatttctcctgttagaatttttaaaaatacccacaggttggaccatctttcttatgggttgcacaatgaatttatattttaaattagattaagtagaatgtgaagtacatttcagatttactagttttctttccattgttcattttgggttgcctcagattcagtgtatattttaaaatattggttacataataggtactcaatgaaatggtttatagtagaatatctaagctagcactttattttaaaaagtaacttattaatcacacattgatggtacaccttgtatttagcaaatgtttgcatgttgataaaatctcctatgtcttctttcttaaatccagttgctgattttgtaaaatacagttgtgataaagcagcattacgggggggaaaaagctatattccaactggtgttaaatgtattcaacaaaatcttacatcatacagtatttatttcttaattaatagaacttcagtgatatacttggtagatatctcaagccttttgtcttttacacaatggtgctctatcctattgttttcttttcaaagaagcatctgaacacttgcatttctattttcctatccaaaggcatccacatctaagtgtgtttttaaagttgattaaaattatttttctgttaaagcattctgaaagtgtttgtctttacctagaatgatttgtacacactcgtggtcaactgaacatgaatgtcagtagtagtctaattatgggaagggtaaacgtgttagattaaggctcttaaagctctaaaccatataaactatggacttgtatcatgatttaactgttcttagatctttcttacacagtgattcattcctctatttgtacagtggctttatgaaatgttgtgaattgatactgtaatcaataaagtgcttttaaccagaaaaaaaaacaacacaacaaaaaacacttgtgcggggcgcgggcccggaaaaagtttctaacccctcgggggcggggcccagaggtatagccacgtgccactggccagaaacccggccgacccgggtggttccccaaaaaagccgggacgcgtctggacacagggcgggcacggctatacaggccggtaccccgcgcg

SEQ ID NO: 88090 - DNA, 2431 bp, Homo sapiens
ccagtctgatctcgtactcctggcctcaagtgatccaccagcctcggcctcccaaagtgctgggattacagacgtgagccaccgtgcccagccaggtttccttctttaccttctaagaaacatttaaacataatgtgcctgagaaggttaatttgttgactctgtagcatgtcaagaagagtagttttttgagatctggcaagaatattttagagatacatattcttttctaagtatgttatcaccctgtggtgttgagcatatcgtcccaaaaacctgcttcagcaagcagttcttggccaggcatggtggctcacacctgtaatcccagcactttgggaggccgaggcaggtggatcacgaggtcaggagttcaagaccagcctggccaagatggtgaaaccccatctctactaaaaatacaaaaattagccgggcgtggaggtgggcgcctgtcagctactcgtgaggctgaggcagagaattgcttgaactcaggaggtggaggttttggtgagctgagatggcgccactgcactccaacccgagcgacagagcaagattccgtcccaaaaagaaaaagcagtttttgccatcagcaaggatatctcctccactttaatggacaggcctcatttttggcagctatgctgtttgagatgtagactgaatatccaaggttcctccctagctcaagtttttacttgtgattacacacaccacattgaattccgtcttcagaggcaaagatttgggcttcatatctcaacagcaaaagggcctgttcagcaattcccttcattttagactcatatgacctcagcgattgcatgatagtagtaaactagtctcctggaaataatggatgtaggtgcttctagaatatgttacagaatttcagacttaacctattaatagataaatggatcttgacttaaggtgacaaaatgaaacttttattattgcttaaaaatgctgtgccaatattgtataactagctcctctaatacttttggtattttggatttaataataagaccttaagcattttaaatgtgaacatgttcagggaagtatgctttgatgtaaatgtctcagatctaagttgtaacacaattgaatacttgtggcttattcttggtttaacttaggaaaactggttaaacaatcccccatttgggcctgtcatcattttaatagtgacgatgttctttctgaaatcttcagggtcggagtcaggctgaatttttttaaaaattaaatattatgttcaaattctttcctttttgccattgtgaaaaagcaaaattttaaatgatttctcctgttagaatttttaaaaatacccacaggttggaccatctttcttatgggttgcacaatgaatttatattttaaattagattaagtagaatgtgaagtacatttcagatttactagttttctttccattgttcattttgggttgcctcagattcagtgtatattttaaaatattggttacataataggtactcaatgaaatggtttatagtagaatatctaagctagcactttattttaaaaagtaacttattaatcacacattgatggtacaccttgtatttagcaaatgtttgcatgttgataaaatctcctatgtcttctttcttaaatccagttgctgattttgtaaaatacagttgtgataaagcagcattacgggggggaaaaagctatattccaactggtgttaaatgtattcaacaaaatcttacatcatacagtatttatttcttaattaatagaacttcagtgatatacttggtagatatctcaagccttttgtcttttacacaatggtgctctatcctattgttttcttttcaaagaagcatctgaacacttgcatttctattttcctatccaaaggcatccacatctaagtgtgtttttaaagttgattaaaattatttttctgttaaagcattctgaaagtgtttgtctttacctagaatgatttgtacacactcgtggtcaactgaacatgaatgtcagtagtagtctaattatgggaagggtaaacgtgttagattaaggctcttaaagctctaaaccatataaactatggacttgtatcatgatttaactgttcttagatctttcttacacagtgattcattcctctatttgtacagtggctttatgaaatgttgtgaattgatactgtaatcaataaagtgcttttaaccagaaaaaaaaacaacacaacaaaaaacacttgtgcggggcgcgggcccggaaaaagtttctaacccctcgggggcggggcccagaggtatagccacgtgccactggccagaaacccggccgacccgggtggttccccaaaaaagccgggacgcgtctggacacagggcgggcacggctatacaggccggtaccccgcgcg

SEQ ID NO: 88091 - DNA, 2030 bp, Homo sapiens
taatggtatcaaggaaggtactagagcattgtaccatcagcaacgtactgatgccttcccatgcagactacctgctgatactgtgttatgtgggagaaagataagagtctagaacttatgccatggagcatagagcttctctgtggattgaaaacattccactgccctaatgtacaaagttacagggcccacttggaatcgctctctctagctaatgacattccaaccctatcattagcatgatttctaaattgggcattccatttccactcactcagtggagctctgagtacttcactggacatttaattttggaaatgagttttgaaactcagttcgtgaagcctgcagtcgagcaaatgactatatatttgccattaagtttgaggggtttcctttcctatatgctttcagtgatttattttgctttttaaataaagattgtttgtttattacctgaaagttgatactgatttaggaatatattttctgtgattggaatcctcaacaatttattttggaagcttgcagatggctagctttgaaattgaaattgtgtttttctccttcttttctcatacgacttctaagtcatcctttctgacataaggcaacttcagtgtagtctgcacaaaattagtccccttctgatcatgcgtcatataattttctctaaagttctgactatgacaaatcatctggccctcagtctttcaaaataatattatataatattttttaaattatggaactaatatattttccattgtaaaatacttaaaaaatatgatagtataaatatcacatgtaatccaacgatgcagatttatcttaaggagtaataaatatattattttaacatttccagctaacatctcttttctcttaggtggaaacttcattgttgaatagaaatgtttttaagtgaagaagttgacagaatagggtctgctgaatttaaacagccatcaaaagttaaactggaatcttgaaatgccatttgctcggcatagaatcagagccttttagaaacatccatttaagttttgttagaagatagtcaccagttgcctgaatcgaatgaggaaaagcctgcttccagagatggacagtatattatagagtgagatatagagtttaaagcaagtgtgtgagtatatgtatattccatattattggtatatgtgtgtttatatatgaatctgtatatatgtgtgtctttgaatagacacaacatatatgcccctcatgcataattgtgcttattttgccctaattgaggaatttgagacgtattattggttcttctccctctcagatactatggtgggtaaaacccacagcctgaaagggttaaattttccataaatgccactgagtgtacatttgtggatataaataaatatatataatacacacacacatatggcaaatacatatacacacacaatattgcctttagtgctaatgcaagttggatcatgaaaacaatgtaggtaaagtaaagtatgtatttgtctgtgcttgaaaaatattgtaaaatgttatgtatttggaatatattttgtggtttgtctaatatttataaacacaactcggggtgaattcacaatgagtttatttcattgaaatactagagatatgggggccatgttactgtgattggagccttacctttgtatagtgaaatttgcatttctatgtcaacatccagattgttttatatgttaatatggtggcaggaatccctaataaaaatactctggggtaaaaaaacaacaaacaaaaacaaaaaaaaagaaaaaaaaagaaacaaaaaaaaaaaaggagcgcaacaacacaaaagaagcacacaccgaagaaggacaacaaacacaaaggagaggggggggcacaaaaaaaaccgcaccaggaggacaaagcacaaaccaccaagggtgttgagaagagggcgcaccacagaggagagagcaaaacaggcgagggcggccgcgaaaaaaacacccagagcgggagaaccaaggggcacg

SEQ ID NO: 88092 - DNA, 384 bp, Homo sapiens
cttgacatttccttccactgcaggctgagtccaggccctcctggcttgtgccatgtgatgcattacggcaggctcagatgttaatgtagcatctgtgattagaaggggaaaacattgcttttataaactaggttttgttgctgccatttctgcattactcaggcacaggcactaggtctaccttccccctgttctcagtgccctccctctccaaacaaaagaaacagtactctaaacattttttgttcttctctgggttggtctggttgagcaacgatcatcatgctctgatttagtgttttcaaataagtatgccctctgctgcagcactctattgagagacaacacagcccaagcgcgagagttcagcatggccactaataa

SEQ ID NO: 88093 - DNA, 249 bp, Homo sapiens
tcctaatgctatccttcccctgccctccaccccgcgacagcccccggggtgtgatgttccccgccctgtgtccaagtgttctcattgttcaattcccacctatgagtgagaacatgcagtgttttgttctccatccacagaggactttatatatattaattcatttaggtttcaaaactactttgtggggtataataatttctactttataaataaggaagttatttataacctaggttcatttgacat

SEQ ID NO: 88094 - DNA, 514 bp, Homo sapiens
  misc_feature (64)..(64): n is a, c, g, or t
actctagaggatcttacgtactggcattttttgtattttaagtacagacaggtttctccatgtnggtcaggctggtctcgaacccccaacctcaggtgatccacccccccctcagcctcccaagtagctgggactacaggcacacaccaccacacccagttaatttttgtatttttagtagacattgctctctttactgtcacaattaaatgttctaccttactggctttaacttctcatatttccctactgatgaactatgtatgggttgggtagccattattccactgaaagtattcttccaaagataaaaatagctgcccatatcatttccaatgggtgttaatctcccaccataagaatctgtgacacacggatgcatgatctatgaagtgagagatgggaacaacaatggaacgaaaaagatcacaaagtgaagtaaacattttgaggataaaatgagtcaagttaaaaaagctagtaaatgattaaatgaaaggtgaccctagaagct

SEQ ID NO: 88095 - DNA, 439 bp, Homo sapiens
ttaagggctatggcctggttttggaccctgggaagcttacagacagtgggcaagtgaggtccactgtattgctttaagagatacatacacatacacacacacaaggaattctggtggcagtgagggggtgtcttactggggaaaggaggacagggtcggggaaatctttcttgctgaaactattaggattcttgaaggttcattaggtaggttggatatacaaggggaattgggcacaaggtcaaagcactataatacagagagtatgtgaagaatgggcctcccattaatgggtcacacgagcatggacctctcagggtagcataccctgtgtttcatctgtgatacctgattcatctgtgtcctccaagcagaggaagagggtttagctaagcaaggaggttctttctggaaagtggaagtcctgaagtgggtagtg

SEQ ID NO: 88096 - DNA, 1602 bp, Homo sapiens
gttattggcaagttcccctgcagtttgggctgtctctgtggctggttctgcggcgtgcggccagccatggagcgctctgggcccagcgaagtgacaggctcagacgcatcgggaccggacccgcagcttgcggtcaccatgggcttcacggggttcggtaaaaaagctcgcacatttgacttggaagcaatgtttgaacaaactcgaagaacagctgtggaaagaagttgcaaaacactggttcaacccaatggaaatggattgaaagagtgaaagtcactggtctcaaagaatctacggaatttagcattttgaaaatcacatagcaattttgggtaggtattcacctgcactaaaaaaccaggcaaacatccgactcccaggataaagtgactgagagcagtagaagacttgttgagccttaaggaataagaggaaaattacgttatgaagtgcaggaacagcacagacccagacgaggggacgcagcccggagccagtaacccggcgccacctcctccccagggcgcagcgctggctgatccccagataccgtgatcacacgtcccgggtcctgagagcgccacataggtagacagttctttgggacttctgggatgcagcacttgaagagaggtttacctaaactttcctcctgggagcctgtgatcatttgaaagtaacagaagaaagttgtcaggctgaggaaagtttcaacaggcacttggtgagaatgggaagcatccattcattgtgaaatcgcggggacagaggaggaattcacgggatcagagcactgagaaactccagaggcttctggttcaccgccctgattccacagatgtgggtcagaggcagagatggaagttggaatggacaagcctgccctctccttggctctccatggctctgtcctcaggctgtttctgcaatttgacatgaggcctggccccagggaaaccagtggggcctcatctcctccctgtgctgctctgaggtggagccttctcagggtcagtccagctctggagcccctctccagctcggtcaccaaagctgtctggtcccagggcggtgctgagtgacaggcatgccagccaatccaatcggcaatttcatatccaatgcatgtgactgataaagagataacgccctgtctccaagacacaggctttacataaacagctttaatgacttcttcacttagagacaagactccttagtggtggaacctcaggcatccgtgcaggacgtaagaaagctcccgtatatacatgaactgagaagtgtgtagaagaataaatactgtaataggtaataaaatgtatgtatttttatttatgtgctactttgtctttctccctctctgtgtatatacacatacatacaaaaatgtattcattctatggaaaacatgaaagatgtaatattctttacatatgaaattttaattaatgtattttttctgatcatatgaaccccacaaatataattttataatttttttacctaacaataagtcttaaacataaatatacatggacaatatcatagttttttttttaatcataattaaaatggttgtgaaacattccactttaa

SEQ ID NO: 88097 - DNA, 588 bp, Homo sapiens
cgaccataatggattaataagcgcagccagggctggtgaattaccagatctccgtcaagtgcagtaaccagttcaagttggaagtgtgtcttttgaaatcagaaaacaaagtcgtggacaaccaggctgggacccagggccagctgaaggtgctgggtgccaacctctggtggccgtacctgatgcacgaacaccccgcctacctgtactcgtgggaggatggtgattgctcacaccaaagccttggacccctcccagcctgtgacctttgtgaccaactccacctacgcagcagacaagggggctctgtatgtggatgtgatccgtgtgaacagctactactcttggtatcgcaactacgggcacctggagttgattcagctgcagctggccgcccagtttgagaactggtgtaagacatcacaatcccattattcagagcgtgtatggagtggaaacgcttgtagggtttcaccagattatatatattcctaccagatggagataattacagctttaaaaatttttattttttcattttatttcacatattgacattaaatttttatggacacataaaaaaaaaaa

SEQ ID NO: 88098 - DNA, 1087 bp, Homo sapiens
  misc_feature (436)..(436): n is a, c, g, or t
  misc_feature (508)..(508): n is a, c, g, or t
  misc_feature (548)..(548): n is a, c, g, or t
  misc_feature (556)..(556): n is a, c, g, or t
actaggccgcctctcttttcttgctccagtgacaggctcagacgcatcgggaccggacccgcagcttgcggtcaccatgggcttcacggggttcggtaaaaaagctcgcacatttgacttggaagcaatgtttgaacaaactcgaagaacagctgtggaaagaagttgcaaaacactggggctggtgaattaccagatctccgtcaagtgcagtaaccagttcaagttggaagtgtgtcttttgaaatcagaaaacaaagtcgtggacaaccaggctgggacccagggccagctgaaggtgctgggtgccaacctctggtggccgtacctgatgcacgaacaccccgcctacctgtactcgtgggagatggtgattgctcacaccaaagccttggacccctcccagcctgtgacctttgtgaccaactccacctangcagcagacaagggggctctgtatgtggatgtgatccgtgtgaacagctactactcttggtatcgcaactangggcacctggagttgattcagctgcagctggccgcccagnttgagaantggtgtaagacatcacaatcccattattcagagcgagtatggagtggaaacgcttgtagggtttcaccagggctggtgacttaccagatctccgtcaagtgcagtaaccagttcaagttggaagtgtgtcttttgaaatcaggtgccaacctctggtggccgtacctgatgcacgaacaccccgcctacctgtactcgtggggatggtgattgctcacaccaaagccttggacccctcccagcctgtgacctttgtgaccaactccacctacgcagcagacaagggggtgagcctgggggtccccaccccatttctcctgcctttgcctgggcttgtcctgaagcctgctcatgggaacagctggaaagaaccatgtgctgccagtctgagctttttattttgttttacttagaaagatagagacagggtcttgccatgttgcccaggctggtctcgaactcctgggctcaagtggtcctcctgcctcggccttccagagggctggggtgacaggcgtgtgccaccgcact

SEQ ID NO: 88099 - DNA, 1331 bp, Homo sapiens
  misc_feature (436)..(436): n is a, c, g, or t
  misc_feature (508)..(508): n is a, c, g, or t
  misc_feature (548)..(548): n is a, c, g, or t
  misc_feature (556)..(556): n is a, c, g, or t
actaggccgcctctcttttcttgctccagtgacaggctcagacgcatcgggaccggacccgcagcttgcggtcaccatgggcttcacggggttcggtaaaaaagctcgcacatttgacttggaagcaatgtttgaacaaactcgaagaacagctgtggaaagaagttgcaaaacactggggctggtgaattaccagatctccgtcaagtgcagtaaccagttcaagttggaagtgtgtcttttgaaatcagaaaacaaagtcgtggacaaccaggctgggacccagggccagctgaaggtgctgggtgccaacctctggtggccgtacctgatgcacgaacaccccgcctacctgtactcgtgggagatggtgattgctcacaccaaagccttggacccctcccagcctgtgacctttgtgaccaactccacctangcagcagacaagggggctctgtatgtggatgtgatccgtgtgaacagctactactcttggtatcgcaactangggcacctggagttgattcagctgcagctggccgcccagnttgagaantggtgtaagacatcacaatcccattattcagagcgagtatggagtggaaacgcttgtagggtttcaccagggctggtgacttaccagatctccgtcaagtgcagtaaccagttcaagttggaagtgtgtcttttgaaatcaggtgccaacctctggtggccgtacctgatgcacgaacaccccgcctacctgtactcgtggggatggtgattgctcacaccaaagccttggacccctcccagcctgtgacctttgtgaccaactccacctacgcagcagacaagggggtgagcctgggggtccccaccccatttctcctgcctttgcctgggcttgtcctgaagcctgctcatgggaacagctggaaagaaccatgtgctgccaatggagtcttgctgtgttgcccaggctggagtgcagtggcacagtctcagctcactgcaacctccgcctcccaggctctgtatgtggatgtgatccgtgtgaacagctactactcttggtatcgcaactacgggcacctggagttgattcagctgcagctggccgcccagtttgagaactggtgtaagacatcacaatcccattattcagagcgtgtatggagtggaaacgcttgtagggtttcaccaggatccaccttgatgttcagtgaagagaaccagaaaagtctgctagagcagtaccatctgggtctcaatcaaaaacgcagaaaatacgtggttggagagctcatctggaattttgccgatttcatgactaaccagtgtaagtg

SEQ ID NO: 88100 - DNA, 562 bp, Homo sapiens
gtggtattgaccacgttcttgtttttgtttgtgaccaggccagattacagaggggtattgatttgccttgcccccgcccccaccatcacagtgtgtccctgtccagtgttggtgctgtgtggcattggcttgtgtccataggagtccatcaaggcagagcggcagagcggcaaggcaggtcagcttccagctcttccaggctgcatgtcccactcaatatcctgtaagttctgatctggcagatactgaatactcaagggttcacattctcttagcctagaggtggctgcaataatgaaaggcatttggctgatgtgttttcaaaggagagggaagctgtctgtgtttgttacctgcggctgcataacaaatgaccacagcctagtgactcgaaacatcacacaccagttacctccgctctcagtaggtcagaagttcaggcatagaccagctgtggcctccactctgagtctcagcaggctacaatcagggctcaatcagggctgtggtcctgtcagaggctctctcaggttgttggtggttgtaggactgaagttcctgt

SEQ ID NO: 88101 - DNA, 1787 bp, Homo sapiens
gttattggcaagttcccctgcagtttgggctgtctctgtggctggttctgcggcgtgcggccagccatggagcgctctgggcccagcgaagtgacaggctcagacgcatcgggaccggacccgcagcttgcggtcaccatgggcttcacggggttcggtaaaaaagctcgcacatttgacttggaagcaatgtttgaacaaactcgaagaacagctgtggaaagaagttgcaaaacactgggccagattacagaggggtattgatttgccttgcccccgcccccaccatcacagtgtgtccctgtccagtgttggtgctgtgtggcattggcttgtgtccataggagtccatcaaggcagagcggcagagcggcaaggcaggtcagcttccagctcttccaggctgcatgtcccactcaatatcctttcaacccaatggaaatggattgaaagagtgaaagtcactggtctcaaagaatctacggaatttagcattttgaaaatcacatagcaattttgggtaggtattcacctgcactaaaaaaccaggcaaacatccgactcccaggataaagtgactgagagcagtagaagacttgttgagccttaaggaataagaggaaaattacgttatgaagtgcaggaacagcacagacccagacgaggggacgcagcccggagccagtaacccggcgccacctcctccccagggcgcagcgctggctgatccccagataccgtgatcacacgtcccgggtcctgagagcgccacataggtagacagttctttgggacttctgggatgcagcacttgaagagaggtttacctaaactttcctcctgggagcctgtgatcatttgaaagtaacagaagaaagttgtcaggctgaggaaagtttcaacaggcacttggtgagaatgggaagcatccattcattgtgaaatcgcggggacagaggaggaattcacgggatcagagcactgagaaactccagaggcttctggttcaccgccctgattccacagatgtgggtcagaggcagagatggaagttggaatggacaagcctgccctctccttggctctccatggctctgtcctcaggctgtttctgcaatttgacatgaggcctggccccagggaaaccagtggggcctcatctcctccctgtgctgctctgaggtggagccttctcagggtcagtccagctctggagcccctctccagctcggtcaccaaagctgtctggtcccagggcggtgctgagtgacaggcatgccagccaatccaatcggcaatttcatatccaatgcatgtgactgataaagagataacgccctgtctccaagacacaggctttacataaacagctttaatgacttcttcacttagagacaagactccttagtggtggaacctcaggcatccgtgcaggacgtaagaaagctcccgtatatacatgaactgagaagtgtgtagaagaataaatactgtaataggtaataaaatgtatgtatttttatttatgtgctactttgtctttctccctctctgtgtatatacacatacatacaaaaatgtattcattctatggaaaacatgaaagatgtaatattctttacatatgaaattttaattaatgtattttttctgatcatatgaaccccacaaatataattttataatttttttacctaacaataagtcttaaacataaatatacatggacaatatcatagttttttttttaatcataattaaaatggttgtgaaacattccactttaa

SEQ ID NO: 88102 - DNA, 831 bp, Homo sapiens
gttattggcaagttcccctgcagtttgggctgtctctgtggctggttctgcggcgtgcggccagccatggagcgctctgggcccagcgaagtgacaggctcagacgcatcgggaccggacccgcagcttgcggtcaccatgggcttcacggggttcggtaaaaaagctcgcacatttgacttggaagcaatgtttgaacaaactcgaagaacagctgtggaaagaagttgcaaaacactggggctggtgaattaccagatctccgtcaagtgcagtaaccagttcaagttggaagtgtgtcttttgaaatcagaaaacaaagtcgtggacaaccaggctgggacccagggccagctgaaggtgctgggtgccaacctctggtggccgtacctgatgcacgaacaccccgcctacctgtactcgtgggaggatggtgattgctcacaccaaagccttggacccctcccagcctgtgacctttgtgaccaactccacctacgcagcagacaagggggctctgtatgtggatgtgatccgtgtgaacagctactactcttggtatcgcaactacgggcacctggagttgattcagctgcagctggccgcccagtttgagaactggtgtaagacatcacaatcccattattcagagcgtgtatggagtggaaacgcttgtagggtttcaccaggatccaccttgatgttcagtgaagagaaccagaaaagtctgctagagcagtaccatctgggtctcaatcaaaaacgcagaaaatacgtggttggagagctcatctggaattttgccgatttcatgactaaccagtgtaagtg

SEQ ID NO: 88103 - DNA, 843 bp, Homo sapiens
ccccgcctacctgtactcgtgggaggatggtgattgctcacaccaaagccttggacccctcccagcctgtgacctttgtgaccaactccacctacgcagcagacaagggggctctgtatgtggatgtgatccgtgtgaacagctactactcttggtatcacaactatgggcacctggagttgattcagctgcagctggccgcccagtttgagaattggtgtaagacatcacaatcccattattcagagcgagtatggagtggaaacgcttgtagggtttcaccagggctggtgaattaccagatctccgtcaagtgcagtaaccagttcaagttggaagtgtgtcttttgaaatcagaaaacaaagtcgtggacaaccaggctgggacccagggccagctgaaggtgctgggtgccaacctctggtggccgtacctgatgcacgaacaccccgcctacctgtactcgtgggaggatggtgattgctcacaccaaagccttggacccctcccagcctgtgacctttgtgaccaactccacctacgcagcagacaagggggctctgtatgtggatgtgatccgtgtgaacagctactactcttggtatcgcaactacgggcacctggagttgattcagctgcagctggccgcccagtttgagaactggtgtaagacatcacaatcccattattcagagcgtgtatggagtggaaacgcttgtagggtttcaccagattatatatattcctaccagatggagataattacagctttaaaaatttttattttttcattttatttcacatattgacattaaatttttatggacacataaaaaaaaaaa

SEQ ID NO: 88104 - DNA, 847 bp, Homo sapiens
gttattggcaagttcccctgcagtttgggctgtctctgtggctggttctgcggcgtgcggccagccatggagcgctctgggcccagcgaagtgacaggctcagacgcatcgggaccggacccgcagcttgcggtcaccatgggcttcacggggttcggtaaaaaagctcgcacatttgacttggaagcaatgtttgaacaaactcgaagaacagctgtggaaagaagttgcaaaacactgggccagattacagaggggtattgatttgccttgcccccgcccccaccatcacagtgtgtccctgtccagtgttggtgctgtgtggcattggcttgtgtccataggagtccatcaaggcagagcggcagagcggcaaggcaggtcagcttccagctcttccaggctgcatgtcccactcaatatcctgtaagttctgatctggcagatactgaatactcaagggttcacattctcttagcctagaggtggctgcaataatgaaaggcatttggctgatgtgttttcaaaggagagggaagctgtctgtgtttgttacctgcggctgcataacaaatgaccacagcctagtgactcgaaacatcacacaccagttacctccgctctcagtaggtcagaagttcaggcatagaccagctgtggcctccactctgagtctcagcaggctacaatcagggctcaatcagggctgtggtcctgtcagaggctctctcaggttgttggtggttgtaggactgaagttcctgtttttggggggtagtcagctggtgtattagtctattttcacactagtgatcaagacatacctgagactgggtactttatttaa

SEQ ID NO: 88105 - DNA, 797 bp, Homo sapiens
ggagtggaccaggatgttgcctttctctccaccgccctgtctctatccagatctacttcactggctgctccatgaacccagcccgctcttttggccctgcggtggtcatgaatcggttcagccccgctcactgggtgagtctgtcccttcccctggctccctggagatgagggcctggagacccagcagtggcagctcagagctcaccagacctggattctgtgggtctagagcttgggggtgggccagggagtggtggctgacagagaaagggacacagtaggggatgggattcagctagaggggcagaggtggctttgtatggcctgaaccgctggggacagggagtctgagtatctatccgcttatggaagaggctctactgaacctggaggtgcagaggggctctgtgtcaattcccttgaggatttggtgtccgtccccctcggtgtctgcgtgctggtcctctctgatgttttatttatctgtccctgttgagggggttgggagagtcttcctgtgggtctgtccctgtggacagtctgtctgccccccctttggaagctcatggtcactctctccagggtctgcttctatccctgcgtggaggggacacgcgctctgttcatccgtctctctgaggacccacgtgtcccctctgaaggtttatttgcttctctttccggtgtggttggagggagcctgtccctctgggaatccgtttgccttctttgagggtctaggtgtctgtggtccatgtctctgtccctgggagtggtgtgtcagtatattcgtcc

SEQ ID NO: 88106 - DNA, 265 bp, Homo sapiens
gaaggtggccgggctctctaatcctctatccgctacagctcaacaacaacacaacgcagggccaggccatggtggtggagctgattctgaccttccagctggcactctgcatcttcgcctccactgactcccgccgcaccagccgctccttaggaagaagacagactggttcattgaatgccgccttatttatttctggtgaggatgcatgcgtggggctgctggtgtttagagtgggggctacccaataaatcactgatactca

SEQ ID NO: 88107 - DNA, 1965 bp, Homo sapiens
  misc_feature (284)..(284): n is a, c, g, or t
agctagacgccccgaggtcggagtgaagcgccgggaccgagccccgtctcccagggagtccggggcgcacggcaccgaggagagcgcgggagccaacctgggcgcatcatgcgcagggcccgggacgctgggccggtctacaccgccgcctgggtcacgtggcccggacgggccggcggctgccccggccggggggcgggggtcgcgccggggttgcgctggacgacggagagcggcgggcccgcagcggcctggagcctcccaacccgcgccgcgctggcccncgagcgtaggagccgccccctgcccccccgcgccggccccgcgcccggccgcccgccccctatatagcgcgccccagcagggcccgcgccaggccgccagcctcggagtgggcgcgggacagtgcgcggcgccccgcagccaggcccccgcccccgccgcatccacctcctccgccgcctgcgacccaacgggcgccccccgccgcggcagctgccgccgggcccccgcggccaccatgaagaaggaggtgtgctccgtggccttcctcaaggccgtgttcgcagagttcttggccaccctcatcttcgtcttctttggcctgggctcggccctcaagtggccgtcggcgctgcctaccatcctgcagatcgcgctggcgtttggcctggccataggcacgctggcccaggccctgggacccgtgagcggcggccacatcaaccccgccatcaccctggccctcttggtgggcaaccagatctcgctgctccgggctttcttctacgtggcggcccagctggtgggcgccattgccggggctggcatcctctacggtgtggcaccgctcaatgcccggggcaatctggccgtcaacgcgctcaacaacaacacaacgcagggccaggccatggtggtggagctgattctgaccttccagctggcactctgcatcttcgcctccactgactcccgccgcaccagccctgtgggctccccagccctgtccattggcctgtctgtcaccctgggccaccttgtcggaatctacttcactggctgctccatgaacccagcccgctcttttggccctgcggtggtcatgaatcggttcagccccgctcactgggttttctgggtagggcccatcgtgggggcggtcctggctgccatcctttacttctacctgctcttccccaactccctgagcctgagtgagcgtgtggccatcatcaaaggcacgtatgagcctgacgaggactgggaggagcagcgggaagagcggaagaagaccatggagctgaccacccgctgaccagtgtcaggcaggggccagcccctcagcccctgagccaagggggaaaagaagaaaaagtacctaacacaagcttcctttttgcacaaccggtcctcttggctgaggaggaggagctggtcaccctggctgcacagttagagaggggagaaggaacccatgatgggactcctggggtaggggccaggggctggggtctgctggggacaggtctctctgggacagacctcagagattgtgaatgcagtgccaagctcacaggctgcaagggccaggccagaaaagggtgggcctgcagcctgcaccccccaccttccccaacccttcctcaagagctgaagggatcccagcccctaggtgggcagaggcagaccctccccagagctccttaggaagaagacagactggttcattgaatgccgccttatttatttctggtgaggatgcatgcgtggggctgctggtgtttagagtgggggctacccaataaatcactgatactcaaaacaccagcagaccctccccagagctccttaggaagaagacagactggttcattgaatgccgccttatttatttctggtgaggatgcatgcgtggggctgctggtgtttagagtgggggctacccaataaatcactgatact

SEQ ID NO: 88108 - DNA, 1657 bp, Homo sapiens
  misc_feature (284)..(284): n is a, c, g, or t
agctagacgccccgaggtcggagtgaagcgccgggaccgagccccgtctcccagggagtccggggcgcacggcaccgaggagagcgcgggagccaacctgggcgcatcatgcgcagggcccgggacgctgggccggtctacaccgccgcctgggtcacgtggcccggacgggccggcggctgccccggccggggggcgggggtcgcgccggggttgcgctggacgacggagagcggcgggcccgcagcggcctggagcctcccaacccgcgccgcgctggcccncgagcgtaggagccgccccctgcccccccgcgccggccccgcgcccggccgcccgccccctatatagcgcgccccagcagggcccgcgccaggccgccagcctcggagtgggcgcgggacagtgcgcggcgccccgcagccaggcccccgcccccgccgcatccacctcctccgccgcctgcgacccaacgggcgccccccgccgcggcagctgccgccgggcccccgcggccaccatgaagaaggaggtgtgctccgtggccttcctcaaggccgtgttcgcagagttcttggccaccctcatcttcgtcttctttggcctgggctcggccctcaagtggccgtcggcgctgcctaccatcctgcagatcgcgctggcgtttggcctggccataggcacgctggcccaggccctgggacccgtgagcggcggccacatcaaccccgccatcaccctggccctcttggtgggcaaccagatctcgctgctccgggctttcttctacgtggcggcccagctggtgggcgccattgccggggctggcatcctctacggtgtggcaccgctcaatgcccggggcaatctggccgtcaacgcgatctacttcactggctgctccatgaacccagcccgctcttttggccctgcggtggtcatgaatcggttcagccccgctcactgggttttctgggtagggcccatcgtgggggcggtcctggctgccatcctttacttctacctgctcttccccaactccctgagcctgagtgagcgtgtggccatcatcaaaggcacgtatgagcctgacgaggactgggaggagcagcgggaagagcggaagaagaccatggagctgaccacccgctgaccagtgtcaggcaggggccagcccctcagcccctgagccaagggggaaaagaagaaaaagtacctaacacaagcttcctttttgcacaaccggtcctcttggctgaggaggaggagctggtcaccctggctgcacagttagagaggggagaaggaacccatgatgggactcctggggtaggggccaggggctggggtctgctggggacaggtctctctgggacagacctcagagattgtgaatgcagtgccaagctcacaggctgcaagggccaggccagaaaagggtgggcctgcagcctgcaccccccaccttccccaacccttcctcaagagctgaagggatcccagcccctaggtgggcagaggcagaccctccccagagctccttaggaagaagacagactggttcattgaatgccgccttatttatttctggtgaggatgcatgcgtggggctgctggtgtttagagtgggggctacccaataaatcactgatactca

SEQ ID NO: 88109 - DNA, 1795 bp, Homo sapiens
  misc_feature (284)..(284): n is a, c, g, or t
agctagacgccccgaggtcggagtgaagcgccgggaccgagccccgtctcccagggagtccggggcgcacggcaccgaggagagcgcgggagccaacctgggcgcatcatgcgcagggcccgggacgctgggccggtctacaccgccgcctgggtcacgtggcccggacgggccggcggctgccccggccggggggcgggggtcgcgccggggttgcgctggacgacggagagcggcgggcccgcagcggcctggagcctcccaacccgcgccgcgctggcccncgagcgtaggagccgccccctgcccccccgcgccggccccgcgcccggccgcccgccccctatatagcgcgccccagcagggcccgcgccaggccgccagcctcggagtgggcgcgggacagtgcgcggcgccccgcagccaggcccccgcccccgccgcatccacctcctccgccgcctgcgacccaacgggcgccccccgccgcggcagctgccgccgggcccccgcggccaccatgaagaaggaggtgtgctccgtggccttcctcaaggccgtgttcgcagagttcttggccaccctcatcttcgtcttctttggcctgggctcggccctcaagtggccgtcggcgctgcctaccatcctgcagatcgcgctggcgtttggcctggccataggcacgctggcccaggccctgggacccgtgagcggcggccacatcaaccccgccatcaccctggccctcttggtgggcaaccagatctcgctgctccgggctttcttctacgtggcggcccagctggtgggcgccattgccggggctggcatcctctacggtgtggcaccgctcaatgcccggggcaatctggccgtcaacgcgctcaacaacaacacaacgcagggccaggccatggtggtggagctgattctgaccttccagctggcactctgcatcttcgcctccactgactcccgccgcaccagccctgtgggctccccagccctgtccattggcctgtctgtcaccctgggccaccttgtcggaatctacttcactggctgctccatgaacccagcccgctcttttggccctgcggtggtcatgaatcggttcagccccgctcactgggtgagtctgtcccttcccctggctccctggagatgagggcctggagacccagcagtggcagctcagagctcaccagacctggattctgtgggtctagagcttgggggtgggccagggagtggtggctgacagagaaagggacacagtaggggatgggattcagctagaggggcagaggtggctttgtatggcctgaaccgctggggacagggagtctgagtatctatccgcttatggaagaggctctactgaacctggaggtgcagaggggctctgtgtcaattcccttgaggatttggtgtccgtccccctcggtgtctgcgtgctggtcctctctgatgttttatttatctgtccctgttgagggggttgggagagtcttcctgtgggtctgtccctgtggacagtctgtctgccccccctttggaagctcatggtcactctctccagggtctgcttctatccctgcgtggaggggacacgcgctctgttcatccgtctctctgaggacccacgtgtcccctctgaaggtttatttgcttctctttccggtgtggttggagggagcctgtccctctgggaatccgtttgccttctttgagggtctaggtgtctgtggtccatgtctctgtccctgggagtggtgtgtcagtatattcgtcc

SEQ ID NO: 88110 - DNA, 1211 bp, Homo sapiens
  misc_feature (284)..(284): n is a, c, g, or t
agctagacgccccgaggtcggagtgaagcgccgggaccgagccccgtctcccagggagtccggggcgcacggcaccgaggagagcgcgggagccaacctgggcgcatcatgcgcagggcccgggacgctgggccggtctacaccgccgcctgggtcacgtggcccggacgggccggcggctgccccggccggggggcgggggtcgcgccggggttgcgctggacgacggagagcggcgggcccgcagcggcctggagcctcccaacccgcgccgcgctggcccncgagcgtaggagccgccccctgcccccccgcgccggccccgcgcccggccgcccgccccctatatagcgcgccccagcagggcccgcgccaggccgccagcctcggagtgggcgcgggacagtgcgcggcgccccgcagccaggcccccgcccccgccgcatccacctcctccgccgcctgcgacccaacgggcgccccccgccgcggcagctgccgccgggcccccgcggccaccatgaagaaggaggtgtgctccgtggccttcctcaaggccgtgttcgcagagttcttggccaccctcatcttcgtcttctttggcctgggctcggccctcaagtggccgtcggcgctgcctaccatcctgcagatcgcgctggcgtttggcctggccataggcacgctggcccaggccctgggacccgtgagcggcggccacatcaaccccgccatcaccctggccctcttggtgggcaaccagatctcgctgctccgggctttcttctacgtggcggcccagctggtgggcgccattgccggggctggcatcctctacggtgtggcaccgctcaatgcccggggcaatctggccgtcaacgcgctcaacaacaacacaacgcagggccaggccatggtggtggagctgattctgaccttccagctggcactctgcatcttcgcctccactgactcccgccgcaccagccctgtgggctccccagccctgtccattggcctgtctgtcaccctgggccaccttgtcggagtgagcagtaccgacattgggctggggtgagggtggggcaggcactcaaggcaaataatggagccctggagcggagcccacttcagatggatgagtccagcagagtttaaggcctggatttagggctcctggactctggccctactgggccccagaattgatc

SEQ ID NO: 88111 - DNA, 1110 bp, Homo sapiens
  misc_feature (284)..(284): n is a, c, g, or t
agctagacgccccgaggtcggagtgaagcgccgggaccgagccccgtctcccagggagtccggggcgcacggcaccgaggagagcgcgggagccaacctgggcgcatcatgcgcagggcccgggacgctgggccggtctacaccgccgcctgggtcacgtggcccggacgggccggcggctgccccggccggggggcgggggtcgcgccggggttgcgctggacgacggagagcggcgggcccgcagcggcctggagcctcccaacccgcgccgcgctggcccncgagcgtaggagccgccccctgcccccccgcgccggccccgcgcccggccgcccgccccctatatagcgcgccccagcagggcccgcgccaggccgccagcctcggagtgggcgcgggacagtgcgcggcgccccgcagccaggcccccgcccccgccgcatccacctcctccgccgcctgcgacccaacgggcgccccccgccgcggcagctgccgccgggcccccgcggccaccatgaagaaggaggtgtgctccgtggccttcctcaaggccgtgttcgcagagttcttggccaccctcatcttcgtcttctttggcctgggctcggccctcaagtggccgtcggcgctgcctaccatcctgcagatcgcgctggcgtttggcctggccataggcacgctggcccaggccctgggacccgtgagcggcggccacatcaaccccgccatcaccctggccctcttggtgggcaaccagatctcgctgctccgggctttcttctacgtggcggcccagctggtgggcgccattgccggggctggcatcctctacggtgtggcaccgctcaatgcccggggcaatctggccgtcaacgcgctcaacaacaacacaacgcagggccaggccatggtggtggagctgattctgaccttccagctggcactctgcatcttcgcctccactgactcccgccgcaccagccgctccttaggaagaagacagactggttcattgaatgccgccttatttatttctggtgaggatgcatgcgtggggctgctggtgtttagagtgggggctacccaataaatcactgatactca

SEQ ID NO: 88112 - DNA, 233 bp, Homo sapiens
cattgaatgccgccttatttatttctggtgaggatgcatgcgtggggctgctggtgtttagagtgggggctacccaataaatcactgatactcacgttccgcctctgtctctcctcagagtgccttgagacactctggcccattgcctctcctctttgtcatcccacatcctccaccacgatctccacagggtaccggggaccccaggacaagtgctctgtgggaagaaaggg

SEQ ID NO: 88113 - DNA, 1822 bp, Homo sapiens
  misc_feature (284)..(284): n is a, c, g, or t
agctagacgccccgaggtcggagtgaagcgccgggaccgagccccgtctcccagggagtccggggcgcacggcaccgaggagagcgcgggagccaacctgggcgcatcatgcgcagggcccgggacgctgggccggtctacaccgccgcctgggtcacgtggcccggacgggccggcggctgccccggccggggggcgggggtcgcgccggggttgcgctggacgacggagagcggcgggcccgcagcggcctggagcctcccaacccgcgccgcgctggcccncgagcgtaggagccgccccctgcccccccgcgccggccccgcgcccggccgcccgccccctatatagcgcgccccagcagggcccgcgccaggccgccagcctcggagtgggcgcgggacagtgcgcggcgccccgcagccaggcccccgcccccgccgcatccacctcctccgccgcctgcgacccaacgggcgccccccgccgcggcagctgccgccgggcccccgcggccaccatgaagaaggaggtgtgctccgtggccttcctcaaggccgtgttcgcagagttcttggccaccctcatcttcgtcttctttggcctgggctcggccctcaagtggccgtcggcgctgcctaccatcctgcagatcgcgctggcgtttggcctggccataggcacgctggcccaggccctgggacccgtgagcggcggccacatcaaccccgccatcaccctggccctcttggtgggcaaccagatctcgctgctccgggctttcttctacgtggcggcccagctggtgggcgccattgccggggctggcatcctctacggtgtggcaccgctcaatgcccggggcaatctggccgtcaacgcgctcaacaacaacacaacgcagggccaggccatggtggtggagctgattctgaccttccagctggcactctgcatcttcgcctccactgactcccgccgcaccagccctgtgggctccccagccctgtccattggcctgtctgtcaccctgggccaccttgtcggaatctacttcactggctgctccatgaacccagcccgctcttttggccctgcggtggtcatgaatcggttcagccccgctcactgggttttctgggtagggcccatcgtgggggcggtcctggctgccatcctttacttctacctgctcttccccaactccctgagcctgagtgagcgtgtggccatcatcaaaggcacgtatgagcctgacgaggactgggaggagcagcgggaagagcggaagaagaccatggagctgaccacccgctgaccagtgtcaggcaggggccagcccctcagcccctgagccaagggggaaaagaagaaaaagtacctaacacaagcttcctttttgcacaaccggtcctcttggctgaggaggaggagctggtcaccctggctgcacagttagagaggggagaaggaacccatgatgggactcctggggtaggggccaggggctggggtctgctggggacaggtctctctgggacagacctcagagattgtgaatgcagtgccaagctcacaggctgcaagggccaggccagaaaagggtgggcctgcagcctgcaccccccaccttccccaacccttcctcaagagctgaagggatcccagcccctaggtgggcagaggcagaccctccccagagctccttaggaagaagacagactggttcattgaatgccgccttatttatttctggtgaggatgcatgcgtggggctgctggtgtttagagtgggggctacccaataaatcactgatactca

SEQ ID NO: 88114 - DNA, 977 bp, Homo sapiens
gaaggtggccgggctctctaatcctctatccgctacagctcaacaacaacacaacgcagggccaggccatggtggtggagctgattctgaccttccagctggcactctgcatcttcgcctccactgactcccgccgcaccagccctgtgggctccccagccctgtccattggcctgtctgtcaccctgggccaccttgtcggaatctacttcactggctgctccatgaacccagcccgctcttttggccctgcggtggtcatgaatcggttcagccccgctcactgggttttctgggtagggcccatcgtgggggcggtcctggctgccatcctttacttctacctgctcttccccaactccctgagcctgagtgagcgtgtggccatcatcaaaggcacgtatgagcctgacgaggactgggaggagcagcgggaagagcggaagaagaccatggagctgaccacccgctgaccagtgtcaggcaggggccagcccctcagcccctgagccaagggggaaaagaagaaaaagtacctaacacaagcttcctttttgcacaaccggtcctcttggctgaggaggaggagctggtcaccctggctgcacagttagagaggggagaaggaacccatgatgggactcctggggtaggggccaggggctggggtctgctggggacaggtctctctgggacagacctcagagattgtgaatgcagtgccaagctcacaggctgcaagggccaggccagaaaagggtgggcctgcagcctgcaccccccaccttccccaacccttcctcaagagctgaagggatcccagcccctaggtgggcagaggcagaccctccccagagctccttaggaagaagacagactggttcattgaatgccgccttatttatttctggtgaggatgcatgcgtggggctgctggtgtttagagtgggggctacccaataaatcactgatactca

SEQ ID NO: 88115 - DNA, 1301 bp, Homo sapiens
  misc_feature (284)..(284): n is a, c, g, or t
agctagacgccccgaggtcggagtgaagcgccgggaccgagccccgtctcccagggagtccggggcgcacggcaccgaggagagcgcgggagccaacctgggcgcatcatgcgcagggcccgggacgctgggccggtctacaccgccgcctgggtcacgtggcccggacgggccggcggctgccccggccggggggcgggggtcgcgccggggttgcgctggacgacggagagcggcgggcccgcagcggcctggagcctcccaacccgcgccgcgctggcccncgagcgtaggagccgccccctgcccccccgcgccggccccgcgcccggccgcccgccccctatatagcgcgccccagcagggcccgcgccaggccgccagcctcggagtgggcgcgggacagtgcgcggcgccccgcagccaggcccccgcccccgccgcatccacctcctccgccgcctgcgacccaacgggcgccccccgccgcggcagctgccgccgggcccccgcggccaccatgaagaaggaggtgtgctccgtggccttcctcaaggccgtgttcgcagagttcttggccaccctcatcttcgtcttctttggcctgggctcggccctcaagtggccgtcggcgctgcctaccatcctgcagatcgcgctggcgtttggcctggccataggcacgctggcccaggccctgggacccgtgagcggcggccacatcaaccccgccatcaccctggccctcttggtgggcaaccagatctcgctgctccgggctttcttctacgtggcggcccagctggtgggcgccattgccggggctggcatcctctacggtgtggcaccgctcaatgcccggggcaatctggccgtcaacgcgctcaacaacaacacaacgcagggccaggccatggtggtggagctgattctgaccttccagctggcactctgcatcttcgcctccactgactcccgccgcaccagccggggtctgctggggacaggtctctctgggacagacctcagagattgtgaatgcagtgccaagctcacaggctgcaagggccaggccagaaaagggtgggcctgcagcctgcaccccccaccttccccaacccttcctcaagagctgaagggatcccagcccctaggtgggcagaggcagaccctccccagagctccttaggaagaagacagactggttcattgaatgccgccttatttatttctggtgaggatgcatgcgtggggctgctggtgtttagagtgggggctacccaataaatcactgatactca

SEQ ID NO: 88116 - DNA, 1084 bp, Homo sapiens
  misc_feature (284)..(284): n is a, c, g, or t
agctagacgccccgaggtcggagtgaagcgccgggaccgagccccgtctcccagggagtccggggcgcacggcaccgaggagagcgcgggagccaacctgggcgcatcatgcgcagggcccgggacgctgggccggtctacaccgccgcctgggtcacgtggcccggacgggccggcggctgccccggccggggggcgggggtcgcgccggggttgcgctggacgacggagagcggcgggcccgcagcggcctggagcctcccaacccgcgccgcgctggcccncgagcgtaggagccgccccctgcccccccgcgccggccccgcgcccggccgcccgccccctatatagcgcgccccagcagggcccgcgccaggccgccagcctcggagtgggcgcgggacagtgcgcggcgccccgcagccaggcccccgcccccgccgcatccacctcctccgccgcctgcgacccaacgggcgccccccgccgcggcagctgccgccgggcccccgcggccaccatgaagaaggaggtgtgctccgtggccttcctcaaggccgtgttcgcagagttcttggccaccctcatcttcgtcttctttggcctgggctcggccctcaagtggccgtcggcgctgcctaccatcctgcagatcgcgctggcgtttggcctggccataggcacgctggcccaggccctgggacccgtgagcggcggccacatcaaccccgccatcaccctggccctcttggtgggcaaccagatctcgctgctccgggctttcttctacgtggcggcccagctggtgggcgccattgccggggctggcatcctctacggtgtggcaccgctcaatgcccggggcaatctggccgtcaacgcgctcaacaacaacacaacgcagggccaggccatggtggtggagctgattctgaccttccagctggcactctgcatcttcgcgctccttaggaagaagacagactggttcattgaatgccgccttatttatttctggtgaggatgcatgcgtggggctgctggtgtttagagtgggggctacccaataaatcactgatactca

SEQ ID NO: 88117 - DNA, 308 bp, Homo sapiens
ctggactgtaaagggtgttaattgagaagccagggtgcacagttgagtagggaatgatcaatggttccagaggcaaggtgacacagctgcctttttctggggaaaaaaatgttctgtgtagcctgagagccttaaagtgggtgtatgtctctcagctgcctctctccctctcacagagaggtccctctggaggcttctcccagtgagcaggggaagtgcgcatttgaaatggcacacttatcttgcagttgcaggggaagcttttgttttatttttctcttgctgcattaaagtatttgtctttcttt

SEQ ID NO: 88118 - DNA, 309 bp, Homo sapiens
ctgagctacatgtgcacactctggctccctccattggaaggtctttgatgttttttcttctcttgaccctggggtacctagcaccctgtgtactctctagagagggatctgggggttgtggaagcaggacacctgcagagtaaagactagggaagggtgacatctgcagccctgtgtagggcaactgtgcagagcccctctgcttcccaggcctcctccccgctcacccaggtgctcatggctcttctggattatttgagacaaggctagtttggccacatctgcttttccctggttgggcttcacgta

SEQ ID NO: 88119 - DNA, 1861 bp, Homo sapiens
  misc_feature (2)..(8): n is a, c, g, or t
  misc_feature (23)..(23): n is a, c, g, or t
  misc_feature (1097)..(1097): n is a, c, g, or t
cnnnnnnntcagcctcctgagtngctgggactacaggcacctgccactgcgcctggctcatttttgtgtttttagtagagatgtagtttcaccatgtcacccaggctgaggtagacatttatatacatggacataactgaagcatgggccagccctttttaaaactgttaccaaagtgctgagttgtttgaagagcctgagaggacatgaaacatgaggatggtgagcttcagggagactctcaggaagagtaccaccccaccttgagacggcaggtctcagtgacgtgaggtgggtaggatggttgaaaagtctgaaaacaccaggtcacccctgatgatggaagatgatcacacacaagatttacctgctctctttctgccatggttttgggtgttcatggtacacatgaagaagcatcctgagacagccaaagtccagtgttttcttgcccaccttggattctgtggtgctggatatgatgattctgttcttgtcccccttggctagctcagcctccattcatcctttctcctttccatctctggtaggctttccagatttggcaaataagaatacaggacacccagttaaactgcatgaataatgtcgtgacatacctatactgaaaagttacttgttgtttctttgaaattcaagtttaactaggtgtcctttatattctcttgcagtcccactggggttaatcagcacaagctctaaaagttatcttttctattctgtcattaacagtgtattcccagtttttgaagggaccaagtatggctttgtaaaattataattttaaactctgactcgggaccaaatgaatgttttggatgagattcagatccatgcactagcaggacacaccctctcacttcctttggtcctgatcttagctcttttcttcacccatttttgggccacacactccatttctaattttagctctcccatgtacttcttgccacttcatgcctgttttccctgaggacccactgactgagaaggactgttatagaaactctgttttcctctaggaacgtgctctcagacagtgtccctgagcctggaagtgctccccacatgtctcnggaagtggggcggggaggagagccaaaggtttcctccaccttcgctttggtggttggtcaccaggaagtaggtgcacactctaaagtgaaacaaacaaaaagtgatgtctgccaacagccaccaccaagacaagcgtctgggttctcgtttctcctctggtggctcctcaggccaaatgataccttcttgtcacccacggggtctgagtcagaggtgaaactcaacccccacaccgtactcctggtatctgccaggggatttggaattccagaatgtttatttctggttcattgacctaagattcaagcacacatagcctgaaattacagtactgtatatccagagcccagaactgcaagcccattattaacagtaatacattttgtggcctgaggatttttcccaaattgctctcagttgcatgttttacccgatatcattttgtctgttctgattttataagtgccacatattacagaaattttgaaaaagcatgtaatggagaacaaaatcccatactctcccttatccccatacccagacaggaggtatgcgaggaaagagatggaagtttcgcccaggactagacttgtgctgggaatcgccctctcttgcctatgtatacagagatttggagggggatgtggagagactggtggagttatggagggaaagataaggcagtatgtttaaaggagatttggagaaaagttttctgaaggaggggcaaatgaccctttgctatatctcctcatcaaaaaaa

SEQ ID NO: 88120 - DNA, 307 bp, Homo sapiens
agactccatatcaaaaaaaaaaaaaaaaaaaaagaatgagttcaaattctatagccagatacggaaaggaaaaaagcttgagagtaggttaagaaggggtattttacttgtcatcttatatccttctctactgtgtgtgtattaaaaaatacagcattaagcctgggcaccgtggctcatgcctataatccaagcattttgggaggccagggtgggtggattacctgagatcaggagtttgaggccagcctggccaacatgatgaaatcccatctctactaaaaataaaaaaattagccgggcatgg

SEQ ID NO: 88121 - DNA, 187 bp, Homo sapiens
acttcagaatatttcctcacaccaactttagtgtgtgtatacctagactggcatcaatgtaatccaattcagtccattttttatgtgctgcttaatgaaaatgaatctgtctctatctctttcaaatgttctaatatcagatatatttgctacaaaccttaatttcaataaagtaaaagtgatatac

SEQ ID NO: 88122 - DNA, 678 bp, Homo sapiens
gcgtcgacgaatctcatgcgtatgactctggagagcgtatattaactacttttttttgctctttatgtaaagtctgaggtcaaggcaaggtcacagatatacagtaattgaacttatagttttgctttctccagctagtactgaaaatttataaacatcttattaaggcacttaagttactttaagttccttaataagatagttttgtacaattatttttgtagcctctccaaaagtgacaagtcactgacatgtaaaaaagtagttaatatacgctctccagagtcatacgcatgagattctcttaagatccgtttgttctgcataatattaaaaattacgtatcaaatccagaaaatgaagaggacatattagattctgaaatagtaaattccttttagttcccaactcagatcaaatctgagcaggacataaaaaatacaatgaaaagtttaataaggctctattaatgattaaaggatccatagtccagtatgaattctagtttgtaaatctgcccacttcaggaaggaaaatagttcctaaaaaccaaaccattaaacagacagggacaggttttcaaaacaaaaatgcatacttcataacattttaagattctcaatatcctgtatccttgtgttctttcattatctgagaagtaattgaaacaaataatga

SEQ ID NO: 88123 - DNA, 321 bp, Homo sapiens
tgctgggattacaggcatgagccacctgcccagacacgtattttacttttaatctctagttttatattacatgctgattgcacatccccactcaggaacatcagaagaaatacaaaaagaggaaatatttcaaaactttgaaatcccacaaaaataatcacattcactaataaatatttctccttatttattttttagggtaccaggtaaggagactctccagtttagttaggactatgcctaatctgagttcccataaatcctcaaatgaactatatatgttattcttctggagactgaggaagctggttaatcactgtt

SEQ ID NO: 88124 - DNA, 836 bp, Homo sapiens
gtctgtaagagagagtgcccccgatcaaaactggtcagaaacccctcaggtttattctccaaaagaaactgactttgaatgttaagctgcttttcatgtttctttgctctttaactcttacactagtgggtcatttcccaagtgtgatgctatctacactagtttaccatggttgctgagaagataaaatatatgcctggacctgttgttagtctactaggttgctgtaaggagagtcttccaagaatgaggcaagataaaaaagcagagggtgccacagagtttgaagtcattatttgagctcctagatgcaactgcacctgaaactagacccctgtctctaggtttttgagccaatatattcctttgttttgcttaagccactttgaattcaatttctgtcacttgcaacccacacagttctgactgatatacaaaataaacatattacatgttatcttctgtgactcagaaattattatccatttttacagatgaggagttggagttttaaaggtgcaggtaacttgcagtgaaaagctaaggtctggcacaaggttgatcttgaatctgaagaagaaatggttcaaagtctcctttagagatgctaccttcctgctgctcacttccagaatttagtcagggaattattgggctgacttgagttgttgtgtatacagtctgtgaacttgcagtttatggtattttataattttgttttccctgccgttctgctaatgcagctttgtgagcaaacattgcctgtgatttaaatccaccaccgtaatgaaacgcacacacacacatgcacacacacttccttggaacagtccaca

SEQ ID NO: 88125 - DNA, 88 bp, Homo sapiens
gatctgcctagccaactttcttaacccaagcccaaactgaaagtctaaaagatgtatttctggggaattaccccacctcaacattctc

SEQ ID NO: 88126 - DNA, 737 bp, Homo sapiens
ttttatttttattttgcccaagatcacaccctacagcatgtcagaaaggagatttgaacccatgtctgttctaggttttttccataacactaagtagcctgacttgtggcttatggtaatattttctaaatccagcttctttctgaaaagacttcattttcacaaaggtttaaacacttgcaagtaaacaaaaggggtgggttctgtggtcttcacgacagccatgttcccactacaggcctggctgctccctcagctgggagctgctgcccactcttatggaaactgcatccaggacaggctttattgatgctgccttcaaagccaaggcggcccatctgagaggatggaagaaacccagtaaagtatgggactctggtgagccatcccaggtacagttgtgtttttatgcaccagcacatttgtggagcaaatttggtgtcctcataacggcagttcatgagtacaagtgaggttcagttctttgtgtaaacaggggagaaagcctgtgtctgaatataattccgacggcatcaaggtcattttagagctggtggagctctatttgtcttaggaaatctcgaaaacttttatagggaattcggaaaatattttcggccagcaggaaagataaaatccctgcacacaaagtgcaggcatgggcccagagactgaacagacagactgctgtaaaacccctgtttaataaggcattaaaatgccatcgacctggacac

SEQ ID NO: 88127 - DNA, 171 bp, Homo sapiens
cccaaatagcagtgaatttctttttctcacatttccaagtgccagtcagcttcataactaacttctttgcccttaaagtacagtcaaatacagtataggaatgttgtaagggattctgctgatgaggaaagatatatcagaatagcaagtgtttattctgaattcatctcg

SEQ ID NO: 88128 - DNA, 400 bp, Homo sapiens
cctccccgcccccccaaaaaatcaggaaggctatagaagatttaaacagcatatcaaatcaacttgaccccagttggcctttcctaaacactaccccaacaattgtataacacagagtcttttcccaggtgcatgtgaaatgtttatcaagatagaacatatatagggaagtcttaataaatttaaaataattggaatcatacagggtgtatattctacacccatgaattaaattagtaattgataacatacagaaaatctccaattatttggcaattaagcaatgcacttacatggacttaatctatgatactagaaaccagaagcagtgtttgcctcagagtaagtaagatgtggcgattgtttggaaagggagatatggaaactttctggattaatg

SEQ ID NO: 88129 - DNA, 655 bp, Homo sapiens
gtgaataagttatttggttctaactagaaggaacccataaaattatgagaataatgtccatatacaaggtaaccctgaatataatgcattctgtcatctttgcagtgaaaaaatatttttaaaaagtgatgtgaggccaggcatggtggctcactcctgtaattccagcactttggaagaccaaggtgggcagatcacttgagctcaggagttcgagaccagcctggccaacacagtgaaacccagtctatactaaaaaaaaaaaaaaaaaaaaaaaaaaaaaaaaaaaaaaaaaaaaaaaaaaaagaagagagggggcggcgcgcgcctagaaaagatatagatccccgcgaggaggggggcccacgagatatagcgctccatcacccaagcatgtttttgttgcggcaaaaagcgagagggcgcccatcaaagagagggacggcgagcaaatgattatacgacggacgatagagacgcacacggcgggcggcgcgcgagattaaaaaaacagcgtcgaggcagagcggggggagaaacacagcggcacgacagcgtgggagaaatctagcgggggagagagagcgacccattttaagcacatgaggggggggggggagaaccacaggagggggacacaacaaatccccccaaa

SEQ ID NO: 88130 - DNA, 942 bp, Homo sapiens
  misc_feature (165)..(165): n is a, c, g, or t
  misc_feature (741)..(741): n is a, c, g, or t
  misc_feature (922)..(922): n is a, c, g, or t
  misc_feature (931)..(931): n is a, c, g, or t
  misc_feature (934)..(935): n is a, c, g, or t
  misc_feature (937)..(937): n is a, c, g, or t
ctggacatctgagacacaggaagtgataggtggcgggacggagggattaaagaagtattataaggaacttcagaaccaactgaatgagattgtagagctggtaagaggaaagttgtctaagcagaccaggaccactctgggggctttggttactattgatgtccntgctagagatgtggtcatggacatgattaaaatgggtgtctcacatgatacagatttcctgtggcttgctcagctccgatattattgggaaaatgagaatgcccgagttcgtatcattaattgcaatgtaaaatatgcttatgaatatcttggtaactcacctcgacttgtcattacgcctctaactgacaggtgttacagaacattgataggtgctttctatttaaaccttggaggtgctccagaggggccagcaggcacaggaaaaaccgaaaccaccaaggacttggctaaagctcttgctgtacagtgtgtggtgttcaactgttctgatgggctagattatctagcaatgggaaagttttttaaaggactggcttcttctggtgcttgggcttgctttgatgaattcaatcgaattgagttggaagtgttgtcagtggtagctcaacagatcctttgcattcagagagctattcaacagaagttggttgtgtttgtttttgaagggacagaacttaagctcaatccgaattgttttgtagctattaccatgaatcctggctatgcaggacnctctgaattgccggacaatcttaaggttctttttagaacagtggctatgatggttccaaactatgcgcttatagcagaaatctccctctactcttacggatttttgaatgcaagacctctgtctgtgaaaatagtaatgacctataggctttgctcagagcagctctcatcgcaatttcantacgactanggnntncgagc

SEQ ID NO: 88131 - DNA, 1420 bp, Homo sapiens
tgtttttaaaaatgagaaaatttggagagagaatactattatgtcaacggtacaagactctgaatcttgaagatgtagatggatataatatttagactttatatacacccatagatatgtatttatatatgcatacgttttgtataaatttacaattgactttttgtattctcttttctgtcattacaagaatgagatggaaaccaaaatagttgttccatcctcttacccaaagaggatactgaaaagtccggtatgtgcatgcacttgtttctctggggtcaaatctgaatgactttctctttaataatgaaaggggagagtcctggttagcttggaaaattggtaattagataagcttcctttcctaggttagtgactcaaatgtagcaatgataataaagttatgaccatatcaatgtggtctaaatatctagatggaaagcaaaaatatccagaagaggtttagggccatctagaccacaaacctggaacctggattgtggtttgatttttttcattttcaacctatatgttgtgtagaaatacaatttatatctgcatagctaaaggtaaagtgaaaatatgaccattatctgtttagtttgagaaatcatttttggataatatggataaattagctttaagaaacttctttgacatctgacttttccaccatttctatctgtatcaattgtattaattagataatggttaaatttttatttttttatcatgtagacatatgctttcatgcttttctgtgggtgaaagttgaacaattgctagctgatattatgtggaagttacaggttaaagtagaaccagaaattttaatataatctgatcaggttccttagtcccattcccatgtgaatctgaactttgaatttgaatctgaaaggcctacttatttgggccattttttgttggaacttgtgattgtaactcacagatgtttcagttcatattagaataaattgcccaatctataagagagtgtttaatcattggaatgaatgtaaatctgattctgatttggttatttatttgataacatttgagaaacagctaatgtggcttgacatcaatacttattaatgtcttcaacctaataatacaattggtgtcatgtatgaatgcttagctgacaataagaatttaatcaactttatttggagacaatgacttatcaaggaggtcctacccatttgtggtagggatatttcccttacagttgtgattacaagggattgtttctatagagagatgaacagcaacaacagtgacaatgatgacaacagaaaaactgacttttgaacttgagtatatccaatagatagaagaaaaaagatattagaattcatggaaattttgttttgcttttctatcaataaaagagttttcttgttaattggct

SEQ ID NO: 88132 - DNA, 593 bp, Homo sapiens
gcacgagattatattaaaatttctggtcagattcacatgggaatgggactaaggaactttgaatttgaatctgaaaggcctacttatttgggccattttttgttggaacttgtgattgtaactcacagatgtttcagttcatattagaataaattgcccaatctataagagagtgtttaatcattggaatgaatgtaaatctgattctgatttggttatttatttgataacatttgagaaacagctaatgtggcttgacatcaatacttattaatgtcttcaacctaataatacaattggtgtcatgtatgaatgcttagctgacaataagaatttaatcaactttatttggagacaatgacttatcaaggaggtcctacccatttgtggtagggatatttcccttacagttgtgattacaagggattgtttctatagagagatgaacagcaacaacagtgacaatgatgacaacagaaaaactgacttttgaacttgagtatatccaatagatagaagaaaaaagatattagaattcatggaaattttgttttgcttttctatcaataaaagagttttcttgttaattggct

SEQ ID NO: 88133 - DNA, 916 bp, Homo sapiens
ttcggtaaacgttacttatgtgcgtctcataaatcaggtgtctgagttctcaggctgtggctgcagtctaccattgaattacatcccgtgagcaatgttgtccgatttcaccggccagcacgttcttctcgagtgtgggattggtttttgcaagacctcgaaaggattttgataagccacctgcttaaggccggctgaaaaagaagaaaggagggcatatgtgggtcagctcactcggaatagaagaggaatcagcttttcttgtgcacgtgcaacagtggaagtgatggctgactgtgtgttggctccataagaagaacatcacagaaagcaaaatggtgccagctcaacaccagtatcctcggactcttcagacagaaaaacctgttaattccaatcacaattcattctttcattcagctcatggaagccaagcagggctttgggacattcattctggcaaagtgaaacaactgactttttgtgaatgctatttaagttgtttaaattttccacattggaaataaagtcattgcatttttgtgaggataaaacacaaattgtggtggagtccagcgtcatggtaacaataatattcctactaaattaagacactaatgaaacagaaatgtgattggaacaggtcatggtgcacacacaatttgttattgcatataaataaatgtcaatattctataaattgacatttatagacgtacgtgacaaaatttacaaaatgttaaaacatatgcacagatttactgaactacaaacttgtgataaagttgttcatgaatttttttaaaaaactggactttcacatgtgttttctcttttattttcccattatcaatcaattttagtggacattgagtctcagcatcctaaaatgttattaaacagtgtattaaaacag

SEQ ID NO: 88134 - DNA, 532 bp, Homo sapiens
caaaacacttaagattatgaagatataaaaaatatgtgtttaactaaatcagtagttttcaactgggggtgatttcaccactcatggaacatttgataatatctggagacatttttggtggtcacaactgggacattgctactggtgtctttgtggatggaggccagggatgaggctaaataacctatagctccccacagtaaagaactgtatggtccaaaatgtcaagagcactgaggctgtgaaacactgaactaaattacagctttataaaaaagcatttgtttctctgatgctacagatcataagatgatgctgtattgatagttattccatttacagtttctatgtaaaaaattgtcatattcttaaaattcatccatgttattgtatatatcaattgtttcttttattgttaacatttcattgcatgaatataccacagttttatccattcaccagtttaaggacaattggattatttcaaagtttgggtgattattaataaagcttctataaacattgttacata

SEQ ID NO: 88135 - DNA, 114 bp, Homo sapiens
acccttgcaactattttctaagttgaggaagtatgacgtatcaagcttcccacgccttagttctagttcagtaacttgtactcggtgtcttaagatccccatttgtgaatactc

SEQ ID NO: 88136 - DNA, 211 bp, Homo sapiens
caactcctatacctacagggacagcaaaaataattttaaaaccttttctgcaatctggcataaagaacaaataagcaaatttaagaaggagtcttcaactagcttcagtaaaagaaaccgtttcttctttaacttctgtaaataatcttattccttcaaagtagtttataataatttataaattattagtttaaactgtcactagatctaa

SEQ ID NO: 88137 - DNA, 338 bp, Homo sapiens
ggggcttcaacctgaaggttggaattgagtttgggataacaaagtgccccgggagggtgcatggactcattaaattgactcccatgtgggccttgcaaaactgcagtcagtgactggcagtggcagcctgggccattcctccattgtttctctgccattgtttctctgcagactgctaaggtgaagctgtggaaccacatcctcctctaacaagggagagaaagggagtcccaagatttggggatgtggcccagtaaggtgcctcccaaaaggaagaaagaaaaaaaaacctctcgcataggaaagctctctgtatttgcaggtctgtgttaactcct

SEQ ID NO: 88138 - DNA, 207 bp, Homo sapiens
ataggccatgccctcagggaggttggagtggcacatggctgtatctagcaggctcctgttgactggtgggtccaagcagtgagtgcctgtgatatgtttggtgctcaggacctgcttacttgctggaccacacttgacaatgtagctccttcccttcgccttcccaggggtgcgggaaacacacaggcatgaagagcgtggcctggg

SEQ ID NO: 88139 - DNA, 655 bp, Homo sapiens
ttttaagcacacgcaatctagatctcaaaactgataaaaggagggagcggccattcactttacaaaaggattctctgaaggatactattaagtcttctcaggaacattagaacaccttcgctttactatttttagttggtggcttttccgtctccttcagcatctactcaaaaccacagtgtagttgcacaagggtagtggtttttatgttttgcttactgctgtattccttgaactccagcatgaggcctaggtacagtgtagtattaccatagcacaggtccttgatggtcacagcagtcttccaaaaaaccatcatgtgcttgagagcttctgtgctactgaaaggggacacctgtcacccctgccagcctattgttgctgtgagtgggtgtggacccactgttgccagatcttcaggttgttttagaaaactcagaaatctaagttactagatttttctgtttttcagttactagattttaaaaacactgttcaaacaaaactgttagtttgtaacctttgcctttactttctcataatataatttttttagtgccttattaggcactttaatgagagacggcagccgtttaatttactgttaatttgtgatgtcttcagaagagtgaatggttttgctttcaggatactg

SEQ ID NO: 88140 - DNA, 458 bp, Homo sapiens
gacttagtcatatctaccaagggaaatctctttggagtttcaattattcacagacccatatggagttttaataaatatattctgctgaatgctttggaaataagctgcagacatcttaagacttcacttagaaatatttcaacatgcaactcctgagagtaaagcctttttcctccataaccacaatacccaagaaaattactaattctctaacatctaatatccaattcttaccaagtgacctcaactgccccccaaaatgtcttttataacagagactcaactattttgactcatgatctcactcttttgactcagaaaaaactcaggactccctggaaagtctgaacctctactacccctgaagaatattaaattcttcatatcacaaatactctattagctttattttctaaaacttttaataccatatttcaaatataaaactatattaaaca

SEQ ID NO: 88141 - DNA, 380 bp, Homo sapiens
cactgctctgtccaggtggtagccactggccccatgtggctattagcacttgaaatgtgactagtccaaattgagacattctgtaaatgtgaaatatacactggatttcaaacttgtaggaagaaacgcaaaatatttctaatacttatatcaatgatgtgttgaaataatattttagatatattgggctaaataagttatagtattacagtttattttgcttgtttttcctttttaaaaagtgtggctataagaaaaaaacattagcttcatatgcatgacttgctttgttttttattgggcagcataatgcaaagaggtttggactgttattatctgccttttagagtgaaagaaaagtaggcacagagaggttaagc

SEQ ID NO: 88142 - DNA, 430 bp, Homo sapiens
cactttggggtttcttcagcaaaatgcaaatccctccattatcttgtggtttaaaccaaagctgccttttggaaactcccgctgattctccagcctcatggagggtggcaggttcctcttttaagtgttccaggctaggagttgcgtggttaacgctggggtaatacacactctgtattttacatttgaggtaactgaggcaacctggaggaggtcacagagctaaccattagtgggagagcatcaggcacatgaggacctgcagctttgcaggaggaagatcctgatgcccccaagcatcctcacaggcgctctcggctggaggttcatctttcaaatcagccctgcctcctccagtcagctctgtctggtttagctcagctaacaggatgcgtcagcttacctgaataaaacactttacacccccacg

SEQ ID NO: 88143 - DNA, 607 bp, Homo sapiens
taataaactggaacttagagcagaattaccaggatagtgggagaaatctgaaaccatatcatatggaaaatggtgaaggctctagtaatatttattccatgctgttgacaccaatttaaaagttatctttaaatacttgaagagttatgtaaagattagatttttgactcaatatacaacaaattgtaaattctattacaaaaatagaatatactgtcttataagtcctcttctattaatattattattaaaacagaactaaatggaagggtggtaattaataaagattcaagctaaggtagggggcccggcatgttggctcatgcctgtaatcccagcctgaccaacatgaggttgaagcgggcagatcacttgaggtcaggagtttgagaccagcctgaccaacatggtgaaatcccatctctactaaaaatacaaaattagctgggcatggtggtgcacgcccataatcccagctactcaggaggctgaggcaggagaattgcttgaacacaggaggcagaagttgcagtgagccgggatcacgccactgcactccagcctgggcgacaaaaaaaccccggctccagccatctcaaaaaaaaaa

SEQ ID NO: 88144 - DNA, 138 bp, Homo sapiens
tctgttttacccttcctaattgcaagctacccaaggtctcatcaggatctgaaaatctgactgaaagacactttcctgaaaagtttccaactctccccactttccacacatagggacgccatatatgtttcagggccc

SEQ ID NO: 88145 - DNA, 1541 bp, Homo sapiens
accactggtcttcttgtgcttatccgggcaagaacttatcgaaatacaatagaagtttttacttagaagagattttcagggagaagtgaaatgacaacctcactagatacagttgagacctttggtaccacatcctactatgatgacgtgggcctgctctgtgaaaaagctgataccagagcactgatggcccagtttgtgcccccgctgtactccctggtgttcactgtgggcctcttgggcaatgtggtggtggtgatgatcctcataaaatacaggaggctccgaattatgaccaacatctacctgctcaacctggccatttcggacctgctcttcctcgtcacccttccattctggatccactatgtcagggggcataactgggtttttggccatggcatgtgtaagctcctctcagggttttatcacacaggcttgtacagcgagatctttttcataatcctgctgacaatcgacaggtacctggccattgtccatgctgtgtttgcccttcgagcccggactgtcacttttggtgtcatcaccagcatcgtcacctggggcctggcagtgctagcagctcttcctgaatttatcttctatgagactgaagagttgtttgaagagactctttgcagtgctctttacccagaggatacagtatatagctggaggcatttccacactctgagaatgaccatcttctgtctcgttctccctctgctcgttatggccatctgctacacaggaatcatcaaaacgctgctgaggtgccccagtaaaaaaaagtacaaggccatccggctcatttttgtcatcatggcggtgtttttcattttctggacaccctacaatgtggctatccttctctcttcctatcaatccatcttatttggaaatgactgtgagcggagcaagcatctggacctggtcatgctggtgacagaggtgatcgcctactcccactgctgcatgaacccggtgatctacgcctttgttggagagaggttccggaagtacctgcgccacttcttccacaggcacttgctcatgcacctgggcagatacatcccattccttcctagtgagaagctggaaagaaccagctctgtctctccatccacagcagagccggaactctctattgtgttttaggtcagatgcagaaaattgcctaaagaggaaggaccaaggagatgaagcaaacacattaagccttccacactcacctctaaaacagtccttcaaacttccagtgcaacactgaagctcttgaagacactgaaatatacacacagcagtagcagtagatgcatgtaccctaaggtcattaccacaggccaggggctgggcagcgtactcatcatcaaccctaaaaagcagagctttgcttctctctctaaaatgagttacctacattttaatgcacctgaatgttagatagttactatatgccgctacaaaaaggtaaaactttttatattttatacattaacttcagccagctattgatataaataaaacattttcacacaata

SEQ ID NO: 88146 - DNA, 1994 bp, Homo sapiens
tgctgggcgaatccctttctgatctggttcatttggaccctccaaagcccacaggctggaacggctgagtcatccaaacaaaaaaggtggcagcccatccctcccccaggagctctaccctgtctcaagtaggtgctaccctgttgctggtggctggctggaattccaagccagttgatcttatcctgtgaggtcccttggaagtggggcccacagactgacgctgctctgcttcctggattcagccctcttcctaaggagctcatggaccctggccgtcatcaggttcaacctcatattcaactgctgggccttgtcttctggccacacactctctccaaatcagcgatggtggggaactgaggagccagaggccattgtggaagaactccaagaaaacaatctccaggttatcacatctaaagcctgagcaagatttgaggctgggaagaggtggatcccagaattggaagaaggagtggtgacgcctaagctatcactggacatatcaaggacttcactaaattagcagggagaagtgaaatgacaacctcactagatacagttgagacctttggtaccacatcctactatgatgacgtgggcctgctctgtgaaaaagctgataccagagcactgatggcccagtttgtgcccccgctgtactccctggtgttcactgtgggcctcttgggcaatgtggtggtggtgatgatcctcataaaatacaggaggctccgaattatgaccaacatctacctgctcaacctggccatttcggacctgctcttcctcgtcacccttccattctggatccactatgtcagggggcataactgggtttttggccatggcatgtgtaagctcctctcagggttttatcacacaggcttgtacagcgagatctttttcataatcctgctgacaatcgacaggtacctggccattgtccatgctgtgtttgcccttcgagcccggactgtcacttttggtgtcatcaccagcatcgtcacctggggcctggcagtgctagcagctcttcctgaatttatcttctatgagactgaagagttgtttgaagagactctttgcagtgctctttacccagaggatacagtatatagctggaggcatttccacactctgagaatgaccatcttctgtctcgttctccctctgctcgttatggccatctgctacacaggaatcatcaaaacgctgctgaggtgccccagtaaaaaaaagtacaaggccatccggctcatttttgtcatcatggcggtgtttttcattttctggacaccctacaatgtggctatccttctctcttcctatcaatccatcttatttggaaatgactgtgagcggagcaagcatctggacctggtcatgctggtgacagaggtgatcgcctactcccactgctgcatgaacccggtgatctacgcctttgttggagagaggttccggaagtacctgcgccacttcttccacaggcacttgctcatgcacctgggcagatacatcccattccttcctagtgagaagctggaaagaaccagctctgtctctccatccacagcagagccggaactctctattgtgttttaggtcagatgcagaaaattgcctaaagaggaaggaccaaggagatgaagcaaacacattaagccttccacactcacctctaaaacagtccttcaaacttccagtgcaacactgaagctcttgaagacactgaaatatacacacagcagtagcagtagatgcatgtaccctaaggtcattaccacaggccaggggctgggcagcgtactcatcatcaaccctaaaaagcagagctttgcttctctctctaaaatgagttacctacattttaatgcacctgaatgttagatagttactatatgccgctacaaaaaggtaaaactttttatattttatacattaacttcagccagctattgatataaataaaacattttcacacaata

SEQ ID NO: 88147 - DNA, 383 bp, Homo sapiens
ctcgtgcaagaaacttctaccctacctttgaacattatggtaaattatgaattaattctttcccagctaaaagagattttaaaaaagcagaacctcaataggcatgataaagaatctccaccatgtaacactacattagtccaactaagttatcatgtcattgtccacttaacagagaatggagcttaattagagaaaaaaaatcataaaaatgttcacagtttcccccgaaatggaaagatgtacagggagatgtgggggtggagaaaaagaagagagaaggcagtcagtaacaaacacttggttataatgatgataagaaccatttcctttatgcaattttgttggtgttcatttttatatccctctcagctatatgatct

SEQ ID NO: 88148 - DNA, 311 bp, Homo sapiens
cctggtccttgaccaccacgtgtgtggtttattaactctgttcccgtagacataggcagccttaactccatcgggggaatggtctggccttacaggtcgaattcaagtgaatcaatcgaactatcctccaagatagagcagaatgaaagacccaggatcagtgcagaatgaaagaccattaggcctctagaaaagctgttagccctcaagtttggctaaaagcaggggctggcaaagtatggcctatgggcagagctgcccctcaatctgtttttatggcttcaagctaagaatgacttaaatttttaaac

SEQ ID NO: 88149 - DNA, 378 bp, Homo sapiens
ctatagcagttaatcttattaaataaaacatagcaatttaaatgcactaaagtcttaagacttttccagttaaagtttgttgagcatgtagaaattacttagtatcttagagttctaggtgcaaaatatactttttaatatcattattttgggaggttagtctttctactccctactctcctctctaccagcctcatccagagaaataactctctcaaggtactgataagagatgccacagtcaggctagtcaatggagtgaaagatgtcactgccagatcccctgtatagtggcacagactcctggaattgaaacggagctagcttaaggagtcatttaatccagacctctttcttcctgcaaggggtctgcctgaa

SEQ ID NO: 88150 - DNA, 289 bp, Homo sapiens
gctttatggttgcaagttttgtgaataatctttaatccttttgagttaaagtgttttttttggtaccacaagagtcctgtattatttagtaccacaagagtcctgtattattcttttgcatatggatatctagttttggaaaccttccccattgtgttgttttggtggtgttttgaaaaatgtgttcactctgtgtaaatttgtgtttattattgagcgctctcattttgctcactggtctgtgtttctctgtgtatgccagtaacatatggattggttaactagggat

SEQ ID NO: 88151 - DNA, 300 bp, Homo sapiens
tggcatttggagcagtaagtgtgcctgggtcatgtgtctgtcagcagctatcctgggttggctcacagggcagtggcagggtaattgaagctcacacatcattacttgtgcagtatagtacaaagaagtcagtctcaaggcgaatccagatttaaggagtaagaagatatactctatttcttgatgcaacaagctacaaattacaaagcatgtagatacagaattatggccatttttgcaatctactccccataatagagtctgggataaaatgggtcctctgttattttatgatttaat

SEQ ID NO: 88152 - DNA, 817 bp, Homo sapiens
tttttacatgtgggttggtagggaaggataatttgtattggatgatagggcagcatgcttcctttttacgtgtgagttggtaggggaggatgattagtattggacaagagggcagcaggctcctgtatgtgctgtcagctccattggaccgctgtgaaggccttctgaccccagagcagtttgagatgctgcagtggcctggatgggtctatgtgtccaggtgacaggtgagagcttttgatatttatgttatgtagaatactcatatgcttggatatgttttaaataaagcatagtatgaattttagttcttttttgcttttctttggaaagagggaaaattatacttagtgacacaaatattttttgtctgatcaagtacctaactgattaatgagctaaagcaaagtttgatcccaacttctggagagaggtagatctggcaactgaagaagaatataactgaattttgctaaaaaaaaaagtgctgattcgaaaagttgttttatgaagtaaaaattctaagctcttatctcttaggctttattttgctaacattgttagaactagcacatctggcttagattccaaaatagtttggttttatgcttgtaaaaatgaaaccaatcaaattggaattgaagatagatgaaaggatggattttggtacaatgaggattcttaaacacagtaaagttatcagggaagatcctgaacattgcctttctgagtgtcccttaaaaatagactggtgtcaaacatcagcatcacacaatatacccaggtaacaaacttgaacacgtacccgttgaatcta

SEQ ID NO: 88153 - DNA, 229 bp, Homo sapiens
gactgactcaagatactcatgaacgtggaaaactcctaaatgtgtcattctgagttcctgagaagttgaacatacacagatgacaaaaaagaatgccatttagccataactaccctttctagattaccaagtatttgtaggtttattggcaagatagcttaaattacgtatgtatttctggcctgcaacatcatgtaatagaagagttgcagaattctttgcagttaag

SEQ ID NO: 88154 - DNA, 514 bp, Homo sapiens
ctttggagcactgtggtcacttgctggattccctttaaactgccattttggaattcatgccaagacaccactgaatgtaatttgggacagcctatgaagcagagaattcagaaaaagcccatgtacctttgaaaatacatttgggaggaccaccacattaaccaaatgaaatagaaccaacagttcccaggctgtttgggttaatttctactttagctgttcacagtgtggggattggggggcagtgatttagaggctccacggagaccctaggaggtgctgcttcttggggtccagtcagtttgcccttcaacaccaagcagccccctgggaggaagccctgtgctctctgctgatggcacaagaagtcagttctctctggaggtgctttacttaaaccagtgctgtttatggtgccaggtttctgatgcaatgcctgcctccagccagcctgtcgaacaaatcgaagtgtgatgggtggctggcttggggccagagtggcgtcactgcccat

SEQ ID NO: 88155 - DNA, 465 bp, Homo sapiens
agagacggggttttgtgacagtggccaggctggtcttgaactcctgacctcaggtgatccacttgcctcggcctcccaaagtgttgggattacaggagtgagccaccacgcccagactcaatgcacccatttcacagatgcgccacagcagtccagagagggctgctggaacatgaagcatcaggcagcaccagggtcctgagctgggtcaattttccaacctggaggttggaagtcgaggtgagcatgaaatcaggtggtcatccagtattcaggaccctctggcctcccaggcccccagcctccttcttcctgtcagccagattcccgtgcaccgcagtcacgcttgctagtttccatggacacgcgtggactcctaggaaaccttttccggagactgggcacgagaggagtgatttgcatctcatttgaatgctaggccctgccccgaaagtgtgccatctc

SEQ ID NO: 88156 - DNA, 538 bp, Homo sapiens
ttccagctgggcactcctgcagcatggctaagatgacaactcaagttccctgggagtgggggttcctgggatgtgaacctttcggtgcaaaaactggagaagttccagttgggaccccaggcatagatactaggataaatagggcctctctcctccaggagcatcaatttaacccaaagattcttggagtcagtttcacataagtaatcttgttgaaaatagtaatcccaacagatctatttttccaaatgcaccatttgcataaatctcagaaaaaagacaacttcaagaacatacctttgctgggcaccatggctcatgcctgtaatcccaactacttggcaggctgaggcacgaggatcacttgaggccaggagtctgagatcagcttgggcaactgatttatggtttggatttgtgtccatgcccttcctcttctgccatgattataagtttcctgaggcctccctagccatgcttcctgtacagcctacagaactatgagtcaattaaacctcttttctttataaattaccca

SEQ ID NO: 88157 - DNA, 770 bp, Homo sapiens
  misc_feature (1)..(1): n is a, c, g, or t
nggtgtcgggcacaccatagcgctaggtacgaggcctgggtgttggcggcgcgcacgctgcgctccttcccctggcaggggggcggcgggcgagcggagaggcccgcggggctcgcgggagtccagggcagacgggatgggtctccgtgctgaaacccccggcgctcctgccacagcttagaagcaaagttaagagactcatcagattctgagctgctgcgggatattttgcagaagactgtgaagcatcctgtgtgtgtgtgaagcacccgccgtcagtcaagaaagcccggtgctttctctcagaactcatcaaaaagcacgaggctgtccacatggaggctttggacgagctgtatgaggcactggcagagaccctgatggccaaggagtccacccagggccaccggagttatttgctgacgtgctgtattgcccagaagccatcgtgtcgctggtcgggatcctgcggaggctggctgcctgctgggagcaccagcaggctcctgaggtctacgtggcctttaccgtccacaacccagagacgtgccagctgttcaccaccgagctaggccgggctgggatcatatgggaagcggaagctcatcatgaccagaaactgtttccctatggagagcacttggagatggcaatgctgaacctcacactgtaggactcacacacgactccaacgggattgtgagaatcaagtcaatctcatgggaagaatttttatatgggaaagcggataaaactttcattgtactgga

SEQ ID NO: 88158 - DNA, 2804 bp, Homo sapiens
  misc_feature (1439)..(1439): n is a, c, g, or t
  misc_feature (2115)..(2115): n is a, c, g, or t
  misc_feature (2499)..(2499): n is a, c, g, or t
  misc_feature (2795)..(2795): n is a, c, g, or t
  misc_feature (2802)..(2802): n is a, c, g, or t
cggtgtacccgggttaggatatgtgaccacgcgtcgcgtatggcgcccgaggagaatgcggggaccgaactcttgctgcagagtttcgagcgccgcttcctggcggcgcgcacgctgcgctccttcccctggcaggggggcggcgggcgagcggagaggcccgcggggctcgcgggagtccagggcagacgggatgggtctccgtgctgaaacccccggcgctcctgccacagcttagaagcaaagttaagagactcatcagattctgagctgctgcgggatattttgcagaagactgtgaagcatcctgtgtgtgtgtgaagcacccgccgtcagtcaagaaagcccggtgctttctctcagaactcatcaaaaagcacgaggctgtccacatggaggctttggacgagctgtatgaggcactggcagagaccctgatggccaaggagtccacccagggccaccggagttatttgctgacgtgctgtattgcccagaagccatcgtgtcgctggtcgggatcctgcggaggctggctgcctgctgggagcaccagcaggctcctgaggtctacgtggcctttaccgtccacaacccagagacgtgccagctgttcaccaccgagctaggccgggctgggatcatatgggaagcggaagctcatcatgaccagaaactgtttccctatggagagcacttggagatggcaatgctgaacctcacactgtaggactcacacacgactccaacgggattgtgagaatcaagtcaatctcatgggaagaatttttatatgggaaagcggataaaactttcattgtactggaatgtttggagaatgttaaattccaaatcagaaaccacaaactgccctctaataagacatcggctatctaagcgtgtgggtgccccctttctgccagcagttctggttcttacgaaaatcaccatatatcagacatgaaaattctggctttgtgcagataaaaaagtgtgtatcaagtatgacgttcccccaatgtggacacacttggttcctcagaaagccaagcccactgcagctgccacatccctggacacactcggttcctcacaaagccaagcccgctgcagctgtcacatccctggacacactcggttcctcacaaagccaagcccactgcagctgccacatccctgagcctatggtgcagcaggtgcttttttcaagacagggatcaaagtgttaggaacacggcagaaaggtgacacctggagaccaaatgcaggatgaggagtactgcagaggtcacagggaagtcagagaacagtaatacgctaacaggggcacggggcatgaagaacaaaagacaggaaaaaagcatctgcaaaatactaaagagcagagcttacctcattgcctgtccccaccccatcccaggtcaccacctggctgaccncaggtccccgacccaacaacaacccctcccaagtccctaactccctcacttggacttgagacccttcacaccccagcagcgctccgcctcccacttgacatcatgctttctggaaacttccccgtatgtcccactttcccacacttggtgccctggagcaccttccggcctctacatgctgtacgttcccctgtgagcaccctcctctcggcctctggccaacacagtcccacccatctgtgggtaacaagggggagtgggtgttcttttcagccttgctaaactctctgaatcaaggatcacaaactacagcctgcaggccaaatccagcccacagcctgtgtttgtaaataaagctttattggaagaaagccacaccccttaatctacagatgatctgtggctactttcacaccacaacagagtaccatggttctgacagagactgggggacccagtctaaatgacttctgacctggacctttactgaaaatcctcccaatcattctgttgacaagaatgatgtattactttttgcaataagaaacaagtaacctttgcagaattccacccatctttcaaggctggtcccagaagttcccttagcccatgcacctacctgatcctgatcacttcctaaactgcagcctggcccacctggatccagcatcatttntggcgtgtcagctccataaatccagagggcaggtggcgttgtgtcctaactttcccgagcctactgtactgaaacaggacagcagagtaggccagcctctgtgacttctgctccctccctagcttttccaccagaccccccatggtcccaccctggctgtgggaagcagggatcagggagtgtggctcggtgccagtctccagaaccctgcccaccctggcgtggtggcagacatggctacctgcagctgagctgccagttcctctgagtcctcaaagaccaggccattttcttcatgtttcaccagctcatgtaaactgcagagagaaccaagggaacccgagagcttcctggagaagacaccagacccctggggtgcccagntgggctcccacccaccccacgctcaagccaggctgggggttggaacagggggtgtggtttctgggagctggttcttagatttggcatctgaagggtataaaggcctggcgggggtgcacatcaaaatggccaaaccgatttgaggagggagccttaaggagggtttgtaccttctgtgctggatgctcttcaaggactgaagaattatttttgcatgtttttctaaattccatggccatggaacaagtaaatgcaaccccctggggactggttcagcacataaaagatgacttttntaggacncc

SEQ ID NO: 88159 - DNA, 2747 bp, Homo sapiens
  misc_feature (1)..(1): n is a, c, g, or t
  misc_feature (1382)..(1382): n is a, c, g, or t
  misc_feature (2058)..(2058): n is a, c, g, or t
  misc_feature (2442)..(2442): n is a, c, g, or t
  misc_feature (2738)..(2738): n is a, c, g, or t
  misc_feature (2745)..(2745): n is a, c, g, or t
nggtgtcgggcacaccatagcgctaggtacgaggcctgggtgttggcggcgcgcacgctgcgctccttcccctggcaggggggcggcgggcgagcggagaggcccgcggggctcgcgggagtccagggcagacgggatgggtctccgtgctgaaacccccggcgctcctgccacagcttagaagcaaagttaagagactcatcagattctgagctgctgcgggatattttgcagaagactgtgaagcatcctgtgtgtgtgtgaagcacccgccgtcagtcaagaaagcccggtgctttctctcagaactcatcaaaaagcacgaggctgtccacatggaggctttggacgagctgtatgaggcactggcagagaccctgatggccaaggagtccacccagggccaccggagttatttgctgacgtgctgtattgcccagaagccatcgtgtcgctggtcgggatcctgcggaggctggctgcctgctgggagcaccagcaggctcctgaggtctacgtggcctttaccgtccacaacccagagacgtgccagctgttcaccaccgagctaggccgggctgggatcatatgggaagcggaagctcatcatgaccagaaactgtttccctatggagagcacttggagatggcaatgctgaacctcacactgtaggactcacacacgactccaacgggattgtgagaatcaagtcaatctcatgggaagaatttttatatgggaaagcggataaaactttcattgtactggaatgtttggagaatgttaaattccaaatcagaaaccacaaactgccctctaataagacatcggctatctaagcgtgtgggtgccccctttctgccagcagttctggttcttacgaaaatcaccatatatcagacatgaaaattctggctttgtgcagataaaaaagtgtgtatcaagtatgacgttcccccaatgtggacacacttggttcctcagaaagccaagcccactgcagctgccacatccctggacacactcggttcctcacaaagccaagcccgctgcagctgtcacatccctggacacactcggttcctcacaaagccaagcccactgcagctgccacatccctgagcctatggtgcagcaggtgcttttttcaagacagggatcaaagtgttaggaacacggcagaaaggtgacacctggagaccaaatgcaggatgaggagtactgcagaggtcacagggaagtcagagaacagtaatacgctaacaggggcacggggcatgaagaacaaaagacaggaaaaaagcatctgcaaaatactaaagagcagagcttacctcattgcctgtccccaccccatcccaggtcaccacctggctgaccncaggtccccgacccaacaacaacccctcccaagtccctaactccctcacttggacttgagacccttcacaccccagcagcgctccgcctcccacttgacatcatgctttctggaaacttccccgtatgtcccactttcccacacttggtgccctggagcaccttccggcctctacatgctgtacgttcccctgtgagcaccctcctctcggcctctggccaacacagtcccacccatctgtgggtaacaagggggagtgggtgttcttttcagccttgctaaactctctgaatcaaggatcacaaactacagcctgcaggccaaatccagcccacagcctgtgtttgtaaataaagctttattggaagaaagccacaccccttaatctacagatgatctgtggctactttcacaccacaacagagtaccatggttctgacagagactgggggacccagtctaaatgacttctgacctggacctttactgaaaatcctcccaatcattctgttgacaagaatgatgtattactttttgcaataagaaacaagtaacctttgcagaattccacccatctttcaaggctggtcccagaagttcccttagcccatgcacctacctgatcctgatcacttcctaaactgcagcctggcccacctggatccagcatcatttntggcgtgtcagctccataaatccagagggcaggtggcgttgtgtcctaactttcccgagcctactgtactgaaacaggacagcagagtaggccagcctctgtgacttctgctccctccctagcttttccaccagaccccccatggtcccaccctggctgtgggaagcagggatcagggagtgtggctcggtgccagtctccagaaccctgcccaccctggcgtggtggcagacatggctacctgcagctgagctgccagttcctctgagtcctcaaagaccaggccattttcttcatgtttcaccagctcatgtaaactgcagagagaaccaagggaacccgagagcttcctggagaagacaccagacccctggggtgcccagntgggctcccacccaccccacgctcaagccaggctgggggttggaacagggggtgtggtttctgggagctggttcttagatttggcatctgaagggtataaaggcctggcgggggtgcacatcaaaatggccaaaccgatttgaggagggagccttaaggagggtttgtaccttctgtgctggatgctcttcaaggactgaagaattatttttgcatgtttttctaaattccatggccatggaacaagtaaatgcaaccccctggggactggttcagcacataaaagatgacttttntaggacncc

SEQ ID NO: 88160 - DNA, 2702 bp, Homo sapiens
  misc_feature (1337)..(1337): n is a, c, g, or t
  misc_feature (2013)..(2013): n is a, c, g, or t
  misc_feature (2397)..(2397): n is a, c, g, or t
  misc_feature (2693)..(2693): n is a, c, g, or t
  misc_feature (2700)..(2700): n is a, c, g, or t
cggtgtacccgggttaggatatgtgaccacgcgtcgcgtatggcgcccgaggagaatgcggggaccgaactcttgctgcagagtttcgagcgccgcttcctggcggcgcgcacgctgcgctccttcccctggcaggggggcggcgggcgagcggagaggcccgcggggctcgcgggagtccagggcagacgggatgggtctccgtgctgaaacccccggcgctcctgccacagcttagaagcaaagttaagagactcatcagattctgagctgctgcgggatattttgcagaagactgtgaagcatcctgtgtgtgtgtgaagcacccgccgtcagtcaagaaagcccggtgctttctctcagaactcatcaaaaagacgtgctgtattgcccagaagccatcgtgtcgctggtcgggatcctgcggaggctggctgcctgctgggagcaccagcaggctcctgaggtctacgtggcctttaccgtccacaacccagagacgtgccagctgttcaccaccgagctaggccgggctgggatcatatgggaagcggaagctcatcatgaccagaaactgtttccctatggagagcacttggagatggcaatgctgaacctcacactgtaggactcacacacgactccaacgggattgtgagaatcaagtcaatctcatgggaagaatttttatatgggaaagcggataaaactttcattgtactggaatgtttggagaatgttaaattccaaatcagaaaccacaaactgccctctaataagacatcggctatctaagcgtgtgggtgccccctttctgccagcagttctggttcttacgaaaatcaccatatatcagacatgaaaattctggctttgtgcagataaaaaagtgtgtatcaagtatgacgttcccccaatgtggacacacttggttcctcagaaagccaagcccactgcagctgccacatccctggacacactcggttcctcacaaagccaagcccgctgcagctgtcacatccctggacacactcggttcctcacaaagccaagcccactgcagctgccacatccctgagcctatggtgcagcaggtgcttttttcaagacagggatcaaagtgttaggaacacggcagaaaggtgacacctggagaccaaatgcaggatgaggagtactgcagaggtcacagggaagtcagagaacagtaatacgctaacaggggcacggggcatgaagaacaaaagacaggaaaaaagcatctgcaaaatactaaagagcagagcttacctcattgcctgtccccaccccatcccaggtcaccacctggctgaccncaggtccccgacccaacaacaacccctcccaagtccctaactccctcacttggacttgagacccttcacaccccagcagcgctccgcctcccacttgacatcatgctttctggaaacttccccgtatgtcccactttcccacacttggtgccctggagcaccttccggcctctacatgctgtacgttcccctgtgagcaccctcctctcggcctctggccaacacagtcccacccatctgtgggtaacaagggggagtgggtgttcttttcagccttgctaaactctctgaatcaaggatcacaaactacagcctgcaggccaaatccagcccacagcctgtgtttgtaaataaagctttattggaagaaagccacaccccttaatctacagatgatctgtggctactttcacaccacaacagagtaccatggttctgacagagactgggggacccagtctaaatgacttctgacctggacctttactgaaaatcctcccaatcattctgttgacaagaatgatgtattactttttgcaataagaaacaagtaacctttgcagaattccacccatctttcaaggctggtcccagaagttcccttagcccatgcacctacctgatcctgatcacttcctaaactgcagcctggcccacctggatccagcatcatttntggcgtgtcagctccataaatccagagggcaggtggcgttgtgtcctaactttcccgagcctactgtactgaaacaggacagcagagtaggccagcctctgtgacttctgctccctccctagcttttccaccagaccccccatggtcccaccctggctgtgggaagcagggatcagggagtgtggctcggtgccagtctccagaaccctgcccaccctggcgtggtggcagacatggctacctgcagctgagctgccagttcctctgagtcctcaaagaccaggccattttcttcatgtttcaccagctcatgtaaactgcagagagaaccaagggaacccgagagcttcctggagaagacaccagacccctggggtgcccagntgggctcccacccaccccacgctcaagccaggctgggggttggaacagggggtgtggtttctgggagctggttcttagatttggcatctgaagggtataaaggcctggcgggggtgcacatcaaaatggccaaaccgatttgaggagggagccttaaggagggtttgtaccttctgtgctggatgctcttcaaggactgaagaattatttttgcatgtttttctaaattccatggccatggaacaagtaaatgcaaccccctggggactggttcagcacataaaagatgacttttntaggacncc

SEQ ID NO: 88161 - DNA, 3103 bp, Homo sapiens
  misc_feature (1738)..(1738): n is a, c, g, or t
  misc_feature (2414)..(2414): n is a, c, g, or t
  misc_feature (2798)..(2798): n is a, c, g, or t
  misc_feature (3094)..(3094): n is a, c, g, or t
  misc_feature (3101)..(3101): n is a, c, g, or t
cggtgtacccgggttaggatatgtgaccacgcgtcgcgtatggcgcccgaggagaatgcggggaccgaactcttgctgcagagtttcgagcgccgcttcctggcggcgcgcacgctgcgctccttcccctggcaggggggcggcgggcgagcggagaggcccgcggggctcgcgggagtccagggcagacgggatgggtctccgtgctgaaacccccggcgctcctgccacagcttagaagcaaagttaagagactcatcagattctgagctgctgcgggatattttgcagaagactgtgaagcatcctgtgtgtgtgtgaagcacccgccgtcagtcaagaaagcccggtgctttctctcagaactcatcaaaaagccctcgggaggctcagtcacactctccgagagcacagccatcatctcccatggtaccacaggcctggtcacatgggatgccaccctctaccttgcagaatgggccatcgagaacccagcagccttcactaacaggactgtcctagagcttggcagtggtgccggcctcacaggcctggccatctgcaagatgtaccgcccccgggcattcatcttcagtgactgtcacagccgggtcctcgagcagctccgagggaatgtccttctcaatggcctctcaattagaggcagacatcactgccaacttagacagccccagggtgacagtggcccagctggactgggacgtagcgacggtccatcagctctctgccttccagccagatgttgtcattgcagcagacgtgctgtattgcccagaagccatcgtgtcgctggtcgggatcctgcggaggctggctgcctgctgggagcaccagcaggctcctgaggtctacgtggcctttaccgtccacaacccagagacgtgccagctgttcaccaccgagctaggccgggctgggatcatatgggaagcggaagctcatcatgaccagaaactgtttccctatggagagcacttggagatggcaatgctgaacctcacactgtaggactcacacacgactccaacgggattgtgagaatcaagtcaatctcatgggaagaatttttatatgggaaagcggataaaactttcattgtactggaatgtttggagaatgttaaattccaaatcagaaaccacaaactgccctctaataagacatcggctatctaagcgtgtgggtgccccctttctgccagcagttctggttcttacgaaaatcaccatatatcagacatgaaaattctggctttgtgcagataaaaaagtgtgtatcaagtatgacgttcccccaatgtggacacacttggttcctcagaaagccaagcccactgcagctgccacatccctggacacactcggttcctcacaaagccaagcccgctgcagctgtcacatccctggacacactcggttcctcacaaagccaagcccactgcagctgccacatccctgagcctatggtgcagcaggtgcttttttcaagacagggatcaaagtgttaggaacacggcagaaaggtgacacctggagaccaaatgcaggatgaggagtactgcagaggtcacagggaagtcagagaacagtaatacgctaacaggggcacggggcatgaagaacaaaagacaggaaaaaagcatctgcaaaatactaaagagcagagcttacctcattgcctgtccccaccccatcccaggtcaccacctggctgaccncaggtccccgacccaacaacaacccctcccaagtccctaactccctcacttggacttgagacccttcacaccccagcagcgctccgcctcccacttgacatcatgctttctggaaacttccccgtatgtcccactttcccacacttggtgccctggagcaccttccggcctctacatgctgtacgttcccctgtgagcaccctcctctcggcctctggccaacacagtcccacccatctgtgggtaacaagggggagtgggtgttcttttcagccttgctaaactctctgaatcaaggatcacaaactacagcctgcaggccaaatccagcccacagcctgtgtttgtaaataaagctttattggaagaaagccacaccccttaatctacagatgatctgtggctactttcacaccacaacagagtaccatggttctgacagagactgggggacccagtctaaatgacttctgacctggacctttactgaaaatcctcccaatcattctgttgacaagaatgatgtattactttttgcaataagaaacaagtaacctttgcagaattccacccatctttcaaggctggtcccagaagttcccttagcccatgcacctacctgatcctgatcacttcctaaactgcagcctggcccacctggatccagcatcatttntggcgtgtcagctccataaatccagagggcaggtggcgttgtgtcctaactttcccgagcctactgtactgaaacaggacagcagagtaggccagcctctgtgacttctgctccctccctagcttttccaccagaccccccatggtcccaccctggctgtgggaagcagggatcagggagtgtggctcggtgccagtctccagaaccctgcccaccctggcgtggtggcagacatggctacctgcagctgagctgccagttcctctgagtcctcaaagaccaggccattttcttcatgtttcaccagctcatgtaaactgcagagagaaccaagggaacccgagagcttcctggagaagacaccagacccctggggtgcccagntgggctcccacccaccccacgctcaagccaggctgggggttggaacagggggtgtggtttctgggagctggttcttagatttggcatctgaagggtataaaggcctggcgggggtgcacatcaaaatggccaaaccgatttgaggagggagccttaaggagggtttgtaccttctgtgctggatgctcttcaaggactgaagaattatttttgcatgtttttctaaattccatggccatggaacaagtaaatgcaaccccctggggactggttcagcacataaaagatgacttttntaggacncc

SEQ ID NO: 88162 - DNA, 3119 bp, Homo sapiens
  misc_feature (1754)..(1754): n is a, c, g, or t
  misc_feature (2430)..(2430): n is a, c, g, or t
  misc_feature (2814)..(2814): n is a, c, g, or t
  misc_feature (3110)..(3110): n is a, c, g, or t
  misc_feature (3117)..(3117): n is a, c, g, or t
cggtgtacccgggttaggatatgtgaccacgcgtcgcgtatggcgcccgaggagaatgcggggaccgaactcttgctgcagagtttcgagcgccgcttcctggcggcgcgcacgctgcgctccttcccctggcaggggggcggcgggcgagcggagaggcccgcggggctcgcgggagtccagggcagacgggatgggtctccgtgctgaaacccccggcgctcctgccacagcttagaagcaaagttaagagactcatcagattctgagctgctgcgggatattttgcagaagactgtgaagcatcctgtgtgtgtgtgaagcacccgccgtcagtcaagaaagcccggtgctttctctcagaactcatcaaaaagcacgaggctgtccacatggaggctttggacgagctgtatgaggcactggcagagaccctgatggccaaggagtccacccagggccaccggagttatttgctgacgtgctgtattgcccagaagccatcgtgtcgctggtcgggatcctgcggaggctggctgcctgctgggagcaccagcaggctcctgaggtctacgtggcctttaccgtccacaacccagagacgtgccagctgttcaccaccgagctaggccgggctgggatcatatgggaagcggaagctcatcatgaccagaaactgtttccctatggagagcacttggagatggcaatgctgaacctcacactgtaggactcacacacgactccaacgggattgtgagaatcaagtcaatctcatgggaagaatttttatatgggaaagcggataaaactttcattgtactggaatgtttggagaatgttaaattccaaatcagaaaccacaaactgccctctaataagacatcggctatctaagcgtgtgggtgccccctttctgccagcagttctggttcttacgaaaatcaccatatatcagacatgaaaattctggctttgtgcagataaaaaagtgtgtatcaagtatgacgttcccccaatgtggacacacttggttcctcagaaagccaagcccactgcagctgccacatccctggacacactcggttcctcacaaagccaagcccgctgcagctgtcacatccctggacacactcggttcctcacaaagccaagcccactgcagctgccacatccctgagcctatggtgcagcaggtgcttttttcaagacagggatcaaagtgttaggaacacggcagaaaggtgacacctggagaccaaatgcaggatgaggagtactgcagaggtcacagggaagtcagagaacagtaatacgctaacaggggcacggggcatgaagaacaaaagacaggaagcgtttcagagactccaaagaagaaatcagggccaaccacagcttcccgggtcattcaccaggtggcaccactgccgtcatttcagcttctggccactgggaggcgctgctcgaaagggtttgccctgacactccaagaagctgcgggaaggacagcaggggccctggggttttagcctctggcccaggagttatgtgtccataaccaaagggagcacagtctgcacccagctctcatcccatcagagctgctgcgactcctgcaggttcttccggaactggtttagcttgcctgcaggatcaggaaagtttgagaaaagcatctgcaaaatactaaagagcagagcttacctcattgcctgtccccaccccatcccaggtcaccacctggctgaccncaggtccccgacccaacaacaacccctcccaagtccctaactccctcacttggacttgagacccttcacaccccagcagcgctccgcctcccacttgacatcatgctttctggaaacttccccgtatgtcccactttcccacacttggtgccctggagcaccttccggcctctacatgctgtacgttcccctgtgagcaccctcctctcggcctctggccaacacagtcccacccatctgtgggtaacaagggggagtgggtgttcttttcagccttgctaaactctctgaatcaaggatcacaaactacagcctgcaggccaaatccagcccacagcctgtgtttgtaaataaagctttattggaagaaagccacaccccttaatctacagatgatctgtggctactttcacaccacaacagagtaccatggttctgacagagactgggggacccagtctaaatgacttctgacctggacctttactgaaaatcctcccaatcattctgttgacaagaatgatgtattactttttgcaataagaaacaagtaacctttgcagaattccacccatctttcaaggctggtcccagaagttcccttagcccatgcacctacctgatcctgatcacttcctaaactgcagcctggcccacctggatccagcatcatttntggcgtgtcagctccataaatccagagggcaggtggcgttgtgtcctaactttcccgagcctactgtactgaaacaggacagcagagtaggccagcctctgtgacttctgctccctccctagcttttccaccagaccccccatggtcccaccctggctgtgggaagcagggatcagggagtgtggctcggtgccagtctccagaaccctgcccaccctggcgtggtggcagacatggctacctgcagctgagctgccagttcctctgagtcctcaaagaccaggccattttcttcatgtttcaccagctcatgtaaactgcagagagaaccaagggaacccgagagcttcctggagaagacaccagacccctggggtgcccagntgggctcccacccaccccacgctcaagccaggctgggggttggaacagggggtgtggtttctgggagctggttcttagatttggcatctgaagggtataaaggcctggcgggggtgcacatcaaaatggccaaaccgatttgaggagggagccttaaggagggtttgtaccttctgtgctggatgctcttcaaggactgaagaattatttttgcatgtttttctaaattccatggccatggaacaagtaaatgcaaccccctggggactggttcagcacataaaagatgacttttntaggacncc

SEQ ID NO: 88163 - DNA, 989 bp, Homo sapiens
cggtgtacccgggttaggatatgtgaccacgcgtcgcgtatggcgcccgaggagaatgcggggaccgaactcttgctgcagagtttcgagcgccgcttcctggcggcgcgcacgctgcgctccttcccctggcaggggggcggcgggcgagcggagaggcccgcggggctcgcgggagtccagggcagacgggatgggtctccgtgctgaaacccccggcgctcctgccacgtgagttcctgggctctccccggtcagggccgcgagacccggtccccgtccctggggcctggccagagtcgctcgcacccctcctgccccgcgagctggcggcggaagatgagggcgtctccaccgccttgggggggcagacgcgtgctcggtgtggggtacagttcacgatcattttcacgactttttaaagagcttagaagcaaagttaagagactcatcagattctgagctgctgcgggatattttgcagaaggtggtgaagcatgaaatgttgggagagctgctttaaaacccagcacaaggctgggtgcactggctcacacctgtaatcccaggactctgggaggctgaggtggacggatcacctaaggtcaggagttcaacaccagcctagccaacatgactgtgaagcatcctgtgtgtgtgtgaagcacccgccgtcagtcaagaaagcccggtgctttctctcagaactcatcaaaaagacgtgctgtatttgcccagaagccatcgggtcgctggtcgggatcagcggaaggatgttgctgccggagaccaaaagctcctgaggcatagtgggcttaacggcaacacccaaaaagtccagagggtaccaccgagaagccagtggacataagggagggaagccaatgcagaatgtcccacgagacacacgcggaggagggcccaagagaagacccgaacaaggatgaacacactcggaaatgagaaggaccggagggagagaaacaacg

SEQ ID NO: 88164 - DNA, 900 bp, Homo sapiens
cggtgtacccgggttaggatatgtgaccacgcgtcgcgtatggcgcccgaggagaatgcggggaccgaactcttgctgcagagtttcgagcgccgcttcctggcggcgcgcacgctgcgctccttcccctggcaggggggcggcgggcgagcggagaggcccgcggggctcgcgggagtccagggcagacgggatgggtctccgtgctgaaacccccggcgctcctgccacagcttagaagcaaagttaagagactcatcagattctgagctgctgcgggatattttgcagaagactgtgaagcatcctgtgtgtgtgtgaagcacccgccgtcagtcaagaaagcccggtgctttctctcagaactcatcaaaaagcacgaggctgtccacatggaggctttggacgagctgtatgaggcactggcagagaccctgatggccaaggagtccacccagggccaccggagttatttgctgccctcgggaggctcagtcacactctccgagagcacagccatcatctcccatggtaccacaggcctggtcacatgggatgccaccctctaccttgcagaatgggccatcgagaacccagcagccttcactaacaggactgtcctagagcttggcagtggtgccggcctcacaggcctggccatctgcaagatgtaccgcccccgggcattcatcttcagtgactgtcacagccgggtcctcgagcagctccgagggaatgtccttctcaatggcctctcaattagaggcagacatcactgccaacttagacagccccagggtgacagtggcccagctggactgggacgtagcgacggtccatcagctctctgccttccagccagatgttgtcattgcagcaggtaatggccagccccaggca

SEQ ID NO: 88165 - DNA, 2724 bp, Homo sapiens
  misc_feature (1359)..(1359): n is a, c, g, or t
  misc_feature (2035)..(2035): n is a, c, g, or t
  misc_feature (2419)..(2419): n is a, c, g, or t
  misc_feature (2715)..(2715): n is a, c, g, or t
  misc_feature (2722)..(2722): n is a, c, g, or t
cggtgtacccgggttaggatatgtgaccacgcgtcgcgtatggcgcccgaggagaatgcggggaccgaactcttgctgcagagtttcgagcgccgcttcctggcggcgcgcacgctgcgctccttcccctggcaggggggcggcgggcgagcggagaggcccgcggggctcgcgggagtccagggcagacgggatgggtctccgtgctgaaacccccggcgctcctgccacagcttagaagcaaagttaagagactcatcagattctgagctgctgcgggatattttgcagaagactgtgaagcatcctgtgtgtgtgtgaagcacccgccgtcagtcaagaaagcccggtgctttctctcagaactcatcaaaaagtaacctgaagctttcaccgtagacgtgctgtattgcccagaagccatcgtgtcgctggtcgggatcctgcggaggctggctgcctgctgggagcaccagcaggctcctgaggtctacgtggcctttaccgtccacaacccagagacgtgccagctgttcaccaccgagctaggccgggctgggatcatatgggaagcggaagctcatcatgaccagaaactgtttccctatggagagcacttggagatggcaatgctgaacctcacactgtaggactcacacacgactccaacgggattgtgagaatcaagtcaatctcatgggaagaatttttatatgggaaagcggataaaactttcattgtactggaatgtttggagaatgttaaattccaaatcagaaaccacaaactgccctctaataagacatcggctatctaagcgtgtgggtgccccctttctgccagcagttctggttcttacgaaaatcaccatatatcagacatgaaaattctggctttgtgcagataaaaaagtgtgtatcaagtatgacgttcccccaatgtggacacacttggttcctcagaaagccaagcccactgcagctgccacatccctggacacactcggttcctcacaaagccaagcccgctgcagctgtcacatccctggacacactcggttcctcacaaagccaagcccactgcagctgccacatccctgagcctatggtgcagcaggtgcttttttcaagacagggatcaaagtgttaggaacacggcagaaaggtgacacctggagaccaaatgcaggatgaggagtactgcagaggtcacagggaagtcagagaacagtaatacgctaacaggggcacggggcatgaagaacaaaagacaggaaaaaagcatctgcaaaatactaaagagcagagcttacctcattgcctgtccccaccccatcccaggtcaccacctggctgaccncaggtccccgacccaacaacaacccctcccaagtccctaactccctcacttggacttgagacccttcacaccccagcagcgctccgcctcccacttgacatcatgctttctggaaacttccccgtatgtcccactttcccacacttggtgccctggagcaccttccggcctctacatgctgtacgttcccctgtgagcaccctcctctcggcctctggccaacacagtcccacccatctgtgggtaacaagggggagtgggtgttcttttcagccttgctaaactctctgaatcaaggatcacaaactacagcctgcaggccaaatccagcccacagcctgtgtttgtaaataaagctttattggaagaaagccacaccccttaatctacagatgatctgtggctactttcacaccacaacagagtaccatggttctgacagagactgggggacccagtctaaatgacttctgacctggacctttactgaaaatcctcccaatcattctgttgacaagaatgatgtattactttttgcaataagaaacaagtaacctttgcagaattccacccatctttcaaggctggtcccagaagttcccttagcccatgcacctacctgatcctgatcacttcctaaactgcagcctggcccacctggatccagcatcatttntggcgtgtcagctccataaatccagagggcaggtggcgttgtgtcctaactttcccgagcctactgtactgaaacaggacagcagagtaggccagcctctgtgacttctgctccctccctagcttttccaccagaccccccatggtcccaccctggctgtgggaagcagggatcagggagtgtggctcggtgccagtctccagaaccctgcccaccctggcgtggtggcagacatggctacctgcagctgagctgccagttcctctgagtcctcaaagaccaggccattttcttcatgtttcaccagctcatgtaaactgcagagagaaccaagggaacccgagagcttcctggagaagacaccagacccctggggtgcccagntgggctcccacccaccccacgctcaagccaggctgggggttggaacagggggtgtggtttctgggagctggttcttagatttggcatctgaagggtataaaggcctggcgggggtgcacatcaaaatggccaaaccgatttgaggagggagccttaaggagggtttgtaccttctgtgctggatgctcttcaaggactgaagaattatttttgcatgtttttctaaattccatggccatggaacaagtaaatgcaaccccctggggactggttcagcacataaaagatgacttttntaggacncc

SEQ ID NO: 88166 - DNA, 2511 bp, Homo sapiens
  misc_feature (1146)..(1146): n is a, c, g, or t
  misc_feature (1822)..(1822): n is a, c, g, or t
  misc_feature (2206)..(2206): n is a, c, g, or t
  misc_feature (2502)..(2502): n is a, c, g, or t
  misc_feature (2509)..(2509): n is a, c, g, or t
tttctaagctttgtgaagagtgagttgactgagcagccaggtagatgtgggttcagatctctgcttctgtcctgctgtgccaagtgctggggcagacgcgggcagagagtggacagtggcatggtgcctgctgctagccatttctatgcaaaaccagatttctagtcccatcctggtggccaattctaggtacctgggtgggcctgggaacctgtgaaacaagtaaactgacttagacaccccctaccccaccaggcctgtcctagcagccccacacaaaacgctcacatcctgtccccaaacaccgccatcctcaagcacgtgctctgtttccaggccgggctgggatcatatgggaagcggaagctcatcatgaccagaaactgtttccctatggagagcacttggagatggcaatgctgaacctcacactgtaggactcacacacgactccaacgggattgtgagaatcaagtcaatctcatgggaagaatttttatatgggaaagcggataaaactttcattgtactggaatgtttggagaatgttaaattccaaatcagaaaccacaaactgccctctaataagacatcggctatctaagcgtgtgggtgccccctttctgccagcagttctggttcttacgaaaatcaccatatatcagacatgaaaattctggctttgtgcagataaaaaagtgtgtatcaagtatgacgttcccccaatgtggacacacttggttcctcagaaagccaagcccactgcagctgccacatccctggacacactcggttcctcacaaagccaagcccgctgcagctgtcacatccctggacacactcggttcctcacaaagccaagcccactgcagctgccacatccctgagcctatggtgcagcaggtgcttttttcaagacagggatcaaagtgttaggaacacggcagaaaggtgacacctggagaccaaatgcaggatgaggagtactgcagaggtcacagggaagtcagagaacagtaatacgctaacaggggcacggggcatgaagaacaaaagacaggaaaaaagcatctgcaaaatactaaagagcagagcttacctcattgcctgtccccaccccatcccaggtcaccacctggctgaccncaggtccccgacccaacaacaacccctcccaagtccctaactccctcacttggacttgagacccttcacaccccagcagcgctccgcctcccacttgacatcatgctttctggaaacttccccgtatgtcccactttcccacacttggtgccctggagcaccttccggcctctacatgctgtacgttcccctgtgagcaccctcctctcggcctctggccaacacagtcccacccatctgtgggtaacaagggggagtgggtgttcttttcagccttgctaaactctctgaatcaaggatcacaaactacagcctgcaggccaaatccagcccacagcctgtgtttgtaaataaagctttattggaagaaagccacaccccttaatctacagatgatctgtggctactttcacaccacaacagagtaccatggttctgacagagactgggggacccagtctaaatgacttctgacctggacctttactgaaaatcctcccaatcattctgttgacaagaatgatgtattactttttgcaataagaaacaagtaacctttgcagaattccacccatctttcaaggctggtcccagaagttcccttagcccatgcacctacctgatcctgatcacttcctaaactgcagcctggcccacctggatccagcatcatttntggcgtgtcagctccataaatccagagggcaggtggcgttgtgtcctaactttcccgagcctactgtactgaaacaggacagcagagtaggccagcctctgtgacttctgctccctccctagcttttccaccagaccccccatggtcccaccctggctgtgggaagcagggatcagggagtgtggctcggtgccagtctccagaaccctgcccaccctggcgtggtggcagacatggctacctgcagctgagctgccagttcctctgagtcctcaaagaccaggccattttcttcatgtttcaccagctcatgtaaactgcagagagaaccaagggaacccgagagcttcctggagaagacaccagacccctggggtgcccagntgggctcccacccaccccacgctcaagccaggctgggggttggaacagggggtgtggtttctgggagctggttcttagatttggcatctgaagggtataaaggcctggcgggggtgcacatcaaaatggccaaaccgatttgaggagggagccttaaggagggtttgtaccttctgtgctggatgctcttcaaggactgaagaattatttttgcatgtttttctaaattccatggccatggaacaagtaaatgcaaccccctggggactggttcagcacataaaagatgacttttntaggacncc

SEQ ID NO: 88167 - DNA, 940 bp, Homo sapiens
cggtgtacccgggttaggatatgtgaccacgcgtcgcgtatggcgcccgaggagaatgcggggaccgaactcttgctgcagagtttcgagcgccgcttcctggcggcgcgcacgctgcgctccttcccctggcaggggggcggcgggcgagcggagaggcccgcggggctcgcgggagtccagggcagacgggatgggtctccgtgctgaaacccccggcgctcctgccacgtgagttcctgggctctccccggtcagggccgcgagacccggtccccgtccctggggcctggccagagtcgctcgcacccctcctgccccgcgagctggcggcggaagatgagggcgtctccaccgccttgggggggcagacgcgtgctcggtgtggggtacagttcacgatcattttcacgactttttaaagagcttagaagcaaagttaagagactcatcagattctgagctgctgcgggatattttgcagaagactgtgaagcatcctgtgtgtgtgtgaagcacccgccgtcagtcaagaaagcccggtgctttctctcagaactcatcaaaaagtaacctgaagctttcaccgtagacgtgctgtattgcccagaagccatcgtgtcgctggtcgggatcctgcggaggctggctgcctgctgggagcaccagcaggctcctgaggtctacgtggcctttaccgtccacaacccagagacgtgccagctgttcaccaccgagctaggccgggctgggatcatatgggaagcggaagctcatcatgaccagaaactgtttccctatggagagcacttggagatggcaatgctgaacctcacactgtaggactcacacacgactccaacgggattgtgagaatcaagtcaatctcatgggaagaatttttatatgggaaagcggataaaactttcattgtactgga

SEQ ID NO: 88168 - DNA, 482 bp, Homo sapiens
tttggtttactgaagtcagagttgccacaacatacgatccttcattttcttccaattctaaaagctctgattctcttatattattaagcttcctttcccagctttggtctttacagaagggacgggaaataaaggtagtaaaaatgaggcatgtttttaggagtgagaagggaggtgaacatgtgaattaaggtggtgatggtaggatgctgagactaaaaacagaggacagcacaacccataaagtgttgactaacttcctgggagaagtttgttctagtaaatcagagtctctatgaaactccctggcaaagaccccagatgtccctgtgttaaattgcaaacacacattctaaaattccccttatgttccattccttagttcctctcaatctttttcactatccaaagtatggttttctactttgttagctagaattttgggggctccaagtgacaaaagcccaactcaacctagctca

SEQ ID NO: 88169 - DNA, 1233 bp, Homo sapiens
cataatccaacaggtatttatcattttttttctctaaagtattatgctaaattttgtggaggcattttttagaaatacagtaaacacattaactgtactcagaatgagaaagggaaatacaatccaataagtaaaacacaaagtagaatgtgatacatgctccaaaagaggtaagaaggaagactcaggtcttggagccttgaaggatatgcatgatttttacaggtggtgatgataaagaagggcctcactgatgaaaagaatagtgtgtttttgtgccagactgttagtctcattcagtcacacttcagtaataaattaggctcatttagatggaactgacttgaaatttctctcttatcttccacagtctgtttccctaggcattgtgggcatctttgagatttcgaatggtaccatctctttgaatcgtcataaggactattctgggactttgcttcatcaattatttttcctttttcttgattcttctatttcatcttcactgaattatttcattccacctatgtatgtattcaagtcttcctccctccctccaacactgtaagagaaaaaagaattattttctcaatcctattatctctgttaagctttcatcctgtttttctctcctttaacttcagtagtattcacttaatgcttccacctcttaacatcgccagttgttcaacctcttgcaatctgaatttgataaggaaaatgtggttcatatacacaatggagtactgttcatccatgaaagggatgagatccggtcattcgcaacagcatggagggaactggagatcattaagtaaaataagccaggcacagaaagacaaacattgcatgttctcacttatttgtgagatctaaaaagccctcaaccacttttctggaaaaaaaaaaaaaattttaaggagaatcctagcatctcctgttcaataagtctaatactttttactttaaggtcagattttttttggcctatctataggcactgttagccatatctttcttcttgatggtctctccttcctaggtttcacttgattctcctgcatctgccttccctgactcttcttccatcccttactgacagtgtttaccaaggatttcccttggcctgcttctttctttgacgctcatttaaacctttcccttcagttgcagacctcgtctgcttctcccagctattccattcagttcaaattcaaggggtaccgagcttcg

SEQ ID NO: 88170 - DNA, 366 bp, Homo sapiens
gagccggtacctgctggggaagagggggagctggacgccaccagctggctacagctttcgagagtgaggcctgccagcaggccagtggactcagcgtcccctgctactcctgtgctctggaggctgcagagctgacccagagtggagtctgagtctgagtcctgtctctgcctgcggcccagaagtttccctcaaatgcgcgtgtgcacgtgtgtgtgtgtgtgtgtgtgtgtggcggggctggggggttggggaggtggtgcctggatacacagttccagggctcagtggagaggtcctggctggagatgggcatttttccccaataatttttatggtagtaaaatatgcagaacacgcagtttc

SEQ ID NO: 88171 - DNA, 357 bp, Homo sapiens
agactgagcactcctaacacccgaccctcactggccatgctgggaccggctgtgaacagtagccatctaatacctaacacagccctttcaggcgggtgcttgttttcccatttgctcagttgtagacaccaggacacagaattgtctggggttccgagccagttctgcctggcactcacctgggtgtgaaggaagagcaggcacctacctaggaggaggtggaggtggagcagggaacgtcatggtcctgtttgagcaggatgtggtgaagggtcattggagctgccattccagggccactggatgccaagggaggcgggagagctgctggccctgtgtcctgggttgtggggaaag

SEQ ID NO: 88172 - DNA, 391 bp, Homo sapiens
ctgtgttgattgcttgagcccatcacagtttagctctcacagctttaatttactagcccatgagaagtcagcttcaaagaacaccatttcgactctcaaagaacattatcaatgtacatggatagcttccaacttcataaggtgtttctctctacctagagcaattaacattaatttgcagaatagtgtttattgaaaacctttgtgtatctccaacaaagtaatagtgtattgatttcattcctactatcttcaactgtatcattaagaggaatttcttaggaaagtctatatgcagtaagcaagtaagatcgcagaacatcaagggagaagtaaatccaaaactgattttacttcttttcttagtgaggaaagaattatgttttaagct

SEQ ID NO: 88173 - DNA, 392 bp, Homo sapiens
tatatcccaggcagcactatgcaaacagtgaggaaaattagaatctcatgaaactcaaaatgggactaattatcctcattaactaataactaataacctactataggtttcctactatgaaggaaaaactactgtaataagaaaaaaaggattaaggatgcaggcaatttttaagtcccgtgttccacccaagttatacttttaatgaataaaactgtatttttttttttttttttgagagggagttttgctttggttgcccaggctggaatgcaatggcacgatttaagctcactgcaacctccaccttctgggttcaagcaattctcctgcctcagaatcctgagtagctgggattacaggcatgcgccaccatgcccagctaattttgt

SEQ ID NO: 88174 - DNA, 325 bp, Homo sapiens
tagctctttaaactgttggggctcaggaaacaaaactccaaaatgaagccccagcagcagcctcaggagcaaaagtttttctctgaccttctcctgccctcctgcctcccagtcctgttctctcccgaggctggccttagaaaccacaaaggtcccctctccacaaaggtgaatcatagaaaccagaactcctttccccaaagccagccacgaaacctgaacatattactctaactctccctccacctttctgtgtaaaaattggccacaaaggacaaaggaattgaccggacctaccttgtttgccaattccagagagggtccc

SEQ ID NO: 88175 - DNA, 330 bp, Homo sapiens
ctctatgtttcttgatgaaagctcatgtatcctgagtgttggagttagttttggaaaaattaacaaatctcactggtggttgcgctgtgtctctggtgctttcgtttgatattaattgtactatactgaccacaaacttttgttgatgattttaataaactatgaggttatgcatattacactatttttacaaagtaagtgacttaatggtaaactgtttgtttgtggacctaccttgtgaagagagatctttcctccatttcagttcctgcaataaagtacacttttcagtgtttgaagtgaagcactttgacttgtgactggaaaatg

SEQ ID NO: 88176 - DNA, 496 bp, Homo sapiens
ccgtgtaaatctagcagtacgggtaagagtgtttgcggaggaactcctcaggtctcttcctccgcatcagcaggagggtatcatgggtgtgactgtcgggcactaacacgaatctccatcccatgattctaggcgttaggactggagaagcagctccgggccaccgtcccagctctaatctcacttaggcaatgcagagctgtgggcctgactaccacgtgtgtctctggcttgttgaaatgggcactttgtacatctcacttgtgctgggtagagtgtcttttctttagaaccagtaccaatctcttaggcttttggcattctctgcagccaaattctaacatgcttctagttagctggaatgtaccctcggcttacctttggtaaatggtatctccccaggtgagcttagccacttccatggctacaaagacctcattttaggtctagctccaatttcttttctatgtactccagattcctacattcaggtgcc

SEQ ID NO: 88177 - DNA, 1522 bp, Homo sapiens
  misc_feature (4)..(4): n is a, c, g, or t
  misc_feature (7)..(7): n is a, c, g, or t
ggcncgnggctgagcggcgcccccgggctcggggcttcccttgcctggcccgaagccgtggagatgagacacccgcgagccccgagctctgagaccttcccctgactcggaggcgctaagccgtaccctctcgttcccgcctccgagagctcccaccgtcaaagacccagagatagccggtccgaatccagaaaccccgcctgcccaccctagtttccgaaacctccctcctgaaccactgaaagtccgttccccgtctcggagctcacacagagaatctgtccttcaaggccaaagctctgagacttgcccccagcaccctgtgcttggagctccgacacccgagactgcactgacctccctcgccagctcggagccctcagtcccctccggggcttgagggcccttccatcccattctggactcgaagcacagcacccccatcagaatggttttgtggattttgagccctttgtcccatcccagagctcagagccctccatcctgcatggaggcccaaccctggggctctgaggattgggcaccctcccctcatctaagaatatatttcatacccctgcccccccttcacccacccccgcctctggctcaggcccttcccttcctcggctcaggcatggggctcagctcctagtctgtccctcccatcccagggacaagcacagcccatctagccttagtgtggagccaactctcagcctttcccaccagggcgctgacctcccgatactcagtgctggtccccagtctcagactctcagctcttcaccccgatctgactttcgtcctcctgcccaagcctttggctcttgaccccccccccatacccaatgctggcactcagcacccacccctgccattcactagtcaaggtccagtgaggaatccgtccctgggatgtcctcatccccttttcgtcccaggacgagctcttcagtcctgccggataggtgcaggtgccatgcacccctagtgcatactggcagatccttgtagggaaggagagagtcttgggtgtgtgaaagggatagtggggcatcgtggcctcagagaggggcaggaagtggggtctgaagggctggaagttgctgcccttcgatttctctatgctctctcccacccctgtggctcttcgcccttggggattccttgccaccaccgctaccaccaccacctcaccccgtgtatcttctgaaagagaagtaggtctttcctcctgcctcaggcacaagccctcctggttcagggtcagaagctcagcaccttgccttctccatgatcccaaagcacaattggtgagtgggggagaggaccccctctccctgactccccaccctctagatcaggcagaatggctggcctgtgctgcgtctgcacacaggaagtcaccttcctttaatatattggcttgaggcctgcctgccctccccatacccagaaaatctggatctcccttgagcagttttctataaagtctgcaataatctcagatactctactc

SEQ ID NO: 88178 - DNA, 1493 bp, Homo sapiens
  misc_feature (4)..(4): n is a, c, g, or t
  misc_feature (7)..(7): n is a, c, g, or t
ggcncgnggctgagcggcgcccccgggctcggggcttcccttgcctggcccgaagccgtggagatgagacacccgcgagccccgagctctgagaccttcccctgactcggaggcgctaagccgtaccctctcgttcccgcctccgagagctcccaccgtcaaagacccagagatagccggtccgaatccagaaaccccgcctgcccaccctagtttccgaaacctccctcctgaaccactgaaagtccgttccccgtctcggagctcacacagagaatctgtccttcaaggccaaagctctgagacttgcccccagcaccctgtgcttggagctccgacacccgagactgcactgacctccctcgccagctcggagccctcagtcccctccggggcttgagggcccttccatcccattctggactcgaagcacagcacccccatcagaatggttttgtggattttgagccctttgtcccatcccagagctcagagccctccatcctgcatggaggcccaaccctggggctctgaggattgggcaccctcccctcatctaagaatatatttcatacccctgcccccccttcacccacccccgcctctggctcaggcccttcccttcctcggctcaggcatggggctcagctcctagtctgtccctcccatcccagggacaagcacagcccatctagccttagtgtggagccaactctcagcctttcccaccagggcgctgacctcccgatactcagtgctggtccccagtctcagactctcagctcttcaccccgatctgactttcgtcctcctgcccaagcctttggctcttgaccccccccccatacccaatgctggcactcagcacccacccctgccattcactagtcaaggtccagtgaggaatccgtccctgggatgtcctcatccccttttcgtcccaggacgagctcttcagtcctgccggataggtgcaggtgccatgcacccctagtgcatactggcagatccttgtagggaaggagagagtcttgggtgtgtgaaagggatagtggggcatcgtggcctcagagaggggcaggaagtggggtctgaagggctggaagttgctgcccttcgatttctctatgctctctcccacccctgtggctcttcgcccttggggattccttgccaccaccgctaccaccaccacctcaccccgtgtatcttctgaaagagaagtaggtctttcctcctgcctcaggcacaagccctcctggttcagggtcagaagctcagcaccttgccttctccatgatcccaaagcacaattggtgagtgggggagaggacccccgcatgcctatcaccccgccctgtgatccagaccatactggctgactcagaccattctctactcaagatgccacctatcttctgggtgtgggggcgagcgtgtgctgccccagctacttgcgaagctgaagcaggaaaattgcgtgaacctttgac

SEQ ID NO: 88179 - DNA, 422 bp, Homo sapiens
agagcttagcatgctgttggttcatgtttttatgtgtttatttcacattgacttttgccgtgagctttgagggagacaacaccatcacatatgtgtaaattgtaaaagaattgggagagaatagctttgggagatcattttcttactggccatgatgaagaaagctgtatcgtaggaaaattactaggtaattttactcacttgataaagttaatttgcaaggtatcattcgattggtagagttaccaaaatgagagttaaagaaacagaaatatggtttcagtttatggtgcattcttatctttttcactgagtctatttctgtctggttgcttcacttagtactccaaccagacaagagaagacaactatgctagtgttttagaaatggacagaatgggtgatttaagtagagcctggtt

SEQ ID NO: 88180 - DNA, 398 bp, Homo sapiens
atggattggaagaatcaatattgttaaaatagccatgctaccccaaagtgatctacagattcagtgaaatttctatcaaaattcctaatggcattttttacagaaatagaaaacactattctaaaaatttccctaaatagccaaagcaactttaatcaagagcaaaactggaagtatcataagtcctaatttgatttttgtcaaattatgccattaaatatgacatttgattaatgtcaaaaaatgccattaaaatccatttcaaagctacagtaatcaaaacagtatagtcttggaataaacccaggcatataggccaattaaataaaatagagatctcagaaataaaaccataaagttgtggttaacttcaacaaggctgccaagaatacacaagg

SEQ ID NO: 88181 - DNA, 650 bp, Homo sapiens
  misc_feature (598)..(598): n is a, c, g, or t
gagcatgggatgtgtttacatttgtttgtgttgtctataatttctttcaccagtattttgcagttttccttgtagaggtcttgcacctccttggttaggtatattcctaagtattttctttttttttttttttttttttgcagctattgtaaagggggtggagttcttgattttattctccatttgatcactgttggtatatagaacagctacagatttgtgtatattaatcttctatctgtaaactttgctgaatgcttttatcaattctaggagctttctggaggaatctttagggttttcaaggtaaatggtcatatcatcagcaaacagtgacagtttgacttcctctttactgatgatgccctttatttcttttctttgtctgattgctctggctatgacttccagtactatgttgaagaggagtggtgagagtgggcatccttgtcttgttccagtgctcagagggaatgctttcaacttttcctcagtcagtattatgttggctgtgggtttgtcatagatggcttttattacattgaggtatgtcccttgtacgccaattttaattgtttcgtggaggagccaagatggncgaataggaacagctccggtctacagctcccagcgcgagcgacgcagaagac

SEQ ID NO: 88182 - DNA, 411 bp, Homo sapiens
tttaatttagacattgttgagagatttcatgtcctaaaaaatatttaaattttacatattttaaagttcagtgtttgttaacaggacaaatcccaatctgctgaaatatgggaaaaattgaattttggaaacaaggaccaaaatgtcaaatttaggaaattgatgggtattaagggtgagtttcacatgtgccaggggatctttgtattagctattagccctcctgcactgttcttccctcattttcttagttctggtctttactcaggtgtcagcgtttttgagttctttcccaccaccttttgtgaaataacaagcaatcccattctgaaacatttccatctcccctacccactgtcctccctacacacacacttggagagagagagagagacggggttttgctctgct

SEQ ID NO: 88183 - DNA, 1930 bp, Homo sapiens
ggcgccgggcctcctcgccttgtgccatccgggtctctcgcgcgagcgatttagtctgaggcgaagcttcggagcggccggtactgttgaaagcgacaagtggaggcgccgctctagcggccgggactctgaactatggcggctagtgatacagagcgagatggactagccccagaaaagacatcaccagatagagataagaaaaaagagcagtcagaagtatctgtttctcctagagcttcaaaacatcattattcaagatcacgatcaaggtcaagagaaagaaaacgaaagtcagataatgaaggaagaaaacacaggagccggagcagaagcaaagagggaagaagacatgaatccaaagataaatcctctaagaaacataagtctgaggaacataatgacaaagaacattcttctgataaaggaagagagcgactaaattcatctgaaaatggtgaggacaggcacaaacgcaaagaaagaaagtcatcaagaggcagaagtcactcaagatctaggtctcgtgaaagacgccatcgtagtagaagcagggagcggaagaagtctcgatccaggagtagggagcggaagaaatcgagatccagaagcagagagaggaagaaatcgagatccagaagcagggaaagaaaacggcggatcaggtctcgttcccgctcaagatcaagacacaggcataggactagaagcaggagtaggacaaggagtaggagtcgagatagaaagaagagaattgaaaagccgagaagatttagcagaagtttaagccggactccaagtccacctcccttcagaggcagaaacacagcaatggatgcacaggaagctttagctagaaggttggaaagggcaaagaaattacaagaacagcgagaaaaggaaatggttgaaaaacaaaaacaacaagaaatagctgcagcagctgcagctactggaggttctgttctcaatgttgctgccctgttggcatcaggaacacaagtaacacctcagatagccatggcagctcagatggcagccctgcaagctaaagctttggcagagacaggaatagctgttcctagctactataacccagccgctgttaatccaatgaaatttgctgaacaagagaaaaaaaggaaaatgctttggcagggcaagaaagaaggggacaaatcccaatctgctgaaatatgggaaaaattgaattttggaaacaaggaccaaaatgtcaaatttaggaaattgatgggtattaagagtgaagatgaagctggatgtagctcagttgatgaagaaagttacaagactctgaagcagcaggaagaagtatttcgaaatttagatgctcagtatgaaatggcaagatcacaaacccacacacaaagaggaatgggtttgggtttcacatcttcaatgcgaggaatggatgcagtttgaaaatgatcacacttgtaaagtttgggacttatagacttcttgttctgatgtcacgtccttgttcaccaaacagctagcactctagcttgcatgggtgttgcattgactttaatttattgaaaaatacaaatttttgtaaatatcagatcagtgatactggtgttagtgttgtaatcaggttaaacccacttccattaaacttgacaggactatagaaggataatattttttagttcatgaattctacttttcaaatatataaaagctgcaggtggggataaaatctcatacatggattttttcgtgtccgctgtcttgtgtacttttgtacttaaccttgtacagttattttcatctcttgaaacatgaaagaaatgttatgtagatgttctttagaagatctggccatttggtacataatccagcacagataagctgggtggtaatgataataaaaatggttttctcaaaactggtgttaatttaa

SEQ ID NO: 88184 - DNA, 2030 bp, Homo sapiens
ggcgccgggcctcctcgccttgtgccatccgggtctctcgcgcgagcgatttagtctgaggcgaagcttcggagcggccggtactgttgaaagcgacaagtggaggcgccgctctagcggccgggactctgaactatggcggctagtgatacagagcgagatggactagccccagaaaagacatcaccagatagagataagaaaaaagagcagtcagaagtatctgtttctcctagagcttcaaaacatcattattcaagatcacgatcaaggtcaagagaaagaaaacgaaagtcagataatgaaggaagaaaacacaggagccggagcagaagcaaagagcgtgcttatgcgcgaagagactgaactgaagacgctgcagactcagatagcaaaataataagcctacttcatgataagaaccaacttcttcttaaaacagggaagaagacatgaatccaaagataaatcctctaagaaacataagtctgaggaacataatgacaaagaacattcttctgataaaggaagagagcgactaaattcatctgaaaatggtgaggacaggcacaaacgcaaagaaagaaagtcatcaagaggcagaagtcactcaagatctaggtctcgtgaaagacgccatcgtagtagaagcagggagcggaagaagtctcgatccaggagtagggagcggaagaaatcgagatccagaagcagagagaggaagaaatcgagatccagaagcagggaaagaaaacggcggatcaggtctcgttcccgctcaagatcaagacacaggcataggactagaagcaggagtaggacaaggagtaggagtcgagatagaaagaagagaattgaaaagccgagaagatttagcagaagtttaagccggactccaagtccacctcccttcagaggcagaaacacagcaatggatgcacaggaagctttagctagaaggttggaaagggcaaagaaattacaagaacagcgagaaaaggaaatggttgaaaaacaaaaacaacaagaaatagctgcagcagctgcagctactggaggttctgttctcaatgttgctgccctgttggcatcaggaacacaagtaacacctcagatagccatggcagctcagatggcagccctgcaagctaaagctttggcagagacaggaatagctgttcctagctactataacccagccgctgttaatccaatgaaatttgctgaacaagagaaaaaaaggaaaatgctttggcagggcaagaaagaaggggacaaatcccaatctgctgaaatatgggaaaaattgaattttggaaacaaggaccaaaatgtcaaatttaggaaattgatgggtattaagagtgaagatgaagctggatgtagctcagttgatgaagaaagttacaagactctgaagcagcaggaagaagtatttcgaaatttagatgctcagtatgaaatggcaagatcacaaacccacacacaaagaggaatgggtttgggtttcacatcttcaatgcgaggaatggatgcagtttgaaaatgatcacacttgtaaagtttgggacttatagacttcttgttctgatgtcacgtccttgttcaccaaacagctagcactctagcttgcatgggtgttgcattgactttaatttattgaaaaatacaaatttttgtaaatatcagatcagtgatactggtgttagtgttgtaatcaggttaaacccacttccattaaacttgacaggactatagaaggataatattttttagttcatgaattctacttttcaaatatataaaagctgcaggtggggataaaatctcatacatggattttttcgtgtccgctgtcttgtgtacttttgtacttaaccttgtacagttattttcatctcttgaaacatgaaagaaatgttatgtagatgttctttagaagatctggccatttggtacataatccagcacagataagctgggtggtaatgataataaaaatggttttctcaaaactggtgttaatttaa

SEQ ID NO: 88185 - DNA, 2008 bp, Homo sapiens
ggcgccgggcctcctcgccttgtgccatccgggtctctcgcgcgagcgatttagtctgaggcgaagcttcggagcggccggtactgttgaaagcgacaagtggaggcgccgctctagcggccgggactctgaactatggcggctagtgatacagagcgagatggactagccccagaaaagacatcaccagatagagataagaaaaaagagcagtcagaagtatctgtttctcctagagcttcaaaacatcattattcaagatcacgatcaaggtcaagagaaagaaaacgaaagtcagataatgaaggaagaaaacacaggagccggagcagaagcaaagagcgtgcttatgcgcgaagagactgaactgaagacgctgcagactcagatagcaaaataataagcctacttcatgataagggaagaagacatgaatccaaagataaatcctctaagaaacataagtctgaggaacataatgacaaagaacattcttctgataaaggaagagagcgactaaattcatctgaaaatggtgaggacaggcacaaacgcaaagaaagaaagtcatcaagaggcagaagtcactcaagatctaggtctcgtgaaagacgccatcgtagtagaagcagggagcggaagaagtctcgatccaggagtagggagcggaagaaatcgagatccagaagcagagagaggaagaaatcgagatccagaagcagggaaagaaaacggcggatcaggtctcgttcccgctcaagatcaagacacaggcataggactagaagcaggagtaggacaaggagtaggagtcgagatagaaagaagagaattgaaaagccgagaagatttagcagaagtttaagccggactccaagtccacctcccttcagaggcagaaacacagcaatggatgcacaggaagctttagctagaaggttggaaagggcaaagaaattacaagaacagcgagaaaaggaaatggttgaaaaacaaaaacaacaagaaatagctgcagcagctgcagctactggaggttctgttctcaatgttgctgccctgttggcatcaggaacacaagtaacacctcagatagccatggcagctcagatggcagccctgcaagctaaagctttggcagagacaggaatagctgttcctagctactataacccagccgctgttaatccaatgaaatttgctgaacaagagaaaaaaaggaaaatgctttggcagggcaagaaagaaggggacaaatcccaatctgctgaaatatgggaaaaattgaattttggaaacaaggaccaaaatgtcaaatttaggaaattgatgggtattaagagtgaagatgaagctggatgtagctcagttgatgaagaaagttacaagactctgaagcagcaggaagaagtatttcgaaatttagatgctcagtatgaaatggcaagatcacaaacccacacacaaagaggaatgggtttgggtttcacatcttcaatgcgaggaatggatgcagtttgaaaatgatcacacttgtaaagtttgggacttatagacttcttgttctgatgtcacgtccttgttcaccaaacagctagcactctagcttgcatgggtgttgcattgactttaatttattgaaaaatacaaatttttgtaaatatcagatcagtgatactggtgttagtgttgtaatcaggttaaacccacttccattaaacttgacaggactatagaaggataatattttttagttcatgaattctacttttcaaatatataaaagctgcaggtggggataaaatctcatacatggattttttcgtgtccgctgtcttgtgtacttttgtacttaaccttgtacagttattttcatctcttgaaacatgaaagaaatgttatgtagatgttctttagaagatctggccatttggtacataatccagcacagataagctgggtggtaatgataataaaaatggttttctcaaaactggtgttaatttaa

SEQ ID NO: 88186 - DNA, 1752 bp, Homo sapiens
atagtaattacatctgcaacatttgggtgatgtgaaactagatcttttttttatttgccacacactcctaaggttactaatgttgcatcacaacatttttgtctactgatacccatactaactctctttgttgcactattagaaccaacttcttcttaaaacagggaagaagacatgaatccaaagataaatcctctaagaaacataagtctgaggaacataatgacaaagaacattcttctgataaaggaagagagcgactaaattcatctgaaaatggtgaggacaggcacaaacgcaaagaaagaaagtcatcaagaggcagaagtcactcaagatctaggtctcgtgaaagacgccatcgtagtagaagcagggagcggaagaagtctcgatccaggagtagggagcggaagaaatcgagatccagaagcagagagaggaagaaatcgagatccagaagcagggaaagaaaacggcggatcaggtctcgttcccgctcaagatcaagacacaggcataggactagaagcaggagtaggacaaggagtaggagtcgagatagaaagaagagaattgaaaagccgagaagatttagcagaagtttaagccggactccaagtccacctcccttcagaggcagaaacacagcaatggatgcacaggaagctttagctagaaggttggaaagggcaaagaaattacaagaacagcgagaaaaggaaatggttgaaaaacaaaaacaacaagaaatagctgcagcagctgcagctactggaggttctgttctcaatgttgctgccctgttggcatcaggaacacaagtaacacctcagatagccatggcagctcagatggcagccctgcaagctaaagctttggcagagacaggaatagctgttcctagctactataacccagccgctgttaatccaatgaaatttgctgaacaagagaaaaaaaggaaaatgctttggcagggcaagaaagaaggggacaaatcccaatctgctgaaatatgggaaaaattgaattttggaaacaaggaccaaaatgtcaaatttaggaaattgatgggtattaagagtgaagatgaagctggatgtagctcagttgatgaagaaagttacaagactctgaagcagcaggaagaagtatttcgaaatttagatgctcagtatgaaatggcaagatcacaaacccacacacaaagaggaatgggtttgggtttcacatcttcaatgcgaggaatggatgcagtttgaaaatgatcacacttgtaaagtttgggacttatagacttcttgttctgatgtcacgtccttgttcaccaaacagctagcactctagcttgcatgggtgttgcattgactttaatttattgaaaaatacaaatttttgtaaatatcagatcagtgatactggtgttagtgttgtaatcaggttaaacccacttccattaaacttgacaggactatagaaggataatattttttagttcatgaattctacttttcaaatatataaaagctgcaggtggggataaaatctcatacatggattttttcgtgtccgctgtcttgtgtacttttgtacttaaccttgtacagttattttcatctcttgaaacatgaaagaaatgttatgtagatgttctttagaagatctggccatttggtacataatccagcacagataagctgggtggtaatgataataaaaatggttttctcaaaactggtgttaatttaa

SEQ ID NO: 88187 - DNA, 2244 bp, Homo sapiens
ggcgccgggcctcctcgccttgtgccatccgggtctctcgcgcgagcgatttagtctgaggcgaagcttcggagcggccggtactgttgaaagcgacaagtggaggcgccgctctagcggccgggactctgaactatggcggctagtgatacagagcgagatggactagccccagaaaagacatcaccagatagagataagaaaaaagagcagtcagaagtatctgtttctcctagagcttcaaaacatcattattcaagatcacgatcaaggtcaagagaaagaaaacgaaagtcagataatgaaggaagaaaacacaggagccggagcagaagcaaagagggaagaagacatgaatccaaagataaatcctctaagaaacataagtctgaggaacataatgacaaagaacattcttctgataaaggaagagagcgactaaattcatctgaaaatggtgaggacaggcacaaacgcaaagaaagaaagtcatcaagaggcagaagtcactcaagatctaggtctcgtgaaagacgccatcgtagtagaagcagggagcggaagaagtctcgatccaggagtagggagcggaagaaatcgagatccagaagcagagagaggaagaaatcgagatccagaagcagggaaagaaaacggcggatcaggtctcgttcccgctcaagatcaagacacaggcataggactagaagcaggagtaggacaaggagtaggagtcgagatagaaagaagagaattgaaaagccgagaagatttagcagaagtttaagccggactccaagtccacctcccttcagaggcagaaacacagcaatggatgcacaggaagctttagctagaaggttggaaagggcaaagaaattacaagaacagcgagaaaaggaaatggttgaaaaacaaaaacaacaagaaatagctgcagcagctgcagctactggaggttctgttctcaatgttgctgccctgttggcatcaggaacacaagtaacacctcagatagccatggcagctcagatggcagccctgcaagctaaagctttggcagagacaggaatagctgttcctagctactataacccagccgctgttaatccaatgaaatttgctgaacaagagaaaaaaaggaaaatgctttggcagggcaagaaagaaggggacaaatcccaatctgctgaaatatgggaaaaattgaattttggaaacaaggaccaaaatgtcaaatttaggaaattgatgggtattaagagtgaagatgaagctggatgtagctcagttgatgaagaaagttacaagactctgaagcagcaggaagaagtatttcgaaatttagatgctcagtatgaaatggcaagatcacaaacccacacacaaagaggaatgggtttgggtttcacatcttcaatgcgaggaatggatgcagtttgaaaatgatcacacttgtaaagtttgggacttatagacttcttgttctgatgtcacgtccttgttcaccaaacagctagcactctagcttgcatgggtgttgcattgactttaatttattgaaaaatacaaatttttgtaaatatcagatcagtgatactggtgttagtgttgtaatcaggttaaacccacttccattaaacttgacaggactatagaaggataatattttttagttcatgaattctacttttcaaatatataaaagctgcaggtggggataaaatctcatacatggattttttcgtgtccgctgtcttgtgtacttttgtacttaaccttgtacagttattttcatctcttgaaacatgaaagaaatgttatgtagatgttctttagaagatctggccatttggtacataatccagcacagataagctgggtggtaatgataataaaaatggttttctcaaaactggtgttaatttaagttacctgggatgtttctttgaatttgttttatagtttctgtagcatttggcaattgctgttagaaaacactagctagaaatcccctccccaccaccctttttaaggccagttaactatactacagtcaataccgtggtgagcaaaaatgtaaaaggtggaaggagaaaacttattaaaatagtatgttttcctattataagggacagacttggtattcagtatttgtcaaatattacatgtgttattcaggagatagattaatgcattaaagggatgtaagcacttttattttaataaagtgccttataacaa

SEQ ID NO: 88188 - DNA, 2328 bp, Homo sapiens
ggcgccgggcctcctcgccttgtgccatccgggtctctcgcgcgagcgatttagtctgaggcgaagcttcggagcggccggtactgttgaaagcgacaagtggaggcgccgctctagcggccgggactctgaactatggcggctagtgatacagagcgagatggactagccccagaaaagacatcaccagatagagataagaaaaaagagcagtcagaagtatctgtttctcctagagcttcaaaacatcattattcaagatcacgatcaaggtcaagagaaagaaaacgaaagtcagataatgaaggaagaaaacacaggagccggagcagaagcaaagagggaagaagacatgaatccaaagataaatcctctaagaaacataagtctgaggaacataatgacaaagaacattcttctgataaaggaagagagcgactaaattcatctgaaaatggtgaggacaggcacaaacgcaaagaaagaaagtcatcaagaggcagaagtcactcaagatctaggtctcgtgaaagacgccatcgtagtagaagcagggagcggaagaagtctcgatccaggagtagggagcggaagaaatcgagatccagaagcagagagaggaagaaatcgagatccagaagcagggaaagaaaacggcggatcaggtctcgttcccgctcaagatcaagacacaggcataggactagaagcaggagtaggacaaggagtaggagtcgagatagaaagaagagaattgaaaagccgagaagatttagcagaagtttaagccggactccaagtccacctcccttcagaggcagaaacacagcaatggatgcacaggaagctttagctagaaggttggaaagggcaaagaaattacaagaacagcgagaaaaggaaatggttgaaaaacaaaaacaacaagaaatagctgcagcagctgcagctactggaggttctgttctcaatgttgctgccctgttggcatcaggaacacaagtaacacctcagatagccatggcagctcagatggcagccctgcaagctaaagctttggcagagacaggaatagctgttcctagctactataacccagccgctgttaatccaatgaaatttgctgaacaagagaaaaaaaggaaaatgctttggcagggcaagaaagaaggggacaaatcccaatctgctgaaatatgggaaaaattgaattttggaaacaaggaccaaaatgtcaaatttaggaaattgatgggtattaagagtgaagatgaagctggatgtagctcagttgatgaagaaagttacaagactctgaagcagcaggaagaagtatttcgaaatttagatgctcagtatgaaatggcaagatcacaaacccacacacaaagaggaatgggtttgggtttcacatcttcaatgcgaggaatggatgcagtttgaaaatgatcacacttgtaaagtttgggacttatagacttcttgttctgatgtcacgtccttgttcaccaaacagctagcactctagcttgcatgggtgttgcattgactttaatttattgaaaaatacaaatttttgtaaatatcagatcagtgatactggtgttagtgttgtaatcaggttaaacccacttccattaaacttgacaggactatagaaggataatattttttagttcatgaattctacttttcaaatatataaaagctgcaggtggggataaaatctcatacatggattttttcgtgtccgctgtcttgtgtacttttgtacttaaccttgtacagttattttcatctcttgaaacatgaaagaaatgttatgtagatgttctttagaagatctggccatttggtacataatccagcacagataagctgggtggtaatgataataaaaatggttttctcaaaactggtgttaatttaagttacctgggatgtttctttgaatttgttttatagtttctgtagcatttggcaattgctgttagaaaacactagctagaaatcccctccccaccaccctttttaaggccagttaactatactacagtcaataccgtggtgagcaaaaatgtaaaaggtggaaggagaaaacttattaaaatagtatgttttcctattataagggacagacttggtattcagtatttgtcaaatattacatgtgttattcaggagatagattaatgcattaaagggatgtaagcacttttattttaataaagtgccttataacaagttctttgcatgctttttgctcattatccctttgaaggcttctccagcatagactataaaatattaaaatattagaaatttttt

SEQ ID NO: 88189 - DNA, 2038 bp, Homo sapiens
ggcgccgggcctcctcgccttgtgccatccgggtctctcgcgcgagcgatttagtctgaggcgaagcttcggagcggccggtactgttgaaagcgacaagtggaggcgccgctctagcggccgggactctgaactatggcggctagtgatacagagcgagatggactagccccagaaaagacatcaccagatagagataagaaaaaagagcagtcagaagtatctgtttctcctagagcttcaaaacatcattattcaagatcacgatcaaggtcaagagaaagaaaacgaaagtcagataatgaaggaagaaaacacaggagccggagcagaagcaaagagggaagaagacatgaatccaaagataaatcctctaagaaacataagtctgaggaacataatgacaaagaacattcttctgataaaggaagagagcgactaaattcatctgaaaatggtgaggacaggcacaaacgcaaagaaagaaagtcatcaagaggcagaagtcactcaagatctaggtctcgtgaaagacgccatcgtagtagaagcagggagcggaagaagtctcgatccaggagtagggagcggaagaaatcgagatccagaagcagagagaggaagaaatcgagatccagaagcagggaaagaaaacggcggatcaggtctcgttcccgctcaagatcaagacacaggcataggactagaagcaggagtaggacaaggagtaggagtcgagatagaaagaagagaattgaaaagccgagaagatttagcagaagtttaagccggactccaagtccacctcccttcagaggcagaaacacagcaatggatgcacaggaagctttagctagaagagaagacggggtctccctatgttgcccaggctggtaacacagtgtaacctgatgtgcttccctgggaacccagcctgacagaaactgcagctgaacagcagcaaaagtgttggaaagggcaaagaaattacaagaacagcgagaaaaggaaatggttgaaaaacaaaaacaacaagaaatagctgcagcagctgcagctactggaggttctgttctcaatgttgctgccctgttggcatcaggaacacaagtaacacctcagatagccatggcagctcagatggcagccctgcaagctaaagctttggcagagacaggaatagctgttcctagctactataacccagccgctgttaatccaatgaaatttgctgaacaagagaaaaaaaggaaaatgctttggcagggcaagaaagaaggggacaaatcccaatctgctgaaatatgggaaaaattgaattttggaaacaaggaccaaaatgtcaaatttaggaaattgatgggtattaagagtgaagatgaagctggatgtagctcagttgatgaagaaagttacaagactctgaagcagcaggaagaagtatttcgaaatttagatgctcagtatgaaatggcaagatcacaaacccacacacaaagaggaatgggtttgggtttcacatcttcaatgcgaggaatggatgcagtttgaaaatgatcacacttgtaaagtttgggacttatagacttcttgttctgatgtcacgtccttgttcaccaaacagctagcactctagcttgcatgggtgttgcattgactttaatttattgaaaaatacaaatttttgtaaatatcagatcagtgatactggtgttagtgttgtaatcaggttaaacccacttccattaaacttgacaggactatagaaggataatattttttagttcatgaattctacttttcaaatatataaaagctgcaggtggggataaaatctcatacatggattttttcgtgtccgctgtcttgtgtacttttgtacttaaccttgtacagttattttcatctcttgaaacatgaaagaaatgttatgtagatgttctttagaagatctggccatttggtacataatccagcacagataagctgggtggtaatgataataaaaatggttttctcaaaactggtgttaatttaa

SEQ ID NO: 88190 - DNA, 1965 bp, Homo sapiens
  misc_feature (1938)..(1938): n is a, c, g, or t
ggcgccgggcctcctcgccttgtgccatccgggtctctcgcgcgagcgatttagtctgaggcgaagcttcggagcggccggtactgttgaaagcgacaagtggaggcgccgctctagcggccgggactctgaactatggcggctagtgatacagagcgagatggactagccccagaaaagacatcaccagatagagataagaaaaaagagcagtcagaagtatctgtttctcctagagcttcaaaacatcattattcaagatcacgatcaaggtcaagagaaagaaaacgaaagtcagataatgaaggaagaaaacacaggagccggagcagaagcaaagagggaagaagacatgaatccaaagataaatcctctaagaaacataagtctgaggaacataatgacaaagaacattcttctgataaaggaagagagcgactaaattcatctgaaaatggtgaggacaggcacaaacgcaaagaaagaaagtcatcaagaggcagaagtcactcaagatctaggtctcgtgaaagacgccatcgtagtagaagcagggagcggaagaagtctcgatccaggagtagggagcggaagaaatcgagatccagaagcagagagaggaagaaatcgagatccagaagcagggaaagaaaacggcggatcaggtctcgttcccgctcaagatcaagacacaggcataggactagaagcaggagtaggacaaggagtaggagtcgagatagaaagaagagaattgaaaagccgagaagatttagcagaagtttaagccggactccaagtccacctcccttcagaggcagaaacacagcaatggatgcacaggaagctttagctagaaggttggaaagggcaaagaaattacaagaacagcgagaaaaggaaatggttgaaaaacaaaaacaacaagaaatagctgcagcagctgcagctactggaggttctgttctcaatgttgctgccctgttggcatcaggaacacaagtaacacctcagatagccatggcagctcagatggcagccctgcaagctaaagctttggcagagacaggaatagctgttcctagctactataacccagccgctgttaatccaatgaaatttgctgaacaagagaaaaaaaggaaaatgctttggcagggcaagaaagaaggggacaaatcccaatctgctgaaatatgggaaaaattgaattttggaaacaaggaccaaaatgtcaaatttaggaaattgatgggtattaagagtgaagatgaagctggatgtagctcagttgatgaagaaagttacaagactctgaagcagcaggaagaagtatttcgaaatttagatgctcagtatgaaatggcaagatcacaaacccacacacaaagaggaatgggtttgggtttcacatcttcaatgcgaggaatggatgcagtttgaaaatgatcacacttgtaaagtttgggacttatagacttcttgttctgatgtcacgtccttgttcaccaaacagctagcactctagcttgcatgggtgttgcattgactttaatttattgaaaaatacaaatttttgtaaatatcagatcagtgatactggtgttagtgttgtaatcaggttaaacccacttccattaaacttgacaggactatagaaggataatattttttagttcatgaattctacttttcaaatatataaaagctgcaggtggggataaaatctcatacatggattttttcgtgtccgctgtcttgtgtacttttgtacttaaccttgtacagttattttcatctcttgaaacatgaaagaaatgttatgtagatgttctttagaagatctggccatttggtacataatccagcacagataagctgggtggtaatgataataaaaatggttttctcaaaactggtgttaatttaaaaaaaaanataaaatgggcctcgttgggctcagcg

SEQ ID NO: 88191 - DNA, 1302 bp, Homo sapiens
ggaggcaatcacttgaacctgggaggtggaggttacagtgagctgagatcgcaccactgcactcctgcctgaacaacagagtgagactctgtctcaataaaaattcaggagatagaaagaagagaattgaaaagccgagaagatttagcagaagtttaagccggactccaagtccacctcccttcagaggcagaaacacagcaatggatgcacaggaagctttagctagaaggttggaaagggcaaagaaattacaagaacagcgagaaaaggaaatggttgaaaaacaaaaacaacaagaaatagctgcagcagctgcagctactggaggttctgttctcaatgttgctgccctgttggcatcaggaacacaagtaacacctcagatagccatggcagctcagatggcagccctgcaagctaaagctttggcagagacaggaatagctgttcctagctactataacccagccgctgttaatccaatgaaatttgctgaacaagagaaaaaaaggaaaatgctttggcagggcaagaaagaaggggacaaatcccaatctgctgaaatatgggaaaaattgaattttggaaacaaggaccaaaatgtcaaatttaggaaattgatgggtattaagagtgaagatgaagctggatgtagctcagttgatgaagaaagttacaagactctgaagcagcaggaagaagtatttcgaaatttagatgctcagtatgaaatggcaagatcacaaacccacacacaaagaggaatgggtttgggtttcacatcttcaatgcgaggaatggatgcagtttgaaaatgatcacacttgtaaagtttgggacttatagacttcttgttctgatgtcacgtccttgttcaccaaacagctagcactctagcttgcatgggtgttgcattgactttaatttattgaaaaatacaaatttttgtaaatatcagatcagtgatactggtgttagtgttgtaatcaggttaaacccacttccattaaacttgacaggactatagaaggataatattttttagttcatgaattctacttttcaaatatataaaagctgcaggtggggataaaatctcatacatggattttttcgtgtccgctgtcttgtgtacttttgtacttaaccttgtacagttattttcatctcttgaaacatgaaagaaatgttatgtagatgttctttagaagatctggccatttggtacataatccagcacagataagctgggtggtaatgataataaaaatggttttctcaaaactggtgttaatttaa

SEQ ID NO: 88192 - DNA, 1850 bp, Homo sapiens
ggcgccgggcctcctcgccttgtgccatccgggtctctcgcgcgagcgatttagtctgaggcgaagcttcggagcggccggtactgttgaaagcgacaagtggaggcgccgctctagcggccgggactctgaactatggcggctagtgatacagagcgagatggactagccccagaaaagacatcaccagatagagataagaaaaaagagcagtcagaagtatctgtttctcctagagcttcaaaacatcattattcaagatcacgatcaaggtcaagagaaagaaaacgaaagtcagataatgaaggaagaaaacacaggagccggagcagaagcaaagagggaagaagacatgaatccaaagataaatcctctaagaaacataagtctgaggaacataatgacaaagaacattcttctgataaaggaagagagcgactaaattcatctgaaaatggtgaggacaggcacaaacgcaaagaaagaaagtcatcaagaggcagaagtcactcaagatctaggtctcgtgaaagacgccatcgtagtagaagcagggagcggaagaagtctcgatccaggagtagggagcggaagaaatcgagatccagaagcagagagaggaagaaatcgagatccagaagcagggaaagaaaacggcggatcaggtctcgttcccgctcaagatcaagacacaggcataggactagaagcaggagtaggacaaggagtaggagtcgagatagaaagaagagaattgaaaagccgagaagatttagcagaagtttaagccggactccaagtccacctcccttcagaggcagaaacacagcaatggatgcacaggaagctttagctagaagcagctgcagctactggaggttctgttctcaatgttgctgccctgttggcatcaggaacacaagtaacacctcagatagccatggcagctcagatggcagccctgcaagctaaagctttggcagagacaggaatagctgttcctagctactataacccagccgctgttaatccaatgaaatttgctgaacaagagaaaaaaaggaaaatgctttggcagggcaagaaagaaggggacaaatcccaatctgctgaaatatgggaaaaattgaattttggaaacaaggaccaaaatgtcaaatttaggaaattgatgggtattaagagtgaagatgaagctggatgtagctcagttgatgaagaaagttacaagactctgaagcagcaggaagaagtatttcgaaatttagatgctcagtatgaaatggcaagatcacaaacccacacacaaagaggaatgggtttgggtttcacatcttcaatgcgaggaatggatgcagtttgaaaatgatcacacttgtaaagtttgggacttatagacttcttgttctgatgtcacgtccttgttcaccaaacagctagcactctagcttgcatgggtgttgcattgactttaatttattgaaaaatacaaatttttgtaaatatcagatcagtgatactggtgttagtgttgtaatcaggttaaacccacttccattaaacttgacaggactatagaaggataatattttttagttcatgaattctacttttcaaatatataaaagctgcaggtggggataaaatctcatacatggattttttcgtgtccgctgtcttgtgtacttttgtacttaaccttgtacagttattttcatctcttgaaacatgaaagaaatgttatgtagatgttctttagaagatctggccatttggtacataatccagcacagataagctgggtggtaatgataataaaaatggttttctcaaaactggtgttaatttaa

SEQ ID NO: 88193 - DNA, 1202 bp, Homo sapiens
atcggtggagggatgctaaaaatttaaaattttatggaagttggcttgtctctgtacatgcacatatagagagatatatacataatggttttatattgtgttattttaaattcattgaaattaattttgcaggttggaaagggcaaagaaattacaagaacagcgagaaaaggaaatggttgaaaaacaaaaacaacaagaaatagctgcagcagctgcagctactggaggttctgttctcaatgttgctgccctgttggcatcaggaacacaagtaacacctcagatagccatggcagctcagatggcagccctgcaagctaaagctttggcagagacaggaatagctgttcctagctactataacccagccgctgttaatccaatgaaatttgctgaacaagagaaaaaaaggaaaatgctttggcagggcaagaaagaaggggacaaatcccaatctgctgaaatatgggaaaaattgaattttggaaacaaggaccaaaatgtcaaatttaggaaattgatgggtattaagagtgaagatgaagctggatgtagctcagttgatgaagaaagttacaagactctgaagcagcaggaagaagtatttcgaaatttagatgctcagtatgaaatggcaagatcacaaacccacacacaaagaggaatgggtttgggtttcacatcttcaatgcgaggaatggatgcagtttgaaaatgatcacacttgtaaagtttgggacttatagacttcttgttctgatgtcacgtccttgttcaccaaacagctagcactctagcttgcatgggtgttgcattgactttaatttattgaaaaatacaaatttttgtaaatatcagatcagtgatactggtgttagtgttgtaatcaggttaaacccacttccattaaacttgacaggactatagaaggataatattttttagttcatgaattctacttttcaaatatataaaagctgcaggtggggataaaatctcatacatggattttttcgtgtccgctgtcttgtgtacttttgtacttaaccttgtacagttattttcatctcttgaaacatgaaagaaatgttatgtagatgttctttagaagatctggccatttggtacataatccagcacagataagctgggtggtaatgataataaaaatggttttctcaaaactggtgttaatttaa

SEQ ID NO: 88194 - DNA, 1077 bp, Homo sapiens
ggtaattctcgaggatcccaagatcacctcaagaacagcgagaaaaggaaatggttgaaaaacaaaaacaacaagaaatagctgcagcagctgcagctactggaggttctgttctcaatgttgctgccctgttggcatcaggaacacaagtaacacctcagatagccatggcagctcagatggcagccctgcaagctaaagctttggcagagacaggaatagctgttcctagctactataacccagccgctgttaatccaatgaaatttgctgaacaagagaaaaaaaggaaaatgctttggcagggcaagaaagaaggggacaaatcccaatctgctgaaatatgggaaaaattgaattttggaaacaaggaccaaaatgtcaaatttaggaaattgatgggtattaagagtgaagatgaagctggatgtagctcagttgatgaagaaagttacaagactctgaagcagcaggaagaagtatttcgaaatttagatgctcagtatgaaatggcaagatcacaaacccacacacaaagaggaatgggtttgggtttcacatcttcaatgcgaggaatggatgcagtttgaaaatgatcacacttgtaaagtttgggacttatagacttcttgttctgatgtcacgtccttgttcaccaaacagctagcactctagcttgcatgggtgttgcattgactttaatttattgaaaaatacaaatttttgtaaatatcagatcagtgatactggtgttagtgttgtaatcaggttaaacccacttccattaaacttgacaggactatagaaggataatattttttagttcatgaattctacttttcaaatatataaaagctgcaggtggggataaaatctcatacatggattttttcgtgtccgctgtcttgtgtacttttgtacttaaccttgtacagttattttcatctcttgaaacatgaaagaaatgttatgtagatgttctttagaagatctggccatttggtacataatccagcacagataagctgggtggtaatgataataaaaatggttttctcaaaactggtgttaatttaa

SEQ ID NO: 88195 - DNA, 1376 bp, Homo sapiens
ggcgccgggcctcctcgccttgtgccatccgggtctctcgcgcgagcgatttagtctgaggcgaagcttcggagcggccggtactgttgaaagcgacaagtggaggcgccgctctagcggccgggactctgaactatggcggctagtgatacagagcgagatggactagccccagaaaagacatcaccagatagagataagaaaaaagagcagtcagaagtatctgtttctcctagagcttcaaaacatcattattcaagatcacgatcaaggtcaagagaaagaaaacgaaagtcagataatgaaggaagaaaacacaggagccggagcagaagcaaagagggaagaagacatgaatccaaagataaatcctctaagaaacataagtctgaggaacataatgacaaagaacattcttctgataaaggaagagagcgactaaattcatctgaaaatggtgaggacaggcacaaacgcaaagaaagaaagtcatcaagaggcagaagtcactcaagatctaggtctcgtgaaagacgccatcgtagtagaagcagggagcggaagaagtctcgatccaggagtagggagcggaagaaatcgagatccagaagcagagagaggaagaaatcgagatccagaagcagggaaagaaaacggcggatcaggtctcgttcccgctcaagatcaagacacaggcataggactagaagcaggagtaggacaaggagtaggagtcgagatagaaagaagagaattgaaaagccgagaagatttagcagaagtttaagccggactccaagtccacctcccttcagaggcagaaacacagcaatggatgcacaggaagctttagctagaaggttggaaagggcaaagaaattacaagaacagcgagaaaaggaaatggttgaaaaacaaaaacaacaagaaatagctgcagcagctgcagctactggaggttctgttctcaatgttgctgccctgttggcatcaggaacacaagtaacacctcagatagccatggcagctcagatggcagccctgcaagctaaagctttggcagagacaggaatagctgttcctagctactataacccagccgctgttaatccaatgaaatttgctgaacaagagaaaaaaaggaaaatgctttggcagggcaagaaagaaggggacaaatcccaatctgctgaaatatgggaaaaattgaattttggaaacaaggaccaaaatgtcaaatttaggaaattgatgggtattaaggagtagatgagctgatgtagctcagttgatgagaagtacagcctctaagcgccggagagtattcgaattagtcccagtataaatgcaagaccaaccccccaagggggtggttg

SEQ ID NO: 88196 - DNA, 1517 bp, Homo sapiens
ggcgccgggcctcctcgccttgtgccatccgggtctctcgcgcgagcgatttagtctgaggcgaagcttcggagcggccggtactgttgaaagcgacaagtggaggcgccgctctagcggccgggactctgaactatggcggctagtgatacagagcgagatggactagccccagaaaagacatcaccagatagagataagaaaaaagagcagtcagaagtatctgtttctcctagagcttcaaaacatcattattcaagatcacgatcaaggtcaagagaaagaaaacgaaagtcagataatgaaggaagaaaacacaggagccggagcagaagcaaagagggaagaagacatgaatccaaagataaatcctctaagaaacataagtctgaggaacataatgacaaagaacattcttctgataaaggaagagagcgactaaattcatctgaaaatggtgaggacaggcacaaacgcaaagaaagaaagtcatcaagaggcagaagtcactcaagatctaggtctcgtgaaagacgccatcgtagtagaagcagggagcggaagaagtctcgatccaggagtagggagcggaagaaatcgagatccagaagcagagagaggaagaaatcgagatccagaagcagggaaagaaaacggcggatcaggtctcgttcccgctcaagatcaagacacaggcataggactagaagcaggagtaggacaaggagtaggagtcgagatagaaagaagagaattgaaaagccgagaagatttagcagaagtttaagccggactccaagtccacctcccttcagaggcagaaacacagcaatggatgcacaggaagctttagctagaaggtgtatatttcttaattcatttgttccagttcgcctttaaataaatgctcaattgtgtggataagatgaattctttcagtaagagaatgattcacatactttagtaatatggtgacatatttgtgatctagaactatgtaaatagtttaattctcatcctaaacatttgcacaactataagattgagatgtctacaatttctgttttttccttcatgatttaactgatttcatttttctcaaatttagactcccaaatattttcagtttgcatttgaaacttttttttttgagtcttaaatctggttcaagaactattattttctcatctaagatgacttttcctttactttttgtttttctccctcaaatagacaaaatacctgaaacagtaagtaaaattttgtcaatattattattttgaagatggcaattaacagataatacattataagctaatttatttgatcttgtaagttttattcctggtaactatgggagaactttttttttttttttttaattttctgctgtttcggccgggtgcaatcggtcacacctgtaatcccagcattttgggaggccgaggcgggcggatcacttgaggtcaggagttgggagaccagcctggccaacatggtgaaaccccatctctact

SEQ ID NO: 88197 - DNA, 326 bp, Homo sapiens
atatactatgcaaaagattggaaacagccagatgcggtggggcatgcttgtagacctgtgtactctggaggctaaggcaggaggatcactggaggccagcctgggcaacatggtgagaccctgtctcttaaaaagggatgagggagttggaaacaaatgttatttccaatgagttcagctgtaacactgatgttttaaatcttttgcatctcaaactaaatgtttttgtatcgttgggatttttgtttgaactaattgatttcttattaacaaaatagttatgacttggccataatttgacatatgaaatacgatttactacagag

SEQ ID NO: 88198 - DNA, 1912 bp, Homo sapiens
gggttaatgacattaagatgaggttctcacttaggctagtgatacagagcgagatggactagccccagaaaagacatcaccagatagagataagaaaaaagagcagtcagaagtatctgtttctcctagagcttcaaaacatcattattcaagatcacgatcaaggtcaagagaaagaaaacgaaagtcagataatgaaggaagaaaacacaggagccggagcagaagcaaagaggtaattaacactttgtagtgaataggtactttaaaatacttataaagtgtctggtagaaagatttgtatgaatataagacgttgtcaagggaagaagacatgaatccaaagataaatcctctaagaaacataagtctgaggaacataatgacaaagaacattcttctgataaaggaagagagcgactaaattcatctgaaaatggtgaggacaggcacaaacgcaaagaaagaaagtcatcaagaggcagaagtcactcaagatctaggtctcgtgaaagacgccatcgtagtagaagcagggagcggaagaagtctcgatccaggagtagggagcggaagaaatcgagatccagaagcagagagaggaagaaatcgagatccagaagcagggaaagaaaacggcggatcaggtctcgttcccgctcaagatcaagacacaggcataggactagaagcaggagtaggacaaggagtaggagtcgagatagaaagaagagaattgaaaagccgagaagatttagcagaagtttaagccggactccaagtccacctcccttcagaggcagaaacacagcaatggatgcacaggaagctttagctagaaggttggaaagggcaaagaaattacaagaacagcgagaaaaggaaatggttgaaaaacaaaaacaacaagaaatagctgcagcagctgcagctactggaggttctgttctcaatgttgctgccctgttggcatcaggaacacaagtaacacctcagatagccatggcagctcagatggcagccctgcaagctaaagctttggcagagacaggaatagctgttcctagctactataacccagccgctgttaatccaatgaaatttgctgaacaagagaaaaaaaggaaaatgctttggcagggcaagaaagaaggggacaaatcccaatctgctgaaatatgggaaaaattgaattttggaaacaaggaccaaaatgtcaaatttaggaaattgatgggtattaagagtgaagatgaagctggatgtagctcagttgatgaagaaagttacaagactctgaagcagcaggaagaagtatttcgaaatttagatgctcagtatgaaatggcaagatcacaaacccacacacaaagaggaatgggtttgggtttcacatcttcaatgcgaggaatggatgcagtttgaaaatgatcacacttgtaaagtttgggacttatagacttcttgttctgatgtcacgtccttgttcaccaaacagctagcactctagcttgcatgggtgttgcattgactttaatttattgaaaaatacaaatttttgtaaatatcagatcagtgatactggtgttagtgttgtaatcaggttaaacccacttccattaaacttgacaggactatagaaggataatattttttagttcatgaattctacttttcaaatatataaaagctgcaggtggggataaaatctcatacatggattttttcgtgtccgctgtcttgtgtacttttgtacttaaccttgtacagttattttcatctcttgaaacatgaaagaaatgttatgtagatgttctttagaagatctggccatttggtacataatccagcacagataagctgggtggtaatgataataaaaatggttttctcaaaactggtgttaatttaa

SEQ ID NO: 88199 - DNA, 1873 bp, Homo sapiens
ggcgccgggcctcctcgccttgtgccatccgggtctctcgcgcgagcgatttagtctgaggcgaagcttcggagcggccggtactgttgaaagcgacaagtggaggcgccgctctagcggccgggactctgaactatggcgataatgaaggaagaaaacacaggagccggagcagaagcaaagagcgtgcttatgcgcgaagagactgaactgaagacgctgcagactcagatagcaaaataataagcctacttcatgataagaaccaacttcttcttaaaacagggaagaagacatgaatccaaagataaatcctctaagaaacataagtctgaggaacataatgacaaagaacattcttctgataaaggaagagagcgactaaattcatctgaaaatggtgaggacaggcacaaacgcaaagaaagaaagtcatcaagaggcagaagtcactcaagatctaggtctcgtgaaagacgccatcgtagtagaagcagggagcggaagaagtctcgatccaggagtagggagcggaagaaatcgagatccagaagcagagagaggaagaaatcgagatccagaagcagggaaagaaaacggcggatcaggtctcgttcccgctcaagatcaagacacaggcataggactagaagcaggagtaggacaaggagtaggagtcgagatagaaagaagagaattgaaaagccgagaagatttagcagaagtttaagccggactccaagtccacctcccttcagaggcagaaacacagcaatggatgcacaggaagctttagctagaaggttggaaagggcaaagaaattacaagaacagcgagaaaaggaaatggttgaaaaacaaaaacaacaagaaatagctgcagcagctgcagctactggaggttctgttctcaatgttgctgccctgttggcatcaggaacacaagtaacacctcagatagccatggcagctcagatggcagccctgcaagctaaagctttggcagagacaggaatagctgttcctagctactataacccagccgctgttaatccaatgaaatttgctgaacaagagaaaaaaaggaaaatgctttggcagggcaagaaagaaggggacaaatcccaatctgctgaaatatgggaaaaattgaattttggaaacaaggaccaaaatgtcaaatttaggaaattgatgggtattaagagtgaagatgaagctggatgtagctcagttgatgaagaaagttacaagactctgaagcagcaggaagaagtatttcgaaatttagatgctcagtatgaaatggcaagatcacaaacccacacacaaagaggaatgggtttgggtttcacatcttcaatgcgaggaatggatgcagtttgaaaatgatcacacttgtaaagtttgggacttatagacttcttgttctgatgtcacgtccttgttcaccaaacagctagcactctagcttgcatgggtgttgcattgactttaatttattgaaaaatacaaatttttgtaaatatcagatcagtgatactggtgttagtgttgtaatcaggttaaacccacttccattaaacttgacaggactatagaaggataatattttttagttcatgaattctacttttcaaatatataaaagctgcaggtggggataaaatctcatacatggattttttcgtgtccgctgtcttgtgtacttttgtacttaaccttgtacagttattttcatctcttgaaacatgaaagaaatgttatgtagatgttctttagaagatctggccatttggtacataatccagcacagataagctgggtggtaatgataataaaaatggttttctcaaaactggtgttaatttaa

SEQ ID NO: 88200 - DNA, 2306 bp, Homo sapiens
ggcgccgggcctcctcgccttgtgccatccgggtctctcgcgcgagcgatttagtctgaggcgaagcttcggagcggccggtactgttgaaagcgacaagtggaggcgccgctctagcggccgggactctgaactatggcggctagtgatacagagcgagatggactagccccagaaaagacatcaccagatagagataagaaaaaagagcagtcagaagtatctgtttctcctagagcttcaaaacatcattattcaagatcacgatcaaggtcaagagaaagaaaacgaaagtcagataatgaaggaagaaaacacaggagccggagcagaagcaaagagggaagaagacatgaatccaaagataaatcctctaagaaacataagtctgaggaacataatgacaaagaacattcttctgataaaggaagagagcgactaaattcatctgaaaatggtgaggacaggcacaaacgcaaagaaagaaagtcatcaagaggcagaagtcactcaagatctaggtctcgtgaaagacgccatcgtagtagaagcagggagcggaagaagtctcgatccaggagtagggagcggaagaaatcgagatccagaagcagagagaggaagaaatcgagatccagaagcagggaaagaaaacggcggatcaggtctcgttcccgctcaagatcaagacacaggcataggactagaagcaggagtaggacaaggagtaggagtcgagatagaaagaagagaattgaaaagccgagaagatttagcagaagtttaagccggactccaagtccacctcccttcagaggcagaaacacagcaatggatgcacaggaagctttagctagaaggttggaaagggcaaagaaattacaagaacagcgagaaaaggaaatggttgaaaaacaaaaacaacaagaaatagctgcagcagctgcagctactggaggttctgttctcaatgttgctgccctgttggcatcaggaacacaagtaacacctcagatagccatggcagctcagatggcagccctgcaagctaaagctttggcagagacaggaatagctgttcctagctactataacccagccgctgttaatccaatgaaatttgctgaacaagagaaaaaaaggaaaatgctttggcagggcaagaaagaaggggacaaatcccaatctgctgaaatatgggaaaaattgaattttggaaacaaggaccaaaatgtcaaatttaggaaattgatgggtattaagagtgaagatgaagctggatgtagctcagttgatgaagaaagttacaagactctgaagcagcaggaagaagtatttcgaaatttagatgctcagtatgaaatggcaagatcacaaacccacacacaaagaggaatgggtttgggtttcacatcttcaatgcgaggaatggatgcagtttgaaaatgatcacacttgtaaagtttgggacttatagacttcttgttctgatgtcacgtccttgttcaccaaacagctagcactctagcttgcatgggtgttgcattgactttaatttattgaaaaatacaaatttttgtaaatatcagatcagtgatactggtgttagtgttgtaatcaggttaaacccacttccattaaacttgacaggactatagaaggataatattttttagttcatgaattctacttttcaaatatataaaagctgcaggtggggataaaatctcatacatggattttttcgtgtccgctgtcttgtgtacttttgtacttaaccttgtacagttattttcatctcttgaaacatgaaagaaatgttatgtagatgttctttagaagatctggccatttggtacataatccagcacagataagctgggtggtaatgataataaaaatggttttctcaaaactggtgttaatttaagttacctgggatgtttctttgaatttgttttatagtttctgtagcatttggcaattgctgttagaaaacactagctagaaatcccctccccaccaccctttttaaggccagttaactatactacagtcaataccgtggtgagcaaaaatgtaaaaggtggaaggagaaaacttattaaaatagtatgttttcctattataagggacagacttggtattcagtatttgtcaaatattacatgtgttattcaggagatagattaatgcattaaagggatgtaagcacttttattttaataaagtgccttataacaaaacacaaaacaaaaaaccacataacacacaaacacaacgaaaaaaaaaggggcgcaaatctc

SEQ ID NO: 88201 - DNA, 1840 bp, Homo sapiens
ggcgccgggcctcctcgccttgtgccatccgggtctctcgcgcgagcgatttagtctgaggcgaagcttcggagcggccggtactgttgaaagcgacaagtggaggcgccgctctagcggccgggactctgaactatggcggctagtgatacagagcgagatggactagccccagaaaagacatcaccagatagagataagaaaaaagagcagtcagaagtatctgtttctcctagagcttcaaaacatcattattcaagatcacgatcaaggtcaagagaaagaaaacgaaagtcagataatgaaggaagaaaacacaggagccggagcagaagcaaagagggaagaagacatgaatccaaagataaatcctctaagaaacataagtctgaggaacataatgacaaagaacattcttctgataaaggaagagagcgactaaattcatctgaaaatggtgaggacaggcacaaacgcaaagaaagaaagtcatcaagaggcagaagtcactcaagatctaggtctcgtgaaagacgccatcgtagtagaagcagggagcggaagaagtctcgatccaggagtagggagcggaagaaatcgagatccagaagcagagagaggaagaaatcgagatccagaagcagggaaagaaaacggcggatcaggtctcgttcccgctcaagatcaagacacaggcataggactagaagcaggagtaggacaaggagtaggagtcgagatagaaagaagagaattgaaaagccgagaagatttagcagaagtttaagccggactccaagtccacctcccttcagaggcagaaacacagcaatggatgcacaggaagctttagctagaaggttggaaagggcaaagaaattacaagaacagcgagaaaaggaaatggttgaaaaacaaaaacaacaagaaatagctgcagcagctgcagctactggaggttctgttctcaatgttgctgccctgttggcatcaggaacacaagtaacacctcagatagccatggcagctcagatggcagccctgcaagctaaagctttggcagagacaggaatagctgttcctagctactataacccagccgctgttaatccaatgaaatttgctgaacaagagaaaaaaaggaaaatgctttggcagggcaagaaagaagggagtgaagatgaagctggatgtagctcagttgatgaagaaagttacaagactctgaagcagcaggaagaagtatttcgaaatttagatgctcagtatgaaatggcaagatcacaaacccacacacaaagaggaatgggtttgggtttcacatcttcaatgcgaggaatggatgcagtttgaaaatgatcacacttgtaaagtttgggacttatagacttcttgttctgatgtcacgtccttgttcaccaaacagctagcactctagcttgcatgggtgttgcattgactttaatttattgaaaaatacaaatttttgtaaatatcagatcagtgatactggtgttagtgttgtaatcaggttaaacccacttccattaaacttgacaggactatagaaggataatattttttagttcatgaattctacttttcaaatatataaaagctgcaggtggggataaaatctcatacatggattttttcgtgtccgctgtcttgtgtacttttgtacttaaccttgtacagttattttcatctcttgaaacatgaaagaaatgttatgtagatgttctttagaagatctggccatttggtacataatccagcacagataagctgggtggtaatgataataaaaatggttttctcaaaactggtgttaatttaa

SEQ ID NO: 88202 - DNA, 1508 bp, Homo sapiens
gtctcgagcatgcaggccgtcgcacgtggaccgacagaggaggtcggtagaaacagtcgtctgcatccacgtgatgtaccgaagcaggataccatgagtcgatgatcttcagagactcagaagatgactgcgaccgaaattctgaaaatcgcaccagaggcgaggggaacacaggagacagtcgcgtgagactcaagtgctcatcagtggcccgtcttcgaaggatcattgactaggggtcttatgcgactaggaaggtccggagctaggcatcggagtgaatgctaagagtagatcggcacgatgagcacatggagatagaaagaagagaattgaaaagccgagaagatttagcagaagtttaagccggactccaagtccacctcccttcagaggcagaaacacagcaatggatgcacaggaagctttagctagaaggttggaaagggcaaagaaattacaagaacagcgagaaaaggaaatggttgaaaaacaaaaacaacaagaaatagctgcagcagctgcagctactggaggttctgttctcaatgttgctgccctgttggcatcaggaacacaagtaacacctcagatagccatggcagctcagatggcagccctgcaagctaaagctttggcagagacaggaatagctgttcctagctactataacccagccgctgttaatccaatgaaatttgctgaacaagagaaaaaaaggaaaatgctttggcagggcaagaaagaaggggacaaatcccaatctgctgaaatatgggaaaaattgaattttggaaacaaggaccaaaatgtcaaatttaggaaattgatgggtattaagagtgaagatgaagctggatgtagctcagttgatgaagaaagttacaagactctgaagcagcaggaagaagtatttcgaaatttagatgctcagtatgaaatggcaagatcacaaacccacacacaaagaggaatgggtttgggtttcacatcttcaatgcgaggaatggatgcagtttgaaaatgatcacacttgtaaagtttgggacttatagacttcttgttctgatgtcacgtccttgttcaccaaacagctagcactctagcttgcatgggtgttgcattgactttaatttattgaaaaatacaaatttttgtaaatatcagatcagtgatactggtgttagtgttgtaatcaggttaaacccacttccattaaacttgacaggactatagaaggataatattttttagttcatgaattctacttttcaaatatataaaagctgcaggtggggataaaatctcatacatggattttttcgtgtccgctgtcttgtgtacttttgtacttaaccttgtacagttattttcatctcttgaaacatgaaagaaatgttatgtagatgttctttagaagatctggccatttggtacataatccagcacagataagctgggtggtaatgataataaaaatggttttctcaaaactggtgttaatttaa

SEQ ID NO: 88203 - DNA, 1807 bp, Homo sapiens
ggcgccgggcctcctcgccttgtgccatccgggtctctcgcgcgagcgatttagtctgaggcgaagcttcggagcggccggtactgttgaaagcgacaagtggaggcgccgctctagcggccgggactctgaactatggcggctagtgatacagagcgagatggactagccccagaaaagacatcaccagatagagataagaaaaaagagcagtcagaagtatctgtttctcctagagcttcaaaacatcattattcaagatcacgatcaaggtcaagagaaagaaaacgaaagtcagataatgaaggaagaaaacacaggagccggagcagaagcaaagagggaagaagacatgaatccaaagataaatcctctaagaaacataagtctgaggaacataatgacaaagaacattcttctgataaaggaagagagcgactaaattcatctgaaaatggtgaggacaggcacaaacgcaaagaaagaaagtcatcaagaggcagaagtcactcaagatctaggtctcgtgaaagacgccatcgtagtagaagcagggagcggaagaagtctcgatccaggagtagggagcggaagaaatcgagatccagaagcagagagaggaagaaatcgagatccagaagcagggaaagaaaacggcggatcaggtctcgttcccgctcaagatcaagacacaggcataggactagaagcaggagtaggacaaggagtaggagtcggttggaaagggcaaagaaattacaagaacagcgagaaaaggaaatggttgaaaaacaaaaacaacaagaaatagctgcagcagctgcagctactggaggttctgttctcaatgttgctgccctgttggcatcaggaacacaagtaacacctcagatagccatggcagctcagatggcagccctgcaagctaaagctttggcagagacaggaatagctgttcctagctactataacccagccgctgttaatccaatgaaatttgctgaacaagagaaaaaaaggaaaatgctttggcagggcaagaaagaaggggacaaatcccaatctgctgaaatatgggaaaaattgaattttggaaacaaggaccaaaatgtcaaatttaggaaattgatgggtattaagagtgaagatgaagctggatgtagctcagttgatgaagaaagttacaagactctgaagcagcaggaagaagtatttcgaaatttagatgctcagtatgaaatggcaagatcacaaacccacacacaaagaggaatgggtttgggtttcacatcttcaatgcgaggaatggatgcagtttgaaaatgatcacacttgtaaagtttgggacttatagacttcttgttctgatgtcacgtccttgttcaccaaacagctagcactctagcttgcatgggtgttgcattgactttaatttattgaaaaatacaaatttttgtaaatatcagatcagtgatactggtgttagtgttgtaatcaggttaaacccacttccattaaacttgacaggactatagaaggataatattttttagttcatgaattctacttttcaaatatataaaagctgcaggtggggataaaatctcatacatggattttttcgtgtccgctgtcttgtgtacttttgtacttaaccttgtacagttattttcatctcttgaaacatgaaagaaatgttatgtagatgttctttagaagatctggccatttggtacataatccagcacagataagctgggtggtaatgataataaaaatggttttctcaaaactggtgttaatttaa

SEQ ID NO: 88204 - DNA, 1227 bp, Homo sapiens
agtagttgggaccacaggcatgcctggctaatttttgtattttttgtagagaagacggggtctccctatgttgcccaggctggtaacacagtgtaacctgatgtgcttccctgggaacccagcctgacagaaactgcagctgaacagcagcaaaagtgttggaaagggcaaagaaattacaagaacagcgagaaaaggaaatggttgaaaaacaaaaacaacaagaaatagctgcagcagctgcagctactggaggttctgttctcaatgttgctgccctgttggcatcaggaacacaagtaacacctcagatagccatggcagctcagatggcagccctgcaagctaaagctttggcagagacaggaatagctgttcctagctactataacccagccgctgttaatccaatgaaatttgctgaacaagagaaaaaaaggaaaatgctttggcagggcaagaaagaaggggacaaatcccaatctgctgaaatatgggaaaaattgaattttggaaacaaggaccaaaatgtcaaatttaggaaattgatgggtattaagagtgaagatgaagctggatgtagctcagttgatgaagaaagttacaagactctgaagcagcaggaagaagtatttcgaaatttagatgctcagtatgaaatggcaagatcacaaacccacacacaaagaggaatgggtttgggtttcacatcttcaatgcgaggaatggatgcagtttgaaaatgatcacacttgtaaagtttgggacttatagacttcttgttctgatgtcacgtccttgttcaccaaacagctagcactctagcttgcatgggtgttgcattgactttaatttattgaaaaatacaaatttttgtaaatatcagatcagtgatactggtgttagtgttgtaatcaggttaaacccacttccattaaacttgacaggactatagaaggataatattttttagttcatgaattctacttttcaaatatataaaagctgcaggtggggataaaatctcatacatggattttttcgtgtccgctgtcttgtgtacttttgtacttaaccttgtacagttattttcatctcttgaaacatgaaagaaatgttatgtagatgttctttagaagatctggccatttggtacataatccagcacagataagctgggtggtaatgataataaaaatggttttctcaaaactggtgttaatttaa

SEQ ID NO: 88205 - DNA, 1753 bp, Homo sapiens
ggcgccgggcctcctcgccttgtgccatccgggtctctcgcgcgagcgatttagtctgaggcgaagcttcggagcggccggtactgttgaaagcgacaagtggaggcgccgctctagcggccgggactctgaactatggcggctagtgatacagagcgagatggactagccccagaaaagacatcaccagatagagataagaaaaaagagcagtcagaagtatctgtttctcctagagcttcaaaacatcattattcaagatcacgatcaaggtcaagagaaagaaaacgaaagtcagataatgaaggaagaaaacacaggagccggagcagaagcaaagagggaagaagacatgaatccaaagataaatcctctaagaaacataagtctgaggaacataatgacaaagaacattcttctgataaaggaagagagcgactaaattcatctgaaaatggtgaggacaggcacaaacgcaaagaaagaaagtcatcaagaggcagaagtcactcaagatctaggtctcgtgaaagacgccatcgtagtagaagcagggagcggaagaagtctcgatccaggagtagggagcggaagaaatcgagatccagaagcagagagaggaagaaatcgagatccagaagcagggaaagaaaacggcggatcaggtctcgttcccgctcaagatcaagacacaggcataggactagaagcaggagtaggacaaggagtaggagtcggttggaaagggcaaagaaattacaagaacagcgagaaaaggaaatggttgaaaaacaaaaacaacaagaaatagctgcagcagctgcagctactggaggttctgttctcaatgttgctgccctgttggcatcaggaacacaagtaacacctcagatagccatggcagctcagatggcagccctgcaagctaaagctttggcagagacaggaatagctgttcctagctactataacccagccgctgttaatccaatgaaatttgctgaacaagagaaaaaaaggaaaatgctttggcagggcaagaaagaaggggacaaatcccaatctgctgaaatatgggaaaaattgaattttggaaacaaggaccgtagctcagttgatgaagaaagttacaagactctgaagcagcaggaagaagtatttcgaaatttagatgctcagtatgaaatggcaagatcacaaacccacacacaaagaggaatgggtttgggtttcacatcttcaatgcgaggaatggatgcagtttgaaaatgatcacacttgtaaagtttgggacttatagacttcttgttctgatgtcacgtccttgttcaccaaacagctagcactctagcttgcatgggtgttgcattgactttaatttattgaaaaatacaaatttttgtaaatatcagatcagtgatactggtgttagtgttgtaatcaggttaaacccacttccattaaacttgacaggactatagaaggataatattttttagttcatgaattctacttttcaaatatataaaagctgcaggtggggataaaatctcatacatggattttttcgtgtccgctgtcttgtgtacttttgtacttaaccttgtacagttattttcatctcttgaaacatgaaagaaatgttatgtagatgttctttagaagatctggccatttggtacataatccagcacagataagctgggtggtaatgataataaaaatggttttctcaaaactggtgttaatttaa

SEQ ID NO: 88206 - DNA, 1130 bp, Homo sapiens
ggcgccgggcctcctcgccttgtgccatccgggtctctcgcgcgagcgatttagtctgaggcgaagcttcggagcggccggtactgttgaaagcgacaagtggaggcgccgctctagcggccgggactctgaactatggcggctagtgatacagagcgagatggactagccccagaaaagacatcaccagatagagataagaaaaaagagcagtcagaagtatctgtttctcctagagcttcaaaacatcattattcaagatcacgatcaaggtcaagagaaagaaaacgaaagtcagataatgaaggaagaaaacacaggagccggagcagaagcaaagagggaagaagacatgaatccaaagataaatcctctaagaaacataagtctgaggaacataatgacaaagaacattcttctgataaaggaagagagcgactaaattcatctgaaaatggtgaggacaggcacaaacgcaaagaaagaaagtcatcaagaggcagaagtcactcaagatctaggtctcgtgaaagacgccatcgtagtagaagcagggagcggaagaagtctcgatccaggagtagggagcggaagaaatcgagatccagaagcagagagaggaagaaatcgagatccagaagcagggaaagaaaacggcggatcaggtctcgttcccgctcaagatcaagacacaggcataggactagaagcaggagtaggacaaggagtaggagtcgagatagaaagaagagaattgaaaagccgagaagatttagcagaagtttaagccggactccaagtccacctcccttcagaggcagaaacacagcaatggatgcacaggaagctttagctagaaggttggaaagggcaaagaaattacaagaacagcgagaaaaggaaatggttgaaaaacaaaaacaacaagaaatagctgcagcagctgcagctactggaggttctgttctcaatgttgctgccctgttggcatcaggaacacaagtaacacctcagatagccatggcagctcagatggcagccctgcaagctaaagctttggcagagacaggaatagctgttcctagctactataacccagccgctgttaatccaatgaaatttgctgaaca

SEQ ID NO: 88207 - DNA, 937 bp, Homo sapiens
  misc_feature (893)..(893): n is a, c, g, or t
  misc_feature (905)..(905): n is a, c, g, or t
ggcgccgggcctcctcgccttgtgccatccgggtctctcgcgcgagcgatttagtctgaggcgaagcttcggagcggccggtactgttgaaagcgacaagtggaggcgccgctctagcggccgggactctgaactatggcggctagtgatacagagcgagatggactagccccagaaaagacatcaccagatagagataagaaaaaagagcagtcagaagtatctgtttctcctagagcttcaaaacatcattattcaagatcacgatcaaggtcaagagaaagaaaacgaaagtcagataatgaaggaagaaaacacaggagccggagcagaagcaaagagggaagaagacatgaatccaaagataaatcctctaagaaacataagtctgaggaacataatgacaaagaacattcttctgataaaggaagagagcgactaaattcatctgaaaatggtgaggacaggcacaaacgcaaagaaagaaagtcatcaagaggcagaagtcactcaagatctaggtctcgtgaaagacgccatcgtagtagaagcagggagcggaagaagtctcgatccaggagtagggagcggaagaaatcgagatccagaagcagagagaggaagaaatcgagatccagaagcagggaaagaaaacggcggatcaggtctcgttcccgctcaagatcaagacacaggcataggactagaagcaggagtaggacaaggagtaggagtcgagatagaaagaagagaattgaaaagccgagaagatttagcagaagtttaagccggactccaagtccacctcccttcagaggcagaaacacagcaatggatgcacaggaagctttagctagaagtggaaaggcaaagaattacaagaacagcgagangaatggttgacnagaaccacagtagctgcagtcgcgcggccgcg

SEQ ID NO: 88208 - DNA, 557 bp, Homo sapiens
caaagacagctggggatttttagcagaatcgggaggcaggtggtcagtggatagaaaattactaagaggagacatcaaggagagggtgattcttgctcaaggcagggtagtgtgatcagatatcaagggtaggggattctctctacactgacttagcacagaattctttccaaaactgcgctgtgcaggccagcaagggcaggggccaatttcaagccttagttgagaagagggctcagtggagtctgactaaagtttggtttaaggagagtcttcatcaagctgtcctcacagagcagctcctagagcagagagccatgtggggaagggtatagagggaatctaggggccaaccaggagctaccttgggagctatacaagtgaaatatttttcagtaaagaatgctgactcccttataaacagggtaaagtgaaatttgaccaaaatcagtttctttgaaagccctgatggaacataacacattacaaggatatgtctgccaagtgcctgagtaaaagtccttagagttgtacgtgaaaatgtacgtgtttaatta

SEQ ID NO: 88209 - DNA, 1335 bp, Homo sapiens
agggtcctctggcgcgagggtgggtaggaggggagcggactcgcccaacacggctcgtctgcagccgccgcctctgcaccgccgctgcccggtcggttcaaaaaacagaaatcgggtttgctgcccggcggacaggcgtgaagagcaagggaaaggaacttcctccaccttcggggctggagccttttcctctgcatctccagtctctgagtgaagatggggggcctgacagcctcggacgtacacccgaccctgggggtccagctcttctcagctggaatagcggcgtgcttggcggacgtgatcaccttcccgctggacacggccaaagtccggctccaggtccaaggtgaatgcccgacgtccagtgttattaggtataaaggtgtcctgggaacaatcaccgctgtggtaaaaacagaagggcggatgaaactctacagcgggctgcctgcggggcttcagcggcaaatcagctccgcctctctcaggatcggcctctacgacacggtccaggagttcctcaccgcagggaaagaaacagcacctagtttaggaagcaagattttagctggtctaacgactggaggagtggcagtattcattgggcaacccacagaggtcgtgaaagtcagacttcaagcacagagccatctccacggaatcaaacctcgctacacggggacttataatgcgtacagaataatagcaacaaccgaaggcttgacgggtctttggaaagggactactcccaatctgatgagaagtgtcatcatcaattgtacagagctagtaacatatgatctaatgaaggaggcctttgtgaaaaacaacatattagcagatgacgtcccctgccacttggtgtcggctcttatcgctggattttgcgcaacagctatgtcctccccggtggatgtagtaaaaaccagatttattaattctccaccaggacagtacaaaagtgtgcccaactgtgcaatgaaagtgttcactaacgaaggaccaacggctttcttcaaggggttggtaccttccttcttgcgacttggatcctggaacgtcattatgtttgtgtgctttgaacaactgaaacgagaactgtcaaagtcaaggcagactatggactgtgccacataatcagcttcaagaaaatgatgtaacataccagtgggaatcttgctgactggatcataaaaacaaacaaacttattcacttattttaacctaaaaagataaaggaattttggcagagaattttggacttttttatataaaaaagaggaaaattaatgcctatttcatataactttttttttttctcagtgtcttaag

SEQ ID NO: 88210 - DNA, 263 bp, Homo sapiens
aattaaaaagagtggacctattgtatgggtgtagagacaggaatatatataaagagcccagtttcaattcacttcgcttcaagtatccctgctgggtaggctgggattcacagttgtgcttttgacctatctttagcatctgaatttcagctttctagaatccttagagtctgatttgacatatgctaaaaacactttgcaagttttgtaggctcttttctcctcactgacattctagttcaggcttaattattctttttttt

SEQ ID NO: 88211 - DNA, 546 bp, Homo sapiens
cttgtgattgactgcttggaactaaagcccctctatctcttccttcagatcttattaatgaaattctatctgagggttcataacccagaaaaacatctgttatctaattatttctgttatctaatcatttctgtctacagagccttcttttccaaaagcgaacctgtatccaaacttccataatgtcctcagcagatttacatggccatatttattagaaagtatttataaatagtgtagtaattctctatatgacacacttagtagggaaaaacagatcacattattagacaaaaagccagaaaatgtagtttgagagattgagaaagcatcaaatggatccttgttcagattgaaactgctcccgtagcataaatgggttcaaaatgggacagaaaatgcttatatagccttaggaacgagggaaagaagcttcttataggtcaattacagaggtgctaaaccttgtcctaagctgttaatgttatactttgagagaagaaaatgtatctgtgaccaccagattgagccttcactaaaattaaa

SEQ ID NO: 88212 - DNA, 412 bp, Homo sapiens
gtatttttagtagaggaggtttcaccatgttggttaggctggtcttgaactcttgacctcaagtgatccaccctccttggcctccaaaagtgctgggattacaggtgtgagctgccatgcctggctaactctgcttgttattaaagtgtttcttaccaattatttcattttatataaaagtacatagtaggaaatagagttttagttggacaaggacaacatggtaaagaggaatttggagtaggaagactgtcacgttagtcactgaatcctacctagttcacttagttttttttagcctgttttcacttctgcaagccatggagtgaagagtgcctacttcagagtctttggtgctctcaaagcagcgtaatgtctataaagtacctattgagtgtggtacttcttatgt

SEQ ID NO: 88213 - DNA, 159 bp, Homo sapiens
agagaagtgttttgtgaaggtgagggagggatactggccacgccgtggctttccccgtgtctgtctgacagtgtaaggaggggctgtgtggccacacatgggccttggcatcagagatcctagattcccctaatgctaaaattaacttggatattttat

SEQ ID NO: 88214 - DNA, 293 bp, Homo sapiens
gaagttagagcaagccctagtgagggcactctgggatgcagacaagccccagggagttctgtgccaagaacagccacatcccaccttcctcattgtggtgaaaagattccttgtgtgactttaggcacagggacattagctagtagcatgtgaccctgtgactcatggccatcaggagtggccccagctctgcattccatgcatgataactcacttcacaaccccgctgtcccattttgaccccgcttacccatttggacatttcttgggatgactctgcctgcataaaaccc

SEQ ID NO: 88215 - DNA, 278 bp, Homo sapiens
aaaaaatcttggaaatttatggacacagttttaaaaaatcataggtcagagatgaaaccataaaggatattaggaaatacttacaactttaatgacaatgaaagcactaactattgaaatatatgggattcagctaaaccactacttagagagaaatgtagagttttacgtgtgtattagaaaagaagaaagcctgaaaaccaataatttaaatgtatgactcgggctgagtgctgtggctcaggcctgtagtcccagctctttgggaggccggggga

SEQ ID NO: 88216 - DNA, 752 bp, Homo sapiens
gctcgaaaacagcctgggcgacatggtaaaatcctgtctctacaaaaaaaaatggaaaaaattagccaggcccggtggtgcacacctgtagtctcagctacttcagaggctgacagaggatggcttgagcctgggaggttgcagtaaaccgagattgcgccattgcactctaatctgggcgacagaaccagaccctgtctcaacaaaaaagaaagggaagatggaaaaggtgtgttaaggcagcccggaggcaaacatatccttgagatgcttttggagctattgtagaaagaaagaatgtgtttgttaggactagtcttggctgcaggttgcagaaaaacataaattgcagctcaggcaagaaacaagcatatttttgtcaggtaaaaaaagttcagagctaggtagtccaaaggctaggatagtcactcctcaatcatgttcttctagcttcccatctttttgctctggtgttttgtctgtcacctcttgtcatagatacgctacagaacaaataaccctaaaactcagtgccttgaagtagcaagcatttactttttactcatggaatgtggatctgcttggcttggctgggatccactggacttgacttggctccaggcttaggttgggttcagagctgttccatgtgtctcctcatcatgggaccagcagctacctgggccgtatttttttcaaggcagatggcagaagcaacaaagcaagccaagccacatgagcatatttaaagc

SEQ ID NO: 88217 - DNA, 372 bp, Homo sapiens
tcattttatagatgaagaaattgccctagtaagtactttgcccattgatttgcctcaatcatatcaaatgtaagtatatcaaatgtaagtataatgaactgtgaattaatcacttaatcaccactattaattgaagacatgcttatatgcactgagtatatactctactggattatgaaggatgtatattttagaaagattttccaaaagcatggaaactgtatgatcaactctcaatccttcagaaaaattaagcattacagtagttatagttatttttccagctgctgcctcatcaaagacctccagtctcttacaatcagctgcctagttgacatctccacttgattatatgacacattaaatctcaga
